United States Patent 6,812,339 (POLYMORPHISMS IN KNOWN GENES ASSOCIATED WITH HUMAN DISEASE, METHODS OF DETECTION AND USES THEREOF) - sequence listing, part 108

SEQ ID NO: 183610 - DNA, 601 bp, Human
acaccattaatcctcacagcttttatccaactacattattactcattaaagtttcagctttcaacatctgcatttgttgaaaagagaaaagtaaattgtagtagacttaaatccttggaaattatgagggatgtgtatgtggtgaaaggacttttcagaaaaaaaaaaagagatgttttagtagtggggaaagtcatgataaatgacgttaagtatgttcttgcctttctaaaatactttcccatgcttaatctttgggaatgctaaagaaaaaatattcatacatgatacaaataaaaacatattagttattctactagtcacatattccagttctaacaacatcacaaaagttgctcatgtactaacactatgacatttataagcctacatgtatattatgatagtgaatgattcttgccaaataaaatattttttcttttacatagtacatgaaagtaaatctaatcttggagctcatttaggatgctgagcagagtaactggagttagactataagatgaaaaagcacacatgtgtctgaaacctttttcaaacttctcaaagcttcagttttcactgttcctcttttcactgtggc

SEQ ID NO: 183611 - DNA, 601 bp, Human
catctaaagtcaggatcagatgggagggcatgtgtataggagaggtttggtgaacctcagtcttaagaggaaaatgagatggcaaaggtcaatataacttccagttaacatctcaaatgagatttggaaaatgtgggttagaaatcattaatgtaagaaatttgtgagattctgtaactttgttaaattcactataatttgatttgattttttttttttttttttttttgaaacaaggtctcacccaggctggagtgcagtggcatgatcatagctcactgcaaccttgaacttctgggcwcaagcaatcattctgcctcagcctcctgagtagctgggactatgggcactactacccccagttactttttaagtttttgtagagatggagtcttgctatgttgcccaggctggtctagaactcctggattcacacaattctcctgccttggcctcccaaagtgctaggattacaggcatgagccaccatgcctggcctgcaatttgatgttttatgcttcagtgtttcttcttaaccattaccaaaaatattctcaaaatttctgtttttcttaactaaaaagtctccttatatattttt

SEQ ID NO: 183612 - DNA, 601 bp, Human
gttctagatttctatatgtcttcattgataattctatttctcatttatatcatctatctaattgtctctaccatctctaccacctcaacttgtagatacttaaggttctcttttctccgaaaacaagcaaataaagtgtcttctttaaccttgttttgccctctctttccaacactgtttctctttttatctttgaagtcaagcttctcaaagatacattatctcataatctcccattccctccttactctccagttctcagtgcaatcttgtttctgttgcaattggtctctagttgtcraataaatccaaaggacattttccatttcttgagagggaatgacagcattgaccatcctctctttattgaatctcattttagcattgttcctttttcctcactgcctcctctgtgttggtatccctgcctgggatccttccttcacctaatccttagattttgattcaagatgccaattattaaaaaaggatgtgttttggagctgggcaagcccgaattaaaatcctagctttgacacttactaggtatataaattacacaagttgttttactgttctaagttgcaattgtctcttaggt

SEQ ID NO: 183613 - DNA, 601 bp, Human
ttgttctcctcatagtcaccaaatccttaaccctgctgactccgtctccctcagcaaatggctttgcctctgattttgcaaagagcagcaaggctgaactctcaccttcctgaccctaccctcactcttaccttctgctggcttaatttatttccatttatgcctattttgctcctcctgtttcaataaaaatggttccttgctttcaatcaaggcaaatctcctaataagagttctagatttctatatgtcttcattgataattctatttctcatttatatcatctatctaattgtctcyaccatctctaccacctcaacttgtagatacttaaggttctcttttctccgaaaacaagcaaataaagtgtcttctttaaccttgttttgccctctctttccaacactgtttctctttttatctttgaagtcaagcttctcaaagatacattatctcataatctcccattccctccttactctccagttctcagtgcaatcttgtttctgttgcaattggtctctagttgtcaaataaatccaaaggacattttccatttcttgagagggaatgacagcattgaccatcctctctttattg

SEQ ID NO: 183614 - DNA, 601 bp, Human
cattgtgtaggaaaaatgattaatatagatgcaagaggaatgtaaattattatgagggggagtaactgacagacctatgttctgtaatggttatttccaatttgagatgtgtgtttctgtgcaggtagaaataactgttcactttaaaataaacattcttgcttttagagactcttgagttttagttataatgctgtatgaaatgttaacatttgtatctgctatgttaaatcataaagccatgtatatatgacaacattcaatcttaatatgattgtttgctggttctttacagtttgtgctcctcatagtcaccaaatccttaaccctgctgactccgtctccctcagcaaatggctttgcctctgattttgcaaagagcagcaaggctgaactctcaccttcctgaccctaccctcactcttaccttctgctggcttaatttatttccatttatgcctattttgctcctcctgtttcaataaaaatggttccttgctttcaatcaaggcaaatctcctaataagagttctagatttctatatgtcttcattgataattctatttctcatttatatcatctatctaattgtctctacca

SEQ ID NO: 183615 - DNA, 601 bp, Human
aaggaaaattgaagcagtagctatcaacggaggcaactctcactcctgcaacccaagtaggaggtgctaatcagagaaataaagtatgactgtggagatggaacgagaagtggcaataaggtcccctaacaatggacaagtatggaataaagtgaatgcagatggttccactcctgttacttaatcaaaaggctgtgcagagtcactgaagccagcataaagtcatgtgttagaacaacagctgatctgtattagagaagattaactcacagtgccatggtggaaggcctaggattatttyatgtacttccattgccttacaagccgtcagcgcaattattgccctccgatgtgaatgactgatctgtaaccacagctaaacagcacgctgcttaggggcctaggagcttcatgaagatgaatttccataccatcaaagtacttttaatgggctccctgatccaaccacaaggcctgctttgcaagtatatagaactcaggatgaaggcttcctgtccaaaaggatttggtcggttgtcacttgacaattcccagccagcactggggaagagaagggggagataggtagagttgtctctgc

SEQ ID NO: 183616 - DNA, 601 bp, Human
aaaccaattactaatccacatatttattggccatagataatattgagtgattataaaactctaataaaaagataagtattagaaaaataacactatatgcatagatatgtggtttatatgagagaaaacatatctacctttgtcaactcaaggatgtaactgatttgacatgctaagcaatatggagtctttattcaattcctataggtgggctcacacacataaatatgtaatgagtagcagtcagataataatttgatccaaactgtaagttctataaaggcagagctcatattttctsgtttaatacaatacctccagtacctaccaccgtctctaatacatagcatgtgctaatgttgaataattactaattaaaagatgtaagtgtgacattattatctcattttcatgatgtacacagacatagattgatcattaatattctagaaatgacacccaagttatttcaacaggaaaagtcaaccacaaactagagtaatacctgcttcaaagagtttcaataatctcaatttcattttcaggtgtcagagtaacataagggatgagataattcagatccgttgattgaggtttcctt

SEQ ID NO: 183617 - DNA, 601 bp, Human
tgttttcactgtccaattacagcttttcagaattaagaccttctagctgggataaccacgtggctggctatttgagatatgaagaaaagttaatgtgtataaggctgtgtacccaagaaaacagatctccaccacaagatttcaatcatctggagctcaggtcatgatatcttttatgttgatgtaaagcacccggctgaacttcttttctttttttcctttctcccagttcctttccctctttctttctgctttatctctctcactccttaccttacacatattttctgggtttggggarttaggagtgttattattattattatttgagatggagtcttgccctgtcgcccaggctggagtacaatggcgtgatctcggctcactgcaacctccgcctccaggttcaagctattctcctgcctcagcctcctgagtagctgggattacaggcgtgcaccaccacacccgggtaattttttgtatctttagtagagacaaggtttcaccacgttggccaggctggtctcgagctcctgacctcgtgatccccccgcctcggcctcccaaagtgctgggattacaggcgtttgagtcaccg

SEQ ID NO: 183618 - DNA, 601 bp, Human
catcccagcgctttgggaggccaaggcgggcggatcatgaggtcaggagattgagaccatcctggcgaccatggtgaaaccttgcctctactgaaaatacaaaaaaattagccaggcgttgtggcacacgcctgtagtcccagctactagcgagggtgaggcagaggaatcgcttgaaccctggaggcggagcttgcagtgagccaggatcgcgccattgcactccagcctgggtgacagagcgagactccgcctcaaaaaaaaaaaaaaaaagaccctggacatgtaatagtggaagggmaaaagatagatagatggtaacaattataagacaaacaaaacaaaccagtttcatgaaggaaatatttgagagctttgatgtcatttttgtaatatgcctgtggctgacaatcgcctgttcctacccagtagccattgcccttctttccttcccagctaacattacctttgatctgaagatatcccctgatctcagagaagacaggattagctctctaatttagtggtaaaaaataattcatgatcaatttaaagtagtctcttttcctttggccagtaatggtcttaaagatgttcatat

SEQ ID NO: 183619 - DNA, 601 bp, Human
caaaagtgagtcttactttacttattgaaaattagaaaattcagaaatgtggaaatacatttgaaaatttacaaccccataaccttggcataactaaactattgttgccattttgttgtatattcttttagtcttttatctatgcattatggaaataatatacttaaaaaaatcaacatcattctatacatggtgttttcaaacttatcttttcagaagtactattgtgagcatatcctcgaatccctaaacaaatagacagtttcaatcatcagagaggcctgtgggtgtctctctgaawgcccaatttggcatgccctatgagtctcattttattggaccatcctacactaacccctctaccagaatgatgtaaagaacacaagactctctgtttgaaaacatgcacagcttttctaggctagaaaattaaaccataaaaagtttactggaaaaaaaaaaaacctttaaaaagctccttaaaaactcacaccataattgctccccaccaagcgtgggcacttgctagctgcaagtagtggcactgtgacaaatgtagcaaaactgaaagcaggctatactaagagaaagaaaaagtctt

SEQ ID NO: 183620 - DNA, 601 bp, Human
cagattgtggagatggtgattgcttaaacaaaatttttttgatcaagtctcaaaaatgtgccaagggctacacatgaccaatgctggggcacaggcgaattgaacaggaactgcgttactttctggaattccctctccatattccgttagaaaagagactgggctttgagctgtaagacttcaatttaaagactgatctgccacttgaattcctctattcttctcaaatctcaagttaaaaaattgttttaaacaaagaatactgttctatttacattacagagtgagaacaaaatatgawgggaaagccatgagaaaatgttaaggtacaaaataaatatcaatagctgttatactcctatgacataggcataagcaagtcttttttattggtaaaagaggagaagagatgtgattggaaagattcaatgagaccctttaaataaatgcgacattcctcctattttcctaataatagttttaaatccatattggtaaaatagcttgcaataaacataataaagaatctatctactaaatatagagagtaactgcaaaacaaacttctcctttattatttcagtgtcttcattgtaagtaa

SEQ ID NO: 183621 - DNA, 601 bp, Human
cccacctgtctccagccatcccctctctgaaagagttcacctatgcactatcatgtataaagctcaaccatttgaggttctgttctgtgggttaaatatttccttttctaaaagtgttttttcataagagcaaatactactggaaaaggtaatattttgattctcaaatttcttataaataaattactcttttctaaatagaggcagatggaacaaaacaaggacagtagatttcaggtaagcagagggttaagtgggaagatgttgaaaatgggaaacaccaaagaaactgattttgggraaacaaataaatgttgatgggcacaagtgacaattttttaccgatcttataatctgataaaaatcatgttggtgatatagatcttataatctgataaaaatcacggctctgataaaaatcatgttactcaagagtttctgcagaaaaatagcatcccattcccccatttaaaggtcaccattctggaacacaaatccagcacagcacttaggaatgctgatatgaaaatgacaagattgattggtcttctctcctttaccttctttttacatttttatacatttaaaggaatactcgcca

SEQ ID NO: 183622 - DNA, 601 bp, Human
atctcaatgaagtctctgacaatgtgacaactgtacatactaaattaaaaaatctcttaagtcagtggccttggaactcctgtactctattcatcaaattatgtacattatttaatagaaaactatttttaaattgtcaatcagtataaaatacagtagagaaactggagacaaaatagtttatattaactttagttctatagaattaaatagtattaaagttgaaataagttacgcatttaaaactgtagaatctgactcgatttgttttgtgtgtgaagttgttgttttcagctgcttyatatgttttggatgtcttttgctgagagagtcggctgtatatattcagctgagctcaggagcatcaaggacaccagcttaacagactttctttacagtaaatgtagctgttaaaacaaaagacagttacatttgaaaacacacgcacacatacacacattccatcaacatgatctgatagtcctcgggtcaatgaagactttactgtactctctttgaggaatgtacggggcttggatcacctcttagcttttgatttaacagtatagggcaataatactacacattttctagagagttt

SEQ ID NO: 183623 - DNA, 601 bp, Human
aatgagatattgaaattcttaacacagtacatgctttatctcaatgaagtctctgacaatgtgacaactgtacatactaaattaaaaaatctcttaagtcagtggccttggaactcctgtactctattcatcaaattatgtacattatttaatagaaaactatttttaaattgtcaatcagtataaaatacagtagagaaactggagacaaaatagtttatattaactttagttctatagaattaaatagtattaaagttgaaataagttacgcatttaaaactgtagaatctgactcgayttgttttgtgtgtgaagttgttgttttcagctgctttatatgttttggatgtcttttgctgagagagtcggctgtatatattcagctgagctcaggagcatcaaggacaccagcttaacagactttctttacagtaaatgtagctgttaaaacaaaagacagttacatttgaaaacacacgcacacatacacacattccatcaacatgatctgatagtcctcgggtcaatgaagactttactgtactctctttgaggaatgtacggggcttggatcacctcttagcttttgatttaacag

SEQ ID NO: 183624 - DNA, 601 bp, Human
atgagacattactgtcaaattaagaaactgggtgactttaggaacagaaaaagcatataatgaaacttgataactttctcgtgaactctccagcactgctctgaggatgatgtagtaccaaacagcaccaaaacagttttaagaaatgcatccattggatctcataacattatctcaagtttctttataattattcacctcattttctgaggaacatagtcatgaatcatactagtgaacgacatacactgcagaactgctattgacacaataaaatgttcacagaaagtaatcaatgatktaagataattgtattacaggtaaagggcccaactaatgttcccaccaagaactaatgagatattgaaattcttaacacagtacatgctttatctcaatgaagtctctgacaatgtgacaactgtacatactaaattaaaaaatctcttaagtcagtggccttggaactcctgtactctattcatcaaattatgtacattatttaatagaaaactatttttaaattgtcaatcagtataaaatacagtagagaaactggagacaaaatagtttatattaactttagttctatagaattaaa

SEQ ID NO: 183625 - DNA, 601 bp, Human
ggagctgaaaatagaagaaaatgtttgcaacattagacccagaaaaatgcaaattgaatccaattgagtaaaattcagttttgatagaattacgtgtttcaacgttcaggtttgtttagtcccttgattagtatagacctggtcttaaaagtagaattggcccaaggcacagagtaaacagttgtgtatattggaggattcaaggggaccccctctcaaagtatgcatctcactggtttgcctttgtgcactcttctctatatgcagggaacttccctgtagtagtaacaaagttgagggyggtactgccaaaggaatgcttaaaatgcatggatgccacctgacagtagagagatgttcccggtcagggtattgtataagaagaacagcacttccttctttttccctctttgctatgctattaaaaatcagagtatcaatttaatttcttgtcactgtggatgtttagaatgttcagagatgatacagaaaacagaagtctgaaggcctatgagaagggagcataaagctgtgcagctggtttctagttaggttatagagagtgggcccgacacttgactatgtagtacatagcactagg

SEQ ID NO: 183626 - DNA, 601 bp, Human
aaatgatcagtagcaatatctagtggctcatgtgaaagcaacttttttctcagctttagtaaaaatatttctagatttttgaagaagataaagcattaaaataattagtatgaagacaaacagctacatgagctatagaaatatggcatatttctcaatggacatagaatgcttcatcaccagaagaagcctcaatgatgatgtttattttctggataagcaaataacacgacctgtatggcctccaaatccaggatccttccacaactgcagaaaacagaacagtacctttattccataygtcacttagttcttaatggttttcttacccaatatcttgctgatgttggagttgtgcatgtcaggaaaggcttgaaggatctttctccgttcatctttagcccacaccatgaaggcattcattggacgctttatgtggggttcattgctaccacgccctcgggattccctataaattcttgactctgagactccagcacttcctgaaaacaggaaacatcacttcgtgttagcgttaaaacttttgtcagctcttttccttgcattcctatttttcagtctattaagatatctgaaaaga

SEQ ID NO: 183627 - DNA, 601 bp, Human
gtaatcccagcactttgggaggccaaggtgggcggatcacctgaggtcagaacttcgaggccagcctggccaaaatggtgaaaccctctctctgcgaaaatacaaaagttagttgggcatggtgtcccgcgcctgtcatccgagctactcaggaggctgaggcagaagaattgcttgaacccgggaggcggaggttgcagtgagccgagatcacaccactgcactccagcctgggcggtaaagcgagactccatctgcaaaacaaaacctcatgcatatgtttgccatttatagatgatcwgtaatgaatcaaaagtgatactatttttataaactccgtgtaattccaagtgccttacgaattctaataaaactttaataattttgacaaattttgttacttatttgttaaaaccaacattttctgataaaatgtttctattctatttttgtcacttaactcttagaagtcacagagtgaatcatcaaaattttcttaggttgtctagtatctggccatcagacagtgatgaatgacaatgacagtgataatgatgtcagataaggcacaaaagcaatggaatcttctttttttcttttt

SEQ ID NO: 183628 - DNA, 601 bp, Human
cttttttttttttttttttgagacagagtcttgctctttcgcccaggctggaatgcagtggtgtgatctcggctcactgcaagctccacctcccggattcacgccattctcctgcctcagcctcccgagtagctgggactacaggcgcccgccaccacgcccggctagcttttttttttgtatttttagtggagatggggtttcaccgtgttagccaggatggtgtcaatctcctgatctcgtgatctgcccggttcggcctcccaaagtgccgggattacaggtgtgagccaccactccyggccaagcattttcaattagaaggggaattgccaaagattcttccctaagtttaaatgatctatacgccaaaaggctttggcctctcaaaggaaagaaaatgtttatgcttagaagtaatctgccttggaatgcgagagctgtttgtttgtatatttcctactatgtacataatgttgcattcattccttaataaatatatagtagtgagtgaatacagaaagttatagttcctgtctctttgcagcttatattcagtcagggaatatacattaaatatctaattacaaaatttattatt

SEQ ID NO: 183629 - DNA, 601 bp, Human
tagctgggattaaaaaagacaagtttgaagcttaaataaaaatagtttatgctaattcacattttagatatggtttaaaacttggattctgtcagtatggctatgtgtaatagaagtggtaatgtgtccggaattggtgggttcttgatctcactgacttcaagaatgaagctgcggaccctcgcggtgagtgttacagttctcaaaggcggtgtgtccggagtttgttccttctgatgttcggattgagaggtgacagcgtgctggcagccctcagtagtaatagcgtttttttttttttaatagtgatttaaaaatctatttgcagatgaagtgtgtttatctgcaaatagtcatctcaactcaacgcgaatgcacaaagaccgataaactggaactaggatatccctaccaaatggccttatacctgccttcaaatgtcatctaagtaagatcttagaatctttcgaatgagttcattactcacccgtaactccctatcttaaatgcaaatagctcactgttgaatagttcttccttacacatgtaaagagttcctcaatatgggctgttacatttattaaagcatacagtgaaagag

SEQ ID NO: 183630 - DNA, 601 bp, Human
cttttgtattatgtcccttaaagctcatagataatttaatggatacatttctcatttctacattagatcatgatataattcacatgtgaacagaaaagttacatgatatgttatcatgcattttgaatctgagactaattatctagttattgaatatttttatgtgggagatgttttttactacaaaagttcccaacatatatcatgtagtctcatcctccccaaaatgtttaagtattttaagcttacaggaatggtagtaattaaaaattcctttgattaaacatttaattataattamaattataatattaataaacatggagtgggtaactactatgtgccagacactgtgctgaaaccttgacatactgatgtctttttcctacctttcacctcaatcttataaaagagacagcatttctatctattttcatagatgagaaaattgagattcaaatagatggactaacttagccagggtcataattactgaagtacagatctgtgactcaaactcagatttgatataacttaaattgtgctataatgtatgccctttcctacatatggccacctactatacaaaatatagcagagg

SEQ ID NO: 183631 - DNA, 389 bp, Human
tgttggcaaggctggtctcgaactcctgacctcaagcaatctgcccacctccgcctcccaaagtgctgagattacaggtgtgcgccacygtgcctggcctatattcatttttcaaaaattttctagagttttacattttcattgctttgtacttttactttgtcttattttactttttcaccatgtgtttttcaaagctgaaggtatatttgatgtgattattataaatcacttgtcaggaagacttgacttaatgaatacagatacagttcatttttaaaatcatggtttaataatttttagaatttacctttataatatagaaaaataccaaatgttctttatctgcactagaaaattaaatgattatttcattaataagtaaaatt

SEQ ID NO: 183632 - DNA, 393 bp, Human
tgttggcaaggctggtctcgaactcctgacctcaagcaatctgcccacctccgcctcccaaagtgctgagattacaggtgtgcgccactgtgsctggcctatattcatttttcaaaaattttctagagttttacattttcattgctttgtacttttactttgtcttattttactttttcaccatgtgtttttcaaagctgaaggtatatttgatgtgattattataaatcacttgtcaggaagacttgacttaatgaatacagatacagttcatttttaaaatcatggtttaataatttttagaatttacctttataatatagaaaaataccaaatgttctttatctgcactagaaaattaaatgattatttcattaataagtaaaattgaag

SEQ ID NO: 183633 - DNA, 601 bp, Human
cccaaaggccaggattacaggtgtgcatcaatgtctggctaatttttttttttttttttttttgtagagatagggtctcactgtgttgttcagactggttttgaattcctggcctcaaacgatcctcccaccttggcttctcaacgtgctgggattataggggtgagccactgtgcctggtctgttgctttcctttaaacccataccccttattattttagtattcccttggtttttaatgttgtgtggacttgaatcatagaattatagagcattattgctggaatgttggaatccaacsttgtgttttacagataaggaaactgaaatacaaatagactagatgcaccaaaattcaaacatttagtgatgggggcagaacaaagactcaacccttgatcttctgacgcaagttctgtgtgtttatgaaaccatactacttctcatctcttgtaattttgccttatttgcctcacattattttgcattttgtgtatttatgccttctcatagattgaaaacttcagggcaggggaaccttcatatttacattgtaaatttttttttttttgagacagagtttcgcagtttttgccctggc

SEQ ID NO: 183634 - DNA, 601 bp, Human
accaaaattcaaacatttagtgatgggggcagaacaaagactcaacccttgatcttctgacgcaagttctgtgtgtttatgaaaccatactacttctcatctcttgtaattttgccttatttgcctcacattattttgcattttgtgtatttatgccttctcatagattgaaaacttcagggcaggggaaccttcatatttacattgtaaatttttttttttttgagacagagtttcgcagtttttgccctggctggagtgcagcagcatgatctcggctcactgcaacctccgcctctcsggttcaagcaattctcttgcctcagcctcctgaggagctgggatcacaggcacctgccaccacacctggctaattttgtatttttagtagagatgggtttcaccatgttggccaggctggtctcaaactcctgacctcaggtgatccgctcaccttggcttcccaaagttctggaattacaggcatgagccaccatgcccagccttacattgtaaattatttaaacaatgatataaagtctatatacagtttctttcccctatgcttgttaggtgtattaacaccattaacaaaaataat

SEQ ID NO: 183635 - DNA, 601 bp, Human
tctctgtggagggaaaggaatgcttattctcttggtctgtttttcatttattttttggttgttaatagttgctttttctatttgtttaaattatcagttaaaaaaacctgttaaaacactgattctcttgtttctattcctgaaattgtaagtaatgattgctgaattggacatgaatatggtatggataatttttgcttttgttcaaacagccagttgaataaaacaagcagtgaaaatatgtggaaatatttaaaagaatggatgtttctcaaaagttttttttttttttttttttttaaaagaatcatcctggcccagcgcagtggctcatgcctgtaatcccattgggaggccgaggcaggtggatcgcttgaggtcaggagttcgagaccagcctggccaacatggtgaaaccctgtctctactaataatacaaaatttagctgggcgtggtggtgcatgcctgtaatcccagctacttgggaggctgctgcaggagaatcatttgaacccaggagccagaggttgcagtgagccgagatcatgccactgcactccagcctgggtgacaaggagagacttaatctcaaaaaaaaaa

SEQ ID NO: 183636 - DNA, 601 bp, Human
ggtctgtttttcatttattttttggttgttaatagttgctttttctatttgtttaaattatcagttaaaaaaacctgttaaaacactgattctcttgtttctattcctgaaattgtaagtaatgattgctgaattggacatgaatatggtatggataatttttgcttttgttcaaacagccagttgaataaaacaagcagtgaaaatatgtggaaatatttaaaagaatggatgtttctcaaaagttttttttttttttttttttttaaaagaatcatcctggcccagcgcagtggctcaygcctgtaatcccattgggaggccgaggcaggtggatcgcttgaggtcaggagttcgagaccagcctggccaacatggtgaaaccctgtctctactaataatacaaaatttagctgggcgtggtggtgcatgcctgtaatcccagctacttgggaggctgctgcaggagaatcatttgaacccaggagccagaggttgcagtgagccgagatcatgccactgcactccagcctgggtgacaaggagagacttaatctcaaaaaaaaaaaaattcatccttttcttccaaaaattttagcac

SEQ ID NO: 183637 - DNA, 601 bp, Human
ctaataatacaaaatttagctgggcgtggtggtgcatgcctgtaatcccagctacttgggaggctgctgcaggagaatcatttgaacccaggagccagaggttgcagtgagccgagatcatgccactgcactccagcctgggtgacaaggagagacttaatctcaaaaaaaaaaaaattcatccttttcttccaaaaattttagcacgtattttcatatgttagtgtgtagatcaattcaaataatagatacaacaaatactgtaatatgttgtgtaccttgtaattattccagctgtatygcagaaatattttataaatttaatagggctgggcagttttttttggaaatgcttgatcatttgcaagtactacatgctcttgaataatatattttcatttttagaaacatttagaatatttagtgtacaacccctgtctcccagtaattctgctgcccaaggaaatcagttactttattttttcttttcatttcttagctatagtctttaaaaaaaaaaaaaaaaaaatggcctgtgaggtcttgcatgatttggcttttgtctacgtctcacttcatctcttgcttttgtctctttcct

SEQ ID NO: 183638 - DNA, 601 bp, Human
gcaggagaatcatttgaacccaggagccagaggttgcagtgagccgagatcatgccactgcactccagcctgggtgacaaggagagacttaatctcaaaaaaaaaaaaattcatccttttcttccaaaaattttagcacgtattttcatatgttagtgtgtagatcaattcaaataatagatacaacaaatactgtaatatgttgtgtaccttgtaattattccagctgtatcgcagaaatattttataaatttaatagggctgggcagttttttttggaaatgcttgatcatttgcaagkactacatgctcttgaataatatattttcatttttagaaacatttagaatatttagtgtacaacccctgtctcccagtaattctgctgcccaaggaaatcagttactttattttttcttttcatttcttagctatagtctttaaaaaaaaaaaaaaaaaaatggcctgtgaggtcttgcatgatttggcttttgtctacgtctcacttcatctcttgcttttgtctctttcctctttcagccttgaatagcttagcccttttttgctttggtgtctgtgatcatgctcttcctcagggcag

SEQ ID NO: 183639 - DNA, 601 bp, Human
agatcaattcaaataatagatacaacaaatactgtaatatgttgtgtaccttgtaattattccagctgtatcgcagaaatattttataaatttaatagggctgggcagttttttttggaaatgcttgatcatttgcaagtactacatgctcttgaataatatattttcatttttagaaacatttagaatatttagtgtacaacccctgtctcccagtaattctgctgcccaaggaaatcagttactttattttttcttttcatttcttagctatagtctttaaaaaaaaaaaaaaaaaaatggcctgtgaggtcttgcatgatttggcttttgtctacgtctcacttcatctcttgcttttgtctctttcctctttcagccttgaatagcttagcccttttttgctttggtgtctgtgatcatgctcttcctcagggcagatggctcctttaggttaatcagcattaagtttggctactagtatcagacagatgccaaatattaatttctctcacaccagagaaatccagggttggcatggcattcatttattaaatgttatttccaggtgtgtgtatgtgttttgctattgtaaattctg

SEQ ID NO: 183640 - DNA, 601 bp, Human
ctgaggtgggaggatgccttgagggtaggagttagagatcagcctgggcaatatagcaagagccggcctttacaaaagtaaaaaaaaaaaattagccaggtttggctgtgagcgtctgtagtcctagctacttgcaaggctggcgggaggattgcttgagtccaagaggtcgaggctgcagtgagctatgatcgcgccactgtactctagcttgggggacagagcgagacgctgtctaaaaaaaacaaaattaaaaatttgtttagagaaagtatctttaaatgtttattgaaaactgcamaaatttaaatgtatagaatgtttatatttgtagatatctgtgtagtcatcactcaaatccagatgtggaacatttttagtgttcgaaaaggctctcttgcgccccctccaatcagtgtctctttccctctcaaaggtaatcactattctgtcctctatcgccataaactatttttgcctgtttttgaactttatataaatgtaactgatatggtttggctgtgtccccactcaaatctcatcttgaattgttactcccacaattcccacgtgtggttggcagaacctggtgggaggtaat

SEQ ID NO: 183641 - DNA, 601 bp, Human
gagcgtctgtagtcctagctacttgcaaggctggcgggaggattgcttgagtccaagaggtcgaggctgcagtgagctatgatcgcgccactgtactctagcttgggggacagagcgagacgctgtctaaaaaaaacaaaattaaaaatttgtttagagaaagtatctttaaatgtttattgaaaactgcacaaatttaaatgtatagaatgtttatatttgtagatatctgtgtagtcatcactcaaatccagatgtggaacatttttagtgttcgaaaaggctctcttgcgccccctcyaatcagtgtctctttccctctcaaaggtaatcactattctgtcctctatcgccataaactatttttgcctgtttttgaactttatataaatgtaactgatatggtttggctgtgtccccactcaaatctcatcttgaattgttactcccacaattcccacgtgtggttggcagaacctggtgggaggtaattgaaccatgggggtgggcctttctcgtgctgttcttgtgatagtgaataggtcttgtgggatctgatggttttaaaaacgggagtttccctgcacaaactctcttctct

SEQ ID NO: 183642 - DNA, 601 bp, Human
gtcgaggctgcagtgagctatgatcgcgccactgtactctagcttgggggacagagcgagacgctgtctaaaaaaaacaaaattaaaaatttgtttagagaaagtatctttaaatgtttattgaaaactgcacaaatttaaatgtatagaatgtttatatttgtagatatctgtgtagtcatcactcaaatccagatgtggaacatttttagtgttcgaaaaggctctcttgcgccccctccaatcagtgtctctttccctctcaaaggtaatcactattctgtcctctatcgccataaaytatttttgcctgtttttgaactttatataaatgtaactgatatggtttggctgtgtccccactcaaatctcatcttgaattgttactcccacaattcccacgtgtggttggcagaacctggtgggaggtaattgaaccatgggggtgggcctttctcgtgctgttcttgtgatagtgaataggtcttgtgggatctgatggttttaaaaacgggagtttccctgcacaaactctcttctcttatctgccgccatgtgagaagacatgcctttaaccttgtgccatgattgtgaggcctct

SEQ ID NO: 183643 - DNA, 601 bp, Human
ctgcagggcgtgtcggaggtcttcatggcagcccctcccatcacaggcgtggaagccttggaggaaaaagtggttttgtgagccagacccaatgtccctgtgctatgtgcagcctagggacttggtacccagcattccagctgctccagccgtggctgaaaggggccagcgtagagcttgggctgtggcttcagagggtgcaagccccaagccttggtgttgatgctgcaatgtggtgttgatgctgcaagtgcacagaagtcaagaattggggtttgggaacctccacctgcatttcagcagatgtatggaaatgcttggatgcccaggcagaagtttgcagcaggggtagagcattcgtggagaacctctgctagggcagtgcagaagggaaatgtggggtcagagcccccacacagagttcctactcgggtaccgcctagtggagctgtgagaagagggccaccatcctccagcctccagaatgatagatccactgacagcttgcaccatgcgcctggaaaagctgcagacactcaatgcaagcctgtgaaagcagccaggagagaggctgtactctgcaaaaccacagagtcagagg

SEQ ID NO: 183644 - DNA, 601 bp, Human
atcaccaccgatcccacagaaatacaaactaccatactttgttttctagcttggcttttatgaacatccttccgtgtcagtgtatatataaatctaaaggttttttgttttttttttaaaccaaaaaactttgcctattttgtctctgttataaagttcctgattttctttaatagagctgtttctacttttattcctacaaagaatatacgtattttttttaggtggctaaaaacttcatttttttctcatctctagtatgagagtaatacttagtcaaaggatagctgtaaggctacartgagaatttacgaatcagtgtaactgctaagcagtgtttggtatccatgaagagcctgtctggatctcccttcctgcctaagatcaatttctaaatgtaaaataactggtttcaaagatacagatgtttatttaaaatgttgctgactgttgccaaactgctatttagaaaagacattccaatttacacctttaccacagtgttttttaactctgtgttatcattctttctaatctttgccagcatggtaggcaaaaaatggacaaaactaaaaggagaattagacaaatccataagcat

SEQ ID NO: 183645 - DNA, 601 bp, Human
tgcagggacatggatgaagctggaagccaccattctcagcaaaatatcacaaggacggaaaaccaaacactgcatgagttgaacaatgagaacacatggacacagggaggggaacatcacacattggggcctgttggcgggtgaggggctgggggagggatagcattaggagaaatacttaatgtaaatgacaagttgatgggtgcagcaaaccaacgtggcacgtgtatacctctaacaaacctgcacgttgtgcacatgtaccctagaacttaaagaatattaaaaaaaaaaaaaggcygggcacagtggctcacgcctgtaatcccagcactttgggaggctgagatgggtggatcacgaggtcaggagaatgagaccatcctggctaacacggtgaaaccccgactctactaaaaatacaaaaaaattagccgggtgtggtggtgggcgcctgtagtcccagctagttaggaggctgaggcaggagaatggcgtgaacccgggaggtggagcttgcagtgagccgagatcatgccactgcactccagccggggtgacagagcgagactccgtctcaaaaaaaaaaaaagaatgtgac

SEQ ID NO: 183646 - DNA, 601 bp, Human
gcagcaaaccaacgtggcacgtgtatacctctaacaaacctgcacgttgtgcacatgtaccctagaacttaaagaatattaaaaaaaaaaaaaggctgggcacagtggctcacgcctgtaatcccagcactttgggaggctgagatgggtggatcacgaggtcaggagaatgagaccatcctggctaacacggtgaaaccccgactctactaaaaatacaaaaaaattagccgggtgtggtggtgggcgcctgtagtcccagctagttaggaggctgaggcaggagaatggcgtgaacccrggaggtggagcttgcagtgagccgagatcatgccactgcactccagccggggtgacagagcgagactccgtctcaaaaaaaaaaaaagaatgtgaccttatttcgaagtggggtctttacagaggtaaacaagttaaaatgaggttattagggtggaccctaatccaccatgacttcgggccttttaaaaaagggagagattttgacacagagacagaacaccagggagaagatgactatctacaagccaactaggagggagcctagagcagattcttcctagcatcttcagaaggaaca

SEQ ID NO: 183647 - DNA, 601 bp, Human
gtcaggagaatgagaccatcctggctaacacggtgaaaccccgactctactaaaaatacaaaaaaattagccgggtgtggtggtgggcgcctgtagtcccagctagttaggaggctgaggcaggagaatggcgtgaacccgggaggtggagcttgcagtgagccgagatcatgccactgcactccagccggggtgacagagcgagactccgtctcaaaaaaaaaaaaagaatgtgaccttatttcgaagtggggtctttacagaggtaaacaagttaaaatgaggttattagggtggaccstaatccaccatgacttcgggccttttaaaaaagggagagattttgacacagagacagaacaccagggagaagatgactatctacaagccaactaggagggagcctagagcagattcttcctagcatcttcagaaggaacacgttcctgctgaaataccttgatttcagacttctggcctccagaacagtgagaatgtgtttccttgatgttgccacttgatatctcatggatcttgaacttaagacaatcaacaaactttgtttgtttgtttttttgaggcaggttcttgctctgtgacc

SEQ ID NO: 183648 - DNA, 601 bp, Human
agccaacaaactcttgatcccttcattcttaaagtacactccaggtctgctttctgcgctctaccctacatttgttcattcctgtctttctcatttcattaaatgatattgccatccactcagtagctagaagccaaggtgtcatacttgatacctttcttttcctcattctaactcacatacttccagtccatcagcaaatcctgtcttttctacctccaaatacatcttgaagtcttctgttctttatctgcatcaccatactactcaagtcaagcagccatcatctcttcacttacaytattggcctcttattttatttaattttttttgagatggagtctcactctgtcacccaggctggagtgcagtggtgcaatcttggctcactgcaacctctgcctcctgggttcaagcagttcttcttcctcagcctccttagtagctgggactacaggtgcacgccactacgcccggctaatttttgtatttttagtggagacgggatttcaccatattggccaggctggtcttgaactcctgacctcatgatctgcccgcctcggcctcccaagtgctgggattggaggcatgagccacc

SEQ ID NO: 183649 - DNA, 601 bp, Human
acactccaggtctgctttctgcgctctaccctacatttgttcattcctgtctttctcatttcattaaatgatattgccatccactcagtagctagaagccaaggtgtcatacttgatacctttcttttcctcattctaactcacatacttccagtccatcagcaaatcctgtcttttctacctccaaatacatcttgaagtcttctgttctttatctgcatcaccatactactcaagtcaagcagccatcatctcttcacttacactattggcctcttattttatttaattttttttgagrtggagtctcactctgtcacccaggctggagtgcagtggtgcaatcttggctcactgcaacctctgcctcctgggttcaagcagttcttcttcctcagcctccttagtagctgggactacaggtgcacgccactacgcccggctaatttttgtatttttagtggagacgggatttcaccatattggccaggctggtcttgaactcctgacctcatgatctgcccgcctcggcctcccaagtgctgggattggaggcatgagccaccacgcccagcttctattttttattgtggtaaactgc

SEQ ID NO: 183650 - DNA, 601 bp, Human
ttattgtggtaaactgcataagcataaagttgaacatcttaaccattttaagtatacagttcagtattaagtatattcacattgttgtacaaccagtccccagaactttttcatcttgtaaaactgaaactgtatacatactaacaactccccaagtcttccctcctcctagcccctggcaaccactattcttcatgtttctcctttatgtttgtataaatttgtttgctctatgtacctcatataaatggaatcatattgtctttccgtggctggcttatttcacttaatgtcttgaagkttcatccgttttgtagcacatgtcaaaattttcttccttgttaaggctgaataatattccattgcttatatataccacattttgtttatccattcatttgttgatgaacagcttgggttgcttccacattttagctgttaagaatagtgtttccatgaacatgggtgtagaaatatctgttcaggttcctgctttcagttttttgatgtacacccagaagttgaattgctggattatatggtaaactattttttatcttttgaggaaccaccataccattttccatagcagctgcaccat

SEQ ID NO: 183651 - DNA, 601 bp, Human
ctcattcttcacacagcagcacacaacagccagagaaatgtttttaagatttctgcattaatgatacaacaatacctcttacttggcagcataatacaatgaaagtttacattactttcccacatcactgtgtgtgtgtgtgtgtgtgtgtgtgtgtgtgtgtgtgtgtgttgaggggcacctttgctttatgcagtcacttggagcacaggcacctgtatcttatgtcaccaccataatcagctttggcttctcagattgttttggaaggggaagtgtgtgtggagaaagattttagggwccaggctagaagtggcatatatcacttttacccattcagttccattggtcagaactgagtcatgtgatcttatctaattgcaggggtggctgggaagtgtagtatagcagtgtcttaatgaagagaacacagtcattagtgaatactagcagtctctttcacagcgtgtgttggattataatttccttgcttaaaacccttattacatgacttttttaaagacagtctcattctgttgcccaggctggagtgcagtggtgtgatctcagctcactgcaacctccgcctcctgggttcaag

SEQ ID NO: 183652 - DNA, 601 bp, Human
tggcagcataatacaatgaaagtttacattactttcccacatcactgtgtgtgtgtgtgtgtgtgtgtgtgtgtgtgtgtgtgtgtgttgaggggcacctttgctttatgcagtcacttggagcacaggcacctgtatcttatgtcaccaccataatcagctttggcttctcagattgttttggaaggggaagtgtgtgtggagaaagattttagggtccaggctagaagtggcatatatcacttttacccattcagttccattggtcagaactgagtcatgtgatcttatctaattgcargggtggctgggaagtgtagtatagcagtgtcttaatgaagagaacacagtcattagtgaatactagcagtctctttcacagcgtgtgttggattataatttccttgcttaaaacccttattacatgacttttttaaagacagtctcattctgttgcccaggctggagtgcagtggtgtgatctcagctcactgcaacctccgcctcctgggttcaagcaattcttgtgcctcagcctcccaagtagctgggattacaggcatgcgccaccacacccagctaattttttgtgttttttagt

SEQ ID NO: 183653 - DNA, 601 bp, Human
agcaattcttgtgcctcagcctcccaagtagctgggattacaggcatgcgccaccacacccagctaattttttgtgttttttagtagacacagggtttaccatgttggctaaggctggtctcgtactactggcgtcatgtgatctgtccaccttggcctcccaaagtgctgggattacaggcatgagcccccatgcccagcctacttcttattacatgtagaataaaattggcctgtgtctctcccaacctcacattgtaccacttttgcccttgttctctggccacatctctagccatayggtcattttctgtaacgtgagacttttttttcccctcctggaacctatgtactttgcagtttcttttgcttggagcactctactttaaatatttacatgactgcctcctcttcatccttaaaatgcccacttaaatttttttttctctaactaaaagctgtaattagagtagcactcatattctctgtcctttatggtagcactgtgttaatctttgtcacagcattttttgcaacctataattattttatttgaaaaaatttaatttcctctgctagaaagaggtgtctgtcgtgctca

SEQ ID NO: 183654 - DNA, 601 bp, Human
tttagtagagatggtttttcaccacgttggtcaggctggtcttgaactcctgacctcaagtgatctgcccacctcggcctcccaaagtgttgagattataggtgtgagccactgcgcctgctgaagttcttatgttttagagatatttacttaaatatttatggatgaaaatattttttcaggtatacactgaaatatttacataaatttttagaggtatacaccgaaatatttacagacaaaagttttttgcttcaaaatacttaagcaaggaaacaggaatgggtgagaatatggataytgtggccgtggacaagtggccatgagttgatgattttagctacatgatgggtttaaggggtttgttctcttctttaatgtatgtttgaaattttacataatagaaattataaaaggagggaattgtcttttccagctgtaatctagggcacattacttaacttttttgagacagggtcttgctctgtcacctaggctggagtacagtggcctgataactcttcagctccttacgtagctggaactataggtgcatgccaccatggctggttaatttttgaattttttgtagagacaggat

SEQ ID NO: 183655 - DNA, 601 bp, Human
ttggcctctgaaagtgctgcaattacaggtgtgagccacagcacccagcgtacttaaacctttgaagccttagtttcttcagttaaaaatggtgatattaatactgattgtatcagtttgctgtggtgattaatgacagtgtattaaaactacttagcatacttactctgtgcactcattgtccagtaaatatttctgaagtgaaatacagtgagataatacagttaggcatcaaggttaaggggtttgtagagggagaaaaggttctgggctctttatagcaacctttcataagagataygttctttttagaatgttataaagttggaatggctaacttaaaagcttccatagacataatatttatttattttggcatgtttttaataggagttttctgatctgaacgtgtacaaaagcagcagtacagtggtatttcatctgttctaaaccacatccttttactgaatgttattccggaagcatttataaggcaggtgcccctttgaaagacattgtcctttaaagtagtttgaaactaaattttcatttaacattaaagtcaaatgagggaatacttaagatggaagcatgggttaat

SEQ ID NO: 183656 - DNA, 601 bp, Human
cagttttgtctccagataaatgagagacctgtgaacacaaaggaaactttcttgtatgccttttcattctcatgtttttaaagttcgttcattttttgtttagggaactttaatgagttacttaggcagagtttggaactgtcctgtagttacatgatcagtcttttttttttttttttttcctatctttctttttctttttttctgagacggagttttgctcttattgcccaggctggaatgcaatggcacaatctcatctcactgcaacctccgcctcccaggttcaagcgattcttaygcctcagcctcccaagtagctgggactacaggcaggtgccaccatgcccggctaatttttgtgttattagtagagacggggtttcattatgttggccaggctggtctcgaactcctgacctcaggtgatccacctgctttggcctcccaaagtgctgggattacaggtgtgagccactgcacccagcccctatcttttatattgtgttttatttctttagaaatgaggtttcactgtgttttccagactggagtacagtggctgttcacaggcaccatcataatgctgtgtggcctccaa

SEQ ID NO: 183657 - DNA, 601 bp, Human
tatgccttttcattctcatgtttttaaagttcgttcattttttgtttagggaactttaatgagttacttaggcagagtttggaactgtcctgtagttacatgatcagtcttttttttttttttttttcctatctttctttttctttttttctgagacggagttttgctcttattgcccaggctggaatgcaatggcacaatctcatctcactgcaacctccgcctcccaggttcaagcgattcttatgcctcagcctcccaagtagctgggactacaggcaggtgccaccatgcccggctratttttgtgttattagtagagacggggtttcattatgttggccaggctggtctcgaactcctgacctcaggtgatccacctgctttggcctcccaaagtgctgggattacaggtgtgagccactgcacccagcccctatcttttatattgtgttttatttctttagaaatgaggtttcactgtgttttccagactggagtacagtggctgttcacaggcaccatcataatgctgtgtggcctccaactcttggcctcaaacgatcttcccaccttatcctcttgagtagcggggactaca

SEQ ID NO: 183658 - DNA, 601 bp, Human
ttatgttggccaggctggtctcgaactcctgacctcaggtgatccacctgctttggcctcccaaagtgctgggattacaggtgtgagccactgcacccagcccctatcttttatattgtgttttatttctttagaaatgaggtttcactgtgttttccagactggagtacagtggctgttcacaggcaccatcataatgctgtgtggcctccaactcttggcctcaaacgatcttcccaccttatcctcttgagtagcggggactacaggagtgcaccgccatgctcagcattttttttcyatcttaacataaaatggaaaagttactgttgccttttctcctgataaatagcagcctaagtaagactggtagtttggaataaaggataagttaaaagggcaggaaggtgaggaaagaagtgtttaaaaatgaaggcgagaaggagaaaaagaagttgagagataaagtttatattttcctgtgccttagtatcgacttgcagtgaattagttgaaagttgccttgccagttacatataattggtgacttttaagttatttgtcacctggaacagacataacttctttagcatacaattca

SEQ ID NO: 183659 - DNA, 601 bp, Human
ccactgcacccagcccctatcttttatattgtgttttatttctttagaaatgaggtttcactgtgttttccagactggagtacagtggctgttcacaggcaccatcataatgctgtgtggcctccaactcttggcctcaaacgatcttcccaccttatcctcttgagtagcggggactacaggagtgcaccgccatgctcagcattttttttctatcttaacataaaatggaaaagttactgttgccttttctcctgataaatagcagcctaagtaagactggtagtttggaataaaggayaagttaaaagggcaggaaggtgaggaaagaagtgtttaaaaatgaaggcgagaaggagaaaaagaagttgagagataaagtttatattttcctgtgccttagtatcgacttgcagtgaattagttgaaagttgccttgccagttacatataattggtgacttttaagttatttgtcacctggaacagacataacttctttagcatacaattcagatacaactgtcattgaatttatgtttccataaaattggtggtagaatttttagcattaggtaggagaagaggacagggaaagacag

SEQ ID NO: 183660 - DNA, 601 bp, Human
tttttctatcttaacataaaatggaaaagttactgttgccttttctcctgataaatagcagcctaagtaagactggtagtttggaataaaggataagttaaaagggcaggaaggtgaggaaagaagtgtttaaaaatgaaggcgagaaggagaaaaagaagttgagagataaagtttatattttcctgtgccttagtatcgacttgcagtgaattagttgaaagttgccttgccagttacatataattggtgacttttaagttatttgtcacctggaacagacataacttctttagcatamaattcagatacaactgtcattgaatttatgtttccataaaattggtggtagaatttttagcattaggtaggagaagaggacagggaaagacagctgtgtctcaggcactgtactgttttacctattttgttaaatcctcacagcaaccctgtaggtaggtgttaactgaagcagagaggttagataacttgctcagtgttacacactgatgataaatgacagagcaagaattcaaactgtaatgtttcggttcttgttatcttttattcatcgcctttattgtttcttttctttctttct

SEQ ID NO: 183661 - DNA, 601 bp, Human
tcacttagttcaatgttttttttgttgtttgttttgtttttttcttttttgaggcaaggtttgctctgttgcttggactgtagtgcagtgcttgatcacagctcactgcaacctctgccatccaggcacaagtgatcctcctgcctcagtctcctgagtagctgggactgcaggcatgtgccaccatgccaggctaattttttgattttttttttttttttttttttttttttttgtagagacagtctcactgtgttgcccaggctggttttgaactcctgcgctcaagtgatcttcccayctctgcctcccaaagagctaggattacaggagtgagccactgcacccagcagcttgatgtttctaaggttcatccatgttatagcacatactggtactgtgtctggaattggtgggttcttggtctctctgacttcaagaatgaagccgcggaccctcgcggtgagtgttacagctgttaaggtggcgcgtctggagtttgctccttctgatgttcagatgtgttcggagtttcttccttctggtggaatcgtgatctcgctggtttcaggagtgaagctgtagaccttcgcggcgagtg

SEQ ID NO: 183662 - DNA, 601 bp, Human
tgtctggaattggtgggttcttggtctctctgacttcaagaatgaagccgcggaccctcgcggtgagtgttacagctgttaaggtggcgcgtctggagtttgctccttctgatgttcagatgtgttcggagtttcttccttctggtggaatcgtgatctcgctggtttcaggagtgaagctgtagaccttcgcggcgagtgttacagctcataaaggcagtgtggacccaaagagtaagcagtagcaagatttattgcaaagagcgaaagaacaaagcttccacagtgtggaaggggaccsgagcgggttgccactgctggctcgggcagcctgcttttattctcttatctggccccacccacatgctgctgattggtagagctgagtggtctgttttgacagggcactgattggtgcgtttacaatccctgagctaggcccaaagttctccacctccccaccagattagctagatacagaatgttgacacaaaggttctccaagtccccaccagagtagctagctacggagtgtcgattggtgcattcacaaaccctgagctagacgcagggtgctgattggtgtgtttacaaaccttga

SEQ ID NO: 183663 - DNA, 601 bp, Human
gacccaaagagtaagcagtagcaagatttattgcaaagagcgaaagaacaaagcttccacagtgtggaaggggacccgagcgggttgccactgctggctcgggcagcctgcttttattctcttatctggccccacccacatgctgctgattggtagagctgagtggtctgttttgacagggcactgattggtgcgtttacaatccctgagctaggcccaaagttctccacctccccaccagattagctagatacagaatgttgacacaaaggttctccaagtccccaccagagtagctagmtacggagtgtcgattggtgcattcacaaaccctgagctagacgcagggtgctgattggtgtgtttacaaaccttgagctagagacagagtgcccattggtgtatttacaatccctgagctagacataaagattctccaaggccccaccagactcaggagcccagctggcttcacccagtggatcccgcacaggggttgcaggtggagctgcctgccagtcctgcgctgtgtgcccgcactcctgagcccttgggtggtcaatgggattgggcgccctggagcagagggtggtccttgttg

SEQ ID NO: 183664 - DNA, 601 bp, Human
aagaacaaagcttccacagtgtggaaggggacccgagcgggttgccactgctggctcgggcagcctgcttttattctcttatctggccccacccacatgctgctgattggtagagctgagtggtctgttttgacagggcactgattggtgcgtttacaatccctgagctaggcccaaagttctccacctccccaccagattagctagatacagaatgttgacacaaaggttctccaagtccccaccagagtagctagctacggagtgtcgattggtgcattcacaaaccctgagctagacrcagggtgctgattggtgtgtttacaaaccttgagctagagacagagtgcccattggtgtatttacaatccctgagctagacataaagattctccaaggccccaccagactcaggagcccagctggcttcacccagtggatcccgcacaggggttgcaggtggagctgcctgccagtcctgcgctgtgtgcccgcactcctgagcccttgggtggtcaatgggattgggcgccctggagcagagggtggtccttgttggggaggctcgggcggcacagcagcccatggggcggggaggctc

SEQ ID NO: 183665 - DNA, 601 bp, Human
acaaaccttgagctagagacagagtgcccattggtgtatttacaatccctgagctagacataaagattctccaaggccccaccagactcaggagcccagctggcttcacccagtggatcccgcacaggggttgcaggtggagctgcctgccagtcctgcgctgtgtgcccgcactcctgagcccttgggtggtcaatgggattgggcgccctggagcagagggtggtccttgttggggaggctcgggcggcacagcagcccatggggcggggaggctcaggcatggcgggctgcaggtccygagccctgccccacggggaggcagctgaggcccggcaagaaatcgagcgcagcgctggtgggctggcattgctgggggacccagtacaccctcttcagttgctggcccgggtgctaagccccccactgtccggccggcagggccggccggctgctctgagtgcgtgcggggcctgccaagcccacgcccacccggaactccagctggcccgccagcgttgcacgcagccccagttcccgctggcgcctctccctctacacctccccccaagctgagggagcaggctctgcccttggccag

SEQ ID NO: 183666 - DNA, 601 bp, Human
tccctgagctagacataaagattctccaaggccccaccagactcaggagcccagctggcttcacccagtggatcccgcacaggggttgcaggtggagctgcctgccagtcctgcgctgtgtgcccgcactcctgagcccttgggtggtcaatgggattgggcgccctggagcagagggtggtccttgttggggaggctcgggcggcacagcagcccatggggcggggaggctcaggcatggcgggctgcaggtcccgagccctgccccacggggaggcagctgaggcccggcaagaaatcragcgcagcgctggtgggctggcattgctgggggacccagtacaccctcttcagttgctggcccgggtgctaagccccccactgtccggccggcagggccggccggctgctctgagtgcgtgcggggcctgccaagcccacgcccacccggaactccagctggcccgccagcgttgcacgcagccccagttcccgctggcgcctctccctctacacctccccccaagctgagggagcaggctctgcccttggccagcccagaaaggggctcccacagtgcagtggtgggctgaagggctcc

SEQ ID NO: 183667 - DNA, 601 bp, Human
atatgaacatgggtgtacaagtatctatttgagttctcacttttacttcttttgggtttgtatccataagtgaaattgctggattgtatggtaattttgtttctaattttttgaagaactgccatatgggtttccacagtggctgtaccatcttatcttcccaccagcagtgcacaagggttctaattttctacattttcaccaacacttgttattttctgtcatcatcatttttttaataataaccatggtgatggttgtgaggtggtattattgtggttttgatttggatttttctaakggatggtgatatgatcatcttttcatgtgcttattcactgtttgcatatcttctttggagaagtgtctattcaattcctactccatttttgtgttggatttttattttattctttttagagacaaagtctcactgtatcactcaggctggaatagagtgacataatcatggctcattgcaatctcatcctcctgggctcaagggatcctcctgtctcagcctcctgagtagctaggactataggtgcatgccactgcttggctcatttatttattttttgtagagatggggatctcacta

SEQ ID NO: 183668 - DNA, 601 bp, Human
tgaacatgggtgtacaagtatctatttgagttctcacttttacttcttttgggtttgtatccataagtgaaattgctggattgtatggtaattttgtttctaattttttgaagaactgccatatgggtttccacagtggctgtaccatcttatcttcccaccagcagtgcacaagggttctaattttctacattttcaccaacacttgttattttctgtcatcatcatttttttaataataaccatggtgatggttgtgaggtggtattattgtggttttgatttggatttttctaagggmtggtgatatgatcatcttttcatgtgcttattcactgtttgcatatcttctttggagaagtgtctattcaattcctactccatttttgtgttggatttttattttattctttttagagacaaagtctcactgtatcactcaggctggaatagagtgacataatcatggctcattgcaatctcatcctcctgggctcaagggatcctcctgtctcagcctcctgagtagctaggactataggtgcatgccactgcttggctcatttatttattttttgtagagatggggatctcactatgt

SEQ ID NO: 183669 - DNA, 601 bp, Human
tctattcaattcctactccatttttgtgttggatttttattttattctttttagagacaaagtctcactgtatcactcaggctggaatagagtgacataatcatggctcattgcaatctcatcctcctgggctcaagggatcctcctgtctcagcctcctgagtagctaggactataggtgcatgccactgcttggctcatttatttattttttgtagagatggggatctcactatgttgcccaagcaggtcttgaacttttagcctcaagggatcctcctgtctcagcctcccaaagtgytgggattataggtgtgagtcaccacacccagctggattttgttgttgttgttgttgttgtttttgacttgtaagagttctttatatattctgaatatcagtgtcctatcagatgtgatttccaaatattcctttctgtgggttaccttttcactgtattaatttagtgtcctttcatatacaaagtatgttaaaaagatcttaattttgatgaagtccagtttgactcttttcggttgcctgtgctactgatgtcctggattatctgagtgggctctggtaatcacaagagtccttatca

SEQ ID NO: 183670 - DNA, 601 bp, Human
atgttgcccaagcaggtcttgaacttttagcctcaagggatcctcctgtctcagcctcccaaagtgttgggattataggtgtgagtcaccacacccagctggattttgttgttgttgttgttgttgtttttgacttgtaagagttctttatatattctgaatatcagtgtcctatcagatgtgatttccaaatattcctttctgtgggttaccttttcactgtattaatttagtgtcctttcatatacaaagtatgttaaaaagatcttaattttgatgaagtccagtttgactcttttcrgttgcctgtgctactgatgtcctggattatctgagtgggctctggtaatcacaagagtccttatcagagggaatcaattagtccaggaaagggatgtgatgctgaaagcagaaatcttgatgatgtggccaagtgcaaaggaatataagcagcttctaggagctggaatagacaaagaacagattcttctctagagccttctgaaggaatgcaggctttgattgtagctttgtaatctactccatccaggctgctgcaaatgccaaacaggcctgtaagacctgttttagacttaatgac

SEQ ID NO: 183671 - DNA, 601 bp, Human
gtttgattacatgagtaagttctttagtggtgatttctgagattggtacaaccatcacccaacagcaatgtacactgtacccaatgtgtagtcttttatccctcacgccaccacccttatcattcatatgcttttgcgtcctcatagctttgctcccacttatgaatggagaatatacgatgtttggttttccattcctgagttacttcagttagaataatggtctccagttccatccaggctgctgcaaatgccattattttgtttctttttatggctaagtaatattccatagtgtgtgtgtgtgtgtgtgtgtgtgtgtgtgtgtgtgtatatatatatatacacacatgtgcaagtatctttttcgtataataacttcttctcctctgggtagatacccaggagtgggattgctcgatctactttcagttctttaaggaatctgcgccatccacgtcaacatctattttttgattttttgattgtggccattcttgcaggagtaaggtggtactgcattgtggttttgatttgcatttccctggtaattagtgatgttgaacattttttcatatgttggccatttgtgtatcttcgt

SEQ ID NO: 183672 - DNA, 601 bp, Human
atttctgagattggtacaaccatcacccaacagcaatgtacactgtacccaatgtgtagtcttttatccctcacgccaccacccttatcattcatatgcttttgcgtcctcatagctttgctcccacttatgaatggagaatatacgatgtttggttttccattcctgagttacttcagttagaataatggtctccagttccatccaggctgctgcaaatgccattattttgtttctttttatggctaagtaatattccatagtgtgtgtgtgtgtgtgtgtgtgtgtgtgtgtgtgtgtrtatatatatatacacacatgtgcaagtatctttttcgtataataacttcttctcctctgggtagatacccaggagtgggattgctcgatctactttcagttctttaaggaatctgcgccatccacgtcaacatctattttttgattttttgattgtggccattcttgcaggagtaaggtggtactgcattgtggttttgatttgcatttccctggtaattagtgatgttgaacattttttcatatgttggccatttgtgtatcttcgtttgagaattgtctattcacgtccttaggctgt

SEQ ID NO: 183673 - DNA, 601 bp, Human
ttctgagattggtacaaccatcacccaacagcaatgtacactgtacccaatgtgtagtcttttatccctcacgccaccacccttatcattcatatgcttttgcgtcctcatagctttgctcccacttatgaatggagaatatacgatgtttggttttccattcctgagttacttcagttagaataatggtctccagttccatccaggctgctgcaaatgccattattttgtttctttttatggctaagtaatattccatagtgtgtgtgtgtgtgtgtgtgtgtgtgtgtgtgtgtgtatrtatatatatacacacatgtgcaagtatctttttcgtataataacttcttctcctctgggtagatacccaggagtgggattgctcgatctactttcagttctttaaggaatctgcgccatccacgtcaacatctattttttgattttttgattgtggccattcttgcaggagtaaggtggtactgcattgtggttttgatttgcatttccctggtaattagtgatgttgaacattttttcatatgttggccatttgtgtatcttcgtttgagaattgtctattcacgtccttaggctgttt

SEQ ID NO: 183674 - DNA, 601 bp, Human
gtgcagaagctttttagtttaagtcccatctctttatctttgtttttgaggcatgagacttttgatagaatctacatcttgctttgctcagattggcttaaaccctacattgattctaatccatcaccaagtcttgacatcttccatggaaatttgagaagggttagtgatataagccagtggtacctgctactgcaactggtattgaggcaggaattactattcatcattaccttcttttactacctattctagatttcctttatgctgggccagcatttaagctggtttaagttgcttstgtcctttaggctttcatccttgtgggacttgagcctttagttgccttgcctgttttgagccatggttgctgtaatttcctgtttaccctattagcaagcatggaaataccctgcattccagacagattgctccctaatctcattgtgtacaacaggtcctaataatcagggtcatttatcactgctagtatatttattcctttctttgcctgctcgttcatcagtatgagaagcccatagtgaccaagtggtggttgtggctttaggctccgtgaacccctactgtggaagcattaccc

SEQ ID NO: 183675 - DNA, 601 bp, Human
tgatgttaaagtgaatcccagattggcaaagcaaacattttgaaaccattgaggtactgtaaatgtccagagacactcagggcaggaaaggcaaactcatttctacagtaagtgtaaatcctacttcccctggaatgcaaaggttccaattccatcctgccacctgctcagttctgtgtctgataagttgtttcctgcattctgctgtgatcctaaattttgctagattttttaaatcttattagtacttttaattatatttttcagaaataagctgatttttttgttttgttttgttttgtttttgagatggagtttcactcttgttgcccaggctagagtgcagtggcactactatctcggctcactgcaacctccacctcctgggttcaagcagttctcctgcctcagcctcccaagtagctgggattacaggcatgtgccaccaagcccagctaattttgtatttttagtaaagacagggtttctccatcttggtcaggctggtctcgaactcctgacctcaggttatccacccgcctcggcctcccaaagtgctaggattataggcatgagccactgcgcccagcaagctgatttt

SEQ ID NO: 183676 - DNA, 601 bp, Human
aatgtccagagacactcagggcaggaaaggcaaactcatttctacagtaagtgtaaatcctacttcccctggaatgcaaaggttccaattccatcctgccacctgctcagttctgtgtctgataagttgtttcctgcattctgctgtgatcctaaattttgctagattttttaaatcttattagtacttttaattatatttttcagaaataagctgatttttttgttttgttttgttttttttttgagatggagtttcactcttgttgcccaggctagagtgcagtggcactactatctcrgctcactgcaacctccacctcctgggttcaagcagttctcctgcctcagcctcccaagtagctgggattacaggcatgtgccaccaagcccagctaattttgtatttttagtaaagacagggtttctccatcttggtcaggctggtctcgaactcctgacctcaggttatccacccgcctcggcctcccaaagtgctaggattataggcatgagccactgcgcccagcaagctgattttttttgataatagggatgtgataaacagttttcactttaacgtagtcaactatatgattcca

SEQ ID NO: 183677 - DNA, 601 bp, Human
actcctgacctcaggttatccacccgcctcggcctcccaaagtgctaggattataggcatgagccactgcgcccagcaagctgattttttttgataatagggatgtgataaacagttttcactttaacgtagtcaactatatgattccatttgtatggaattcaagaaaaggcaaactgatgatagatgtgtataaggctttggtatgtttttggtttattttattatatatatatatcatgtttccgtaccttttaatgttgcaataaaattgttttgtctgacattaaaattgccataycaccttttttaaaaaattgccataccaccttttttaaaaaattgccataccacctttttaaaaaaaaggtttgtcagaatttatttttttcatcttttctctgttaatgttttagttcacttttataaacagctttagttgaatttgtatgttgtttttattttattttatattatttattttttgagatggagtcccactctgttgcccaggctggagtgcagtggcacaatctcggctcactgcaacctctgcttcctgtgttcaagtggttcttgtgccacagcctcccgggtagct

SEQ ID NO: 183678 - DNA, 601 bp, Human
agtcagggtatttgggatatctatcaccttgagtatttatcatttctatgtgttgggaacatttaaagtcctctcttctatctactttgaaatacacagttttgctagctatagtcaccttagtctgctatagaatattagaatttttatactttttctttaacaatatgtttgtgtacattgagcaacctcttttcattacctaccacccatgtacccttctcagattttggtgtctgtcattctactgtctacctccatgagatcatcttttaaacccactgaatgagttagaacataytatatttgtctttctagtcctggcttatttcacttaacatagtgacctccaggtccatccatgttgctgcaaatgacatgatttcattattttttaatggccaaatagtatcccattgtgtatatatgccacatatgtccattaatctgtttttgttttgttttgtttttaaaggcagggtctcactctgtcacccaggctggagtgcagtggtgcaatcatggctcactgcagtgagtagccgggaccacaagcataccccaccacacctggctaattaaaaaagaattttttttgtag

SEQ ID NO: 183679 - DNA, 601 bp, Human
tttctatgtgttgggaacatttaaagtcctctcttctatctactttgaaatacacagttttgctagctatagtcaccttagtctgctatagaatattagaatttttatactttttctttaacaatatgtttgtgtacattgagcaacctcttttcattacctaccacccatgtacccttctcagattttggtgtctgtcattctactgtctacctccatgagatcatcttttaaacccactgaatgagttagaacatactatatttgtctttctagtcctggcttatttcacttaacatartgacctccaggtccatccatgttgctgcaaatgacatgatttcattattttttaatggccaaatagtatcccattgtgtatatatgccacatatgtccattaatctgtttttgttttgttttgtttttaaaggcagggtctcactctgtcacccaggctggagtgcagtggtgcaatcatggctcactgcagtgagtagccgggaccacaagcataccccaccacacctggctaattaaaaaagaattttttttgtagaaatgggggtctcactatgttgcccaaactggtctcaaattc

SEQ ID NO: 183680 - DNA, 601 bp, Human
ttgttgaatagttcgcacatattttctcccattcagcagattgtctcttcaccctttttttagacaaatgctcactttaatcacagttctaaattaattattttcacgttaacatagatgttcccataaactgagaagaactgagctaagtattatacatttttaatggttaatatgatttgaaaattttttataaaaattgatcagaagctagttgaaattctcaccataaatataaaatattgattacaattgtttttcacagtaaattgagatctgagcttcctaaaaagctgtattatctaatatcataatagggatgactaaatacttgacaactactttctgaagactggcttaacaaaaagttactatttgaagaaacagctttcccttgtttatatttacaagaaaaaggctaacatttttgcagaactctcattttatcatgaagtgtggacagtcagaagcaggtggctgttggtggggtgcagtggctcacacctgtaatcccagcactttgggaggccaaggcaggcagatcacttgaggtcaggagttcaagaccagcctggccaacatggtgaaaccctgtctctac

SEQ ID NO: 183681 - DNA, 601 bp, Human
tgtggacagtcagaagcaggtggctgttggtggggtgcagtggctcacacctgtaatcccagcactttgggaggccaaggcaggcagatcacttgaggtcaggagttcaagaccagcctggccaacatggtgaaaccctgtctctactaaaaatacaaaaactagctgggtatggtggtgattgcctgtgatcccacctattcggggaggctgaggcatgagaatcacttgaacccgggaggcggaggttccagtgagctgagatcgtgccagcctgggtgataggcaagactccctctcaaaaaaaaaaaaaaaaaaaggtggatgcagtggtatcaagaaaaaagcatttcaaaacatttccacttttattaaaggttttgacaatgaagatatcactaaatgtcttcaaattctatttgttatagaataaccatctaaataggagacacatgccataatacagcaaccattttagtgtgtaaaatacttctgaactcttactatgaaaaaatttggctaaaatacaaaacatctttgcaataaaactgataatatagcttaagtagcttataagatttcagaaatgtcttatgaaaga

SEQ ID NO: 183682 - DNA, 601 bp, Human
ctctagtagcatttggatgcaaaggtttaactggtgctgatctggacaagccacagcagagactctgatttggagacttcatggacactcctgccagtgcgctgctgctattgctgctacttccagatgctggtagaaccatttaggtctcttgctttcagctgaaggactgcatatttgtaatggtttcctagtggcatctgaagaaagataaatctcttttggcgaggactgagattctgatttgatggcagccagagcagtctaccaaagtcactaaagcattacatttggatttagrttccttctctttcttttctactggggattttaccttcatttcttttcttttttttttttttaaatttctttaactttactttttctcatagaggagtctttgtcattatcctcactctcaccaaaatcagaatcatcctcagaatcttcaccagttgccaagtctggtttggtgttattagcactattgccatcactgccttccagaaaaattttcctctgttgtaccgcagctttagatgctgcttttcttttcccttgaataccaccattgtctttcttagtaatcttatccaaatct

SEQ ID NO: 183683 - DNA, 601 bp, Human
agccacagcagagactctgatttggagacttcatggacactcctgccagtgcgctgctgctattgctgctacttccagatgctggtagaaccatttaggtctcttgctttcagctgaaggactgcatatttgtaatggtttcctagtggcatctgaagaaagataaatctcttttggcgaggactgagattctgatttgatggcagccagagcagtctaccaaagtcactaaagcattacatttggatttaggttccttctctttcttttctactggggattttaccttcatttcttttcttttttttttttttaaatttctttaactttactttttctcatagaggagtctttgtcattatcctcactctcaccaaaatcagaatcatcctcagaatcttcaccagttgccaagtctggtttggtgttattagcactattgccatcactgccttccagaaaaattttcctctgttgtaccgcagctttagatgctgcttttcttttcccttgaataccaccattgtctttcttagtaatcttatccaaatctaaataatcactggctacactgcaattagagatacgaggagacttactc

SEQ ID NO: 183684 - DNA, 601 bp, Human
gagacttctgcacattagtggtgactgttgaaagttccttcactgataaagctagtgcaacttctaagtctctctggtagagcttatcatctaaagccatccttttttttttaggggttttctcttctagtgggatttcttctttctggagattgttcaaattaggttttggtttatcttgttttaactcctttgatgttctggattgcttgtttaaaggtacagttgcagaaacaaaatcatcatcactgtcagagtcgccaaactgtgagtaattgattggtttcttacatctcacagsctgcaccatggtccctttcagggcttgatatttacacttcccaagttcttgttggctgtagtggtggtttcagttcccacccaaaaccagacattggcgctctcccttcactcttcattgtttcctttgctgtgcagaagccttttttgttgttgttgttgtttaatataatcagttggctttaaatatgtggatttatttctgaattatctgttttattccattagtctatgtgtctgtcttataccagtaccatgctgttttggttactgtaaccttgtaatgtattttgaagtcagg

SEQ ID NO: 183685 - DNA, 601 bp, Human
catatgaattttaagattgcttcttctatttctgtgaaaaaagacattggtattttgatagccattgcattgaaaatgtagattgcttatggcagtatggtcattttaatgatgttaattcttattcttgagcatgggatgtctttccatttgtttgtgccctctttattttatctagtgttttgtagtttttatagctattgtaaaaagggaatgccttcttgatttctttctcagctagtttgttttattggtatatagaaacaggttttgtatgttgatttttttttaacactccctrcttcacagatggatgcatattgatttatgtgtgttgattttgtcctgcaactttactgaatttatttagcagaactaagttttttggtggagtctaggtttctctagatataaaatcatatcatcagcaaagagggacagtttgacttcctcttttctaatttggatgccttttctttttttccctcttgcctgattggtctggctaggacttgcagtactatgttgaataggagtgattaaagtgggcatcctcgtcttgttccagttcttagaagaaagggtttcaacttttccccat

SEQ ID NO: 183686 - DNA, 601 bp, Human
ttctactaatttggggtttggttctagttccttaaggtgcattgctagattgtttctttaaaatcttactacttttttgatgtaggcatttgttgatataaatttccctctttgcactgtttttgctgtatctcatagattttcggtatgttgtattagattttcatttgtttcaataatttttttgatttcttccttaatgtcttccttgacccagtggtcattcagaagcatgttgtttaacttctgtgtatttatatagtttccagagttcttcttaactctttgttttttttttttktttttgtttttgttttttgagacagagttttgcttagtcacccaggctggagtgcagtggcactatctcagcttactgcaacctccgcctcctgggttcaagcagttcttgtgcctcagcctcctgagtagctgggactacaggtgcacgccaccatgcctggctgatttgtattttagtaaaaacggggtttcagcatgctgcccaggctggtctcgagctcctgagctcaggcaatctgcccacctcggcctcccagagtgctaagattacaggcgcgagctatcccacctggcctat

SEQ ID NO: 183687 - DNA, 601 bp, Human
ctactaatttggggtttggttctagttccttaaggtgcattgctagattgtttctttaaaatcttactacttttttgatgtaggcatttgttgatataaatttccctctttgcactgtttttgctgtatctcatagattttcggtatgttgtattagattttcatttgtttcaataatttttttgatttcttccttaatgtcttccttgacccagtggtcattcagaagcatgttgtttaacttctgtgtatttatatagtttccagagttcttcttaactctttgttttttttttttttgtttgtttttgttttttgagacagagttttgcttagtcacccaggctggagtgcagtggcactatctcagcttactgcaacctccgcctcctgggttcaagcagttcttgtgcctcagcctcctgagtagctgggactacaggtgcacgccaccatgcctggctgatttgtattttagtaaaaacggggtttcagcatgctgcccaggctggtctcgagctcctgagctcaggcaatctgcccacctcggcctcccagagtgctaagattacaggcgcgagctatcccacctggcctatta

SEQ ID NO: 183688 - DNA, 601 bp, Human
gttgtattagattttcatttgtttcaataatttttttgatttcttccttaatgtcttccttgacccagtggtcattcagaagcatgttgtttaacttctgtgtatttatatagtttccagagttcttcttaactctttgttttttttttttttttttgtttttgttttttgagacagagttttgcttagtcacccaggctggagtgcagtggcactatctcagcttactgcaacctccgcctcctgggttcaagcagttcttgtgcctcagcctcctgagtagctgggactacaggtgcaygccaccatgcctggctgatttgtattttagtaaaaacggggtttcagcatgctgcccaggctggtctcgagctcctgagctcaggcaatctgcccacctcggcctcccagagtgctaagattacaggcgcgagctatcccacctggcctattattcttgatttctagttttattccattcttatctgaggagatacttgatacgatttcaatttttaaaaatttgttgacacttgttttgtgtcctaacttgatctatcctggagaatgttctatatgctgatgaaaagaatgtgttcac

SEQ ID NO: 183689 - DNA, 601 bp, Human
tgttttttttttttttttttgtttttgttttttgagacagagttttgcttagtcacccaggctggagtgcagtggcactatctcagcttactgcaacctccgcctcctgggttcaagcagttcttgtgcctcagcctcctgagtagctgggactacaggtgcacgccaccatgcctggctgatttgtattttagtaaaaacggggtttcagcatgctgcccaggctggtctcgagctcctgagctcaggcaatctgcccacctcggcctcccagagtgctaagattacaggcgcgagctaycccacctggcctattattcttgatttctagttttattccattcttatctgaggagatacttgatacgatttcaatttttaaaaatttgttgacacttgttttgtgtcctaacttgatctatcctggagaatgttctatatgctgatgaaaagaatgtgttcacagtggggtgctggtgcccactttaatcactcctatttaacacagtactgcaagtcctaaccagaccaatcaggcaagagggaaaaaaagaaaaggcatccaaattagaaaagaggaagtcaaactgtccccctttgc

SEQ ID NO: 183690 - DNA, 601 bp, Human
tttttttgtttttgttttttgagacagagttttgcttagtcacccaggctggagtgcagtggcactatctcagcttactgcaacctccgcctcctgggttcaagcagttcttgtgcctcagcctcctgagtagctgggactacaggtgcacgccaccatgcctggctgatttgtattttagtaaaaacggggtttcagcatgctgcccaggctggtctcgagctcctgagctcaggcaatctgcccacctcggcctcccagagtgctaagattacaggcgcgagctatcccacctggcctrttattcttgatttctagttttattccattcttatctgaggagatacttgatacgatttcaatttttaaaaatttgttgacacttgttttgtgtcctaacttgatctatcctggagaatgttctatatgctgatgaaaagaatgtgttcacagtggggtgctggtgcccactttaatcactcctatttaacacagtactgcaagtcctaaccagaccaatcaggcaagagggaaaaaaagaaaaggcatccaaattagaaaagaggaagtcaaactgtccccctttgctgatgatatgatc

SEQ ID NO: 183691 - DNA, 601 bp, Human
caagcagttcttgtgcctcagcctcctgagtagctgggactacaggtgcacgccaccatgcctggctgatttgtattttagtaaaaacggggtttcagcatgctgcccaggctggtctcgagctcctgagctcaggcaatctgcccacctcggcctcccagagtgctaagattacaggcgcgagctatcccacctggcctattattcttgatttctagttttattccattcttatctgaggagatacttgatacgatttcaatttttaaaaatttgttgacacttgttttgtgtcctaacwtgatctatcctggagaatgttctatatgctgatgaaaagaatgtgttcacagtggggtgctggtgcccactttaatcactcctatttaacacagtactgcaagtcctaaccagaccaatcaggcaagagggaaaaaaagaaaaggcatccaaattagaaaagaggaagtcaaactgtccccctttgctgatgatatgatcttatatttagaaaaacctagactccaccaaaaaacttagttctgctaaataaattcagtaaagttgcaggacaaaatcaacacacataaatcaatatgca

SEQ ID NO: 183692 - DNA, 601 bp, Human
acacttgttttgtgtcctaacttgatctatcctggagaatgttctatatgctgatgaaaagaatgtgttcacagtggggtgctggtgcccactttaatcactcctatttaacacagtactgcaagtcctaaccagaccaatcaggcaagagggaaaaaaagaaaaggcatccaaattagaaaagaggaagtcaaactgtccccctttgctgatgatatgatcttatatttagaaaaacctagactccaccaaaaaacttagttctgctaaataaattcagtaaagttgcaggacaaaatcmacacacataaatcaatatgcatccacctgtgaagtagggagtgttaagatgttagatgaaatgttctgtaaatgtctgttaggtctatttggtctgatatgcagtttaaatccagtgtggctttcttaatttttgtatctacatgatccatttaatgctcacagtggggtgctggtgtccctaactattatcgtagtggaatctatctctccttacagatctaataatacttgctttatatatctgggtgctacagtgttgggtgccttatatgtttggaattgttaaatcctcctcctg

SEQ ID NO: 183693 - DNA, 601 bp, Human
agtatctatcttatttatttaattgagatggagttttgctcttgttgcccagactggagtacaatggtgcggtcttggcttactgcaacctctgcctcctgggttcaagcgattctcctgcctcagcttcctgagtagctgggattacaggcacctgccaccacgcctggctaatttttgtattttcagtggagatggggtttcaccgtgtaggccagcctggtcttgaacccctgacctcaggtgatccacctgcctcagcctcccaaagtgctgggattgtaggtgagagccacaccgygcctggccaaattagtctgtatcttttaagtggaaagtttgatcagtttacattcagagttattgatgtgtgaaggcttatttctgtcattttattaactgatttatggctgttcagtatatcatctattccctctgtctcttattaattattattttggcttggtggttttctgtagttgtgagtctcttccttgtttgtgtttggtctatcagtggtttttatatttttttgtgtttttgtgatggtagatagtgttcttttgcttctggatgtaggactttcttaagcatttcttct

SEQ ID NO: 183694 - DNA, 601 bp, Human
gagaatcttttatctgcttaatctagtctgttgttgacactttccaacgtagtttgtatttcattcagtgaaatcttcagttctggaattcctgtttggtttttcctttttttttttttttttctttttgagatggagtctcgctctgtttcccaggctagagtgctatggcacgatctcagctaactgcaaccttcacctcccaggttcaagtgattcttctgcctcagcctccgaagtagctgggactacaggtgcctgccaccacacctggtgtggcggcaatttttttgtattcttygcagagacagggtttcactgtgttagccagtcttgtcttgaactcctgacctccagtgatttgccttccttggcctcccaaagtgctgggattgattacaggcatcagccattgtgcccaacctggttttcctttgtgatatctagttcctttagtaaatttctccctcatatcctgaattgtttttctgaattttttgtattgtttttcagaattctcttgtatctttttttttttgagacagagatggggttctgccaggttggtcttgaactcctggcctcaggtgatctgcctgcc

SEQ ID NO: 183695 - DNA, 601 bp, Human
aggtaagccaatctttgagcctccaggtgtcttgcttgggtaccaggagtggcacaggtgagccaggcaggttgacaggtttttaaacctctgtgcagtgggcatggtgtggatgatggcagtagcagtggtgggataacctttaggacccaagctgtctgtgctggtgtaggcagtggctgtgatggactggacaggccaatcccccaggcttgcaggtggcacgtgtggttagttgccagctgtggtggtagaggcaggttgaataggtccaatctcagaccctgggaggagtgcttargtgccaacagtggtggtctatgctaggtgatcgccaggcccacggattgcatgcttggttactgagagggatggagccaggttgtaggagcctgtccttaggctccccactggtacgtgcaggtactggctgtggtaggcaggggagagtgatcctcagactgccatcagaatgctctggtggcaacagcagggcttgtgctgtggccttgttaccgggaagggtggggttgctgtcagtgggagcattcataggcaggtggcttgcagggtcacatactttgcttgtgccttgctcctg

SEQ ID NO: 183696 - DNA, 601 bp, Human
cagctctccgctgatcctggttgagcaggctgtcttgcctcctcctcctttcttgctttcagtgcttctcgtcaccaccctgctgaattccagtgttctctcttaggtgatctatttgaagtgtgattatctcctcactattttgttcccttttcatggaagaggcaagtaccaaatgcatgtagtcagccatcttgaagttcctccctttcctgtttttttgatgaattgataattgaatactgtccatgactcagactgtaacaaagtgagaacatagaatcttacctattgtcctcaktgctacaggtattatatccttatatatgtggcgtcagcctcagtccccagatctttttgtacctaataagctaggaaccggtaatatcatggtcagcaagagagagaacatccttaacctaatatttgatcacttactctctttgggaatattttttcaatcttagtagtgatggtgtttctgaaagtccagtagttaaaggtagaattgaaagtgtttaccattcaaaagtacttcagtattttagtaaaaacatacattatagtaaacaatgataaatatgattttcagggaggaaaa

SEQ ID NO: 183697 - DNA, 601 bp, Human
gccagcatttggatatggaaacagggttgacgtggttctgaattcatgtccttataagatcatcagggctgaaagagtcacacatgaaactggagaccaaatctgtggatactgagtaaaacaagaaacagggataggttgtcccacctgttaaaggaggcgaactgcgactgattactgccaatgtggtgacatctaactccaaaggagactgacaatatatattttttactgtggttgccatgtcccttactcaaaattggtagctcttaggaagaagagaaaagatattaaaagtagrcagctaatggtttctgcatgtgaaggtacaaaaattataagaccattacaagagaatttcagattcagtgggatatatacagtatagtgctgtggtttgaatgtgtaccccaaagttaatgtgttggaaagttgatgcagtggtgttgggaggtggggcataatgggaggtgtttgggtcttggggacactacactcatgaatgaattaatgctgttattttaggaatgggatccatgactcttcccccactcacccccagatatttgatgccttcctccttgttgttatgtagtaggaa

SEQ ID NO: 183698 - DNA, 601 bp, Human
aggagctgggactgcaagtgtgcaccactatgcctgcctaatgttttattttttgtagagacagggtctcattatgttgcccaagcttgtctagaactcctaggctcaagcagtcctcccgctttggcctctcaaagtcttggaattacaagtttgagacactgcacccagccctttttattttttgattgttgtaggctatctcagatcttttctgagcctttgccttttcctggacatgcacagtgattttcttttgttttgttttttgtttgttttgttttgtttttttgagacggartctcactctttcgcccaggctggagtgcagtggcgcgatctcggcccactgcaagctccgcctcccgggttcacgccattctcctgcctcagcctcctgagtagctgggactacaggcgcccgccaccgcgcccaactaattttgtgtatttttattagagacggggtttcaccgtgttagccaggatggtctcgatctcctgaccttgtgatcctggcctcccaaagtgctgggattacaggcgtgagccaccacgcccagccgcacagtgattttctaaattccccatttatatggtt

SEQ ID NO: 183699 - DNA, 601 bp, Human
agtacaattgttgtctaggtggagagaagattcttgttgcttcctactctgctttctccccagaatcctctaatgttttttaaaggtttcattagagttagaagagttctttttctccttaattttgaggaactcaagaatagtaagttcattataactcaaagaaaatccattggagaccttttatttagcttttatcttcagttagcaaacatttatagaaggaatttgtgtttcagatcttttttgcgccctaatgtgacaactaatgtgacaacttctggcttccagccagaagatwttgggacttgaaattgggagatcgcttgctatggtttgaatgttctctccaaatctcatgttgaaatttgatccccatgttggaagtggggcctaatgggaggtgtttgggtcgtgggagtggatccctcataatatattactgccatccctcttgagtaagtgagttctcactatattagttcctgtgggagccagttgttaaaaagagcctgacacctccccattctctctcttgcttcatctctcgtcatgtgatctgtgtacatgctggcttctctttgccatctttcatgggtgg

SEQ ID NO: 183700 - DNA, 601 bp, Human
ccaaacacttttaaacaaccaggtctcatgagaattcatcatggaacaacagctatcacagaacaacaaggggggaaatctgtccccatgatccagtcacctcgcagtcacctccagtcacctggagattacaattcgacatgagatttgggtggatacacaaatccaaactgtatcaagggctaagtggtagagtcctaaaaccattttgtgattaaaaatgacataagctcatggaaggcatgagggggaattggaattaagtgcagcaattaatatgaaaaattctcaaatgttatgrttagtcataagttaaatacgtctgatatttcaggttaacacaggttttatgtatgtgaactcactcaagagggatggcagtaatgtattcatgaggtatccactcccacaacccaaacacctcccattaggccccatttccaacatggggatcaaatttcaacatgagatttggagagaaccttcaagtaagcatattcaggttttatgaatatgcttactagaagagatgacacaatctaaaccttattaataatgtaaagcatggggaaattatagtcagtgttctctgtgttagttt

SEQ ID NO: 183701 - DNA, 601 bp, Human
cacctcccattaggccccatttccaacatggggatcaaatttcaacatgagatttggagagaaccttcaagtaagcatattcaggttttatgaatatgcttactagaagagatgacacaatctaaaccttattaataatgtaaagcatggggaaattatagtcagtgttctctgtgttagtttgtgtatgttgttttggaaatatgtataacttggagtgacactgaaatataataattagattagaagggtaaggatcagaatgagggtttagtgtaatgaaaaacttagaaaataaaasagtttgtttagttcaaaaaattgaaattgtaattttgatactcaataaaagagacttttttatattatccagttcaattcccttattttgtagataaggaaatggagtttctgggaggttggtatgacaggccctgagtgatcactaacggcagagcagtggctacaacccaagtgtgtggctaggagggaaattaaatatattataagcatattttgcttataggggcagccaaacagggctgaaaactagggtaagataaacaagttgcctaaggtgaaatattgtacatttgtaatt

SEQ ID NO: 183702 - DNA, 601 bp, Human
tttaaagttgttttaaccttcacaatcctttgggggtttttctccagcttttgaaaaattggagaatctagaccatcttcctagtgccctccaccttatagcccatgtaaccaaatatgaaagcaatttagagataatagtaaaagggaaataaaggatagttcatatcttacacttttcctgtcatgcctctggtttctagtttgtgactcccattttacttttgagggtcaagttacctaggtcagttctctctccttaggtaaaggtcacgtttctttatttataacagttctttccmacagcacttacgagttagaggtggtttaggttgagtaaaatctctgcttccatgtctcaggaagataattcccagaaccttcgcaatggatgacaaatacatcagtaagctctcaccaaatattagtgcttccctttttggcatcaccctttgtgaggagaataagaccagaatccatagtctctatcttacaaccagtgggtgtaaatttcttgtgttgcttctctggatctgtcctgttttatacctgacacctggcctgtccccaggatcattattctttttgttctttacaccctt

SEQ ID NO: 183703 - DNA, 601 bp, Human
gagttcaaggcaggccgtttgtttttatattacatttaaaaataaattgtttatgtggagcattctgggagcttagagtttgtaaagtgaaaagatgggtggttttattgatccagcaagagttggctaaatgtatagctaggtttcttctgatattctttatagatacatatctaaataatatatacatattatctcttagttcatttctattaagataaatgaagatacagtcagccctccacatctctgggttctgcatccacagattcaaccaaccacaggtaaaaaatattctggaaaaaaaaatacactaattaaaatatacaaacaaaaaacccaatacagtgaaacaactattcacattttattatattaggtattacaagtaatctagagatgacttaacgtatacaggaggttgtgcataggttatgtacaagtactaggccattttcatataagagacttgagcatctctggattttggtattggggaggaggaaactggcactgatttcccttagattaaccttatccaacctgtggcctgcgggctgcatgcagcccaggatggctttgaatgcagcccaacacaaat

SEQ ID NO: 183704 - DNA, 601 bp, Human
tagcaataaaataaaattctaaagggaaatctcttgttcagttttagattctgttgtactttaacacataacttgacaatttcctgcttctgataagaatcagctaagtaacaatacccaagtgactaagtccggaagtttggttggggtacagatctcacagtaaacaatgaagggggagaaagtccccaattaactaacttggatatgctgtaagtaatgcaaaaagacaaggcaattcataagatgattttattctcttcagctttttaaaccctagtatctcatcaagtaattttarttggtaaatactcttactaatgaaacaactaatgaaacagatcccaccactgggaaaacaaaaaattacaggctagtcagaaataaaggctacttaaaaattaagtttttcttcttttttttttaaaaatagtgtaggtcaaataaaattccatctaattctgtccacttttggaaatatcactttgaaatcatccccaatatgagaaggcacaaaataatgacaaaggcaaaagtgctgtgcatagcacaattcattcacgtattcactcaacaaatgtttattgagtagttagtggag

SEQ ID NO: 183705 - DNA, 601 bp, Human
agaacagtgtcagagacttaaaacatgttagcttaagtgcaatatatcgacttagtttggatcccagttcacaccaactgtaagaatgtttaaaaaaatacacttagcaaaaattgaatattagcattagatgaaataagtgttgcaggagttcttaataaaggaacaccttttcaaaatgagcttttgaaaatatactgataatttaattttagtataattgacttgtttgcaatcttatatatttttatgcatcagaaacattgtgagtagaggttctatgtttcaccacactgccatwaggcaggaggaggggaggtccatggcttaacccatttgtgcctagtgttccattattggaacgctaagcttgtgagagttatttatatcatgctcaaggtcgtcaccaaggtctgatttttcacacaagaaattgcaacctccggcatatatgggttaaaaaggggaaaaggtcaggagcccttgatttgttcatttttgaggggtatgggtttttaatctgttagtgcttaatgaaatcatgggattccagttcccccaccaaaaattagggggatagctgaaccacaaggcataatat

SEQ ID NO: 183706 - DNA, 601 bp, Human
gaacaccttttcaaaatgagcttttgaaaatatactgataatttaattttagtataattgacttgtttgcaatcttatatatttttatgcatcagaaacattgtgagtagaggttctatgtttcaccacactgccattaggcaggaggaggggaggtccatggcttaacccatttgtgcctagtgttccattattggaacgctaagcttgtgagagttatttatatcatgctcaaggtcgtcaccaaggtctgatttttcacacaagaaattgcaacctccggcatatatgggttaaaaargggaaaaggtcaggagcccttgatttgttcatttttgaggggtatgggtttttaatctgttagtgcttaatgaaatcatgggattccagttcccccaccaaaaattagggggatagctgaaccacaaggcataatattgataaaattgggtgataggtataggattcattatactattctcttctgtaaatgttgaaaagtgccataattataaaacttaaaagcattatataaatttttagttattataccagtaatgtagtagaatgctatttttgtacattctggggaggactagat

SEQ ID NO: 183707 - DNA, 601 bp, Human
attattattattattattttttgatacagagtctcgctctgcggcccaggctggagtgcagtggcgcgatctcggctcactgcaagccccgcctcccgggttcaagccattctcctgcctcagcgtcccaagtagctgggactacaggcacccgccaccacgcctgtctaatttttttgtatttttagtagagacagggttttaccgtgttagccaggatggtctcgatctcctgaacttgtgattcacccgcctcagcctcctgaagtgctgggattacaggcatgagccaccgcgcccrgccactctttttgttttttaatgttactatttaaaactaaaaatctgtctatatacactcctcttgctacatcccacagagttcgatgtatagtttttaaaattatttacttctaagtattttcaaaattcaatatgatttcttcttagattcattagtttttagaagtttccaaacgtggtatttcaaaagttatctttttgttatggttgttggagaatatggttgtaggatatcagttacgtgaacattgagacattctttatggcctggcatttgattgctttttgtatgtgtttc

SEQ ID NO: 183708 - DNA, 601 bp, Human
ttattattattattttttgatacagagtctcgctctgcggcccaggctggagtgcagtggcgcgatctcggctcactgcaagccccgcctcccgggttcaagccattctcctgcctcagcgtcccaagtagctgggactacaggcacccgccaccacgcctgtctaatttttttgtatttttagtagagacagggttttaccgtgttagccaggatggtctcgatctcctgaacttgtgattcacccgcctcagcctcctgaagtgctgggattacaggcatgagccaccgcgcccggccrctctttttgttttttaatgttactatttaaaactaaaaatctgtctatatacactcctcttgctacatcccacagagttcgatgtatagtttttaaaattatttacttctaagtattttcaaaattcaatatgatttcttcttagattcattagtttttagaagtttccaaacgtggtatttcaaaagttatctttttgttatggttgttggagaatatggttgtaggatatcagttacgtgaacattgagacattctttatggcctggcatttgattgctttttgtatgtgtttcattt

SEQ ID NO: 183709 - DNA, 601 bp, Human
tttaaaattatttacttctaagtattttcaaaattcaatatgatttcttcttagattcattagtttttagaagtttccaaacgtggtatttcaaaagttatctttttgttatggttgttggagaatatggttgtaggatatcagttacgtgaacattgagacattctttatggcctggcatttgattgctttttgtatgtgtttcatttgttttctatttggaagcaatattctgtatatgtctattaaatcagacttgctggttgtgatatgagttcttctctagccttaataatgtttktatttatttatttatttttttgagaccaagtctggctgtgtcacccaggcctggagtgcagtggcacgatcttggctaactgcaacctccgcctcccaggttcaagggattctcctgcctcagcctcctgagtagctgggattccaagtgtgcgccaccatacctagctaatttttgtatttttagtagagatggggtttcaccatgttggccaggctggtcttgcattcctgacctcaggtgatccaccagcctcggcctcccgaagtgctgggattacaggtgtgtgccaccaggcct

SEQ ID NO: 183710 - DNA, 601 bp, Human
taagtattttcaaaattcaatatgatttcttcttagattcattagtttttagaagtttccaaacgtggtatttcaaaagttatctttttgttatggttgttggagaatatggttgtaggatatcagttacgtgaacattgagacattctttatggcctggcatttgattgctttttgtatgtgtttcatttgttttctatttggaagcaatattctgtatatgtctattaaatcagacttgctggttgtgatatgagttcttctctagccttaataatgtttttatttatttatttatttktttgagaccaagtctggctgtgtcacccaggcctggagtgcagtggcacgatcttggctaactgcaacctccgcctcccaggttcaagggattctcctgcctcagcctcctgagtagctgggattccaagtgtgcgccaccatacctagctaatttttgtatttttagtagagatggggtttcaccatgttggccaggctggtcttgcattcctgacctcaggtgatccaccagcctcggcctcccgaagtgctgggattacaggtgtgtgccaccaggcctggccgtttttatttcttt

SEQ ID NO: 183711 - DNA, 601 bp, Human
ctggttgtgatatgagttcttctctagccttaataatgtttttatttatttatttatttttttgagaccaagtctggctgtgtcacccaggcctggagtgcagtggcacgatcttggctaactgcaacctccgcctcccaggttcaagggattctcctgcctcagcctcctgagtagctgggattccaagtgtgcgccaccatacctagctaatttttgtatttttagtagagatggggtttcaccatgttggccaggctggtcttgcattcctgacctcaggtgatccaccagcctcggyctcccgaagtgctgggattacaggtgtgtgccaccaggcctggccgtttttatttctttgttttgttactctgataatatgttaaaaattgtcctctgtggtaatgggtttgtcaagatctccttgtggttctgtcaacatattttgaaactatcttgttactaggtacatagaagtttagatattgtaattgagtagaacatttttcattgggtagtgaactttattgctagtaatggtttttgccctttaagttttgtttgatactaatagagcaacaccagtctctttattgattgg

SEQ ID NO: 183712 - DNA, 601 bp, Human
tacaggtgtgtgccaccaggcctggccgtttttatttctttgttttgttactctgataatatgttaaaaattgtcctctgtggtaatgggtttgtcaagatctccttgtggttctgtcaacatattttgaaactatcttgttactaggtacatagaagtttagatattgtaattgagtagaacatttttcattgggtagtgaactttattgctagtaatggtttttgccctttaagttttgtttgatactaatagagcaacaccagtctctttattgattggttgattgattgattgagasagattctccctctgtcgccaggctggagtgcagtggtgcgatatcggctcactgcaaccttcgcctcccaggttcaagctattcccatgcctcagcctcctgagtagctgggactacgggtgtgcaccatcacgcccagctaatttttgtattttagtacagatggggtttcaccatgttggccaagctggtctcgaactcaacctcaagtgatctgcctgccttggcctcccaaagtgctgggattacaggcatgagccactgcgcacggccatacagtcacagtctctttaaattact

SEQ ID NO: 183713 - DNA, 601 bp, Human
ctaggtaagtttgagtcatagcaggtggtcaacccagaagaccagtgaaggtcataagtgttaacgtgcagtttctgtaaatctaggcccatgctccaagtcaaggcagagtgataccaatgagtagaactaactctcaccttctagcaggggctttttgaaccatgaatcactgttggagtttagacttataggcagaattgcctctttggcaccaaggcaacttatgtacatggcacataatgaattttaacatctaatgaccttatgttttgaacttcacttaaaaccctccattttrtttttctatttgataagagaactgtggatcattactgtacattagcacctacagagctcttttctattttgtttctctttttccctttatttctccaaagtttttgttttttatttttactggccctccattagggcctgagacagtggagcccacttcacactggacttggctaagctgataggaaggaaatatgcatgggcaaggaatggcctcttctttaaaaaaaaaaaaaaaaaaaaaaaattaaactctccttagctgacaggaaggaattgggagggacagaatttcattttt

SEQ ID NO: 183714 - DNA, 601 bp, Human
gccctccattagggcctgagacagtggagcccacttcacactggacttggctaagctgataggaaggaaatatgcatgggcaaggaatggcctcttctttaaaaaaaaaaaaaaaaaaaaaaaattaaactctccttagctgacaggaaggaattgggagggacagaatttcatttttggtgttcaggcaaacatgctatttgcgtaattgttctttgtctaggtgtagaagaaaagtacaatttctccttgtgcagacagtttgggagcaatatagcatgactgacaaatatgaaatacygttgactcactactttacattagtttttatttatttattttttatggttttgtagagatggagtcttgctctgttgtccaggccaaacttgaactcctgggctcaagcaaccctcccacctcagcttcctgagtagctgggactacagatgcttactaccatacccagcttagtttttattcttattcaacattattgttattctagaatgttcttctaattatcaataaaatacaaatatttaatgtttttaaccattgtaaaactgcaaaaactaaaatatagtacaatttggagtaa

SEQ ID NO: 183715 - DNA, 601 bp, Human
tttaaatacttttgggttttgtgattaagaccattatttttagtttttcaatggaagacaaatcagaaagagattttccttcagtagcagaagagaccagggttagaatcagcaatactggttttgtaaatactggaatttatttaaagcatgatgattagagatattgggagaaattaaggtaatttctgtcaagaaagtatgcctcatagtgatacgtgcacagggtactaagacatacccagttagacttttttgttccattttaagaggacactggtatcttgggattagagtgaaygtgacagtaattaacaaaatatagtgaaaaaactattatcatagagcaaaggggggaagtagtccagtattaggtattactgtatgtaaatctaaaatcccatttaaatataatttttatttgttaatactccaggatgcattccgtactacagtattctgatgttattgagacagttttatcaagattttatctctatttaagtcttaggaaatctctgttaactttattactgtattacagttattgctacctttattccagggtgcttggaaacattgttttgagttagtgatctgt

SEQ ID NO: 183716 - DNA, 601 bp, Human
tttttagtttttcaatggaagacaaatcagaaagagattttccttcagtagcagaagagaccagggttagaatcagcaatactggttttgtaaatactggaatttatttaaagcatgatgattagagatattgggagaaattaaggtaatttctgtcaagaaagtatgcctcatagtgatacgtgcacagggtactaagacatacccagttagacttttttgttccattttaagaggacactggtatcttgggattagagtgaatgtgacagtaattaacaaaatatagtgaaaaaactawtatcatagagcaaaggggggaagtagtccagtattaggtattactgtatgtaaatctaaaatcccatttaaatataatttttatttgttaatactccaggatgcattccgtactacagtattctgatgttattgagacagttttatcaagattttatctctatttaagtcttaggaaatctctgttaactttattactgtattacagttattgctacctttattccagggtgcttggaaacattgttttgagttagtgatctgtagttaacctgtaaagagatataagtccagcttttac

SEQ ID NO: 183717 - DNA, 601 bp, Human
gcagaagagaccagggttagaatcagcaatactggttttgtaaatactggaatttatttaaagcatgatgattagagatattgggagaaattaaggtaatttctgtcaagaaagtatgcctcatagtgatacgtgcacagggtactaagacatacccagttagacttttttgttccattttaagaggacactggtatcttgggattagagtgaatgtgacagtaattaacaaaatatagtgaaaaaactattatcatagagcaaaggggggaagtagtccagtattaggtattactgtatrtaaatctaaaatcccatttaaatataatttttatttgttaatactccaggatgcattccgtactacagtattctgatgttattgagacagttttatcaagattttatctctatttaagtcttaggaaatctctgttaactttattactgtattacagttattgctacctttattccagggtgcttggaaacattgttttgagttagtgatctgtagttaacctgtaaagagatataagtccagcttttacattagataaacttttcccttttctcataatttctgtatccctttttggta

SEQ ID NO: 183718 - DNA, 601 bp, Human
atttggtgggtttatgtaagctactacattatgtgtatgtaatataaaccaaatgattggtgatatatccaaaaattgtagtttcgacttggtaagtaaaataattttaaaatgttttagcatgaatgtttaacaagtagagaaaggatataaatggtttgagtttgatgcagttctaattcagtaattttcaacttagcacagacatttgaagtgaattaaataaattgtaaacattaaaaacattagataaaaaggattaggtgaacaaatttcttcatcctcaactttggaattaacttttttttttttaactactttttgcttactttttttttagcggaacagtgtaaagataatctttaataaaaacactagtaaagagaatatttttatttaattaatgtagtattgctagaaattgatgttttgattaatgtgagatttgatattttgatatgagttatgagaacagctatacaaccaagaggaaaatagtgaattcttgactgttattgagtttgggtcatgaagtaaaactaataataatttataagagcctaattctgctgattctgctagtggcctccttatgatctta

SEQ ID NO: 183719 - DNA, 601 bp, Human
ctacattatgtgtatgtaatataaaccaaatgattggtgatatatccaaaaattgtagtttcgacttggtaagtaaaataattttaaaatgttttagcatgaatgtttaacaagtagagaaaggatataaatggtttgagtttgatgcagttctaattcagtaattttcaacttagcacagacatttgaagtgaattaaataaattgtaaacattaaaaacattagataaaaaggattaggtgaacaaatttcttcatcctcaactttggaattaacttttttttttttaactactttttrcttactttttttttagcggaacagtgtaaagataatctttaataaaaacactagtaaagagaatatttttatttaattaatgtagtattgctagaaattgatgttttgattaatgtgagatttgatattttgatatgagttatgagaacagctatacaaccaagaggaaaatagtgaattcttgactgttattgagtttgggtcatgaagtaaaactaataataatttataagagcctaattctgctgattctgctagtggcctccttatgatcttatagtgaacttaatttgatctcct

SEQ ID NO: 183720 - DNA, 601 bp, Human
ccttatgatcttatagtgaacttaatttgatctccttgaacatttgcttggtgtttctagaaaaatgaacagaggaattattatagaagtctcttatgcacaacaagcctaaggaaacaaagagtaacctgacaagagattccagagaaaagggcaaaagagaaaaggaataagcactttgttgaaaaagaatgttgtaattgtaatgtgaagactcatttgttagctttagtgactccctctggaatatgtctcttctgtttactttttggggagttactaaaatttcagatctttgcatttttcattttttgggtaagttttacctttgaagaacttacttatttgctcattcatttgtttatcaacacattcttattgagagcctactccaagccaggcagaaatcatagggtgaaaaactaatactaactctagcaaatcttacattctggtggagaggtatatgatgattgttattaataatacagtggatttcatatctagatttagtcataagtgatgttgaccataaagcaaccagaaatgacataaaaagaatccattgtggctaggcgtggcagctcaagcctgtaatctc

SEQ ID NO: 183721 - DNA, 601 bp, Human
taagtgatgttgaccataaagcaaccagaaatgacataaaaagaatccattgtggctaggcgtggcagctcaagcctgtaatctcagcactttgggaggccgaagtgggtggatcacttgaggtcaggagtttgagaccagcctggtcaacatggtgaaacactgtctctactaaaaatgcaaacattagctgggcgtggtggcgggtgcctgtaatcccagctacttgggaagctgaggcaggagaatcacttgaaaccagaggtagaggctgcagtgagccaagattgtgccactgcaygccagcctgggcaacagagcgagactccatctcaaaaaaaaaaaaaaaaaaagaatccattgtatcattgatacagtgattcaatatatatcatcaatacagtggtaaaattattctttttgctgagtcttaggaagttgatagttaatgcatttgcagactgggagtcaggatttgaaatttgtaaccaaaatgtttctttgctcaatccctgcagcaaccccagatttttatttattttgccaggcagtttgtcagagtagagacaggctattcatctacttcctacctgaatgggct

SEQ ID NO: 183722 - DNA, 601 bp, Human
ttgggaagctgaggcaggagaatcacttgaaaccagaggtagaggctgcagtgagccaagattgtgccactgcatgccagcctgggcaacagagcgagactccatctcaaaaaaaaaaaaaaaaaaagaatccattgtatcattgatacagtgattcaatatatatcatcaatacagtggtaaaattattctttttgctgagtcttaggaagttgatagttaatgcatttgcagactgggagtcaggatttgaaatttgtaaccaaaatgtttctttgctcaatccctgcagcaaccccaratttttatttattttgccaggcagtttgtcagagtagagacaggctattcatctacttcctacctgaatgggcttataaagtagaagaaacagagtattatgtgctttttgtgtggcagccagagtatctttgaaaacaaaaattgtacaatgttttaaataaaacaataaaaaataatttatttcatgtagatgaagtgaacagatggacatataaaaatttaaataaaaacctgtaatggaaggaataccatatatttatatgtggtatttcttagttctgttcccagacatatcact

SEQ ID NO: 183723 - DNA, 601 bp, Human
ctgaatgggcttataaagtagaagaaacagagtattatgtgctttttgtgtggcagccagagtatctttgaaaacaaaaattgtacaatgttttaaataaaacaataaaaaataatttatttcatgtagatgaagtgaacagatggacatataaaaatttaaataaaaacctgtaatggaaggaataccatatatttatatgtggtatttcttagttctgttcccagacatatcacttacaagccatgtggcctgcaaaatataactgaacttctctgattttctgttccttgtaaaagasagagttgggcaagactaaatgatcctggaaagtcccttctaactctaaaagtcttacatcctggtaaacaactaagcagtcttaggtgtgtcataggaattgagcgaaagcaatgagtgagaaattggttttgaagaagtagaaacatgggaacagaattgtagttgactaaggaattagaagaaacagaaaaactttctttggccccattctcaacacttactcagtgatacaggtgaaggaaaaacaacatgcttaaactaaagaatactgaaatcactaataagtacactgggttca

SEQ ID NO: 183724 - DNA, 601 bp, Human
atgggaacagaattgtagttgactaaggaattagaagaaacagaaaaactttctttggccccattctcaacacttactcagtgatacaggtgaaggaaaaacaacatgcttaaactaaagaatactgaaatcactaataagtacactgggttcagaaatatatttggaaactaaaatcaagatagaaataaacaagatgaataggaacagacagtattgtaaaactctacattaaaattttaaaaggaattgtatagattggtgagaacctagcctggcagcagcttacatgagtaaaaamcttagtaagagctgctgtggtaatgtaggtactaaaactctcaacacagtccatggtgacattgattcgagtctgagaggtgcttaggtggaggtatgctcccttatgtgtgtgttggccaaataaaacatgatgtaattaatccacttttgatagatattctttaacaatggtattgagaaacttggatgcttccaaatgctggcatccagtatatcaaggatttgcaaaccaggtcacataaggaatagttatgggtacaaagacttgcctcagggagcacagctgtcatatgaagaa

SEQ ID NO: 183725 - DNA, 601 bp, Human
tcatatgaagaaggaatgttcacagtgcttaaccaggttcttaagaattcttgtggagtttataatgcattgttctggttaagaaacagtgctataggaaaagagaagtaaagaccagtgggtggtagtgagggaaagatcagaaattatctttacactttttttttttaatttaagcaaagctaacaataaaaaactgcctcagaatggtacacttcctcagtgcttagatctgagcagtttccttccaactacagccaggtccagctatataatgcaagaataaagatttaagtaatctttttttttttcttgagacagtcttgctctgccacccaggctggagtgcactggtgccatctcagctcactgccacttctgtctctcaagttcaaacgattctcgtccctcagcctcccaagcagctgggactacaggtgcatgccaccacacctggctaattttttttgtatttttagtagagatggggtttccccatgttggccaggcatgtctcgaactcctggcctcaagttatctgcctgcctcagcctcccaaagtgctgggattacatgcctgagccaccttgcccggccaagt

SEQ ID NO: 183726 - DNA, 601 bp, Human
ctgccacccaggctggagtgcactggtgccatctcagctcactgccacttctgtctctcaagttcaaacgattctcgtccctcagcctcccaagcagctgggactacaggtgcatgccaccacacctggctaattttttttgtatttttagtagagatggggtttccccatgttggccaggcatgtctcgaactcctggcctcaagttatctgcctgcctcagcctcccaaagtgctgggattacatgcctgagccaccttgcccggccaagtttaagtaattttgaaaattaaacaccakaagcactagaaggtaggaaaatagtaaccaccattgatggagttcctgctatgtactgtaagtgctttacacatagacttctaaaaattttttacaagcattttatgaatttatttttttacacaccaccattgtacaaacaaggatactggaggtttttttttttaacttttagggttgggggtacatgtgaaggtttgttacataggtaaatacatgtcatgggggtttgctgttcatattatttctttctttcttttttctgagaccaagtctcactctgttgcccaggttggagtg

SEQ ID NO: 183727 - DNA, 601 bp, Human
ctcccaaagtgctgggattacaggtgtgcaccaccgcgcctgtcctgttgtacatattatttcatcacccaggtattaagcccagtatccaatcattatcttttctcctactctcctttgcccacccttccccttcaagggggaagcatttggttttctgttcctgtgttagaaataaaaaagattaaataacttgaccaagatcacacaaccagtagcggaactaaaatttaaacttgtatctcctattaaagttctcatagtagatattttattactaaagagtagagaattggagtcrgttaagcaatgggttagaagggtttgatgcaaaaaggactagtcaaggttaagaagattgtggtgaactgtgaggtcaggaagtgctatgacctgagtgtttgtgtcccccaaaactccgcatgatcttggctcactgcaacctccgcctcctgggttcaaatgattctcatgccacagccacccaagtagctggaattacaggtgtgcgccaccatgactggctaatttttgtatttttagtactgacagggtttcgcatgttggccaggctggtcttgaactcctggcctcaggtgat

SEQ ID NO: 183728 - DNA, 601 bp, Human
ctattaaagttctcatagtagatattttattactaaagagtagagaattggagtcggttaagcaatgggttagaagggtttgatgcaaaaaggactagtcaaggttaagaagattgtggtgaactgtgaggtcaggaagtgctatgacctgagtgtttgtgtcccccaaaactccgcatgatcttggctcactgcaacctccgcctcctgggttcaaatgattctcatgccacagccacccaagtagctggaattacaggtgtgcgccaccatgactggctaatttttgtatttttagtastgacagggtttcgcatgttggccaggctggtcttgaactcctggcctcaggtgatctgcctgcctcggcctcccaaaatgctgggattacagtgtgagcccccgtgctgggccattctttttttgacaatgtgtaattagtcttagacataatgtttttaaatataagcttccagagagaatcattctaggttttactgatcttttgcatttcttttaccatacaaaactgtgcaaattctgaattttcaaaaatatcatttgaaacttagtctgtattttcaggtttaacttttttttt

SEQ ID NO: 183729 - DNA, 601 bp, Human
ttccaaaatgtttccatcaccccaaaaatagtcactctcaatcagtccctggcaattactaatctgctttctgtctctatggatttacctattctggataatttatataaatggaatcatacagtatgtgaccttttgtgtctggcttctttcatttagtataatatcttcaagttttgtccatgttgtagcatatatcagtaattcatcccttttatgtctaaataacttttttttttttttttttctgagacagagtctcgccctgtcacacaggctggagtgcagtgacgtgatctcrgctcactgcaacctctgcctcttgggttcaagtgattctcctgcctcagcctcccaagtagctgggattacaggcacatgccaccacgcctggctaatttgtgtatttttagtagagatggggtttcaccatgttggccaggctggtcacgaactccttacctcaagtcatctgcccgcctcggcctcccaaagtgctgggattacagacgtgagccactgtgcccggctggctgaataactattatatgtatatatcacattttgtttatccactcatctgttcatagatggacatttg

SEQ ID NO: 183730 - DNA, 601 bp, Human
gctgggattacaggcacatgccaccacgcctggctaatttgtgtatttttagtagagatggggtttcaccatgttggccaggctggtcacgaactccttacctcaagtcatctgcccgcctcggcctcccaaagtgctgggattacagacgtgagccactgtgcccggctggctgaataactattatatgtatatatcacattttgtttatccactcatctgttcatagatggacatttgaattgtttccatattttggttattgtgaacagcgttgtgataaacattcatgtacagttaytgtttgaatatctattttcagttaagtgtatacctaaaagtggaattgctggatcgtatggtaattctttgctttttgagaaaccatctgtttttcacatggtggcaccattttacattccaaccagtattgtaagggggattccagtttctccatatccttgccaacacctattttctttctttctttgcttatatccattgtagttggtgtgaggtagggtcattgtggttttgatttacatttctctaatgactaatgatattgaggatcttttcatgtgcctgttggccattcgta

SEQ ID NO: 183731 - DNA, 601 bp, Human
tggtaattctttgctttttgagaaaccatctgtttttcacatggtggcaccattttacattccaaccagtattgtaagggggattccagtttctccatatccttgccaacacctattttctttctttctttgcttatatccattgtagttggtgtgaggtagggtcattgtggttttgatttacatttctctaatgactaatgatattgaggatcttttcatgtgcctgttggccattcgtataccgtagttggaacaatctttattcaagtcctttgcccatttttgaagtagttgtttytgttgttgggttctaagagttgtttatatgttctggatactagacccttatcagaattatgatttgcaaatattctcttctaattctgtaggttgtcttttcacttcttgatagtgtgttatacacaaatgttttcaattttaatgaagtataatggatcttgtttttttggttgcttatgcttttagtgtcagtatctaagaatccattgctaaatccaaggtcacagatatttgctcctatgttttcttctaagagttttatagttttagctctgacatttggtcatttcgagttaat

SEQ ID NO: 183732 - DNA, 601 bp, Human
ttatgatttgcaaatattctcttctaattctgtaggttgtcttttcacttcttgatagtgtgttatacacaaatgttttcaattttaatgaagtataatggatcttgtttttttggttgcttatgcttttagtgtcagtatctaagaatccattgctaaatccaaggtcacagatatttgctcctatgttttcttctaagagttttatagttttagctctgacatttggtcatttcgagttaatttttatatatgatgtgaagttggagtccagtttcattcttttgtttatagatatccrtttgttccagtaccctttgttgaagaaactattctttcttcccattgagtgatcttggcaccattgatgaaaatcaattgaccatagatccatgggtttattttaggactctcgattctatttcattgctgtatatgtctgtccttattccaataccacactgttttgattactgtggctttgtagtaagttttgaaatcagaaagggagagtcctcccacttgattttcctttttcaagattgttttggttgcttagggtccaccttgcagttctgtgtgaatattagaatcagccttt

SEQ ID NO: 183733 - DNA, 601 bp, Human
accttgcagttctgtgtgaatattagaatcagccttttcatttctgtggaaaaaacaaaatggttgaactttagtaagaattgcattgaatctgtggattgttttggatactgttgccatcttacacagaatatctttccgtttatttaagtcttctttaatttctttcagcggtgttttgcagtgtttagtatatgagtctgatacttggttaaaattattcctatgtatcttattcttcttaatgctgttataaatggattattttcttaattttgtctttgaattgttcattgttaaygtatagaaatacaactgattttgtgtgttgatcttgcagctttgctgaatttttttattctcactctgtgtgagtgtgtgggtgtgtgtgtattctttaggattttctatttataagatcatgtcatctgtggatactttttcccctccctaattgctttgactagcacttccaatacaatgttaaataaaagtggtggaaggagagcatccttgttcttgtcttgttcctgttcttacggtggaaaactttgtctttcaccattgagtgtgatgtcagctccacagttttttgcagatg

SEQ ID NO: 183734 - DNA, 601 bp, Human
gatacttggttaaaattattcctatgtatcttattcttcttaatgctgttataaatggattattttcttaattttgtctttgaattgttcattgttaacgtatagaaatacaactgattttgtgtgttgatcttgcagctttgctgaatttttttattctcactctgtgtgagtgtgtgggtgtgtgtgtattctttaggattttctatttataagatcatgtcatctgtggatactttttcccctccctaattgctttgactagcacttccaatacaatgttaaataaaagtggtggaaggagagcatccttgttcttgtcttgttcctgttcttacggtggaaaactttgtctttcaccattgagtgtgatgtcagctccacagttttttgcagatgccctttattatattgaggaaattcccttctaatcctagtttgctgagcattgttatcatgaaacggttttggattttgtccaatactttttctgcatcaattgagatagtcatttgttttttcccctttgttttactaatatgaggtgtcttatattgattttcatatgttgaaccacccttgcataaatcccacttactca

SEQ ID NO: 183735 - DNA, 601 bp, Human
ttctccctcaattctgtcattttttgctttatatgccttgaggctctcttgttaggtatgcatatatttgtaactgttacacttcttgatggactgattcttttatcaatatatgctgtcctttgtctttaagtctgtgttgtgtgatatatatttatttatttttagacagtctcgctctgttgcccaggctggagtgcagtggcgtgacctcggctcactgcaacctccgcctcccaggttcaagcgattcttctgtctcagcctcctgagtagctgggattacaggcacctgacatcrtgcctaactaatttttgtatttttggtagagacggagtttcaccatgttggccaggctagtcttgaactcctgagctcaagtgatccacccgcctcggcttcctaaagtgcagggattacaggcatgagacaccgcgccgggcctatgctgtgtgatatttatatagccaccccactctcttagttatcctttacatgggatatcttcttccatcctttcattttcaaacctatttgcatctttgtttggatctaaagtgagtgtcttgcagataacagttgcatcatgttatttttaat

SEQ ID NO: 183736 - DNA, 601 bp, Human
gcctctgtgactggactattttctctaatatattgttttattacccttcttgtttctctttctgtatttttgtttttccttagtggttaccctggggattaacatcttaggtttttaacaatcatgtttgaattaataccaacttagtttcagtactatgcataactctgctcctttgcagctccatctttgtatattacatctttacacattaaaatatatgcccattaacctagaattgaaatttttgttttatgcatttgtattttaaattgtgtaggaaagaaaaggagaatttacaaaaaaaaactgcaatactactgacttttatatttacttatgtagctacctttaccattgttctttatttcttcatatgacttcaaattactgtccagtgttttttcattttagcctggaggattctctttagcacttcttttttgagacagtcttgctctgtctcccaggctggagtacagtggtgcggtcttggctcactacaacctccacctcccgggttcaagcaattctcctgcctcagcttcccgagtagctgggactacaagcgtgtgccaccacgcccggctaattttttgta

SEQ ID NO: 183737 - DNA, 601 bp, Human
atatgacttcaaattactgtccagtgttttttcattttagcctggaggattctctttagcacttcttttttgagacagtcttgctctgtctcccaggctggagtacagtggtgcggtcttggctcactacaacctccacctcccgggttcaagcaattctcctgcctcagcttcccgagtagctgggactacaagcgtgtgccaccacgcccggctaattttttgtatttttagtagagacggggtttcaccatgttggccaggctggtttcgatctcctgacctcgtgatccacccacckctgtctcccaaagtgctgggattacaggtgtgagcccctgtgcccagcctctctttagcatttcttagcacaggtctggtagtgatgaattcctttagtttttgtttatctgggaatgtcttatgttctccttcatttttgaaggacagttttgctaaatatagaattctttgttggctcttttgctttcagcatcagatcagattctatcccctccccagggcttattactgctgcttattgtgagtggttgttgtttgcttgtttagtgactttactaaactacttttataagctcta

SEQ ID NO: 183738 - DNA, 601 bp, Human
cagggagctgccagacaagttgaaacccacaatcacaattgtttaagaatgagatctgtattgcttcctctggcattaggagtgcaggttactgtccacacagccatcactgacttggggtgtgggggatggtgggcaggcaacttaggatgcgatagcactctctttaccacaaagcagcaacttctttctttaccaagccttgccctagattttataagttttttttttttactagattccagagttctgcaaaagttgagtctgacagtatttaccagctcattaattgcattcattrctttttgcagggacagtgccttggagttccttactctactatttttggtggtatcaccccaaatgtagggatttctccgaaggctatcattaaccggaagtaagaaaattaggaaggaagaagttgatttaggggtatagactggattatttttatttggacatgagtgttgggtttgaggtactgatggcacaatctgtgggtgtctagtgacagttggaattgtaatgcctgaattccagaaaggtcttagagctgcaaagagatctgggaaccttctgcacagaaattatagaaaat

SEQ ID NO: 183739 - DNA, 601 bp, Human
gtgggctgtgatcttggttgctgcatatagagtttgagaaggctgaggactttaaaagttactgatttgacagtaaggagagatgacataagaatggtattcataagaatggttttaattgagtagttttgttagaatgttggagacaaaggatcagataataaagagttgggagtgtgagtggtgaaaaagtcgagggaaaaggaaaaacaactttttttttttttttttttttttttgagacagagtcttgccctgtcgccaggctggagtatagtgacgtgatcttggctcactgcarcctccgcctgccaggttcaaacgattctcctgcctcagcctcctgagtagctgggactacaggtgcacaccactgcacccagctaatttttgtatttttagtagagacggggtttcaccatgtttggccaggatggtctcgatctcttgagcttgtgatctgcccgcctcagcctcccagaatgctgggattactggcatgagccaccgtgcccagccgggaaagacaacttttaaaagagtggtatagtttattctataggaaaattggaccagttagagaaaaaataaataaattacc

SEQ ID NO: 183740 - DNA, 601 bp, Human
cacctcttttgatcctccttctccggtacactctgcggagcatccgttactgcaatccttaaagaagaattaaaccaccattaagtaaatgcaggtgggtaagcgggacccggggtaacctacgtgacactcaccatgataccgtgcgctcctctccaggacccaggcaaacacaaaaaaggaggctcagacaaccaagcacccaggcccgaacctccaacaagcgtgtcttgggagcgctgccctgcacttcccaccctgccggggtcgcggcggtttttgtcctcctccgccggctcarggaagactggttaaattccaggtcagccctacagagccagggttcgccggcaaagaacaaaaaaacaattgtctcccttatatccgagcaaatagtctagactggggtgttaagccatttatagaaaaatctccagggcgcgctcagcctcgtggtcttgtcaatcacagacgcacaatagcaagcctgcaaagggaacggggacgggcgtgaaccatttcctccaccagcagggtcctccgatgccgcagcatccaccccacaccttaaacctcatggtattagtgggcaatttaaaag

SEQ ID NO: 183741 - DNA, 601 bp, Human
ggctttttttcctctaagagtggaattttaaaagtctggcaacacaacctaggaactgggtaacccacacagtgaaaatttccccgaatctcaacaagaaatggatttattcagttgaacgttgctttagacactaagcctctggcaagcaacttaccttaaaagtccccaccacctcttttgatcctccttctccggtacactctgcggagcatccgttactgcaatccttaaagaagaattaaaccaccattaagtaaatgcaggtgggtaagcgggacccggggtaacctacgtgacrctcaccatgataccgtgcgctcctctccaggacccaggcaaacacaaaaaaggaggctcagacaaccaagcacccaggcccgaacctccaacaagcgtgtcttgggagcgctgccctgcacttcccaccctgccggggtcgcggcggtttttgtcctcctccgccggctcagggaagactggttaaattccaggtcagccctacagagccagggttcgccggcaaagaacaaaaaaacaattgtctcccttatatccgagcaaatagtctagactggggtgttaagccatttatagaaaa

SEQ ID NO: 183742 - DNA, 601 bp, Human
ctctgtctcaaaaaaaagaaaaagaaaggaaaagattatttaaatttgagttgatatttttctttgcaaagaattcttcaggctaggcttggtggctcacgcctgcaatcccagcactttgggaggtggattgcatgaggccaggagttcgagaccagcctggctaacatggtgataaccccatctctactaaaaatacaaaattagctgggcgtgatggcacatgcctgtaatctcagctactcaggaggctgaggcaggagaatcacttgaacctgggaggcagagattgcagtgagcygagatcgtgccactgcactccagcctgggtgacagagcgagaccctgtctcaaaaaacagaaaagaaattgcaatattctaattttgctttttaaaaaatccttgctaagatgacagcaagagaaggaaaaagaaaaataaaataaaaattccttgcaagtagagacctaatcttgaattcacctttggatgtccaatgcatggcacagtctccagcacactgtgagagagctcaatgtgtgagaaactgatgagtcaagtttccttccctctctgaaccgccaggatgtgagatcatta

SEQ ID NO: 183743 - DNA, 601 bp, Human
aagtatatcaaaaacaaagatggtctataaaatctaccatttttattccctaaattatcaatatcatttttacacatgccttattacatatgtgctgtgaatacatccaccataactcatgttttgatgtgtaaatacatgagtgtaaacaggcaattcccctaaataaaacctaatatacagaaatctaaattaacaaataaaaaagattatttatggccaggcattgtggcttatgcctgtgacccagcattttgggaggccgaggtgggagggttgcacaagcccaggagttggagaycagtctgggcaacacagggagatcccatctctacaaaaaatgacgaaattagttgggcctgatggcatgcaagccgatagtctcaggtacttgagaggctaagaggatcacttgagtctgagagatcaaggctgaaagtgatacctaattgatggtgccactgcacttcagtctgggcaacagaacaagactctgtctcaaaaaaaagaaaaagaaaggaaaagattatttaaatttgagttgatatttttctttgcaaagaattcttcaggctaggcttggtggctcacgcctgcaatc

SEQ ID NO: 183744 - DNA, 601 bp, Human
ttttccaaaggaaaggaaatcagtatatcaaagggatatctgcagtcccatgtttattacagcactattcacaatagtcaagacatggaatcacctaagtgtccatcaatgaacaaataaaatgtggtgcatatacacaatggaatactactcagccattaaaaaagagtaaaatcgtgtcatttgtagcaacatggatggaactggaagtcattatggtaagcgaaataagccaaacacagaaaaacaaaaaaacccagaaaaacaaatattgcatgttctcactcatacgtgagagctaaaaaaaaaagttgatctcatggaggaagagagtactcatagaatgatagatatcagaagatggcagggggtgggaagggtgtaggtggaggaagagaggttggttaatgagtacaaacatacagttagatagaagcgataaagtctactgttcatagcagagtagggtgattatagttaacaacaatgtaggctatatatatatattttgtttgtttgtttgtttttgtttttgttttttgagacagagaaaagtatatcaaaaacaaagatggtctataaaatctaccatttttattcc

SEQ ID NO: 183745 - DNA, 601 bp, Human
aaatattgagaaaaacagggcatattaaaaacaacttcctaattcaaagtttgcagttgggtaatcatttgttctgaaatagggaggctcagggcagggaagtgtaaatttgttgaaagcacctgaaaactgtttcagccagggttcagtcaacactttttttttttttttttttttttttttttgctctgttgcccaggctggagtgcagtggcacaatctcggctcgctgcaacctccgcctccccggttcaagcaagtctcaagcctcagcctcccaggtagctgggattacaggcaygtgtcatcgcacctggctaatttttgtatttttaatacaaacagggtttcaccatgttggccaggctagtctcaaactcctgacctcaaatgatccacccacctcagcctcccaaagtgctgggattacaggggtgagtcaccatgccaggcctgtcaacaccttttgctcaccatcgtatagcacatttgctcttctcttcattggccacatttttcaaaaatcaagtctgtattacaactgtatcagacatttaataactttattctaggttcttgtgcattattcttactccatttg

SEQ ID NO: 183746 - DNA, 601 bp, Human
ctcagaaaaaaaaaaaagaaaagaaaagaagagaaaagagaagaaaaaaagaaacacaagagaaggaactttttgatcagttaaaaaaacaggggcaagttcaacctgtaacaggttgtgaagggatgtcaaactccatctctttgaatatacaaaaaaagtcttttccctcccaaattaaatacagaccttcactttacatcatcagctcttatcattatttttaaaatgatctaattctgtttaattcactgccttgcagctacgtgagtcatttgatatattatgaatgatagtaaattgtatttttagaataatattcaggctgaaaacatattccaaaacaaacagaaagctcatattacagtgacacaaaaggcattaaggacagaatattactgtaatgttcaggctagtctagtaatgctactttgtaatatgccaataaaatgccaagtttcaataaaaaattgactttgttctaccattattattattattttgtattttttttagagatagggactcactatgttgcccaggctggtctcgaactcctgggcttaagcaatctgcctgcctcgacctcccaaagttctaa

SEQ ID NO: 183747 - DNA, 601 bp, Human
tttttcttgaaagagtagttttgaggctagggcgtaaacagcaatagagcttccatctgggctcagtcaactgacacatacagattttgggccctaggtcagcacataagaaggctgcctactctgtgactgccatcctgaggagaccacatggagaacaagtaatgccggaagagccttcaactccttgagttttgcagcccagatggcaatgaaagtgacctctggtcatcctcactgttcattatacacaaattatgaagcattagcatgctaagagacactccctccagcaccataygagttaggaagcctgtgagctgactctaaccccagccactgacagcaaccgtgtgacggaccccaagcaaaaaccacttagccatcctagtcaaccccagaaacatgaaaaataattttaaaatgacgcttgtaattttaagctattaattttgttacatagtggtaaccatgcaatatacaatccagttattaatacaaaacatttattttacttatattgtaagcagaagactaataataaaagattttggtttttaacaaaggataacagtaatttgagagtttttttaaactaccc

SEQ ID NO: 183748 - DNA, 601 bp, Human
cacgacaatttacagaggccatggcaatggtgggaagttaacctacaaggtctaaaaaggggaggaaccctcagttccaggaattgcccatcccttttctggaaaatttatgaataatctaccccttctttagcaaatgatcaagaaataaccattaaaatagccaaccagcagccctcggagctcctctgtctacggagtagccattctttttttcctttactttcttaataaattttattttactttgtggactctccccaaattctttcttgtgcaacatccaagaacctcttggggwctggattgggacacctttcccgtaataacagtgtgagaattgaattggaggacacccagctggggttcactgcttggtggtggggagaaatccctacacctttgatcatagaagtctcctatgttgactattgttgtggtggtgtgagagtagaggaaaaactcggttggagaatttttcttgaaagagtagttttgaggctagggcgtaaacagcaatagagcttccatctgggctcagtcaactgacacatacagattttgggccctaggtcagcacataagaaggctgcctactctg

SEQ ID NO: 183749 - DNA, 601 bp, Human
tggctcatgcctgtagtcccagcactttcggaggcagaggcgggaggcttacttgggcccaggaattcaataccaccctaggctacatagcaagaccccatcttatattttaaaaataatgaaataaaataaaagaccctctccggtgaaggtcctgcctcataccccaggggaaggaatattgacgtgaagcttccataaaaacccaaaagaatgagttcagtgagcttccggatagcagaacacatgaaggttcctaaagggtggcacaccccgggagggcatggaagccctgcactcyatcccccgatacctcaccctacacatcgcttcatctatacactttgcagtatcctttataataaaccactaaacctaagtgtttccctgagttttgtgagctgctccagtaaattaatcaaaccagaagagggggtcatgggaactccaacttgatgcctctcagtcagacattccagaggacaggacttgtgacttgtgtctgggccaggtgagggtggttagggtcttggggaatgagcccttaacccatgggatctgacactatttccaggtggataatgtcagaggtgtttggacc

SEQ ID NO: 183750 - DNA, 601 bp, Human
tttatgggaggaaaaaaactatatgatcatctcattagatgtagcagatgtatctgataaaatcaaactaacttttctgattttttagtttcctagataactaaaaaacaaagataacttccctaagtgacaaaggatagctataataagctcgcaaacgttatacttaatggtaaaatgtaaaagctttccttatcaaattgggaacatcgcaaattgcctactgcaatcactctaactgaatatgtacaaccagtataaagcaagaataatgaaatttaaaatatcagcttggagatgaaaaaatataactgtcatagatcataaaacatagatgatatgattacagagatagagaacacagaaaatctgacagataatattttgaaatcatctgtttaggcaagctggccagatgcaaaattatattcctatgtaatagcagcagttaaaaaataaaaacactatttacagtagaattaaaagatacagtacttaggtggagaaaaatctaacaaaagaagtgaaagatccataaggaaaatataaaactttaccaagttattaatgtagaaagcaatttcatgctcatggataaaaa

SEQ ID NO: 183751 - DNA, 601 bp, Human
tgaatttatcccagaaatggagattggtttaacatttaaaaaaatcaattaatgtgattcattatattcacagtttatgggaggaaaaaaactatatgatcatctcattagatgtagcagatgtatctgataaaatcaaactaacttttctgattttttagtttcctagataactaaaaaacaaagataacttccctaagtgacaaaggatagctataataagctcgcaaacgttatacttaatggtaaaatgtaaaagctttccttatcaaattgggaacatcgcaaattgcctactgcmatcactctaactgaatatgtacaaccagtataaagcaagaataatgaaatttaaaatatcagcttggagatgaaaaaatataactgtcatagatcataaaacatagatgatatgattacagagatagagaacacagaaaatctgacagataatattttgaaatcatctgtttaggcaagctggccagatgcaaaattatattcctatgtaatagcagcagttaaaaaataaaaacactatttacagtagaattaaaagatacagtacttaggtggagaaaaatctaacaaaagaagtgaa

SEQ ID NO: 183752 - DNA, 601 bp, Human
ttgaatttatcccagaaatggagattggtttaacatttaaaaaaatcaattaatgtgattcattatattcacagtttatgggaggaaaaaaactatatgatcatctcattagatgtagcagatgtatctgataaaatcaaactaacttttctgattttttagtttcctagataactaaaaaacaaagataacttccctaagtgacaaaggatagctataataagctcgcaaacgttatacttaatggtaaaatgtaaaagctttccttatcaaattgggaacatcgcaaattgcctactgyaatcactctaactgaatatgtacaaccagtataaagcaagaataatgaaatttaaaatatcagcttggagatgaaaaaatataactgtcatagatcataaaacatagatgatatgattacagagatagagaacacagaaaatctgacagataatattttgaaatcatctgtttaggcaagctggccagatgcaaaattatattcctatgtaatagcagcagttaaaaaataaaaacactatttacagtagaattaaaagatacagtacttaggtggagaaaaatctaacaaaagaagtga

SEQ ID NO: 183753 - DNA, 601 bp, Human
acaagacaagtacagaaagacaaatactgcacgatttcactcatatgtggactgaaaaagtcaaactaatggaagtagagagtagaatggtggttaccagaggaggctaggggttggggaattggaagatgttggtcaaagggaacaaaatttcaattaggaggaataagtttttgagacctatcgcacagcatggtgactgtagttaataataatgtatcatatatttcaaaattgctaagagattaaatttcaaatgttctcaccacaagaaatgataaatatgttcagtgatgagtaygctaattagcttgatttagtcactctacaatgtaaacatatatcaaaacactacatcgtaccccataaataaatacaattatttgtcaattaaaaatttaataaaaattgtatgcacttaatgacatggcttcaaatacatgtaaagagtatgataatctcattcagtattatagatataagatatacaaaaggctaatacaacatgactaagttgaatttatcccagaaatggagattggtttaacatttaaaaaaatcaattaatgtgattcattatattcacagtttatgggaggaa

SEQ ID NO: 183754 - DNA, 601 bp, Human
tatgctaagtgaaacaagacaagtacagaaagacaaatactgcacgatttcactcatatgtggactgaaaaagtcaaactaatggaagtagagagtagaatggtggttaccagaggaggctaggggttggggaattggaagatgttggtcaaagggaacaaaatttcaattaggaggaataagtttttgagacctatcgcacagcatggtgactgtagttaataataatgtatcatatatttcaaaattgctaagagattaaatttcaaatgttctcaccacaagaaatgataaatatgtkcagtgatgagtatgctaattagcttgatttagtcactctacaatgtaaacatatatcaaaacactacatcgtaccccataaataaatacaattatttgtcaattaaaaatttaataaaaattgtatgcacttaatgacatggcttcaaatacatgtaaagagtatgataatctcattcagtattatagatataagatatacaaaaggctaatacaacatgactaagttgaatttatcccagaaatggagattggtttaacatttaaaaaaatcaattaatgtgattcattatattcacag

SEQ ID NO: 183755 - DNA, 601 bp, Human
atcatttacaatgacatggggaacctgttggacattatgctaagtgaaacaagacaagtacagaaagacaaatactgcacgatttcactcatatgtggactgaaaaagtcaaactaatggaagtagagagtagaatggtggttaccagaggaggctaggggttggggaattggaagatgttggtcaaagggaacaaaatttcaattaggaggaataagtttttgagacctatcgcacagcatggtgactgtagttaataataatgtatcatatatttcaaaattgctaagagattaaattycaaatgttctcaccacaagaaatgataaatatgttcagtgatgagtatgctaattagcttgatttagtcactctacaatgtaaacatatatcaaaacactacatcgtaccccataaataaatacaattatttgtcaattaaaaatttaataaaaattgtatgcacttaatgacatggcttcaaatacatgtaaagagtatgataatctcattcagtattatagatataagatatacaaaaggctaatacaacatgactaagttgaatttatcccagaaatggagattggtttaacattta

SEQ ID NO: 183756 - DNA, 601 bp, Human
agaaaattccatcatttacaatgacatggggaacctgttggacattatgctaagtgaaacaagacaagtacagaaagacaaatactgcacgatttcactcatatgtggactgaaaaagtcaaactaatggaagtagagagtagaatggtggttaccagaggaggctaggggttggggaattggaagatgttggtcaaagggaacaaaatttcaattaggaggaataagtttttgagacctatcgcacagcatggtgactgtagttaataataatgtatcatatatttcaaaattgctaagwgattaaatttcaaatgttctcaccacaagaaatgataaatatgttcagtgatgagtatgctaattagcttgatttagtcactctacaatgtaaacatatatcaaaacactacatcgtaccccataaataaatacaattatttgtcaattaaaaatttaataaaaattgtatgcacttaatgacatggcttcaaatacatgtaaagagtatgataatctcattcagtattatagatataagatatacaaaaggctaatacaacatgactaagttgaatttatcccagaaatggagattggt

SEQ ID NO: 183757 - DNA, 601 bp, Human
taatgctcactcgcagctgctcacctcctacagtgcgatccagtacctaacaggccacacataccactgctgttccatagcctggggtttggggacccttatccaaaggaattgaaatcagcatgaggtatctgtgctctcatgtttattgtagcattattcacaatagccaggatacagaagcaacctaactgtccatcaacagatgaatcgataaagaaaatgtggtatgtatacatgatggaatgttatttagctataaaaaagaaaattccatcatttacaatgacatggggaaccygttggacattatgctaagtgaaacaagacaagtacagaaagacaaatactgcacgatttcactcatatgtggactgaaaaagtcaaactaatggaagtagagagtagaatggtggttaccagaggaggctaggggttggggaattggaagatgttggtcaaagggaacaaaatttcaattaggaggaataagtttttgagacctatcgcacagcatggtgactgtagttaataataatgtatcatatatttcaaaattgctaagagattaaatttcaaatgttctcaccacaagaaatga

SEQ ID NO: 183758 - DNA, 601 bp, Human
ctgagatgagatggagctcaggtggtaatgctcactcgcagctgctcacctcctacagtgcgatccagtacctaacaggccacacataccactgctgttccatagcctggggtttggggacccttatccaaaggaattgaaatcagcatgaggtatctgtgctctcatgtttattgtagcattattcacaatagccaggatacagaagcaacctaactgtccatcaacagatgaatcgataaagaaaatgtggtatgtatacatgatggaatgttatttagctataaaaaagaaaattccrtcatttacaatgacatggggaacctgttggacattatgctaagtgaaacaagacaagtacagaaagacaaatactgcacgatttcactcatatgtggactgaaaaagtcaaactaatggaagtagagagtagaatggtggttaccagaggaggctaggggttggggaattggaagatgttggtcaaagggaacaaaatttcaattaggaggaataagtttttgagacctatcgcacagcatggtgactgtagttaataataatgtatcatatatttcaaaattgctaagagattaaattt

SEQ ID NO: 183759 - DNA, 601 bp, Human
ttagaatggctactatcaaaaagataaaagataagtattagtgaggatatggaacccttgtatactgagggtagcggtgtaaattagtacagtcattactttttgagattcttcccaacactaaaaatagggctgagtgagatggctcattcctgtagttccagaaatttgggaggctgagttgggaggatggcttgaggtcaggaattggaagctgcagtgagctatgattgcactgctgcattccagcctaggtgctaaaaataaattaattaaactaaattaaattaaaattaaaatwaaactaccatatgcttcagcaatcccacttctgggtatatatccaaaagcagcagtccccaacctttttggcaccagggaccagttttgtggaagataatttttccacagggatgagcgtggggagtcttgcagagtgcaatcattctacctcagatcatcaagcattagattctcataaaaagtgcaccacctagattcctgcaatgcacagttcacaatagggttcacactcctatgagaacctaatgctgccactgatctgagatgagatggagctcaggtggtaatgctcactcgc

SEQ ID NO: 183760 - DNA, 601 bp, Human
acaacatggtgaaacccatctctaccaaaaatataaaaatgagccaggcatggtagcatgtgcctgtagtcccagctacttgggaggctgagccaggagaattgcttaaacccaggaggcggagattgtggtgaaccaagatcacgctgctgcactccagcctggtgacagagtagcaacttcctaaggttcaatttaaacttcataattttaaaactatacatacttagaatggctactatcaaaaagataaaagataagtattagtgaggatatggaacccttgtatactgagggtagyggtgtaaattagtacagtcattactttttgagattcttcccaacactaaaaatagggctgagtgagatggctcattcctgtagttccagaaatttgggaggctgagttgggaggatggcttgaggtcaggaattggaagctgcagtgagctatgattgcactgctgcattccagcctaggtgctaaaaataaattaattaaactaaattaaattaaaattaaaataaaactaccatatgcttcagcaatcccacttctgggtatatatccaaaagcagcagtccccaacctttttggcac

SEQ ID NO: 183761 - DNA, 601 bp, Human
ggcaatggagatcgaaaccaaaggccttgtggcaccgtggcccccaaagagtacccccatatcctttcatgtaatctggttcatttgaatgctggatagtagataatccagatgtgaccagagctggttcagtccctaaatcacagaaaccaggcagctcaagaccatactatgttaagccacgtcacctccctcaatcaaagtgctgtcccgaacaaaccactgatcagggatttgaaaagacttcagtagatacatactgataaatacagagaaagacaaaaatcaataattttagtgrgaaaatttaacacagcttctctaagtaatttatagaacaaacaggctaaaccttagtaaagatatgcaagatatgaacaacaggaagaacaaacttccctaactgatacagagaactcttacacagaccagctgtagaattcacatattttccaaacacaagataagccagaaatcaataccaaaagtttgactggacaccatccatattttggaaaataaatccaccactaactaaaccataggtcacagaagaaaaatggaaattagaaaataagttaaactgaacgataatgaaaag

SEQ ID NO: 183762 - DNA, 601 bp, Human
gaggaaagttattttattatcagaatttggtaggaattccgagttctcctctgcttagcaggagccacactgctgaataacacatttaggtgttatttaagggagcaggaagaaaacatctagaatcacacagcacaggttaattccctaggcaatggagatcgaaaccaaaggccttgtggcaccgtggcccccaaagagtacccccatatcctttcatgtaatctggttcatttgaatgctggatagtagataatccagatgtgaccagagctggttcagtccctaaatcacagaaacsaggcagctcaagaccatactatgttaagccacgtcacctccctcaatcaaagtgctgtcccgaacaaaccactgatcagggatttgaaaagacttcagtagatacatactgataaatacagagaaagacaaaaatcaataattttagtgagaaaatttaacacagcttctctaagtaatttatagaacaaacaggctaaaccttagtaaagatatgcaagatatgaacaacaggaagaacaaacttccctaactgatacagagaactcttacacagaccagctgtagaattcacatattt

SEQ ID NO: 183763 - DNA, 601 bp, Human
aatatacagactagcagatgttgaatatgggacccattcttgatccaatttcacaagctgttgaatacactctaagagctcttctttgtcaaatacctgaaagaatgaaaaacataataaatgacagaattttctcacaatgtggcaataataaatgatcctcactgaagcatttaaactgttaaaaaattaataatcccaacacaaaaaaataagaaatgtttgaggtgatggatatcctaattatcctaatttttatttatttctttcttatttgtcctaatcattacacattatatgmatgcatgaaaacatcagtgtacctcataaatatgtataatttatggtaccaataaaaaaaattttaaagtaataataaaaccaaacaattttttctgattttccccccaaaaattgtgatgggatgacgagctatccacatgtgaaagataagattagatccctacatcttaccataccccccaatcaattctaattagatgatatacttaaatgtgacaaaatactaagactttatttaaaaagtacaaaatatctctgtgaccttaaggtaggaaaggattcttaagtaggagatgta

SEQ ID NO: 183764 - DNA, 601 bp, Human
gttatttaaacctaccatcccagctcttcaatttccttccttaactcccactgtgaactttattttcaccatttttctatgtgggaaggggaacctccattctcactccatgccaagtaatcccaagacctcatgaaaatgaaaattagcagctctccctcccctaaattttaaaaccatttctacctcagagaagtactgccacaatgggaggcactgcacttgtaaacttagaaaataatgactagtcttaattgggcaaggcaaacagcactgcatttactcatttatgtgctgtctrtggctgctttagtactaaaatggcagagtttaagaatcctctccggtcaggtgaagtggctcatgcctgtaatcccaggactttgggaggccaaggtgggaggattgctagaggccaggagtttgagaccagccaggacaacagagtgagacatcatctctacaaaaaatttaaaaattagctaggcatggtagcacatgcctgtagtactagctacttgggaagctgaggcaggaggatcacttgagcccaggaggtcaaagctgcagtcagccgtgattgcatcactgcaccccagcc

SEQ ID NO: 183765 - DNA, 601 bp, Human
aatattttaagtccatccaatagcagagccactccctaattatatggcagtgactgaatcttattttatgtgaaaaacaataatattagactgttatatcagggcctatggaagtgaactcaacactgccattaggatgaagtttagctttcaattatataaatatttccactttggtgccattaaaagttcagctttcaatgacttaaagcactgaaattactggcagacatatatttcattccttaacaaggtttgggatggtgagtcctttaaaagtggttatgaaatctctggagastttgttgaatgcagagtctctgatcctggctctagaaatttcgatttgggtctgggctggggcccaacaccaatgtgtccattgtagaatcctcaatgttctataaacacagcaactaccataccagggaatagagactggacacaagtgatcaactaggtgtctataaaacctaatacagtagcctaacatagatttattcattcaaagaaatcaaaatatctcttggacataagacccagttaatctaactatgaaaaggacatgaaataaaaacatatagaagtcagccaaaagcaa

SEQ ID NO: 183766 - DNA, 601 bp, Human
ctgttcactggagcattgtgtgaggtagcagggaactgggattccagttagggaattgggatacaatgtggaagatgcctcgcatcatgaactatgcaacagttagaaatgatggacttgatgtacacatagtagactggatagaaatggaacacacagtgctgggcgaaaaagagaagaaacacaatgaaatctgtaggacaaagtctcttacataaattaaaattacatgtataaaaagcgatgagatttttaaaaacacatataagccagaataatattaatttgattcctgagaatkatttctagtggagagagaggaaatgagagtggtgaatgaagatagaagggaataaaacaaagacagggaccttatatgccccatgatggaagtaccatgaatcaggagcataattaataacctggtgtacctaaactccaaagagtaaaaaacatcccctgtgacaagttgaaatgagcaagaacagcctcaagatgatactcactggtaagagtggccagataataataagctgattataacaggctaaaatcaaggcaaatagactgtatctctaaaaacagactcgatgtcttaaga

SEQ ID NO: 183767 - DNA, 601 bp, Human
ggaggctgaggcaggagaatcgcttgaatttgggaggtggaggttgcagtgagctgagatcacacaactgcactccagcctgggcaacagagcaagactctgtctcaaaaaaagaaaaaaaaaagattgttatcagagttagtgcatggaaagcactgagtacagtgcctgacaagtggggtcacttctgatgccagacgacagtgatgagaacagatcaaatgccaatttcgccaaggagaccaggccattcccgaaaagtagcagtaccttcttggggtggaagtgtaagatgggcctrggccttttgctgggatataatcactttcaataattccttgggttgtatgattttccagctgttcactggagcattgtgtgaggtagcagggaactgggattccagttagggaattgggatacaatgtggaagatgcctcgcatcatgaactatgcaacagttagaaatgatggacttgatgtacacatagtagactggatagaaatggaacacacagtgctgggcgaaaaagagaagaaacacaatgaaatctgtaggacaaagtctcttacataaattaaaattacatgtataaaaagc

SEQ ID NO: 183768 - DNA, 601 bp, Human
tacctttggttctacttgaattttttaccagataatttctctgccaaaatgaaaatgaatagtcctaaacttagaagcattgtaattgaacttgagacttaattggctgtgtgtatgtatgtatatgtgtatgttatatgatatatatacatgttataaaatacataatacaatatataaaatctggttaaatacatcaaatatagttgagagcaagaaagctgatagctcagaaaagaaaaaagtagagatgaaagtagacatagtagaatgagatgggaaagaacttagttgcccccaytggggctatgtttccatgctaaccattcccacttcttcacagcagtgaccgccatcaatatgcactcatttagtgggtttatattatgaaagtctgaccccctgccagacactgagctctgtgaaagcaagaagatagtttttgctcagcacagtatccctagacttagtgcagggactgacacataaaagatgttgcgggatggaggttaagagaatacaggctcttatttcaccgctttggaccttactttcacatccctaaaatactgcataagcacctgctcacaagattgttatc

SEQ ID NO: 183769 - DNA, 601 bp, Human
ctattgtatacctttggttctacttgaattttttaccagataatttctctgccaaaatgaaaatgaatagtcctaaacttagaagcattgtaattgaacttgagacttaattggctgtgtgtatgtatgtatatgtgtatgttatatgatatatatacatgttataaaatacataatacaatatataaaatctggttaaatacatcaaatatagttgagagcaagaaagctgatagctcagaaaagaaaaaagtagagatgaaagtagacatagtagaatgagatgggaaagaacttagtygcccccattggggctatgtttccatgctaaccattcccacttcttcacagcagtgaccgccatcaatatgcactcatttagtgggtttatattatgaaagtctgaccccctgccagacactgagctctgtgaaagcaagaagatagtttttgctcagcacagtatccctagacttagtgcagggactgacacataaaagatgttgcgggatggaggttaagagaatacaggctcttatttcaccgctttggaccttactttcacatccctaaaatactgcataagcacctgctcacaaga

SEQ ID NO: 183770 - DNA, 601 bp, Human
agccagcgagaccacgaacccaccgcaaggaacgaacaactccagacatgccgccttaagagctgcaacactcaccgcaaaggtccgcagcttcactcctgagccaacgagaccacgaacctaccagaaggaagaaactccgaacacatctgaacatcagaaggaacaaactccagacacgacacctttaagaactgtaacacttaccgcgagggtccatggcttcattcttgaagtcagtgagaccaagaacccaccaattccggatacgctaccatgttttacagactcgaaaatatctttttttttttttttttttacctttaacatgtttgagatctggactcagcattccacaattgttattggctaagcagcagttatggcaaagctgtcattgccaaacgtcatagctgttgacactgatgatacttccagtggctatgggcattggtgacacatgttgagtgtgccatgttaaatgtctttaaaaacttatgatttagcactgagaagaaaagttactgcacagaaaagcacaaaagcaggagcatggcatgtatttgatgttagtgaaacaaatatttataagactattaaa

SEQ ID NO: 183771 - DNA, 601 bp, Human
cccatcaacagcccgagggctgaggagtgcgggtgcacggcgcgggactggcaggcagctccacctgcagccctggtgcaagatacactgggtgaagccagctgggctcctgagtctagtggggacttggagaatctttacgtctggctaagagattgtaaatacaccaatcggcgctctgtatctagctcaaggtttgtaaatgcaccagtcagcactctgtgtctagctcagggtttgtaaatacatcaatcaacactctttatctagctaatccagtggggaggtggagaacttttgygtctagctcagggattgtaaatgcaccaatcagcaccctgacaaaacagaccaatcagctctctgtaaaatggaccaatcagcaggatgtgggtggggccagataagagaataaaagcaggctgcctgagccagcagtggcaacctgctggggtccccttccatactgtggaagctttgttctctcgctctttgcagtaaatcttgctgctgctcactctttgggtccacactgcctttatgagctgtaacactcactgggaaggtctgcagcttcactcctgaagccagcgagaccacg

SEQ ID NO: 183772 - DNA, 601 bp, Human
cagctgcggagggtgcaccgggtcccccagcagtgctggcccaccggcgccgcgctagatttctcgccgggccagatttctcgccaggccttagctgcctccctgcagggcagggctcgggacctgcagcctgccatgcctgagcctcccgccccccgccaccgctgtgggatcctgtgcggcctgagtctccctgacgagtgccacccccactccacagtgcctggtcccatcaacagcccgagggctgaggagtgcgggtgcacggcgcgggactggcaggcagctccacctgcagccmtggtgcaagatacactgggtgaagccagctgggctcctgagtctagtggggacttggagaatctttacgtctggctaagagattgtaaatacaccaatcggcgctctgtatctagctcaaggtttgtaaatgcaccagtcagcactctgtgtctagctcagggtttgtaaatacatcaatcaacactctttatctagctaatccagtggggaggtggagaacttttgtgtctagctcagggattgtaaatgcaccaatcagcaccctgacaaaacagaccaatcagctctctgtaaaatg

SEQ ID NO: 183773 - DNA, 601 bp, Human
aatactaatagctcctcctatagcctgttgaatatatatacttagccaccctgctcagcataaattcccgttctcttttcccctctctctcctttccaaatttatgagccccatcattcttcagttaacaatatttaggactgccagaactagaggaacttctaccacacttcaattattttcatttgtaaaaaaaaaaaaatctgatgctagtcctaacattttgcattgactgacaccctagagaaaatgtcctttgtctcttgcctgatttcctttagttctagccaataaactaatrggcaatccatacataggcatttgaaaatgtatcactggggaagctgaagtccaaattttctgagacttgctgtaacagggctaagggataaatccaggtttatttgccagccctgttcaaagaaaaaagatggtataaatttaacacttgataaaaaggctgatcaactcttttaagtttttagataagaatgaccttagaatttaaaagaacagctaagagaaaactaaagacaaagtggaaaagactaaaagaacacttaacactcttctctaacttcctcctgtgtaaaagaagtga

SEQ ID NO: 183774 - DNA, 601 bp, Human
gtaatacattaaatgttaaggctccaccccaaagtgacttgtgatgcatgctgcatacacgttagcctactatgtatgtgtgtgccaccccttcgtgaatactaatagctcctcctatagcctgttgaatatatatacttagccaccctgctcagcataaattcccgttctcttttcccctctctctcctttccaaatttatgagccccatcattcttcagttaacaatatttaggactgccagaactagaggaacttctaccacacttcaattattttcatttgtaaaaaaaaaaaaatmtgatgctagtcctaacattttgcattgactgacaccctagagaaaatgtcctttgtctcttgcctgatttcctttagttctagccaataaactaataggcaatccatacataggcatttgaaaatgtatcactggggaagctgaagtccaaattttctgagacttgctgtaacagggctaagggataaatccaggtttatttgccagccctgttcaaagaaaaaagatggtataaatttaacacttgataaaaaggctgatcaactcttttaagtttttagataagaatgaccttagaat

SEQ ID NO: 183775 - DNA, 601 bp, Human
atttagattgaccctgtttgttcctatgaaccaaccagtgatctctagctgctgctcagaagaaacagaagggtaacataaatatctggatcagtattttaattctgaacatgtgttggaattggctagcaaccccatataagcttggttccaacaactgcctagttcatggaaaggcttattatttagtttagttgggataattatacttattttgctttactgttgtagaatatattgctgtggtactctttgtgtagcaatgcaggataagactactcaacgttttcttaaattgaayacttattaatcttccagatatcaccttttgtgagaactcgggagttaggaatggccttcaccatactgatgctttctcactgagctcctctctaccctgaatagttacgcaaaaatatcatcacctgtattcagccagaagaagctacagaagatggatcttcatctgtctgcaaattttgggattaagggtccctttgggggtattggggaaaatatgtcagaactatttaaaccagagcaactccatcttgaataggggatagataaaatgagctgagaccacctgtgctccattcct

SEQ ID NO: 183776 - DNA, 601 bp, Human
gtgaaatagccttcaccctctacacaccccacgctcaaaccatactgaaccccttccattgctcctcactttcctacttccatatgctctactgcactacttcctctgcctggaacactctccttccaatgccctcctattatgggttgaattgtgtccctaaaattcctatgttgaaatcctaacccacggtgtgactgtatttggacatcgggcctttaaagaggtaattaaacttaaatgaagacatgaaagtgaggccttaatccataggcctgctgtccttataagaagaggaaaagacaccagagatagctcccttggccagatagaggaaaggcccagagaggacatagggagaaggtggccatctacaagccaggagagctcttaccagaaatcagctttacaggcaccctcatcttggacttctagactttggagcagtgagaaaataaacacctgtggttgaagctgcctagtctgtaatattctattatggcagccctagctagccacaggatagaatgcaggcctaggaatcctacaaatctggtcttcaagctggcccgcaaactggtcagttacaaacttttctgca

SEQ ID NO: 183777 - DNA, 601 bp, Human
tcttttttattttttttagagacagagtcttgccatgttgactaggctggtcttgaaatcctggcctcaagttaccctccttcttcagcctttcaaagtgctgaggttacaagcatgagccaccacacctggcctgctgatcccatctttagacaaatatccccttccttaaacaatgtgcaaatcagaaaatatttggatttacctgtaacctgtaagcccctacttcaggatatcccacctttttaggccaaaccaatatatggcttccatgtgttgattgatgcctttgcctgtaacytctgcaccttacatgtaagccactgtggagttcaggtcttaagcatgagctccctgattctgtttgcttcttgacctgcaaataaacaccctcctttctcccactgtaaaaccccggtgtggatgatagagcttactgcactgggtgaaatagccttcaccctctacacaccccacgctcaaaccatactgaaccccttccattgctcctcactttcctacttccatatgctctactgcactacttcctctgcctggaacactctccttccaatgccctcctattatgggttgaattgtg

SEQ ID NO: 183778 - DNA, 601 bp, Human
gtgcaccaccacacccggctagtttttgtatttttagtagagatggggtttcaccatgttggccaggctggtctcaaatccctgacctcaagtgatccaccctcctcagcctcccaaagtgctgggattacaggcgtgaactaccacgcctggcaccattctttgtcttaaatttctttctgagaagtctggaggaagtccgcccatgggccagacctaacattcctttctgctgattccatctttattttttttctttttctttttttcttttttattttttttagagacagagtcttgycatgttgactaggctggtcttgaaatcctggcctcaagttaccctccttcttcagcctttcaaagtgctgaggttacaagcatgagccaccacacctggcctgctgatcccatctttagacaaatatccccttccttaaacaatgtgcaaatcagaaaatatttggatttacctgtaacctgtaagcccctacttcaggatatcccacctttttaggccaaaccaatatatggcttccatgtgttgattgatgcctttgcctgtaacctctgcaccttacatgtaagccactgtggagtt

SEQ ID NO: 183779 - DNA, 601 bp, Human
aaagacatggaatcaacccaggtgaccatcaatggtggactgaataaagaaaatgtgatacatataaaccatggaatactatgcagccataaaaaagaatgaactcatgtcatttgtagcaacacagctgcagctggagtctctctatcctaaatgaattaacacagaaacagaaaaccaaaatatcacacgtccgcacttataagtgagagctaagcattagatacatatagacacaaagatgggaacaataaacactagggattccaaaagagggggaggggaaaagtgtttagaaatactacctatagtgtactacgttcactacttgggcaatgagatccttagaagctaaaatctttgtatcacaacatatacccatgtaacaaacttgcacatgtaactcctgactctcacataaattttttttaattaaaaaaagtcaattaacttgtttcacacaagagtattttattatataatattaaacaactacaagcaaaatcccacgatgataagttcagtcatctgattaaataaagcaaaagccacgtaaataatgagaacatatggatgacaatagctgatgaattgtgtgagt

SEQ ID NO: 183780 - DNA, 601 bp, Human
attcagctgaagtttttttatttaacaatatcttcaaaaaaacagggaatgaatgacttataaataacaaagatagaagaccatctttcccacaaacactgtaaagccagaagcccacaatgcaaaatcatgccaattcctccatcacaagagcagttataaataattagggttcattgtttattaaggaagaaaactgagagacccaacgttttgaaggctacatattaaggtagaaatgatcactgggctatcctcagcaattcaagaccacatgaagtaaaaaaacaaggcaggactyttaggttaagagcttcgggatataaaccacttgtgtccaatcttcactagagcctggtctacctggataggaatggggatctgtcaggagaagaaagagaatctttacaatagaagactcaacttcagctgattttgtggctttgtaatgtttctggagggatatttttatctgaacttcaattaaacttccccttactacccattgccccaccatccctcacccactgctcaacactcagatcaccaaaatcaggcaggtaaaatattcatgagcacaaaaaaatgtgtttacacaagc

SEQ ID NO: 183781 - DNA, 601 bp, Human
atgacaaaatataaattcttggtcaatgtggagatgaagcaagtctggtatacagataggaagctattaaaaaaacaataaaataaataaaaattaaaaagacaaagacaacagataggaagctattgtttaatgaccataaaaagtcaaataatccttattcataactgatagtaaatagataactgagttaaattacaaatgctttttaataatgagtataaaccagattgcaggggacgtctggtagaaagaccacaggtttgttgttaacagacctgaggacagctcttgcatttcyactatttggtatatgtgaacttaagcaagttagtccttatttttccctcatttaattatctggcagataaaaatatctgctttatatatctcattgggttgcttggaaaaaataaataataacaataaaagccaaaggatgagttacatgagactgttacatcctaatgaaattaagttttttaaaaaataactatttcagtggggtgtggtggctcatgcctgtaatcccagtgactcaggacaccgaggcaggaggatggcttgaggccagaagtcccagaccagcctgggcaacaca

SEQ ID NO: 183782 - DNA, 601 bp, Human
atttccaggccgggcacggtggctcatgcctgtaatcccagcactttgggaggctgaggtgggcagatcacctgaggttgggagtttgagaccatcctgaccaacatggagaaaccccgtctctactaaaaataacaaaaaaattagccgggagtggtggcccatgcctgtaatcccagctactctggaggctgaggcaggagaattgcttgaactcgggaggcggaggttgcagtgagccgagattgtgccatggcactccagcctgggcaacaagagcaaaattccgtctcaaaaaaawaaataaataaataaataataatttcaagttggttttctgacttgcaactgaaagaatattgactaatagctgaaatattccagtaagctgtggaaaatagacatcatactatggtgattgcgattggagcacgatgaggttgactcacaccaaggtaatgttaagagtccttaaaagggccaggcgcggtggctcacgcctgtaatcccagcactttgggaggcgagacggccggatcatgaggtcaggagattgagaccatcctggctaacacggtgaaacctcgtctctactaaaaat

SEQ ID NO: 183783 - DNA, 601 bp, Human
gagccagaagctctgaccagaggcagaggaagaagggaagaaaaagggggatgtgcaaaggacacaagaaacttggaaataattgctttagcccctagcatcctagtttcataagcccttgtctgcttaagatcatttccaggccgggcacggtggctcatgcctgtaatcccagcactttgggaggctgaggtgggcagatcacctgaggttgggagtttgagaccatcctgaccaacatggagaaaccccgtctctactaaaaataacaaaaaaattagccgggagtggtggcccatgyctgtaatcccagctactctggaggctgaggcaggagaattgcttgaactcgggaggcggaggttgcagtgagccgagattgtgccatggcactccagcctgggcaacaagagcaaaattccgtctcaaaaaaataaataaataaataaataataatttcaagttggttttctgacttgcaactgaaagaatattgactaatagctgaaatattccagtaagctgtggaaaatagacatcatactatggtgattgcgattggagcacgatgaggttgactcacaccaaggtaatgttaaga

SEQ ID NO: 183784 - DNA, 601 bp, Human
aatatctatttaggtctcttagactcttttacatctgggtaaaattacaatttgtactgttgtctaaataaaagttgagcatgaggccaggcgcggtggcttatgtctgtaatcctagcactttaggagcctaagatgggcggatcactgaggtcaggagttcgagaccagcccggccaacatggtgaaaccatgtctctactgaaaatacaagaattagctgggcgtggtggcgggtgcctataatctcagctgctagggaggctgagggaggagaatcattttaactcgggaggcaaargttgcagtgagccaagatagcaccactgcactccagcctgggtgacacagtgagactctgtctcaaaaaaaataaaaattaaacattagagccacatgttagtgtatatctactgttttcatctgcactatattccatactcttataaaaacatagtctttctatagagctatgtcattctgcttggactgataatatagcatcttgccctaccacaactgatgacaatatagcatcttgccctgctgcagctgagttaaagggtgggcatataacctaagacagtcacatgattccttt

SEQ ID NO: 183785 - DNA, 601 bp, Human
taaaacaactacaaatgtagtaatgtaaaactcctacattacattacattaatgtaatctaccacaaaatatctatttaggtctcttagactcttttacatctgggtaaaattacaatttgtactgttgtctaaataaaagttgagcatgaggccaggcgcggtggcttatgtctgtaatcctagcactttaggagcctaagatgggcggatcactgaggtcaggagttcgagaccagcccggccaacatggtgaaaccatgtctctactgaaaatacaagaattagctgggcgtggtggygggtgcctataatctcagctgctagggaggctgagggaggagaatcattttaactcgggaggcaaaagttgcagtgagccaagatagcaccactgcactccagcctgggtgacacagtgagactctgtctcaaaaaaaataaaaattaaacattagagccacatgttagtgtatatctactgttttcatctgcactatattccatactcttataaaaacatagtctttctatagagctatgtcattctgcttggactgataatatagcatcttgccctaccacaactgatgacaatatag

SEQ ID NO: 183786 - DNA, 601 bp, Human
aatagaagagcagcaagtgtgagcgctcttatctaacaccttttaatgtatccaaggaatacataatgcccaatgtctaaattcccctaaaagataggacaaatgttaaaagtctcgatgttgaccaaaaagtatttcaaaagcctatttttctcagcctgcaccattcatctcagattatttaaaatgaaaggaacacagcacattttcccggaatgacaatttagtgttataatacttttaaggtatcatcttttatctaaacttatatgggaaaattatggagtatattataaaatarggatgaatattttagacaaaacatgagagtcctcaaataaatgtgatgactgcttgcctccctacacccctggttgtataactcagtaggtctgagaagtactgccgtaagacagtcagggatcgggaataaactctagtcctcctgttgcaccatgaaatccccagaaatacacagaaacaaacaatgaaaaacaactaaaacaactacaaatgtagtaatgtaaaactcctacattacattacattaatgtaatctaccacaaaatatctatttaggtctcttagactcttttacatc

SEQ ID NO: 183787 - DNA, 601 bp, Human
ggtcaggagttcaagaccagcctgaccaacatggtgaaaccctatctctactaaaaaaaaaaatacaaaaattagctgggcatggtggcaggctcctgcaatcccagctactcgggaggctgaggcaggagaattgcttgaaccagggtgcagtgagctgagatcacaccattgcactgcagcctgggtgacatagtgagactccacctctttaaaaaagaaagaaagaaaaaaaagaaacttgtgtctatttgggcagcaaaagcacagtagtccttacttagcctttggaactgtgctmcttactcccttgtactaagtttctagctcttgtctttctggtcctgttgaaaatgactgagaaatgcacacagtgaaatctgagtggattacctccatcttcatttatccagtaaagaaaaagattcatagttcccacttcagtgatctgatggtcctctccatagagccacaggacctgctgacacccattatctactgcttcacattgggcaaaaagagatgagccgtaattcctttaagaaagagaaaatacacaggttacaaacatacttcatccccactccctcatcttctaccc

SEQ ID NO: 183788 - DNA, 601 bp, Human
actgcattttaaaaaatttaattgaaactactaacactgagacttcataagtatttggaaacatcatttatatttctagtctctataattactactgtgaaatgaacaacctaagaatgtaaacaagtctaaaaatacgcttctaaatttggtatgattatcaaaattctaatagaaataaatgcctgtttttctcccaccgttggccatttaattcaatatcatacacgttgccaacacttcactgaacccctatggtctctgccaactaataaaaaaaaacagcaaagaaaagtaatgmgtactcaggatattaaagataatagagaaatattgatatctatagtggatatatgaaattgtcttgaatgaaccaggatctagttacaatcccaagatacattgatttatcttttaaaatggtgctctttaatcagattgagttctagagtaaatttggagagattgtgatacattttcaaaatatgtagaaaaggcaacaattgttaaaacaattacagccagagagtacacaaaatccttccagtagaatcagtacactgcatttattactctagcattttatatacggtatatggtg

SEQ ID NO: 183789 - DNA, 601 bp, Human
tgagctgtgtggttttttggtggagtttggggtgggggtaagagtgggcagatgggaagaagggttgaatcggcctattatcttctaagtgcagaggtcaacactggctacaatcttccaagtgtagcttttgttatatgtcacatacagtaactcaaatttataaatcataaatattcctgtataaattttattttcaaacagtgccaagtacaaacagcaggaatggaaggatgagaatgatctgtatctggtttttcatatgccaaggactaccaatggccaagcccaggacaaggcktactcaccatatcttctgtttattctacctctgactgcagtataagactcatcttgttagtctctgcaactaacactaaaattagtacttagctctgaattcagccacatctaaattaccattttcctctttttgtagccaaataacattagagcaagagaggctactgtagctactttcaaatataaactgcattttaaaaaatttaattgaaactactaacactgagacttcataagtatttggaaacatcatttatatttctagtctctataattactactgtgaaatgaacaacct

SEQ ID NO: 183790 - DNA, 601 bp, Human
attttcttaaaatcatatgatataaatcaaagttacttcagaattgcatgtctttttttttagcccaaaggtttttcctaacattctatttacttcaaatatatattctatttcctttctccttattctgaattttatttgttctgttagatgaacatccccaaagtgaaggagtatattaaaactaaagttatcccaggcaaccataatctgaatagtaactaacagtcttaaggtcttgtatattttgcaagaggcagaagacaaactcactcatttctattctgacctttaaaagccwtggtggaaatgtttcatgattattgtttggataaagaacaattttccaccaggacagtttctggtgtttctggttaaatcatgtagctctgattcagagtgtacttaaattctgacatctcccatccataaaaataatgatggtaccacctctgaatgatgtaactgtttttgttttgagctgtgtggttttttggtggagtttggggtgggggtaagagtgggcagatgggaagaagggttgaatcggcctattatcttctaagtgcagaggtcaacactggctacaatcttccaagtg

SEQ ID NO: 183791 - DNA, 601 bp, Human
agcactgtgctttgaacacacactatccaccaccccatccaccttcctgcaccagccatctcaaccaacaggagcagtgtgtgtgggcgctcatgaaaagacggcaggctattaccgaaagaactctgtttatacctcctatcggtaacgtttgtgaaaatcagtattgtgctgattttcaactcgtttgttcattgtattttcttaaaatcatatgatataaatcaaagttacttcagaattgcatgtctttttttttagcccaaaggtttttcctaacattctatttacttcaaatatwtattctatttcctttctccttattctgaattttatttgttctgttagatgaacatccccaaagtgaaggagtatattaaaactaaagttatcccaggcaaccataatctgaatagtaactaacagtcttaaggtcttgtatattttgcaagaggcagaagacaaactcactcatttctattctgacctttaaaagccatggtggaaatgtttcatgattattgtttggataaagaacaattttccaccaggacagtttctggtgtttctggttaaatcatgtagctctgattcagagtgt

SEQ ID NO: 183792 - DNA, 601 bp, Human
tttgacaaagaagtcatttttaggagatgaggaatttagaagcaataacagcaggattcatctgtgacttcccaaagtcaaacactaatggaaaccaggaatgtaggtctgcataagtgccctaaacaccatcagcacaattagccatttattctacaaatacatattgagtgctgtttaccgttttaagctctatgaatacagcagtgaacaaaactgacatatctccctgcttactttctaatagacacaggtaaacatttattgtgttgatagtatgttagactacacagggggaaayaaagaaggaaaagcaatggagaatgctggaatgctgaggagaaatgggaaatggagtttatgattttgattaagagctcaaggaaagccagactgagaatgggatttgtaagcaaagatttggaggatgtcaaagagcaagcggtacagacatctgaggaagagtgctccaagtcgagtccgtatacacgcctgacgtgtccgagaagactcatgatgtggcctgagcaataccgagattcactgctgtggttgttttcccaaagtgactgtgaactcaaccacaaggcctgggtcttat

SEQ ID NO: 183793 - DNA, 601 bp, Human
ttgcctgtgtcacacgaatttgaaagtctactgaaaacaactttacatttgcttgcatgttctgattttaaaataggcatgtatatgaattttggaggatgggggtaggacagagagaaaaagaaggcagtcaaaccaataatgttatattagtaaacatttatatgtcagtgaaattatttcatttctacggcaagcatggttacactggtataaataaaggaaaggaagaagtatcattgccatttggaagcaacacagacttgggaagttaaggaatgtctggatggaagcacatcargtatgaaccagacaaaagttggtgggagatacctggtagactgagactactactagaatacttctccactatgacatcttgctaaactggtttctctctgcccttgctatcaacaatacttattttaatagtcttgccaagaaagcccttctagaagaatacttttcattcacgttagaatttaaagattagataacattggttggaaccacaggatattatttcaacactaggctgggcttattttgattattttttatttcaggcttacaaaagttgttcatatcaaaggcacccacc

SEQ ID NO: 183794 - DNA, 601 bp, Human
gggtctcactatgttgcccaggctggtctcgaattcctgggcttaagtgatcctcctgccttggcctcccaaaatgctagaattataggcatgaaccactgcacccggtccaccaaattgtttaatatgcttgcctgtgtcacacgaatttgaaagtctactgaaaacaactttacatttgcttgcatgttctgattttaaaataggcatgtatatgaattttggaggatgggggtaggacagagagaaaaagaaggcagtcaaaccaataatgttatattagtaaacatttatatgtcartgaaattatttcatttctacggcaagcatggttacactggtataaataaaggaaaggaagaagtatcattgccatttggaagcaacacagacttgggaagttaaggaatgtctggatggaagcacatcaggtatgaaccagacaaaagttggtgggagatacctggtagactgagactactactagaatacttctccactatgacatcttgctaaactggtttctctctgcccttgctatcaacaatacttattttaatagtcttgccaagaaagcccttctagaagaatacttttcatt

SEQ ID NO: 183795 - DNA, 601 bp, Human
ggctcatgtgatcctcccacctcagcctcccaaagtgccaaagtgctgggattatagttgtgagccactgtgcacggcttacctatatcttttatggaataaagaacagactgagttcaaatatctgaaatactcattatttttaaacgttgaatgtatatttggactttatttgagaaattgtattgtatgtattttttttcctaatatgactaacagttgactttacagtgacaattctcttccttctctttcagtatcacattcagttgattttcatcatggaattagtggtataacmtcattgacttctgccaaagtgtttgaatatattctttgctcaaggataggaaatgggaaaaagatccttttaagctatgtgtttaaactatctgtttaattcttgttcttttacctcagtggttcaagttcaaagtttgtcaacaagttatttgaataaagggcaataaaaatagagaggtttaaaaaaataagatgagtattttttcttaatttataaacccacaagagataaaaatggaaatcaaagctcttggcaatattcaaaatatttgaatatttaaaagaagaactcatgctg

SEQ ID NO: 183796 - DNA, 601 bp, Human
cggagtgagactctgtctccaaaaacaaaacaaaacaaaaaaatcagtgtcttaaaacctactttaccataaaggagaacaatgtattatataatattaataattatagctaccatttatcaagcacccgctattatgccaagttctgtaattttaagggtgagtactatcatccccattttacagatgaggaaactaaggttcaaggaggttgaagggcatctccagggccacaaaggaagtaagtgacagaaactcaatttgaacccaggtctgatctgattggctccaaatttggtaytctttctacgtttgtctctttcttttttttttttttttaagacagggtcttgccctgtcacccaggctggaatgcagtggcataatcttggctcattgcagcctcgacctcccaggcccaagtgatcctcctgtctcagtctcctgagcacctgggactacaggtgtatgctgccatgcccaactaggttttatattttatattttattttgtaaagataggggtctccctatgttgcccaggctgggctcatgtgatcctcccacctcagcctcccaaagtgccaaagtgctgggatta

SEQ ID NO: 183797 - DNA, 601 bp, Human
cagtagtttggaagtacttttggttaaccagaaactgaaatgtaactacctatagagccttccctagtgagctggtaggaaggaagagagaagagtagaagactgtcggcatagctccaatcccgacatgtaggtaagacagatcttacacgtgtccaaggacaaaactaacttcccaccatgtttaagcttacatgaaatcactggaaacatagtagatatatgctaatacagtttcatctggataaactgtcccagttattttttttgtagtgccaagttaaaaaacaaaaacaacaamaaaaaagacctagcatggtgcggtggcgcactcctgtaatcccagcaactcaggaggctgaagcagaaggattgcgtgagcccaggagtttgaggctgcagtgagctatgatcacaccagtgaatagccactgcactccagcctgggcaacacagcgagactccatctctttaaaataaagaaaaacaacaacaacgacaaaacttttgcatcttgggtctgggtccagatacaattttattcatacacttaaattaaatgtaatttaatgtgattggaaatgataggaaatgaggaaat

SEQ ID NO: 183798 - DNA, 601 bp, Human
ctcgaatgcattttccataactatttgccattcctaatccagtagtttggaagtacttttggttaaccagaaactgaaatgtaactacctatagagccttccctagtgagctggtaggaaggaagagagaagagtagaagactgtcggcatagctccaatcccgacatgtaggtaagacagatcttacacgtgtccaaggacaaaactaacttcccaccatgtttaagcttacatgaaatcactggaaacatagtagatatatgctaatacagtttcatctggataaactgtcccagttattttttttgtagtgccaagttaaaaaacaaaaacaacaacaaaaaagacctagcatggtgcggtggcgcactcctgtaatcccagcaactcaggaggctgaagcagaaggattgcgtgagcccaggagtttgaggctgcagtgagctatgatcacaccagtgaatagccactgcactccagcctgggcaacacagcgagactccatctctttaaaataaagaaaaacaacaacaacgacaaaacttttgcatcttgggtctgggtccagatacaattttattcatacacttaaattaaatg

SEQ ID NO: 183799 - DNA, 601 bp, Human
ccaaccaaatcctcaaattccttttgtaagattttagtaaatgcaccaggtttgccaatgaataattcttgtaaagtggtctacttactattaatgataacagcattaatagtaaaaaaaattcaagggattgaccactcgaatgcattttccataactatttgccattcctaatccagtagtttggaagtacttttggttaaccagaaactgaaatgtaactacctatagagccttccctagtgagctggtaggaaggaagagagaagagtagaagactgtcggcatagctccaatcccracatgtaggtaagacagatcttacacgtgtccaaggacaaaactaacttcccaccatgtttaagcttacatgaaatcactggaaacatagtagatatatgctaatacagtttcatctggataaactgtcccagttattttttttgtagtgccaagttaaaaaacaaaaacaacaacaaaaaagacctagcatggtgcggtggcgcactcctgtaatcccagcaactcaggaggctgaagcagaaggattgcgtgagcccaggagtttgaggctgcagtgagctatgatcacaccagtgaa

SEQ ID NO: 183800 - DNA, 601 bp, Human
aagccagttcacattataagactaatacttacatgcctttaagttataaagttagataccaatgttaatcataagtattggagctttgttataaagtgaaaagcaaaacaatttgacaagaaaacaaaagtatggcacatataaaatcagactaatttactaagaggagaacatttcttccaaccaaatcctcaaattccttttgtaagattttagtaaatgcaccaggtttgccaatgaataattcttgtaaagtggtctacttactattaatgataacagcattaatagtaaaaaaaawtcaagggattgaccactcgaatgcattttccataactatttgccattcctaatccagtagtttggaagtacttttggttaaccagaaactgaaatgtaactacctatagagccttccctagtgagctggtaggaaggaagagagaagagtagaagactgtcggcatagctccaatcccgacatgtaggtaagacagatcttacacgtgtccaaggacaaaactaacttcccaccatgtttaagcttacatgaaatcactggaaacatagtagatatatgctaatacagtttcatctggat

SEQ ID NO: 183801 - DNA, 601 bp, Human
gtggtgcacacctgtggtcccagctacttgggagactgaggtgggaggatcgcttgagcttgggaggcggaggttgcagtgagccgagattgtgcccctgcactccagtacaggtgacagagaaagaccccgtttaaaaaaacaaacaaacaaaaaaagttgtatgtggatttttcaactgcatgggggttgacacccctaatccctgtgttgttcaaggatctgctataatatgaataacttaagccagttcacattataagactaatacttacatgcctttaagttataaagttagatrccaatgttaatcataagtattggagctttgttataaagtgaaaagcaaaacaatttgacaagaaaacaaaagtatggcacatataaaatcagactaatttactaagaggagaacatttcttccaaccaaatcctcaaattccttttgtaagattttagtaaatgcaccaggtttgccaatgaataattcttgtaaagtggtctacttactattaatgataacagcattaatagtaaaaaaaattcaagggattgaccactcgaatgcattttccataactatttgccattcctaatccag

SEQ ID NO: 183802 - DNA, 601 bp, Human
aatatattttcccttccccatgattttcgtaacttactttattgtaagaatacatatataacatacataacatacaaaatatgtgccaatcgactgtttttgttgttgataaggcttccggtgaacagcaggctactagtagttaagtttttgggaagtcaaaagttacatgtgggccgggcatggtgactcacgcctgtaataccagcactttgggaggtcaaggcaggtgaatcacttgaactcaagagtttgagaccagcctgtgaaacatcttgaaaccccgtctctacaaaaaatrctaaaattagctgggtgtggtggtgcacacctgtggtcccagctacttgggagactgaggtgggaggatcgcttgagcttgggaggcggaggttgcagtgagccgagattgtgcccctgcactccagtacaggtgacagagaaagaccccgtttaaaaaaacaaacaaacaaaaaaagttgtatgtggatttttcaactgcatgggggttgacacccctaatccctgtgttgttcaaggatctgctataatatgaataacttaagccagttcacattataagactaatacttacatgcct

SEQ ID NO: 183803 - DNA, 601 bp, Human
aaaaaaaatctggcctaatgacaacttcagtggatggatcacattaccttgatgcattattatcaatgtaagtattgacatgaaacagaacaattcttctcccatgaaacagtctatctgttgatgcaattatgtcaagagcaatcccttaaaagcaagttctaaaacctcaacaaatgaagcagccattattaaagtcagaggagttgagcaaaactccaatcagctgagggaaaataactctaaagtaaaatttgaaaaccagtggagtttgcatttacggttgacacttgaacaacaygggtttgaactacacaagttcacttatacgtggactttcttctgcctctgccactcctaaaacagcaagaccaatccctcctcctcctcctcctcctcagcctactcaacatgatggacaatgaggatgaagacctttatgatgatccacttccatgtaatgaatagtaaatatattttcccttccccatgattttcgtaacttactttattgtaagaatacatatataacatacataacatacaaaatatgtgccaatcgactgtttttgttgttgataaggcttccggtgaacagcag

SEQ ID NO: 183804 - DNA, 601 bp, Human
gctaatatgagaacgcaaagatattttgccacagtttaatgcaagtcattctgggagcataaattaaagcaagtctatgacttcataaaaggggcttctatacctatctctggcccaaggtaaacttccaggggccactacctccacaatattggatagcatgattaaatgcatggctgaaagagatttcatgcttctaatttgtatctgagtcatgcctactcatgccttgctggcttgcaggttttgatagtttgattttaggagatagtctgtgctctcaaacacttttcatattatrccctttagtataatatgataattatatatacttactttttggctgtaaatgcttcctaagcctggatcattaaaattatgctaaactttataaacttcttatttctagaagtgaaataataattcaacttaaaaaaaatctggcctaatgacaacttcagtggatggatcacattaccttgatgcattattatcaatgtaagtattgacatgaaacagaacaattcttctcccatgaaacagtctatctgttgatgcaattatgtcaagagcaatcccttaaaagcaagttctaaaacct

SEQ ID NO: 183805 - DNA, 601 bp, Human
aggaatagcactaaaacctactgactctgagtgctagcaccttatgccaaagactttcatatccaaaatttgaataaaaactagccaatgacaggttatacattgcctacctaccaattaattttagggcataactggtttgtataccagccttcaggatcatttgaagaaccaaggaggagctacagttacctaaaatagtggctaaacttaaagaaccttacctcttccaagattctgagaatctgtaaggatgaatgattgtcttctacatattaaccctctggctaatatgagaackcaaagatattttgccacagtttaatgcaagtcattctgggagcataaattaaagcaagtctatgacttcataaaaggggcttctatacctatctctggcccaaggtaaacttccaggggccactacctccacaatattggatagcatgattaaatgcatggctgaaagagatttcatgcttctaatttgtatctgagtcatgcctactcatgccttgctggcttgcaggttttgatagtttgattttaggagatagtctgtgctctcaaacacttttcatattatgccctttagtataat

SEQ ID NO: 183806 - DNA, 601 bp, Human
tgagggtactcatgtatatggtgataacagataagacactcaagcaattctgctatactaaggcaattccactgaagttaaggaatagcactaaaacctactgactctgagtgctagcaccttatgccaaagactttcatatccaaaatttgaataaaaactagccaatgacaggttatacattgcctacctaccaattaattttagggcataactggtttgtataccagccttcaggatcatttgaagaaccaaggaggagctacagttacctaaaatagtggctaaacttaaagaaccytacctcttccaagattctgagaatctgtaaggatgaatgattgtcttctacatattaaccctctggctaatatgagaacgcaaagatattttgccacagtttaatgcaagtcattctgggagcataaattaaagcaagtctatgacttcataaaaggggcttctatacctatctctggcccaaggtaaacttccaggggccactacctccacaatattggatagcatgattaaatgcatggctgaaagagatttcatgcttctaatttgtatctgagtcatgcctactcatgccttgctg

SEQ ID NO: 183807 - DNA, 601 bp, Human
aaaagaaaagaaaagaaaagctttacctggatatcagttaatttgctcaagatgcggcttgccagcttaggaccattctccatagttggaatgtgtattgtctacaaaagaaagggaaatgagataatttgagggtactcatgtatatggtgataacagataagacactcaagcaattctgctatactaaggcaattccactgaagttaaggaatagcactaaaacctactgactctgagtgctagcaccttatgccaaagactttcatatccaaaatttgaataaaaactagccaatgayaggttatacattgcctacctaccaattaattttagggcataactggtttgtataccagccttcaggatcatttgaagaaccaaggaggagctacagttacctaaaatagtggctaaacttaaagaaccttacctcttccaagattctgagaatctgtaaggatgaatgattgtcttctacatattaaccctctggctaatatgagaacgcaaagatattttgccacagtttaatgcaagtcattctgggagcataaattaaagcaagtctatgacttcataaaaggggcttctataccta

SEQ ID NO: 183808 - DNA, 601 bp, Human
ctttttttaacaaaagttatgttatccttcttaatgagatttttaaatgttaccaaaaattacatctattttttaatgttaagtaatgtggagtcctgaacaatattttctttctttttttaaaacatacatcttctttcccatttctgctttgctcatgcccacacattgtgttgggaatatcttccttaaatttaacttattgatctcaaattgtattatttaatcctcttcattgaaatataatttagttgtaagctctgacagaaataaggtgacataaaaaaaagaaaagaaaagraaagaaaagaaaagaaaagaaaagctttacctggatatcagttaatttgctcaagatgcggcttgccagcttaggaccattctccatagttggaatgtgtattgtctacaaaagaaagggaaatgagataatttgagggtactcatgtatatggtgataacagataagacactcaagcaattctgctatactaaggcaattccactgaagttaaggaatagcactaaaacctactgactctgagtgctagcaccttatgccaaagactttcatatccaaaatttgaataaaaactagcca

SEQ ID NO: 183809 - DNA, 601 bp, Human
tcttcctttttttaacaaaagttatgttatccttcttaatgagatttttaaatgttaccaaaaattacatctattttttaatgttaagtaatgtggagtcctgaacaatattttctttctttttttaaaacatacatcttctttcccatttctgctttgctcatgcccacacattgtgttgggaatatcttccttaaatttaacttattgatctcaaattgtattatttaatcctcttcattgaaatataatttagttgtaagctctgacagaaataaggtgacataaaaaaaagaaaagraaaggaaagaaaagaaaagaaaagaaaagctttacctggatatcagttaatttgctcaagatgcggcttgccagcttaggaccattctccatagttggaatgtgtattgtctacaaaagaaagggaaatgagataatttgagggtactcatgtatatggtgataacagataagacactcaagcaattctgctatactaaggcaattccactgaagttaaggaatagcactaaaacctactgactctgagtgctagcaccttatgccaaagactttcatatccaaaatttgaataaaaact

SEQ ID NO: 183810 - DNA, 601 bp, Human
actttcaaattttttcttcctttttttaacaaaagttatgttatccttcttaatgagatttttaaatgttaccaaaaattacatctattttttaatgttaagtaatgtggagtcctgaacaatattttctttctttttttaaaacatacatcttctttcccatttctgctttgctcatgcccacacattgtgttgggaatatcttccttaaatttaacttattgatctcaaattgtattatttaatcctcttcattgaaatataatttagttgtaagctctgacagaaataaggtgacataaaaaaaagaaaagaaaaggaaagaaaagaaaagaaaagaaaagctttacctggatatcagttaatttgctcaagatgcggcttgccagcttaggaccattctccatagttggaatgtgtattgtctacaaaagaaagggaaatgagataatttgagggtactcatgtatatggtgataacagataagacactcaagcaattctgctatactaaggcaattccactgaagttaaggaatagcactaaaacctactgactctgagtgctagcaccttatgccaaagactttcatatccaaaa

SEQ ID NO: 183811 - DNA, 601 bp, Human
cccagctactcgggaggctgaggtaggaaaattgcttgaacccgggaggcagaggttgcagtgagccaagatcgtgccatcgtactccagcctgggcaacaagagtgaaactccagctcaaaaataaaaagacataaaaaattaacagtgattatatctcagtgttggaatcacatgcactgtaattttcttcctgaagttgcttctactttcaaattttttcttcctttttttaacaaaagttatgttatccttcttaatgagatttttaaatgttaccaaaaattacatctattttttwatgttaagtaatgtggagtcctgaacaatattttctttctttttttaaaacatacatcttctttcccatttctgctttgctcatgcccacacattgtgttgggaatatcttccttaaatttaacttattgatctcaaattgtattatttaatcctcttcattgaaatataatttagttgtaagctctgacagaaataaggtgacataaaaaaaagaaaagaaaaggaaagaaaagaaaagaaaagaaaagctttacctggatatcagttaatttgctcaagatgcggcttgccagcttag

SEQ ID NO: 183812 - DNA, 601 bp, Human
aataaataaagtatataaatgcttacaaaatattgaaggttaagacatcaaaaaatggcagggcacagtggttcatgcctgtaatcccaacaatttaggaggccaaggcaggtggattaccttaggtcaggagttcaagaccagcctggccaacatggtgaaatcccatctctactaaaaacacaaaaattagctgggcatggtggcgcacacctataatcccagctactcgggaggctgaggtaggaaaattgcttgaacccgggaggcagaggttgcagtgagccaagatcgtgccatygtactccagcctgggcaacaagagtgaaactccagctcaaaaataaaaagacataaaaaattaacagtgattatatctcagtgttggaatcacatgcactgtaattttcttcctgaagttgcttctactttcaaattttttcttcctttttttaacaaaagttatgttatccttcttaatgagatttttaaatgttaccaaaaattacatctattttttaatgttaagtaatgtggagtcctgaacaatattttctttctttttttaaaacatacatcttctttcccatttctgctttgc

SEQ ID NO: 183813 - DNA, 601 bp, Human
agatcatgccactgttctccagcctgggtgacacagcgagacttagtctcaaaaataaataagtaaataaataaataaagtatataaatgcttacaaaatattgaaggttaagacatcaaaaaatggcagggcacagtggttcatgcctgtaatcccaacaatttaggaggccaaggcaggtggattaccttaggtcaggagttcaagaccagcctggccaacatggtgaaatcccatctctactaaaaacacaaaaattagctgggcatggtggcgcacacctataatcccagctactcrggaggctgaggtaggaaaattgcttgaacccgggaggcagaggttgcagtgagccaagatcgtgccatcgtactccagcctgggcaacaagagtgaaactccagctcaaaaataaaaagacataaaaaattaacagtgattatatctcagtgttggaatcacatgcactgtaattttcttcctgaagttgcttctactttcaaattttttcttcctttttttaacaaaagttatgttatccttcttaatgagatttttaaatgttaccaaaaattacatctattttttaatgttaagtaa

SEQ ID NO: 183814 - DNA, 601 bp, Human
aaatacaaaaattagccgggaacggtggcatgagacctgtaatcccagctactcgggaggctgaggcagaagaatcgcttgaacccaggaggtggaggttgtagtgagctgagatcatgccactgttctccagcctgggtgacacagcgagacttagtctcaaaaataaataagtaaataaataaataaagtatataaatgcttacaaaatattgaaggttaagacatcaaaaaatggcagggcacagtggttcatgcctgtaatcccaacaatttaggaggccaaggcaggtggattacyttaggtcaggagttcaagaccagcctggccaacatggtgaaatcccatctctactaaaaacacaaaaattagctgggcatggtggcgcacacctataatcccagctactcgggaggctgaggtaggaaaattgcttgaacccgggaggcagaggttgcagtgagccaagatcgtgccatcgtactccagcctgggcaacaagagtgaaactccagctcaaaaataaaaagacataaaaaattaacagtgattatatctcagtgttggaatcacatgcactgtaattttcttcctgaagtt

SEQ ID NO: 183815 - DNA, 601 bp, Human
tataaaaaagcaaagcatttattcagtgaaaaaacatgtaacaaaattatgtacaatatgatcccattttgttaggaaaaaataactatctaaaagtatactggctgggcatggtggctcacggctgtaatcccagcactttgggaagccaaggcgggtggatcacctgaggtcaagagttcaagaccagcctggccaacagggcaaaacctcatctctactaaaaatacaaaaattagccgggaacggtggcatgagacctgtaatcccagctactcgggaggctgaggcagaagaatcrcttgaacccaggaggtggaggttgtagtgagctgagatcatgccactgttctccagcctgggtgacacagcgagacttagtctcaaaaataaataagtaaataaataaataaagtatataaatgcttacaaaatattgaaggttaagacatcaaaaaatggcagggcacagtggttcatgcctgtaatcccaacaatttaggaggccaaggcaggtggattaccttaggtcaggagttcaagaccagcctggccaacatggtgaaatcccatctctactaaaaacacaaaaattagctgg

SEQ ID NO: 183816 - DNA, 601 bp, Human
gattattgctcagaaaaaaaataggcaaaacaaagttagcagtatgaaaaaatagacgtgtatactctttgatcccagatttatccttaggaagtaatcgaggatgtactgtccatactagtgaaaaaaaaattgccaacaacataaatgttcaataatataattttttaaaaaaattatggtacatcaatataatggaattcaattaaactttataaatggtgttggagaaaactacttattgatataaaaaagcaaagcatttattcagtgaaaaaacatgtaacaaaattatgtacamtatgatcccattttgttaggaaaaaataactatctaaaagtatactggctgggcatggtggctcacggctgtaatcccagcactttgggaagccaaggcgggtggatcacctgaggtcaagagttcaagaccagcctggccaacagggcaaaacctcatctctactaaaaatacaaaaattagccgggaacggtggcatgagacctgtaatcccagctactcgggaggctgaggcagaagaatcgcttgaacccaggaggtggaggttgtagtgagctgagatcatgccactgttctcca

SEQ ID NO: 183817 - DNA, 601 bp, Human
ttctaacttgtgaaatgcttgcaaattacaggataatctcttttctgagtagcccagtgttatctggtatttagcatgcctgcttaactgcctgatgaggcattactgtagattattgctcagaaaaaaaataggcaaaacaaagttagcagtatgaaaaaatagacgtgtatactctttgatcccagatttatccttaggaagtaatcgaggatgtactgtccatactagtgaaaaaaaaattgccaacaacataaatgttcaataatataattttttaaaaaaattatggtacatcaayataatggaattcaattaaactttataaatggtgttggagaaaactacttattgatataaaaaagcaaagcatttattcagtgaaaaaacatgtaacaaaattatgtacaatatgatcccattttgttaggaaaaaataactatctaaaagtatactggctgggcatggtggctcacggctgtaatcccagcactttgggaagccaaggcgggtggatcacctgaggtcaagagttcaagaccagcctggccaacagggcaaaacctcatctctactaaaaatacaaaaattagccgggaa

SEQ ID NO: 183818 - DNA, 601 bp, Human
ctctcttttaaacttttatttttattttatttccctttttttagaggaaggttctcactatgttgcctaggctagtcttgaacacctggcctcaagcgatcctcctgtcttggcctcccatagtgttgggattataggtgtgagccactgcacccagccagaaatgccatttttatcactacccaaggacctccattgctctctggaggcctgttgcattctcagccacctttaagtttcacttagtttcatgacttaatgccatccgacatcactcaaatgatcaaactttattttactyttcaatgtaagtctcaggccctcttggatatttttactaattgacaaggatagtaactggcttcaacaaagtcttctaacttgtgaaatgcttgcaaattacaggataatctcttttctgagtagcccagtgttatctggtatttagcatgcctgcttaactgcctgatgaggcattactgtagattattgctcagaaaaaaaataggcaaaacaaagttagcagtatgaaaaaatagacgtgtatactctttgatcccagatttatccttaggaagtaatcgaggatgtactgtccata

SEQ ID NO: 183819 - DNA, 601 bp, Human
tttagctccatatacattttaggattgttttttctatttctgtgaagaaagtcatcagtattttaatagggattgcattgaatctgtaaattgctttgtgtagtatagtcattttaacaaaattaattcttccaatccatgaatatggaatatctttccacctttgtgtgttttcttcaattttttaaatcatagttttatacttttccttgtatagatctctcatgtctttggttagattgattcctaggtattttatactttttgtggctattataaatgggattgctttcttgatttstttttcagattgttcactgttagcatatataaattctactgatttttatatgttgattttatatcctgcaactttactgaattcatttatcagttctacaggttttttgagggagtctttaggtttttctaggtgtaagataatgtcatctgctaagaaagctaatttaacttcttcttttccaatttggatgccctttatttatttttcctgcctatttgccctggcctctaaacctctgttttggaaaaaggctttcatgtaatctagccagttatgtattttttgttctatttgtgt

SEQ ID NO: 183820 - DNA, 601 bp, Human
gaccaatgtcctgaagcatttccttaatgttttcttcaagtaatttcatagtttcaggtctaagattcaagtcattaatatactttcatttgatttctgtgtatggtaagagaagcgaatctagtttcattcttctgcatataattatccaattttcccagcaccatttattgaaaagactgtcttccccgttacagttcttggcacctttgtcaaagatgagttggttgtaaacatgtggacttaggcatctgggttctctattctgtcccactggtctactatgtctgtttttatatcwgtactatgctgttttggttattatagttttataataaattttgaagtaaggtagtgtggtgattctaactttgttctttttgctcaagattgctttggctatttggggtctttttagctccatatacattttaggattgttttttctatttctgtgaagaaagtcatcagtattttaatagggattgcattgaatctgtaaattgctttgtgtagtatagtcattttaacaaaattaattcttccaatccatgaatatggaatatctttccacctttgtgtgttttcttcaattttttaa

SEQ ID NO: 183821 - DNA, 601 bp, Human
aggttcatgccactacactccagcctgagtgacagaatgagatctttgcttagaccaatgtcctgaagcatttccttaatgttttcttcaagtaatttcatagtttcaggtctaagattcaagtcattaatatactttcatttgatttctgtgtatggtaagagaagcgaatctagtttcattcttctgcatataattatccaattttcccagcaccatttattgaaaagactgtcttccccgttacagttcttggcacctttgtcaaagatgagttggttgtaaacatgtggacttaggyatctgggttctctattctgtcccactggtctactatgtctgtttttatatctgtactatgctgttttggttattatagttttataataaattttgaagtaaggtagtgtggtgattctaactttgttctttttgctcaagattgctttggctatttggggtctttttagctccatatacattttaggattgttttttctatttctgtgaagaaagtcatcagtattttaatagggattgcattgaatctgtaaattgctttgtgtagtatagtcattttaacaaaattaattcttccaat

SEQ ID NO: 183822 - DNA, 601 bp, Human
tagcctatgctttttcaggtcttacataagaaatcttcgctggccagggacagtggcttatgctagtaatctcagcactttgggaggctgagacaggaggatcccttgagttcaggagttcgagaccagcctgggcaagatggtgagactccatctctacaaaaaatttaaaaattagtggaatgtggtggcatgcacctgtggttctagctacatggaaagccaaggtgggagaattgcttgagcccaggaggtcaatgccacaatgagccaggttcatgccactacactccagcctgartgacagaatgagatctttgcttagaccaatgtcctgaagcatttccttaatgttttcttcaagtaatttcatagtttcaggtctaagattcaagtcattaatatactttcatttgatttctgtgtatggtaagagaagcgaatctagtttcattcttctgcatataattatccaattttcccagcaccatttattgaaaagactgtcttccccgttacagttcttggcacctttgtcaaagatgagttggttgtaaacatgtggacttaggcatctgggttctctattctgtcccactgg

SEQ ID NO: 183823 - DNA, 601 bp, Human
cttgacataatcccaattgcctatttttgctttgatagcctatgctttttcaggtcttacataagaaatcttcgctggccagggacagtggcttatgctagtaatctcagcactttgggaggctgagacaggaggatcccttgagttcaggagttcgagaccagcctgggcaagatggtgagactccatctctacaaaaaatttaaaaattagtggaatgtggtggcatgcacctgtggttctagctacatggaaagccaaggtgggagaattgcttgagcccaggaggtcaatgccacartgagccaggttcatgccactacactccagcctgagtgacagaatgagatctttgcttagaccaatgtcctgaagcatttccttaatgttttcttcaagtaatttcatagtttcaggtctaagattcaagtcattaatatactttcatttgatttctgtgtatggtaagagaagcgaatctagtttcattcttctgcatataattatccaattttcccagcaccatttattgaaaagactgtcttccccgttacagttcttggcacctttgtcaaagatgagttggttgtaaacatgtgga

SEQ ID NO: 183824 - DNA, 601 bp, Human
acggaagttctagttctacttttatttttggaggaccctccatactgttctccatagtggctgtactatttatatttcaaccaacaatatatgatggttccctttctccacatcctcccagcatctgttattgcctgttttttttttttttttaatacaagccattttaactagggcaagtggattttacattgtggttttgttttgcatttctctgataattagtgatgttgcgcattttttcatgtaccttctggccatttgtctgtcttcttttgagaaatgtccattcagatctttwatccatttttaatcaaatttttttttctgttgagttttctaatcaggtctcatgcccattttaaaaccagattactagatttttcctatacagttgtttgagctccttatagactctggttattaatcccttgtcagattgatagtttgcaaatattttcatccattctttgggtaatctattccctttgtggattgttttctttgctgtggagaagctttccagcttgacataatcccaattgcctatttttgctttgatagcctatgctttttcaggtcttacataagaaatcttcgc

SEQ ID NO: 183825 - DNA, 601 bp, Human
ttatccatttatctgttgacagacatttaggttaattccatatcttggctattgtgaatactattgcaataaacatgggagtgcagatatctctttgatatactaatttttttcttttggatatatacccggtggtagaattgctggatcacacggaagttctagttctacttttatttttggaggaccctccatactgttctccatagtggctgtactatttatatttcaaccaacaatatatgatggttccctttctccacatcctcccagcatctgttattgcctgtttttttttttkttttaatacaagccattttaactagggcaagtggattttacattgtggttttgttttgcatttctctgataattagtgatgttgcgcattttttcatgtaccttctggccatttgtctgtcttcttttgagaaatgtccattcagatctttaatccatttttaatcaaatttttttttctgttgagttttctaatcaggtctcatgcccattttaaaaccagattactagatttttcctatacagttgtttgagctccttatagactctggttattaatcccttgtcagattgatagttt

SEQ ID NO: 183826 - DNA, 601 bp, Human
tgaatagtaccacattgtgtgtgtgtgtgtgtgtgtgtgtgtgtatatatatatatatctttatgccacattctctttatccatttatctgttgacagacatttaggttaattccatatcttggctattgtgaatactattgcaataaacatgggagtgcagatatctctttgatatactaatttttttcttttggatatatacccggtggtagaattgctggatcacacggaagttctagttctacttttatttttggaggaccctccatactgttctccatagtggctgtactatttayatttcaaccaacaatatatgatggttccctttctccacatcctcccagcatctgttattgcctgttttttttttttttttaatacaagccattttaactagggcaagtggattttacattgtggttttgttttgcatttctctgataattagtgatgttgcgcattttttcatgtaccttctggccatttgtctgtcttcttttgagaaatgtccattcagatctttaatccatttttaatcaaatttttttttctgttgagttttctaatcaggtctcatgcccattttaaaaccagat

SEQ ID NO: 183827 - DNA, 601 bp, Human
acctcttttctttacaaactacccagtctcaggtagttcgttacagcagtgtgagaacagactactacatatccttttggcttctataatcttacttttaaaaatgctctttctgagaactttggtaatggtttcccatcttaccccaaaattgtgtgtttgggcttctctttcagtcactttcaggtttgaatgcacatattttgtcaccatttcaattttgatgagttgcatttctgcttttgcctcctagagtttccttcctcagtgaaagcttcatgatcatgtctgccaaacaccyccacttagatctttataccaattcaatagagttcaatttttctcagcctagtgactacgttttccttttctattaatcctttacagccaaatcaaatgagtttacatttccttccttccttccttccttccttccttccttcattccctccctccctccctccctccctccctccctccttcctttcgagacagggtctctttctacagtgaaggctggagtggagtgctgtggcacaatcatagcccactgcagtctcacattcctggcctcaagtgttcctcctgcctcagcctcctg

SEQ ID NO: 183828 - DNA, 601 bp, Human
ggcacctcccaccctccctctcctcctcctgttcccaccatgtaatatgtactggcttcccctttgccttccgccatgactgtaagtttcctgaggcctccccagccatgtctcctgtatggcctgcagaactgagcgtcaataaaacctcttttctttacaaactacccagtctcaggtagttcgttacagcagtgtgagaacagactactacatatccttttggcttctataatcttacttttaaaaatgctctttctgagaactttggtaatggtttcccatcttaccccaaaattgygtgtttgggcttctctttcagtcactttcaggtttgaatgcacatattttgtcaccatttcaattttgatgagttgcatttctgcttttgcctcctagagtttccttcctcagtgaaagcttcatgatcatgtctgccaaacacctccacttagatctttataccaattcaatagagttcaatttttctcagcctagtgactacgttttccttttctattaatcctttacagccaaatcaaatgagtttacatttccttccttccttccttccttccttccttccttcattccctccctc

SEQ ID NO: 183829 - DNA, 601 bp, Human
ctgagccatactggcaagaatcttgaaggttttttcggtggctgttgttggcctcttcttcaatttatcagagcactttgtagaaaacatccatgctcccatgtcatgccaaaagtaatgaaatgtaaaacatgatgcaattctatgctttttccttaataattactgaaatttatttttcttggagaaacagacaatctaggagcttagctgacagcctcaatttgccatcttgtaagagtaattttgagactttaagttccatgcacataggcatgagataactgagacgtgctcttcrattctgaagggatggtcctttgttactaaacaatttgtagcacatttggtagttctggtttgtggttagttcagaaccactgtttccacctgtcctgtgattgcatgcctttgtttctttgtttagtatgaggttctgaatatatcatttagttttttgtgttaactaccattatactttactaccaacggtgaaaaaagaaattattcatttcttattggccataagcactaatttatagagggagtatataaagttagggagaaaaggttttttccccgtctcccatcctctgcttaa

SEQ ID NO: 183830 - DNA, 601 bp, Human
cacatgctccccctgatacttaaaagccaggctctagcttttatgtgattatttgttgacagcagtgtcaacatgtatctcattttgaaaaaaatctaaatcaagatctcttaagaaataatttgatattattcaagaccttcctcccatctcttctcggaatgtgttaatatacaagagcaatacatgttttgctctttagtatttgtttggtgtttcacttgcccattcactccttcaagaaacattactgcatacgcattataccctaggctctgtgctgaacactggaggtataaaragagtgaacgattcaaacagccccagagcagagagaagtgcatgactaattataatgtaatttaaaggccttacgggatcatccccagcactgtgaaactggaggaagaagcagcattcaagtgagtgaatgtgtatttggactgagcaaagggaatattcttcaagagagattcaaaaggcttctgaacgagatgagtcataaaggacagccaaggccttatccaggtgagcaatttctagaaggtgcagcaaaacctggaggcatcagagagcagaacacaactgcagaacagaggac

SEQ ID NO: 183831 - DNA, 601 bp, Human
aatacctgaaaagaattacaaattttacaattattgctgaactcaaattcatagctggtataggtcctttatctatttaggtacatgccttttcattatcatttctcattgagttaacttgcttaatgactgtgacttttactgtgaaaaagtgatcctcaaagtgtattctcagaccactagcatcagcatcaccagacaacaagttaaaaatgcaaattcccagacctcatctcagactgaatcagaatctggggatgggttccagcaacctgtgattcagcaagcatcaaatgattcygacatgcactaaagagtgttttatgctcataaacaaaaatatgaagttgacaagtcccatggattttaacagagactctgttctctaaatcaaagttgttcatgctgtgttagcatttttcttatttcttcaaaagttatgtaactgtatcatagtcagaatttcattctttgcatcagcaaatactttggtttaaaagcaagcctgaattttaatattcaaaatgaaattaaatgaaatagagatattccatacatcacaaatagaaagctagttctatattcattcattcaatcagtc

SEQ ID NO: 183832 - DNA, 601 bp, Human
atttaccttaacacggacttggaggaccttcaaaaaacagtgatgggaggaaatccagttttaaaagtcttgatttaaaaaaaagaaaacactttctgtggataaagataggctgcaggaaatgtaacctatgaaattttctcaaattagctttcaaacacacacaaaaaattgcatttggttgaggagcagaatgtaacttatattaaagaataaactactatttagtatctgagtgaagtacaaaaggaggcactaaaatcattgaggaaaatcccatgttatatggcttacattaatrtttttctaggtaaggtaaggtaagttactactaccaagttatgaaacaccatttgatgattgcaattcattttctctggcatgaagaaacaatcactcttgtaacacattgatactacaaactacattatgcacaggtagccaaagaaatctatcacaattcaaatgcaacagtctgtcccagtagcatacagttggtatcctctattttccattgtatcctctattttccattcaggatagcacaattgtccagtcgctctcttctcttccatactgcaacaaaagcaagaaaacgtgt

SEQ ID NO: 183833 - DNA, 601 bp, Human
tagtcgcctgacagccagccagctacaacataatgtggaaaggacaatggtgggaaatgcactcaggtcttcctaatgcacagagtatgctcaggctgtgacatcaggaagaaaacagatatttaccttaacacggacttggaggaccttcaaaaaacagtgatgggaggaaatccagttttaaaagtcttgatttaaaaaaaagaaaacactttctgtggataaagataggctgcaggaaatgtaacctatgaaattttctcaaattagctttcaaacacacacaaaaaattgcatttgkttgaggagcagaatgtaacttatattaaagaataaactactatttagtatctgagtgaagtacaaaaggaggcactaaaatcattgaggaaaatcccatgttatatggcttacattaatatttttctaggtaaggtaaggtaagttactactaccaagttatgaaacaccatttgatgattgcaattcattttctctggcatgaagaaacaatcactcttgtaacacattgatactacaaactacattatgcacaggtagccaaagaaatctatcacaattcaaatgcaacagtctgtcc

SEQ ID NO: 183834 - DNA, 601 bp, Human
tttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaaggtgatttaatgattacgctgataaaaatgtgttgcttgtgtttttcatatttaaaatctacaggatatgtggctcttagatggctttcccaatcactggccaattgtatctttagatacaattgggatttttttttttttttttttttttggtggggagacgagtcttgcactgtcactgggctggagtgcagtggtacagtctcccgctccccgcaacctcggcctccggggttcaagtgattctcctgcctcagccttctgagtaactgggactacaggcgtgtgccatcatgcggggctgatttttgtatttctagcagagatggggtttcaccatgttggccaggctggtctcgaactcctgaccccaggtgatctgaccgccttgacctcccaaagtgctggaattacaggtgggagccactgt

SEQ ID NO: 183835 - DNA, 601 bp, Human
atggcaacaagacggaattggaacgggcttttggctactatggaccactccgaagtgtgtgggttgctagaaacccacccggctttgcttttgttgaatttgaagatccccgagatgcagctgatgcagtccgagagctagatggaaggtgatttaatgattacgctgataaaaatgtgttgcttgtgtttttcatatttaaaatctacaggatatgtggctcttagatggctttcccaatcactggccaattgtatctttagatacaattgggatctttttttttttttttttttttggkggggagacgagtcttgcactgtcactgggctggagtgcagtggtacagtctcccgctccccgcaacctcggcctccggggttcaagtgattctcctgcctcagccttctgagtaactgggactacaggcgtgtgccatcatgcggggctgatttttgtatttctagcagagatggggtttcaccatgttggccaggctggtctcgaactcctgaccccaggtgatctgaccgccttgacctcccaaagtgctggaattacaggtgggagccactgtgcccagccaggatcaaatattttt

SEQ ID NO: 183836 - DNA, 601 bp, Human
tgcaatggtgtgatcttggctcgttgtaacctctgcctactgggttcaagtgattctcctgcctcagccgcctgagtagctgggattacaggcatgtaccaccacacctggctattttttgtatttttagtagagcgagggtttcaccacgttggccaagatagtgtcgaactcttgaccttgtgatccgcctgcctcggcctcataaagtgttgggattacaggcgtgtaccaccgtgcctggccaaagctcattttatattagtaaaaataagggagctagaaatttgatgttaaattscacagacacttaggtgtgttctttgcagaatagccaactgagagtacttttggctttaatacgcatgtcagaaagtcaggctgttttaagtttaatatctttgccccctcagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcaggtacttgagagaaagcttgttaagaggtattggtgtaatggagtagctagtag

SEQ ID NO: 183837 - DNA, 601 bp, Human
ctcagccgcctgagtagctgggattacaggcatgtaccaccacacctggctattttttgtatttttagtagagcgagggtttcaccacgttggccaagatagtgtcgaactcttgaccttgtgatccgcctgcctcggcctcataaagtgttgggattacaggcgtgtaccaccgtgcctggccaaagctcattttatattagtaaaaataagggagctagaaatttgatgttaaattgcacagacacttaggtgtgttctttgcagaatagccaactgagagtacttttggctttaataygcatgtcagaaagtcaggctgttttaagtttaatatctttgccccctcagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcaggtacttgagagaaagcttgttaagaggtattggtgtaatggagtagctagtaggagcaggtatttctcttaagtttgttggtgggttttaaactttggaagaatcggaggtttct

SEQ ID NO: 183838 - DNA, 601 bp, Human
catttcagatagcgtctgtgcatgtttaaatagctatttgaaaggaattactcgaggggaagtggaaatgggggacaaggggatggggctgcatctctgtatattggcgtttcaagcctcgatgtggtgtgtggcaggattcatttataagaaagcaagccatgttttattatgtctagcattggggaaaaaactcattatttttcaattcacaaaaaaaacccagtgaatttaatgaaatgttatgagatgagtgcttttcttaaagttccaccctatttcaaaacatcatttaggaggytgacagcggaacctgtttgttcactgtacactttggacacattagatcgtcattcacatgttacatgatccctttggcctcgttaaaatatttaatgcttttcctacacagcactgattatttttaaaattgttgaacaactgtgaataagtgattttttttccccctcctgaaacaacacttattctttggactgacttctgacttgtgcgtgatcatttttttttcttctgcctttaaccgggctgcaaaatactataaaagatacttaacaaatgacagttttttcctctggtataa

SEQ ID NO: 183839 - DNA, 601 bp, Human
atacatactaataggccacctggcattaatattgtcatgacagttaaatgttggaagggggaacagtagtagccaaatgctcaaaatgaagttgtcattgttagttgagggataagtggagttaggtaaggaattttctatggcattagtgcttttaagcctacagaaaaagttagggctctaccaagaagccagggtccagtacagaaagagacaggtttggatttgaagcccgacaagtaatgttttcctctcctgaaaaatctgacaagttactaggcttctaagctttctcagcctytaagttatctcatctgtaaatgagataatgccctcttgcaaagttgatgtgagtaataaatgaagccgccagagcaatgtttgacatacagttaacttggatgaattgagtgatgctgctgttccctagtaagagtatcctccagtaggtatgcaggtagttacatttgtgggtgtgaacagtgtagaattgatagtgtttccctagagcatcagcatgaaggtttcttaggtagcttacagtggtgtggggaggaaatggtttcatccatgtgttggttccttcagcaatggtggtatt

SEQ ID NO: 183840 - DNA, 601 bp, Human
atctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaaaacttggaactaacccaaatrcccaacaatgatagactggattaagaaaatgtggcacatatacaccatggagtactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagatcacatggacacaggaaggggaatatcacactctggggactgttgtggggtggggggagggatagcattgggagatatacctaatgctagatgacgagtta

SEQ ID NO: 183841 - DNA, 601 bp, Human
ctaccacgcccggcctagagtttcttttttaaggctacatagtattccattgtacatatattccacattttaaaaatcctttcatctgttggtggacattaggtttctgcagctatcactatcacattgtgaatagtgttgtggtgaacatcggagtggtaatatccgtttgagatcctgatttcattcttttggataaataccccaaagtgggacttctggaatatatggtagttctgtttttaaatttttgaggaagcttcatacttttttccatagtggctgcaccattttgcattcycaccaacaggattccaatttcttcacatcctcaccaacagtagttgtgttttgttttgttttggttttttgataatagttttccttacaggtgtgaggtaatattgtgttgtggttttgattttcatttccctaatggttaatgatgagcatcttttcatgtgcttactgcccatttgtatatgtttggagaaatgtctgttgatgtccttagcacatttttaagttgagttatttgtgtttttttactgttgaattattggagttctttatatatttggagactagccccttgtcagat

SEQ ID NO: 183842 - DNA, 601 bp, Human
tcaataaacaaacctgtcacctcattcaagtttattcctaggtagttaatttttttctattgtaaatgagattgttttcctaatgtccttttcagatagttagtgtatggaaacattactgatttttatatgttgattttgtatcctgctactttactcaatttgtttattctaacagttttttaaaaatggaatcttgcgagttttctttcttttttttttttttttttttgagacggagtctcgcacagtttcccaggctggagtgcaggggcacagtcttgggtcagtgcaacctccrcctcccaggttcaagtgattctcctgcctcagcctccgaagtagctgggattataggtgcctgccaccacacctgactaacttttgtatttttagtagagatggggtttcaccatgttggctaggctggtctcaagctcctgacctcaagtgatccgcccacctcggcttcccaaagtgctgggattataggcatgggccactgtgcctggcccaaaagggacaattttactacttcctttctgatttggatgtattttttttattttattaagcatttaatttattgcttaattgcttt

SEQ ID NO: 183843 - DNA, 601 bp, Human
aagtttattcctaggtagttaatttttttctattgtaaatgagattgttttcctaatgtccttttcagatagttagtgtatggaaacattactgatttttatatgttgattttgtatcctgctactttactcaatttgtttattctaacagttttttaaaaatggaatcttgcgagttttctttcttttttttttttttttttttgagacggagtctcgcacagtttcccaggctggagtgcaggggcacagtcttgggtcagtgcaacctccgcctcccaggttcaagtgattctcctgyctcagcctccgaagtagctgggattataggtgcctgccaccacacctgactaacttttgtatttttagtagagatggggtttcaccatgttggctaggctggtctcaagctcctgacctcaagtgatccgcccacctcggcttcccaaagtgctgggattataggcatgggccactgtgcctggcccaaaagggacaattttactacttcctttctgatttggatgtattttttttattttattaagcatttaatttattgcttaattgctttggctaggatttccagtactatgttgaa

SEQ ID NO: 183844 - DNA, 601 bp, Human
gattcagttagctagtattttgttgggaagttttgcatctatatttattaaggatattggtctgtaattttctttttttgttatattcttcccttgttttggtgttagggtgatactggcttcatagaatgatttacggaggattccctctttatctttaggaatagtttcagtaacggtagtaccaaatttctttgaatgtctgaaataattcagctgtagatccatctggtactggactttttttttgttggcaattttttcattcctgtttcagtctcaccacttgttattggtctgytcagagtttctgtatcttcctgatttaatctaggagagttttatatttctaggaaattaaccatctcctctggattttctagtttgtgcatgtaaaagtgttcatagtagccttgaatgatcttttctatttctgtgttatcagttgtaatatctcctgtttcatttctaattgagcttatttggatcttgtctcttcttttcttggctaatgttgctaatggtctattgattttgtttatttttttttaaagaaccagctttttgtttcatttattttttgtaattttttgtttcaatt

SEQ ID NO: 183845 - DNA, 601 bp, Human
tctccagttttattccactgtggtcagagaggatacttcatataatttcagttttcataaatttattgagtcttgtttaatggcgtatcatatggcctgtcttggagaatgttccatctgctggtgaaaagaatgtatattctgcaattgttgggtagaatgttctgtaaatatctgttaagtctatttgttgtagggtatagtcttaagtccattgtttctttcttgactttctgtcttggtgacctgtctagtgttgtcagtggattattgaagttccctcactattattgtgttgccrtctgtctcatttcttaggcatagtagtaattgttttataaatttgggagcttcaatgttaggtgcatatatatttaggattgccacattttcctgttgtactagtccttttatcgttatataatatccctctttgtctttctttttttttttgttggagacagagtcttgctctgttacccaggctggagtgtagtggtgcgaccttggcacactgcaacctctgcctcccaggttcaagcaattctcctgcctcagcctcccgagtagctgggattacaggcacacaccaccatgcctg

SEQ ID NO: 183846 - DNA, 601 bp, Human
ccagtcccttctagcttgtagggtttctgctgaaagatacactgttaatctgataggtttttctttataggttacctgatacttttgccccacagctcttaagattctttccttcatcttgactttaggtaatgatgactatgtgcctgggccatctttttatgatgaatttcccaggtatttttgagcctcttgagatttggatgtctagatctctagcaagaccggggaagttttccttgattatttcctgaaatatgttttccaaactttcaaatttcttttcttcctcaggaacacsaattatttttagctttggatgtttaacgtagacccagccttcacggatgctttgtttatttttttttaaataatttttctttatcttggcagattgggttaattcgaaagcattgtcttctgtctctgaagttctttcttctgcttgtttgattctattgctgagacttcccagtgcgtttggcatttctctaagtgtgtccttgatttccagaagttgtggttgttttttatttatgctatatatttcactgaagaattttccttttatatcctgtatcatgtttttgatttctttaag

SEQ ID NO: 183847 - DNA, 601 bp, Human
taggttacctgatacttttgccccacagctcttaagattctttccttcatcttgactttaggtaatgatgactatgtgcctgggccatctttttatgatgaatttcccaggtatttttgagcctcttgagatttggatgtctagatctctagcaagaccggggaagttttccttgattatttcctgaaatatgttttccaaactttcaaatttcttttcttcctcaggaacaccaattatttttagctttggatgtttaacgtagacccagccttcacggatgctttgtttattttttttwaaataatttttctttatcttggcagattgggttaattcgaaagcattgtcttctgtctctgaagttctttcttctgcttgtttgattctattgctgagacttcccagtgcgtttggcatttctctaagtgtgtccttgatttccagaagttgtggttgttttttatttatgctatatatttcactgaagaattttccttttatatcctgtatcatgtttttgatttctttaagttggacttcagctttctctggtgcctcctttgattagcttaataattgaccttctaaattctttttc

SEQ ID NO: 183848 - DNA, 601 bp, Human
aaagaaccttgttttgtcatattaccagaattgtttttctggttccttctcatttgggtagactatgtcagagggaagatctgggattcaagggctgcttttcagattcttttgtcccatggggttctcccttgatgtggtgttctcccctttcccctaggaatggggcttcctgagtgccaaactgtagtgattgtttttgctcttctgggtctagccacccagtcgagctaccaggtgccaggctagtactggcgagtgtctgtaaagagtcctatgatgtgatccgttttcaggtctygcagctgtggatactagtacctgctctggtggaggtagctggggagtgaagtagactctgtgagggtccttggttgtgtttttgtttagtgtgctggttttgtgttggttgtcctccagctgggagttggcactttcaagagcatatcagctgtggtgctacagggaggatgcacatttgccctagagacacttggtcaagtattcaggtttctcaggcagtgagcaggcccatagagctcccaagagattatgacctttgtctttggctaccaggatggctagagaaagactacgaggt

SEQ ID NO: 183849 - DNA, 601 bp, Human
aaacattaaataaaatagtatatccaagacccagtatgtgttaatatatgggataaccagatcgttttaactgctctggctaatcctcatttctataaatatgtagacaaaactagcactgctgtatggtaataactaccagtatactgctttgtcctttaaaatgtgtctgccatactaggctcaaactattaaaccaagtttttctactaaggctaggaatgtcacatgtatgcagggatgagaaccttatcacacacactcacgctcacataccaggtctctcagcccttgggcgtcrccttccaactccatgtgtattttatgcatgtgatctttatatgtgttctttcgctgttttcctatcatgtgaaacacattaaacatctcaacacatttgcgcctggttttggttgcccagtagtattcttgtgtgcaatgaaaccagtgagcaagtacacatagtaggaattataccatcttggtagaaaacagctatataaacacggatgtacatatttcactggaaatctcaaggacccacctcttcagtctgtagcagaagtctgcttgccacatcagatccttttacccttcacct

SEQ ID NO: 183850 - DNA, 601 bp, Human
gttcatgccattctcctgcctcagcttcctgagtagctgtgactaccggcgcctgccaccatgcctggctaattttttgtattttttagtagagacggggtttcattatgttagccaggatggtctcgatctcctgaccttgtgaaccgcccgcttcagcctcccaaagtgctgggattacaggcgtgaaccaccatgcccggcctttttaactttttaaaatagagaaaacagtatattccttggggaaagatgaaggattgagaaaaccagctctgggtaaaaattattatgactgcayctggagttgattaggcctgcctaggaaagaaacaggcaactgctatatgaccacaggggacagccaccatctgagtctcagcagactagttcacacgccatgcaatgttgctgtatattcaaattgtaaaaatcatctagcttatcatgaaacaagctgcatttatcatcagagactgtcaggtcatcatctccacctgcagacagagcttaagcagcatctcacctatctcaaagatgacagactcttgtcactgttgtcaaaggggttgctgttctgtttcctcagtgagctcccaga

SEQ ID NO: 183851 - DNA, 601 bp, Human
agctgcatcaagtacgtaccttgattactactatctcgtgactaactgcttgttcacagccttccccacccttcccaccagctccccttcactaacctgtgcatcctttgcttgtctggtctcttttacttcttgtttttctcctagtttgtgaatagctcttaaagtctgacttgttgtcatggtgcgttgaaagagtagccagttgtcttttctgggtagatcagctatgagctgactgactaagaggagtagttaaaatggagaaagcttagctgtactttgtcttgcatgttaaacrtaatgagtttagaggattatgattatttgtaatcatcaggatctgctagacaggacatctgttttactttttactcttatgttggtggagaaatagcgtgcttttcattcaatgtgaaaattttgtgttctagctgggcaccgatggcttagtttttgaaatgtaatttcttgagaagtagcatgtggttagtataaaattgtctttcctattaggactagctacgtaattagtctgaaatatttttctaactggaaaattagttgctgtgaacttttggatttttattattctagactg

SEQ ID NO: 183852 - DNA, 601 bp, Human
tgtcttatttttatggaatattatttatatgtgtctttgtattttcatacttaccacattcccacattaccaaagacttcagaaagcattaacatagtttactctggatttataaattgtaatgatttgacttatccctaggcagtatgatttaatgttttactttcttgatcctgttaccaaagctagagcacctgccccttgggattcctgtgagaattaaatagtgcctgtaatgtagttaagcacaactaaacaaataacagtaaatagtaatcgtaatcacaaagcactgggtgattattcctctgcagcctgccatccatcaagtggtgtgcttagtaatgtggcacagcttttttaggggaaaataaaaaagatcatgggtcttgccctcaaagtgtgacgttaatagctaacatttttaagaactttttttggtttacacggtgctttaatgtacattcttagttaatccttataacagttctttggtataaggttctgttttaccagatgaagaatctggagcttaaaaagattaaggtgacacacagatgccagcaactggattcaaacctaggtactctgactcagtcag

SEQ ID NO: 183853 - DNA, 601 bp, Human
ataatttatgtaatgaaatgggaagtatgcatgaaactcttttgtatattgaaatacaatggttgtctcaaggaagggtgatgattgtgaggcaaactagccttgtacttgaaagactgactcatagacaaactatgggtgttaggacttgggtaaccagcagattcttatttttgaaagtgaattaaatgagcgaatcagaccaaggaaaggcaactggcagaatttgttgctaatgataaaattcaggttttcaagcaataattagggttttggaaaatttgtatgcactcttatgggytggatagcatcccagtatttaagactttattccaattagatcagtagtgatttcaacaaatgtgtgttttttttaaaaaaaaaattgttacgaaatgtggtaaccttggggaagatttgggcaatcttggggaagatttgaataaccaagtgaaccaatatttcccagaagaccaatgcgtgacattacaaaatctgaaatggtaaaagatccattcaaatgcaagataggtcaatggatttcgatataatagattatgaaaggtgcattgatacagttttatattctacattgcagatt

SEQ ID NO: 183854 - DNA, 601 bp, Human
aggcaggagaatggcgtgaaccccggaggcggagcttgcagtgagctgagatcacgcccctgcacaccagcctgggcaatagagcaagactctgtctcaaaaaaaaaaaaaaaaaaaactcctccctaaaaaaaataaaaaagaaaaaatgctcctcccttttccaccgtatctgtatggggctggattttcttcatacactttagcctgaacaatatgttatagtaaatggaatactagctttctagaaagtcatatattaaaatataaaaatttaaaacactgctatttttctcacaatttttttggaaaatttatttttcataaagttatttgtgttagcatgtaatgaggtttaaaattttttacatgagttgatgagtagaaattaaaactgactagttgaaaaatttgatatggtaaatatcagtatatataacccacttaaaagctggtcctcaatttgtgagagcataaaagggccctgagatcaaaaagttagagaagctgccctggtaatggcaagccactgtaaactgttagcttctttccccacaggccttaaggtaaagttgtgatttcttttccagctgatctcagt

SEQ ID NO: 183855 - DNA, 601 bp, Human
ttttttttttagatggagtctggctctgtcacccaggctggagtgcagtggcacaatctcggctcactgcaagctccatctgccgggttcacgccattttcttgcctcagcctcctgagtagctgggactacaggtgcctgccaccacgcccagattatcttttgtattttttagtagagacaggtttcaccatgttagccaggatggtctcgatctcctgacctcgtgatctgcccacctcggcctcccaaagtgttgggattacaggcgtgagccaccgcgcccggctgtatttaacactgtgtgtgtgtgtgtgtgtgtgtgtgtgtgtgtgtgtgtgtctgtgtgtgtgcgcgcacgcgcgcatgcatgcgcgtgtccatgcgcaagtgtgtgctaagccctgttctgggtatagtgattcacaatcaaacagacccaggtgattcaaaaggttgcttcaatttgcacattttacatttgaacaaataatttgtttttcaagttattttctgtcatcttggcatcttaagtgtttagaaacagtctttttcttggttcttatatttgccttttcctcagacaagcctactggaaata

SEQ ID NO: 183856 - DNA, 601 bp, Human
tggggaagacaatgaagcaacaccattcaaatcactatgaacattccagtgtatgaaactctgttgggacatggtaagggtagaaaacgtgtgatggaatcagatttcagaggccttggatactaggcttaacttcagatttttttggttaggagttaccttttgaggctcctgtgcagttgctaaataatgttatccttaatctggctacagtgtgtagaatagattgaagaactggaaaatggagataggcacctagtttaacaggctttcaaaacccattagtatgcaggtcttatcyaccattggaattaagctgtttgttaacacctgcagagcagtcagtctttaaatactatggccaaaagtatgagtgttctcatagatgctgtagaaggcctgaaaaacctttcagactgtaataagaacaaacttggcttaatctttcagcagaggccttttttccaaatatttgaaatttatccttagaaagctactggattgctttaattgggtgactaggaataattgataatattgcaagtgttactaattttacttcattatcctttttctcgtctttgaggtctttttaatgtta

SEQ ID NO: 183857 - DNA, 601 bp, Human
ttgtttttttttcccccgagggtttttattttaacttttagtgttgagaagaggcaccactggccaattacttgatgataaccaatggattggtcggacaatgactttagatgaagcaatcttattgactatgtatgcctggataacagtacattttatttttatttttatttcatttatttattttttattattatactttgttttagggtacatgtgcacaacatgcaggtttgttacatatgtatacaagtgccatgttggtgtgcagcacccattaacttgtcatttacattagatatatctcctaatgctgtccctcccccctccccccaccccacgacaggccccggtgtgtgatgtttccaaccccgtgtccaagtgttctcattgttcaattcccacgtatgagtgagaacatgtggtgtttggttttgggtccttgtgatagtttgctcagaatgatggtttccagcttcatccatgtccctacaaaggacaagaactcatccttttttatggcttcatagtattccctgctgtatatgtgccacattttcttaatccagtctatcattgaacagtatgttttgcctttgtg

SEQ ID NO: 183858 - DNA, 601 bp, Human
tggtgatctgtgatcagtgatctttgctgttactgttaaaattgttttggggcatcattaacgatgttcatgtaagactataaatgtaatgagtaaatgttgcgtgttttctactgctgctctgcccgactgctctttccttctccttgggctttcctgttctctgagaaacagcaatatggaaattaagccaattaataaccctacagtggcctcttaagtgttcaagtgaaaggaaaaattgcatgtctttcactttaagtcaaaagctagaaatgattaagcttactgaggaatgcaygtcaaaagctaagataggctgaaggctaggcctcttgcctcaaacaattagccaagttgtgaatgcaaagaaaaaattcttgaaattaaaagtgctattccagtgaacacacaaatgataagaagtaaaacattcttattgtggatatgaagaaagtttgaaaggtttcgataaaacataaaagcagccacaatatttccttaaaccaaacctaatccagagcaggaccctaactctcttcagttctgtgaaggccgagagaagtgaggaagctgccaaagaaaagtttgaagcttgcag

SEQ ID NO: 183859 - DNA, 601 bp, Human
gcacaattttgtctctttggagttatatttattttcatgatgaatattttaaaacttaacaacctattgtaaactgttatttttgcagttatgtttgcctaacacacaaacacaccaagcatgttcctgtccccaaggtctttgtactttttgttgcctttacatgaaatccactctccctaattatggcccagccttggagctctcaggtctgtcagggctctgcagaggattacctggttttggggaatgttttcttctaaaatgtggctctatctttattatgtttgttgttttcccyctacctggcattatgttatatactcgtgcttgtttaaaatcactttcccattaatatccaagggtagaaactttgtttcattcactgctgattatcctactgtgtatgataaagcacagggcctggcacattgtaagcagtaataaatatttgttaagtgaatgtaggaatgttgttgatcaaattaaaacagttttgttgaggagatgaagattctgtgaaccaatttttaataatcattttacgtgaggttatttgaggtttttatgctcagaagtgaaccatttgaaaagatgtaat

SEQ ID NO: 183860 - DNA, 601 bp, Human
ctcctttcagaagctttgctgtatatctgtattcctgttgaggtgattcatgttaatgtattgaaggttttgagagcactgcagtagaggaagctgtttaactcttaactatttctgacttacttggccctagtcctctccctcacttgttcgtatgtatgtatgtatgtatgtatgtatgtatgtatatatgtatgtatgtgtgtatgtatctatactcataaaattgttttttttttcttttttctgtatgcttgggtaggtaaatactgtgtcaggagtgaagccttcaaaactgagccctgttgcagagttggaagatattatgatagttatgatctgcatgaaagcatttgtatacatttttgagtcttgcaaattgtaatttggaataaacggcatgtataacaataatgattttatgaaaattgattccaaaatgatgaaatgatttctaagtaacatttttcccctttattcatttatcactttcagtcatcgtcgatggttttaatctgccaagccatatttccagaactttaggtacttgacaaaattaggaaataatattttgtcatgaaaagttgagttttctctagat

SEQ ID NO: 183861 - DNA, 601 bp, Human
tgttttcatggatgtgtttattattaaataaattttaatttagttaatatgatactggctataataatctgactatatgttgttcacctgttgatcgatttcaaatgcttcctttcctgaattctgatactccaccagtgcaaaagacaccattcactaggggtaaaaagaaactatattaaatgtctcctattgagtataatacatgtttgtatttcagaaatactaatataggcaaaaaataggcctcagaattgagtctgctatacgtttttttttgagacggagtctcactttgtcrtccaggctggagtgcagtggcgtgatcttggctcactacaaccttcaccttccaggttcaagtgattctcctgcctcagcctcctgtgtagtagggattacaggcatgtcccaccatgcctggctaattttttgtatttttagtagagatggcatttcaccatgtgggccaggctgatctcgaactcctgacctcaagtgatccacccgcctcggccacccaaagtactggcattataggcgtgagccacagcacccggccagcaatacgtttaatgtaatgtttgtttccagagtttaa

SEQ ID NO: 183862 - DNA, 601 bp, Human
ggaaatcttaggagtgtgtatgttagacatcttcactgtaggtaagactttgaaagttgttggatgtgtgtgtgtatgtgttttggtttacatttcatctggatgtaaatgtattttcctgtttttccccttagggtgttgtcattggaacaggagaaaattctgaatttggggaggtttttaaaatgatgcaagcagaagaggtgagtacttaatatgttaatgatgtatttgttccaaatctgaaattcttcattgtaagtagagaatgttggattattttatatactattgagagcartattttattcagaatggaaatcagttgtctctgtttagaaacataattggaaagcctgtaattgaaaaggtctaaattgatgttgttagtattctaaaggattttgagctttactcattgtttatagcagaaaaaggcttatagccacttatttgtagatcttattattttcagaaattagtgttgtggtaattttaaggattagtaattagtatatttgtaccttggaatatgtcttctatcaaattttttcaacttcacataattccaagtaagggtggcagggaaaagattgccaag

SEQ ID NO: 183863 - DNA, 601 bp, Human
agactactagtagccattgttcatttcaacaaagaaaaaatagaactctgattcttgtaatcagaaaatatttcttgaaacattttagtatttgtctttctagtcttcaacaagaatgtaatacgatagttttatggactgcttttctatttttatttcacatatcctgtcataaaactcttgtcattaaattgatggtcacataaaacaaacataaaggttgtatagttttctattttgtgggaaaacatataagaagacctcttctagacatttaggattttttgagggtttttttttkgtcatataaatacttctttagtgtggtgtcttctggtaaatacctctcttttttaaggaaaaattcttagaaataaaattatttagtcaaaggggatccatgtaacttttaaatttttggccagctttaagtattgtcattaacttcaactgtaaataaaagagttctcattatttgatttcacagttcattattagggaaaccgaatgctttgtcatgtgtgggttgatcatttttatttcattttatgacctgccaacgatttcttttgtcccttttcttgtgtcttgagtcttagat

SEQ ID NO: 183864 - DNA, 601 bp, Human
atccatgtaacttttaaatttttggccagctttaagtattgtcattaacttcaactgtaaataaaagagttctcattatttgatttcacagttcattattagggaaaccgaatgctttgtcatgtgtgggttgatcatttttatttcattttatgacctgccaacgatttcttttgtcccttttcttgtgtcttgagtcttagattgataaaagctttttatatgactagattatcaatctttttgttgtataagtttttttttcccgtttaagttgcctttgaggcatgtggaataaacytggtaagaggacaatatatgtaattaaccatttatgcctagtgttccattattggaatgctaagcatgtgggacttatttatatcctactgctcaaggtcattgccaaggtctggttgcaaaaattcaaaaaattgcaacctcagacacaaatgggttaaaacatccccttttccttgagattctgttatcaccctcctattgataatctctgcaattaagttggttttgttctgttcctaaagattttcccaacctcatgtttataagaacatttattaaaacattgttgtatagtttt

SEQ ID NO: 183865 - DNA, 601 bp, Human
catatgaaatatttcaaatattagaacaaaagtcaatgtctttcaaaaagaaaagtcaaatagattacaaggaatcagaatgaataagaagtaaaaagatatttgtgatatagtgaaagaatgtgtttttttttttctcaagggagggggtgaaaatgcaatttgaaactcttggtttaaatttgtgtttaaaaacgccatgggttaaatataaaatacatttaaaatggggaataagtttgagatattaaacattgacatattatccattggatcatttttagtttttgaggatttgggtttttttttttttgagttctgtttgtacagattgacatatcataacttctgttctttcttcaaggtcttccaaaggacaagatacttaaaaattttcaaatagaataaaactcattctattttgcaattctgttttgcagtatggatccattggaatcttttataagtataagctacattatgggacctttaatgatcctatttttcctctttcttgaagtattttacaatttcttcaccctaggaattattttaacaattatttgcaagagtgctgaagatgactaaaacaataagaaag

SEQ ID NO: 183866 - DNA, 601 bp, Human
aaatattttttgaaatctgaaatcaatatttataagataaatatgttccaagttcaccaaaagcagtagatgagcagttagttgcatccaaaagatgttacccatttcaggtatagatgccttcaagtccaggaatagttttgggttatcattaaaatgaaaatttagagtgaagtttttttacaatttaattattcctctgcaaagttttgctaagatgacttaaatataaaagattgaaaagattcgttgtatctagattgtaagtgataatgcctgtttttccttaatggaagcattaaaaaaaaaaaaaaaaagaaaagaaaaaagaaaaaaaaggattccatttgaactaggaacattctctttgagtagcccaaaggagaaaaggaagtattaatgataatacatatttcttgactcttcagtgtgtattgtttagccaataatgttgttgcttatgtgctttcaactttaaaatcaaccagtaaataaagcatgaaaaagtcaattacggttatagaaaaggatgctaatgtactagattatgcaaagaaaaagttggtaatggaaattaggaagtagaagcagcagagggaac

SEQ ID NO: 183867 - DNA, 601 bp, Human
ttggtgacttgtaatgatttaattctttaggctgctgtaatgtgatttgttcagataaaactggaacactgacgaagaatgaaatgactgttactcacatatttacttcagatggtctgcatgctgaggtactctataggtttttaaaaacaaacaaaaacagtatccctttaagaaacttggtgtttaacattcctaacagttccagtgtcttaccttcaaaagggctgtaaattagtagtggagttattttctctctctgtgattttaccaagtctttgtctcattccacttgtacacytgttcaatccaaaaactttgattcctccttgacatctctctttcagtcaccccttcatctatccataatcaaatcctaccaattttgacttcctaaagaattttcccagccatctactttatagccagcttctttaagttaccgccatttctcacctgccattctgataaagctttttgactggtctttttccattcttgatgccctcactccataagcagtttgagggatctttttagaaccaaattttaagcatgtcactccataaattaaggtactccaatggttttccattgtgat

SEQ ID NO: 183868 - DNA, 601 bp, Human
tctttagtatttctatgtaaagataataacacagtcatgagaaaatagctttgttttcccagtctttcctttctctcctttgttaatttctcaaaatgattgtgaagttataatttgttttggggagaagaagtctcagttaacttttcatctgtcccaatccgtctccttatcccctaagtcctatatttgattcagtgagaaacctagtaagtccagcctgtcactcataacaaaaataactattcctacctttaagagtattcagagaaaattttgatacttgtataaagcaagaggyttctaaatgaggttgcttgaaatgagagacagtacagaattacaggttattataacatatttaatgaaataaaattgatagttttagaatatatagtttccttggcagaaaagcacatttctgtatcatttggtctccttacaactaaaacagcatagtactcaaaacatgaatccgttatcaagtatttcctgtgttatgcttataaagatattagtttctttgagggataaagaatatgaaactatctttttatgggcagagacctcacattttaggtagggaatttatattgacatt

SEQ ID NO: 183869 - DNA, 601 bp, Human
ggttgtggctaatgagttggccaaactggatgaaatgaaacgtatttgcacgaccaggaggatttttatagacgctgtatgtggtgggtttctggagaacctttaaggccaagaagagcctgaacatgtttcagtagaaagtagaaagcaatacatggtagaattttgagtagtttaaacatttttgatatttggaagatattttttgatatttttgatatttagatatttgatattgatgcaaaggctattaggagggaaaacaacaacatgactggtagtattcaggatataaagtggyagagggtaagggactaggatgataacaggtgagccatttgagtccctaagaagtgagagatttaatctaaaacttctattgatcataaaaatacatgctcagaattggttgggtacttttatttatttatatcctgcttcctttcagaatttgagtgggtagagggattaatacagtgtgtatgggaggtttagtcagcgtacaatccagaaaacctgccttagactatatctacatacctgggctttcatgttgaaaatgtatgctgatgtgtagggaagtacagtatatatagatgga

SEQ ID NO: 183870 - DNA, 601 bp, Human
aacatgcggtgtttggttttttgtccttgcgatagtttactgagaatgatgatttccagtttcatccatgtccctacaaaggacatgaactcatcattttttatggctgcatagtattccatggtgtattaaatacaagtgaacagggagggattactagatacttggagaaaatctttagtatgaaagccaaagaccaaaccaacagagaaagggatcttagagaaaggtagtggcagatgctgaagaaaatttccaaaaaccataaaaaagacaaaataactttcaataaaatgtttaytaaataaagtcaagaaatgtatcaaagtagaacagaaagtcaaagacatgtacagtataaaaggtaaaaatcaaaacaaatacagaagatccagtaattaccccatagtggtaataggaagggtaataggaataggtaataggaagaaagaacagaaaatgagaagattttatcaactaatgctggaaaattttccagaatgaaaagactttagcatctagaataaagtggcccaccaacagctcagcacaatatgtatgttaaagcagagtggggtgagggataaacacaagacccata

SEQ ID NO: 183871 - DNA, 601 bp, Human
catgtccctacaaaggacatgaactcatcattttttatggctgcatagtattccatggtgtattaaatacaagtgaacagggagggattactagatacttggagaaaatctttagtatgaaagccaaagaccaaaccaacagagaaagggatcttagagaaaggtagtggcagatgctgaagaaaatttccaaaaaccataaaaaagacaaaataactttcaataaaatgtttattaaataaagtcaagaaatgtatcaaagtagaacagaaagtcaaagacatgtacagtataaaaggtaaaaatcaaaacaaatacagaagatccagtaattaccccatagtggtaataggaagggtaataggaataggtaataggaagaaagaacagaaaatgagaagattttatcaactaatgctggaaaattttccagaatgaaaagactttagcatctagaataaagtggcccaccaacagctcagcacaatatgtatgttaaagcagagtggggtgagggataaacacaagacccataattaagaaatttgaggacacttggagagggagaattcgaagagcttctagagagctttaagcaaag

SEQ ID NO: 183872 - DNA, 601 bp, Human
gctgaagaaaatttccaaaaaccataaaaaagacaaaataactttcaataaaatgtttattaaataaagtcaagaaatgtatcaaagtagaacagaaagtcaaagacatgtacagtataaaaggtaaaaatcaaaacaaatacagaagatccagtaattaccccatagtggtaataggaagggtaataggaataggtaataggaagaaagaacagaaaatgagaagattttatcaactaatgctggaaaattttccagaatgaaaagactttagcatctagaataaagtggcccaccaacwgctcagcacaatatgtatgttaaagcagagtggggtgagggataaacacaagacccataattaagaaatttgaggacacttggagagggagaattcgaagagcttctagagagctttaagcaaaggggagatcatataaaagggcttaggaactaaagtatggtagtctgccacttagcccagcgggatacattccaagactgctagtggatgcctgaaaccatgaataatattgaaccttatatataccgtgtttttttcgatccggtaacatagatggctactaagtgattaatgggc

SEQ ID NO: 183873 - DNA, 601 bp, Human
ataatattgaaccttatatataccgtgtttttttcgatccggtaacatagatggctactaagtgattaatgggcagggagcatatacggtgtggatatgctggacaaagggatgatgtccttggcaggacagagtgggatttcatcaccatactcagaatgttgtataattggaaacttatgaattatttatttttggaattttctatttaatatttttggactgctgctaagtaacagaaactgcaggaaattaaaccctggataaggggacactactttaatttctttatacttttcartgaaaacattgacactggaggctggaagataatagagcaaagccttcaaaatgagaggaaatttatccctagctaaacttacaaatgtgaggatagaagaaaaatgtgtcccacaccacgcaccctttcttagatattggtggataaaagaaaaaaaagaaaagggagacttaaaagacttaaaattcagtgaggatagaggtagagggttgttcctagataccagtggtacagcaggcctagaaatcagccaattagaaatggaaagaagactgaaggagggtggtctccagtaataat

SEQ ID NO: 183874 - DNA, 601 bp, Human
ttggcaggacagagtgggatttcatcaccatactcagaatgttgtataattggaaacttatgaattatttatttttggaattttctatttaatatttttggactgctgctaagtaacagaaactgcaggaaattaaaccctggataaggggacactactttaatttctttatacttttcaatgaaaacattgacactggaggctggaagataatagagcaaagccttcaaaatgagaggaaatttatccctagctaaacttacaaatgtgaggatagaagaaaaatgtgtcccacaccacrcaccctttcttagatattggtggataaaagaaaaaaaagaaaagggagacttaaaagacttaaaattcagtgaggatagaggtagagggttgttcctagataccagtggtacagcaggcctagaaatcagccaattagaaatggaaagaagactgaaggagggtggtctccagtaataatatagaggtaatagcttatctgcttctttgttgttgtgaaaaaataccatgagaagggttttatattacattgaagagtttaggaagaatgaatgataggtatacagaaaacaaattaaag

SEQ ID NO: 183875 - DNA, 601 bp, Human
agaaatggaaagaagactgaaggagggtggtctccagtaataatatagaggtaatagcttatctgcttctttgttgttgtgaaaaaataccatgagaagggttttatattacattgaagagtttaggaagaatgaatgataggtatacagaaaacaaattaaagaggtggttattaactttataaaagacaaaacttgaacaggaaaagaagtatcctatttgagctatcaatcaggataggccatgaaaacaacatcatgctctcctgctgcctccctgtccccaaatatctgctcattrtagttacttgggaatgcaggcagatggaagctccattttaatgtgagcacacactgtcacagcaggggtagaagaataggaaattgtgcactggcacctacatttccatttggaagtgacacaagtactcatgtttattggccaaagcaagtcatacctgaccgttgtggagtgaggacggcaatagggaaatacattcctgcctcccaggagaactgggatatttgtgaactgctatagtcattaccacacttggcttagcagcaaagagtcttgttgtaaacaaaatactggcagatt

SEQ ID NO: 183876 - DNA, 601 bp, Human
gggatatttgtgaactgctatagtcattaccacacttggcttagcagcaaagagtcttgttgtaaacaaaatactggcagattttgctttagctatatcataaagatggggagggggggaatagatagtggaaatggggaaattaacatctgtcacaatagacagtgtataaaattgataactgatggagtagcagtataaacatgttaaaaacatgagggtaaatatcagagaaaacagctaagagagttaaaattattttgcttccatggagtaggactagtggtgagaagcgttgaayaggaaactgcagtatttcattataagcttttgaagattatttaccatgacaaaaaataaaagaaaaagtgcgataatacccataaatacagtgtgattgggagaattaaatggtgttttaggtagatagatatagacgtatatagtagctaatagagaacttgaaccattgtgagctgttatttctcttccatttcctgttatgttgcagtgagcctctttccacatttcagagtgccaaatttggggcttagtatagcattgccttttatgtgtgggatggtgggatagatgttttcta

SEQ ID NO: 183877 - DNA, 601 bp, Human
gcttacgaacaagtaattaagtactgtactacataccagagcaaagggcagaccttgacacttactcagcagcagagagatgtgtaccaacaagagaaggcacgcatgggctcagcgggactcagaggtaaggctatttcagcatagtcccctggggtggaaaggtagagccttcttttaattgcagatgaattcatgcttcacatttgagctgtccaactcacttccaggatttgtagaacccttgccagtattgaggtgttaagttttagttggttaattggccctcaaaagatggaartttgagaatgtagcaaaatatgaatcactggttcttttagatctccagaggtctctgagtagctgatagaaattttattttaaacaagtttatcttatgagaagggaaatggatcgaggtaaaatggtgttactctctttttatcactttgttttaaagacaaaaatacttttctaaaaattgagtctgaagcctctaatatatcctttaaggtgattgctaacttgatctgttactgttcaccagggaggtaaagaagtccccagattctgcttacttatatgctgctgactgagcagt

SEQ ID NO: 183878 - DNA, 601 bp, Human
ggatctctgaaaccacagggttttgatgtgtttttatcaagccaaatgtacaattgccaactgacactctggataattgagcacagggggtgccctcgtacattgtaccgtcactcccttctgaacagttggcagaccaaactgtttggaagctcagatactctggctcagggtaacacttttgttccccttacactcctcaactttccacctcagctagggaaagagaatgacagttaaggcttgacccaggattataatcgttagagcaagtgggagtttcagagacttaaggggcacygcagggaggccttgctgccacaaaattagggtttggattgataaagcctgtgtcggaaggggcagtggcagctccactgagacaatcctgggaagactgtggtgcagagggcctgttactcccctgattcacctgattctggggctttgaccctttctttttaaatttacttttgctaagttgcacttatttattttttaaaaagaccgttggtgaacaaaatgtgaacccatttctttcctcttttgaacttctgggatgtcatcacttccagtttgttggctttgtttccagctatta

SEQ ID NO: 183879 - DNA, 601 bp, Human
acttactttattatcttgggctgccttgtaaggggcctatcaaagcctggtttgtggatacccaggtcccataggaagtgccccataagaggtgggcagcagtcttcccagttgctgacagttcagatttcttggttttattgttagttaacttatatatgcacatctatttgtatgtccttcaaaataagcacttatctggaatttattttattagctattttgtagccatccattgttactaataaaatgtgctacctcctccttcatttattttacacttacaacttcaagttatatrttcagaatgtggaattttcttaaattgtttctgcatcttaaggtatgtctatacttttttgattagaaaatttattcattagtggtatatgttcaacatagaaaaatcaaataatatagaaaagtaagagctacaatagaagttgtctgtaatctaacccacactcaggttatgcatccacagagtatccataataagttaacctattatgacttaaaaaaatgtgtttaacaaaacctggttgctactttatactgttataattctgaacattcattttacataactttggcatttctg

SEQ ID NO: 183880 - DNA, 601 bp, Human
atacccaggtcccataggaagtgccccataagaggtgggcagcagtcttcccagttgctgacagttcagatttcttggttttattgttagttaacttatatatgcacatctatttgtatgtccttcaaaataagcacttatctggaatttattttattagctattttgtagccatccattgttactaataaaatgtgctacctcctccttcatttattttacacttacaacttcaagttatatattcagaatgtggaattttcttaaattgtttctgcatcttaaggtatgtctatacttytttgattagaaaatttattcattagtggtatatgttcaacatagaaaaatcaaataatatagaaaagtaagagctacaatagaagttgtctgtaatctaacccacactcaggttatgcatccacagagtatccataataagttaacctattatgacttaaaaaaatgtgtttaacaaaacctggttgctactttatactgttataattctgaacattcattttacataactttggcatttctgaaatcaattattattagaaaacatgtttttaattgctgtacaatattttgagtatac

SEQ ID NO: 183881 - DNA, 601 bp, Human
gaaaaatcaaataatatagaaaagtaagagctacaatagaagttgtctgtaatctaacccacactcaggttatgcatccacagagtatccataataagttaacctattatgacttaaaaaaatgtgtttaacaaaacctggttgctactttatactgttataattctgaacattcattttacataactttggcatttctgaaatcaattattattagaaaacatgtttttaattgctgtacaatattttgagtataccatgtgtatgtgtgtataaatgcatagcatgcatatatatatakagagagagagagttacataaccattttcctgttgaaatttgagcttctattctttttactactgtaaatgttcctttaaggataatgacaatagcaaccatttattatctgccaatgcatgtattacctacattatctaatttacttcttatagctaccttatgaaagataggcagcaccgctttaaaaattctaataattaataagccttatttcttagcagtgttagatttatagaataattgagcagataacacagagttctacattcctactccatctctaccctctactcttaca

SEQ ID NO: 183882 - DNA, 601 bp, Human
aaaatcaaataatatagaaaagtaagagctacaatagaagttgtctgtaatctaacccacactcaggttatgcatccacagagtatccataataagttaacctattatgacttaaaaaaatgtgtttaacaaaacctggttgctactttatactgttataattctgaacattcattttacataactttggcatttctgaaatcaattattattagaaaacatgtttttaattgctgtacaatattttgagtataccatgtgtatgtgtgtataaatgcatagcatgcatatatatatatakagagagagagttacataaccattttcctgttgaaatttgagcttctattctttttactactgtaaatgttcctttaaggataatgacaatagcaaccatttattatctgccaatgcatgtattacctacattatctaatttacttcttatagctaccttatgaaagataggcagcaccgctttaaaaattctaataattaataagccttatttcttagcagtgttagatttatagaataattgagcagataacacagagttctacattcctactccatctctaccctctactcttacaca

SEQ ID NO: 183883 - DNA, 601 bp, Human
tctgaacattcattttacataactttggcatttctgaaatcaattattattagaaaacatgtttttaattgctgtacaatattttgagtataccatgtgtatgtgtgtataaatgcatagcatgcatatatatatatagagagagagagttacataaccattttcctgttgaaatttgagcttctattctttttactactgtaaatgttcctttaaggataatgacaatagcaaccatttattatctgccaatgcatgtattacctacattatctaatttacttcttatagctaccttatraaagataggcagcaccgctttaaaaattctaataattaataagccttatttcttagcagtgttagatttatagaataattgagcagataacacagagttctacattcctactccatctctaccctctactcttacacagttcctcttcatattaatagactgcattactgtagtatatttattgcaattaatgagctaatattgatacattcttatttcatggtttacattaaggtttactttttgtgttgtacctttctaggggttttgacaaatgcataatgacatatatccaccatt

SEQ ID NO: 183884 - DNA, 601 bp, Human
tatgtggcactgctgtttttgaaattctatgattcgatgtacactaacatgaacattctctattaaattttcctatcctgtgattgtgattttcaggagtttagactttagggattttgatctttagggatttcagcatttgggattatggcatttggtattgcatctttcaagattatgatcccagtatgttgggatcatagatgactgttgggatcactgccacccagagagctggggcagtgtggatgtttgctttgtttttggggtggggaaggtgtttatatatttgaatagggcttttttttttttttttggtgcacgtcctatcctggtaatctcttcctgatgtttatttctgaataaatcccatattggatttttttagtggtattgggacagagtattagtaaatgtatgtgaaatctgcagttacttaaacattttaccattagacttctgcataacttctcagagatgctaaaggtggtgaaactttcattttatttgctttcttcagtttgtcctctggctctcttataaaaattaaggtgaactctggaaaccaaccaaagatagttagggaagaaagaaactaatt

SEQ ID NO: 183885 - DNA, 601 bp, Human
actgcactcagacagtttgctgcttttgcttcacatcagtttgaataacttttattattgttacaaataaaacagaccttttgttctaaatcattagcttgttgacattttcccccatgtactagaatcatattaattgtgcccctcattaaaatatttttcagccatcctttttcataattcttttgaacacatttcattctccttttggaatatgaagtgttgctatgtactttgacctagagccagttaaaaagtagtactgaatctcagttttgcttgttattaagtcatctgggarttctcagtgttttccatttatgactttttctagtgtgtcctacattttccattgatccattgatagaagtggtcatcctctttcattcttctttttctgatttttacagcattacttgcatttatatttctactgaatctattcaccaagtccccatattattatcacaattcatatagtctaatttttaataggttgtaaacctttatttcaatcacttgttttttcttcagtgcattagttttctttaatctgtcctagaagatttgaggatcttcggtaggttattctaatgcaaga

SEQ ID NO: 183886 - DNA, 601 bp, Human
ttttcaacaggagtatagcagcattaactttaatctcattggctacattaatgaactttcctaatcctctcaatgccatgcagattttgtggatcaatattattatggatggacccccagctcagaggtacgagttttttaattgcatgagctggaaagacaaggaatgtgtactaccctgataattaagttttaaaacttgatttatggacagtgttggaaaactttgcagcaaatgttttaacatttatgttataaattgtgtgatgtgtgtattttattaattctttttgagtgtgcrtgcagtgtagatctgagcctttccactgttagatgcctagcctaaggttgagaatagatcaggaataggtgctatccctgtcctcaggaagtaagtaagccttttatttctaagaaatgggtataatggagaaatttctgggttcagttttattatctaggttctactgtcagttttagagactttgggaaagtattagaggacctgagtgtcataacttttttaaaaaatttaataataatggggtagttgagtgatagatgtcatttggccactccagcaaatcatcccagttaaaac

SEQ ID NO: 183887 - DNA, 601 bp, Human
gttaagggagctcttttagtgaaaaatataagaacattttaaaagagtttgatttccatctttatggataaataaaattattgattcatgtattagaataaatctgcagagaagtatcagttacaataaaaatacatgaaaatttagagagaagttggaaaatctgagtcttaaaatcatagagccactttattatttttaaataataacagtattttaatatctaatacatagttcatgagaagttttttttttactttttattatgtagattacagctattcactaggtgatttatagraaatttaggtagcttttatgtttcatgtgttaggctaaagttatttcttcctaatggaaagaaaatgtttatattttttaaaaagcagcgatttatccattaaattcagccactgaaaagtaattttgttattgcctcttgacagctacgagacaatgtgattacacctcgagacacaacaatgaccttcacatgctttgtgttttttgacatgttcaatgcactaagttccagatcccaggtatgtttaggtgaacttagttgattgacttgattgactcacttgagtagagtgctttc

SEQ ID NO: 183888 - DNA, 601 bp, Human
aaaactagacttaatctccctgaaaaccaagttgctctcttctttaaagttagaattttcagtaaactaataatttcattattctttcttgtttgtacattctaatttcacaaaatgtcagtctgaccaaatagcagaatgttttataaagactatttggaaattacacatttttcttacattaccatttattaaatgtataatacagtgcatttaaaaattagttttcctatgtaggtgtgaggaatgatatatttgacagtaatgctatcctttattgagttctcaatttgggtatttatgaaaaggagttatacagtttcactgtattttttcttgtaagttaaaatttaccttaaaattgaactagttgaatttcagtattttaattccatattcacatttcttcctctttttaaaaaaatggcattttaaggaaacatctgcaattttccaagcagtaaataagaattgagatagtgtggatagtattgtaaagacaagtcttctatgctttgaaatagaacatattaatgtcaaatttttaatcttcagataggcattgtcattcaaattgtctactactgttgatacagtactt

SEQ ID NO: 183889 - DNA, 601 bp, Human
acccctggctgtgtgattggctctttttggtcctgagtcttgcaccttgccagataggcaatattgtcagtgaggtgggcaggggatcaatgtccatagctgccagatcgcaaggtctcattctttccattttcccactgaactgcgtaggctggattttctcttaaagagaaagggcagcagttgactacagaaggaggggatgctggcaatacgtcagatctcacctccccacacctttgtcccagggtggcctcacccatgtagctaggtctgggctggctgtacctcctgggacccyccccaccacgctgcactggggcggtgttaaggcaggacaacaaagagcccttctgaacaggagatagataagaagctgattagggccaacggcccttccccgcccttggcagcatctgggggtgggcagacccctccatcctgggcagagtaggaggcctgggggcccatgggagcacagttttctgcagtgtgccttgaaggtgtgggtgatgagggggtagaaagtggctgaagcgagatgtttgtctaaaagcacttttctgtctcccagcatcccagccatcactcttccacctgc

SEQ ID NO: 183890 - DNA, 601 bp, Human
tgtgtgattggctctttttggtcctgagtcttgcaccttgccagataggcaatattgtcagtgaggtgggcaggggatcaatgtccatagctgccagatcgcaaggtctcattctttccattttcccactgaactgcgtaggctggattttctcttaaagagaaagggcagcagttgactacagaaggaggggatgctggcaatacgtcagatctcacctccccacacctttgtcccagggtggcctcacccatgtagctaggtctgggctggctgtacctcctgggaccccccccaccaygctgcactggggcggtgttaaggcaggacaacaaagagcccttctgaacaggagatagataagaagctgattagggccaacggcccttccccgcccttggcagcatctgggggtgggcagacccctccatcctgggcagagtaggaggcctgggggcccatgggagcacagttttctgcagtgtgccttgaaggtgtgggtgatgagggggtagaaagtggctgaagcgagatgtttgtctaaaagcacttttctgtctcccagcatcccagccatcactcttccacctgctccttagag

SEQ ID NO: 183891 - DNA, 601 bp, Human
tctaccttgtgttccccacaaactcggtgactcccctcaaaactctgctggcgactcctaagccctactccaatagttttccacgcactcaccttgtacacaaccctcagtatctttatcctgtagccgtatgaccctcgttccacgtctgcctttatcctaaaatcacccccactggcatctctctctgcgatcccagcccttcagtgtcaatcagcacatgacttacaagcgtccagcacctttctggtgctaaggaggatatagagattaatatgaagtagtaataattggaggcatsagagaattctggatcaatccagaatccagtcaatccagtgtgtggtcccagctctgtcactgctgtgctttagggacctgtgagaagtcccctcctcagtctggacctcagtttctcatcatgactgtgatgaggttgggttagatgatctttgagtttccttccgtctgtgaaattgtgaaattatgcagttctcagtcaagataataattttttgcaatcatttttgtaccccaccctggaaatttcctcttgtaacctcatcccaggatctgcttgcatcatgaaccttactccctc

SEQ ID NO: 183892 - DNA, 601 bp, Human
ctcggtgactcccctcaaaactctgctggcgactcctaagccctactccaatagttttccacgcactcaccttgtacacaaccctcagtatctttatcctgtagccgtatgaccctcgttccacgtctgcctttatcctaaaatcacccccactggcatctctctctgcgatcccagcccttcagtgtcaatcagcacatgacttacaagcgtccagcacctttctggtgctaaggaggatatagagattaatatgaagtagtaataattggaggcatgagagaattctggatcaatccagaatccagtcaatccagtgtgtggtcccagctctgtcactgctgtgctttagggacctgtgagaagtcccctcctcagtctggacctcagtttctcatcatgactgtgatgaggttgggttagatgatctttgagtttccttccgtctgtgaaattgtgaaattatgcagttctcagtcaagataataattttttgcaatcatttttgtaccccaccctggaaatttcctcttgtaacctcatcccaggatctgcttgcatcatgaaccttactccctcattcccggatcaccctcttcac

SEQ ID NO: 183893 - DNA, 601 bp, Human
ccctataacaacagatttaataagagaagattatatacatttatttaatgtaagttttatgtgacaggagccttcataaggaaatgaagacctaaagaaatgattaaacttgtatatttttatactagatctgatgaagagtggatagttgtggaaaaatacaaaaagggtaatatcaaatagtaataaactgggagaaacttagcaaggcctgtttgttcagactcttctctgtgtccctgtgtcttcacagataagggtgcttctttcctctgagtatagggagggcacctctttatgagggtattatgacctgcttcaggggaaagtcagaaaaatccttcctaggttttgtgatctgcttcaggggagaagagcctcagagaaagtgagagtgaccttcctactgccattttctcaagttgccatattttggagtagtgtcttgaacccagtcaacttctctcttcatcctttgcccaaatatctcttgttctatgaatctttgacgcttccagccctttccctgtgaactcactcaccatacagtgtctcccacctcactggcactttaccccaaatcctttcatcttgttaagtc

SEQ ID NO: 183894 - DNA, 601 bp, Human
caatcctgtataacttgcacaccctcccattctaaggcctctcctctcatacccttgcccagtatcctgtgagatcctgcctctcagattcctccctcaccttttcaaacccggattgtctttcacccttccacagggcctcctcttcctgccttcctcttatttgtcccctcagccatcctcacctcaccaatcttgataattgattacaatataaatctcccttccatctcaggtctgctcctttcttcctccactctcttgtgcatctatctccagggccatgcgtatgcccctgctrctttcagctctgcttccttcatatgctgcactgttccaccaaacttcatcagtctcttcggtttatccagagaactacactcttctctgggaacttctgatgacttctgataatagatcaccaaaggatcttggttttttagagggcagggagagagccctttgaagtccttcagaatcaatctagctgtgtctcctggacaccctcccactatcctatcctgttatgaagctgcttgctgtatatgccctcagagtagaatgctttgggtgtcagcttctgcaggcactgaattagccc

SEQ ID NO: 183895 - DNA, 601 bp, Human
tcagctctgcttccttcatatgctgcactgttccaccaaacttcatcagtctcttcggtttatccagagaactacactcttctctgggaacttctgatgacttctgataatagatcaccaaaggatcttggttttttagagggcagggagagagccctttgaagtccttcagaatcaatctagctgtgtctcctggacaccctcccactatcctatcctgttatgaagctgcttgctgtatatgccctcagagtagaatgctttgggtgtcagcttctgcaggcactgaattagccccatkgttttccaagccctgggaaaacttgataatccccaaccactgaagtctgaagagtcagtagcaaaatgtgacatcaaagatccacatccaaaagtctattctgtgggtcaccaaattcccaggtctcttataatgtacttattggctgtgcagcaataaatacagcagaaactaaaactagagttgaggaaagggtataccctgggttctacaactgctgtgggtggattttaaaaaggagttcttgccttagatttgtttacttagggcacagaacttattctgccttgtatttgagtt

SEQ ID NO: 183896 - DNA, 601 bp, Human
acctcctcctcctgagttcaagtgattctcacacctcagcctcccaagtagctggtgttacaggcgcctgcaaccatgcccagctaatttttgtatttttagtagagacagggtttcaccatgttggccagactgatctctaactcctgacctcaggtgatccactcgcctcagcctcccaaagtgctaggattacaggcatgagccactgcacctggctggttttctttatcttctgtcttcatctcttccctcacatttagcaggtagtcagtacttacctgttggattaaattaactsactcagaaattctgcatcaggtgtacaaaagtaaaagcagttcatgtctacattcattttgtggacacaacacccctccccaaagttctccaaacatgataatgggcatgtcccttgatttaaacgtcggtaatttagacacttccttttttagtcattgctcgggtgggggaatgggtgtaagtgcttttctttttctactgtatttctggtaagataggttgtttgacgcagttgctcaaatacagtggtaacagcatcaggggctgtcttatataaatctgttctcaagaaaacagc

SEQ ID NO: 183897 - DNA, 601 bp, Human
atcacgctgctgcactccagcctgggcgacagagcgagactctgtctcaaaaaaaaaaaaaaaagaagaagaagaagaagaaaatgccaggattctgggtgttaaaattttaaatagggtagttgaagaggttcccactaaaaaggtaacatttgagcaaagacctgaaggaagttagggggtaagtcaagcatacatctaggggaagtttattccagtcaggaagaacagcaaacacaaaggccctgaggcaggaatgtgccctatatattcaagaaacatgaggaagccagccaatacrgctgcagtatattagtgagagaagaaatggcagatgttgcggtgggggtgaattgggggcagatcacacaggccactggcttgtagtgtgagttgtgagtgagatggtagccattagagaattctaggcagataaataacatggcctgacatattgaaaaggtcattgtggctgctgtgttgagaataagctataacggggcaaaaatggaaggagagaaactggttaggaggctactacaatagtctaaacaagagaagttggtggcttgaacccaaggtgaagcaatggaaaggtgag

SEQ ID NO: 183898 - DNA, 601 bp, Human
caccgcaacctctgcctcccaggttcaagcaattctcctgcctcagcctcccaagtagctgggattacaggcatgtgccaccatgcccagctaattttgtatttttagtagagacggggcttctccatgttagtcaggctggtctcgaactcctggatggtctataattttgccaagatattgatccgctcgcccctcagggctgtcaaagccccagttggtcgcttctggcttgaagcagtgacatctgcaatgtgaacttctgactttaagcagcagcatctgcaatgcaatgtacaartatctgtctctctaggtcccctgacatgaaaacagtttgggtagcaccagtcaaagatatcggttggtaagtcgtgagaatccagtaggcagtccagattccaagtccaggagaattttgagaatggatgtcaaagagagtcttcacgactgcactgagtttagaggccgtgggcttcctgcaggcttcacaagtgttggggtccactgctagagcaggctgcacaccacagtgggtacagaagatatcctgccagcaggaagcttcagtgcttcccaccttgcacatgagggacccagg

SEQ ID NO: 183899 - DNA, 601 bp, Human
acatgaatgttagaacatgagttggaagaggctgaggcaggaagatcacttgagcccaggagttcgaggttacagtgaactgtgatggagccactgcactccagctgggcgacagagtgatactttgtctctaaaaaaggaaagaaaagaaaatgaattggaaacagacaaaagtttatctgaggacataagttataaggctccttatagttgtccagaggtgaaaggtgagacatgcctgaaataagtacctggacttttaagggaaaaggaggactcaagcatgatcccccccccccccgccctgaagttctgggtggaaggcgataccacccctgggataggggatactggaagtacaatagttctggaaggttgggacacattgtgagttctgttgaggacttattccacgtgtggtacatgtgggatgttccctgaggatggttaacaagctcagtagataaatgggtccgagcacaggagagatgttggagtaggcagagagaaccatcagcagtggggttaactgcctgccttcagcagggctccttcctaaggggagaaagtttagaaatgggttttgatcagtgatttctta

SEQ ID NO: 183900 - DNA, 601 bp, Human
gcctcccaaagtgctgggattataagtgtgagccaccacacccagccttacttttttgttttttctttttgagacaggacctcactctgtcacccaggctagagtgcagtggtacaatctcagctcactgcaacctccgcctcccgggttcaagtgattctcctgcctcagccttccgagtagctgggacgacaggtacctgcctccacacccagctaatttttttgtatttttagtagagacagggtttcaccatgttggttaggctggtctcaaactcctgacctcaggtgatctgctygccttggcctcccaaagtgctgggattacagatgtaagccaccgtgcccagcctttttatttatttattttttatttttttcagacagggtcttactctgtcacccaggctggactgcagtggcataatcacggcttactgcaacttctgcctcctgggctcaagcaatcctcccacctcagcctcccgagtaactgggaccacaggcatgcactactacatccagttaatttttgtgttttttgtagagacagggttttgtcacatagctcaggctggtctcaaactcctgagctcaag

SEQ ID NO: 183901 - DNA, 601 bp, Human
gacgtctttatatcaaacttaaaaagcttgttttgttgcagactaagtgaagtggggaattgaggaagtctgattataaatagactacatcactgtctttcagggattcttcagctatgctttaggcatgtatacatatagaagacactacattagatataagaaacttaagatgttttatctgtcctcaattaggaagaacatttgcaaacttcattgtttgaataatttgaacatttattagagagatttcttgagtcttctctgaaaattaaatcttctcttaggttgctatcttttyaattacaattctcttaacatctgggaccgtctaattttggtaagaatgagcagatgctggcaagaaaccatcgaaatgaagataatattcaatgtaaatatatattatacttatcaagaaatgactcgaagaaggaaccaaatttatagataagatgtgacttgtttagctattagtagcttatgttttatagaaatgaaatatggaatacatcccaaacatatttatacaattaaaaaactaggacaatacaaacaaacaacaacaacaaaaaattaggagaacaaaacagaactttga

SEQ ID NO: 183902 - DNA, 601 bp, Human
tacttaatggatatatctatttctatatctaattctaacaatattcatatgtatatgcatatatatttacatataaaatgactgctataataataaggttttaaaaaaatcaagccacaagattattattttttcagttctgtttggtacaattagatgtgtgctaagatcaataaaacataattaaaatatatttttagcagcatttctacattcatgatatttaggtactattatatataatttaggtactattatataatgtatccttgtcatatgccatttattgacagggatacaytctaagaaatgcattgttaggcgatctaatcattgtgcacacattataagtgtactcacgcaaacttagatgccatagcctaccacacctttaggctatatggtataggctgttgcatctaggctacaaatctgtataacatgttcctgaatactgtaggcaattgttagaaaatggtaactgtatgtgtatgtaaacagagaaaaggtacagtgaaaatactatattataattgtataagaccaccattattgattgaagcatcattatgtattgtatgactgtatcataaatcacagt

SEQ ID NO: 183903 - DNA, 601 bp, Human
attttgaaaagaattgtacaactgatattgtagaaacatacatacagtaacatgaaatacaaagaattccaaatggagggtggaaaagaacaccagaaagcaataatgtaactatcggcattttgtttagttataaaagatagtgtgatagactgaattactgaatcaatcaacttatgatttatgtaaacatttcttgtataagtaaatttctaaatttctattttttttaaattattcacattggtgcaatttactcccatgtataaaatgtggttttggtttacaaatgtagtgggagaaaaaaaaactactttattttctatagatacacatacatatttagaaaatatattctaaatggttattttttctgactcttttggacatactatcacaatacttataatatatgggggaaatatgttttttgtaatgtctctgattatctaatgtcagccataagactgctcaggtggagaacggcttagctaaaacctcatggccccagtcaaacacaggctgcctcaaatctgatcaggcctattaggaaaaaaagaaaaaccaaacaatacaatggcaaatgtatattttgggtaaa

SEQ ID NO: 183904 - DNA, 601 bp, Human
agaatgctagtcataatatccccaaaaggaaacaacgtatgagtgaatggataaacaagtagtggtacaatcatccataggaaatagcacttagcagtgaataacaaataaactactttacacatacaacacagatgaattgcaattctattatgctgagcaaaagaagcgagacacaagattatataggctatgataccatgaatataaagctctagaaaaggtaaaactaatctataataaaaatagaatcagtgattgactggacatggggagtaagatggctgtttgcaaagaggtsgggggggactttattctgaggcaatggaattatgctttatctttatggagttgtacatattggtaaaaatttactgatctttatgtttattgtgtatatttttacagtatgtacattatatttcaatgaagattataaatagtagacatagatttactaattaagaagaatttattaaaacatttcgtgaatcatgaacttgaaaactcattttcctaaatgataattacagctccaattctacttttacttccttaataagacattttgaagttctgaggaagtagagactagaagagt

SEQ ID NO: 183905 - DNA, 601 bp, Human
ccaattaaaaaaatactgtgtagacatactatataagacactccagtactggcataagaatagacatgagaccatttagtgggacagaataaaatgtactcattcatatccacacgtatatggtcagttgattttcaagaaagtagcctaagtaatttagtaagtaaagaagtgtcttttctaaagaatagtgatgtagtatctgaatatttatatgggaaataatgaacctcaatgcctacattaaaagttcacagatatgaatgtaaatatattatgaatcaaaagtaaaaagctaaamccataaagcaagaagaaaacagaaaaaaaaaccagtcttcacaaatgttggtgtagggaaatatttatttgataagatggaaataaattaataagctgagattcattgaaattcaacattttaaaaatcaaagtaagatataaactgggagaaaatattgaaaatacataggatatgtatctttttatatttattgtactttaagttttagggtacatgtgcacaacgtacagcttagttacacatgtatacatgtgccgtgttggtgtgctgcacccattaactcgtcatttaacatca

SEQ ID NO: 183906 - DNA, 601 bp, Human
aaatccaaggggatttaagccctgattcttttttaaagtcatgaaaatgttccattgggttaattatgataatataccacaaataattgtagaatcagagggtaagaatttttctcttcactctggaagccacgtgaactattatctgtcagaaaatctaattataagtctgataataattggactagatggccagatgacagtctcacaaacttaaacttgcctctaagtctcatgatgtctaattttagtctgttctctgcccttacctctataacattaaccaagcaggtataagcatgctaacatttaaaattacaagtttacaaccaaatgcattttgtaagcatacttaatgactgcttttaagaattcatggtgaaggcagcctggcgaatgtataatacaaggaaatgaaagttaatagccttgagtcacagttaatcattgttctgtcacctgttagttgcaattcacttttcttctatggaacacaattttctcacttaaaaaaagttagatagtctcatcatttcagcactttaaaattctaataatagaatgcatatacctcacaccttgtcattgtgatagtacactg

SEQ ID NO: 183907 - DNA, 601 bp, Human
ttttagtgtagattagttcaagctcaaagtatctgaaggctgtatactaaagactgtgaatactgaccttcaagaacagacggaggaccacctgaattacatcaggaataaacaagtttatatacataaatgtttttgcattctcaatattttagtaccaactctaagatatacaattttatcagtagctgaacagtttggaagtactaaaaatactattaatatccttatccaactatttcttagacatcaatctatcaatggaaaaaaaaatggatctcatgagtctttgatttttttgttttgaggtcccactacgtttatcatgtattttatcaaatctttatcacacagtttatcaagtatttatcaacatttttactctatatataattttagacattatctattcttattggcatgataatctaaccatttattttgcatgttacacatagggaaacaataaaatgattttagtatactttcaaacaaatggagtgttccatgcttaaactggatttagcatgggcatttacaattttctgtataatcacatctttatttcatttgaaaatttatctcttgtttgtatttagaa

SEQ ID NO: 183908 - DNA, 601 bp, Human
tagccaaatcataaatgaagtattattctaattgtttaatggccatatttggttctctttatgacagtattgaatgattatgcaaaactcagttattaaattagagaaagaaaacagcatgaccagaacactataatcttatagaaacaattataaatcatgacaccgtgtctttaggaggttatgttaaataaatacaatcaaaatctctaactttaaaacaactatgatcgatcatattttccttaagaaattattacttttttggggggttggtggagcggagtaggaaatgtaaatkgtatctaattttcatttcctttttaattttagagctaaaatattacaaaactgaagaaaatgtttcactgagttcttcatgttaattcatttaaatttttcacactggtattttttataagttcattgcaaaaaccttgaagattgaggtaaattataattgaattataatgtttgtctacctttctgacataatatgatttttattttttctgcgatctctcatgataaaggccatttttaaaatcaagtcatattttctagaaccttatttgtctaataaatttccttaggaaatata

SEQ ID NO: 183909 - DNA, 601 bp, Human
agtaaatcatacagatgtgaggtaacatttaatataaaatatcagatattttatgatcatcatttacattcataatgttggataaaaccaaaagggattagaatcagatacacaaataatggtgtaaacacatctttataataataattatatagttttttaaatctgcctaaataatagccaaatcataaatgaagtattattctaattgtttaatggccatatttggttctctttatgacagtattgaatgattatgcaaaactcagttattaaattagagaaagaaaacagcatgacyagaacactataatcttatagaaacaattataaatcatgacaccgtgtctttaggaggttatgttaaataaatacaatcaaaatctctaactttaaaacaactatgatcgatcatattttccttaagaaattattacttttttggggggttggtggagcggagtaggaaatgtaaatggtatctaattttcatttcctttttaattttagagctaaaatattacaaaactgaagaaaatgtttcactgagttcttcatgttaattcatttaaatttttcacactggtattttttataagtt

SEQ ID NO: 183910 - DNA, 601 bp, Human
ttatcaaagtggatgcctcataagtaagaaagaaacatttggtttgaaggggaaataaaaacacacacaaaaatgtaaaactgaatcctgcatataaggtgagacttcttgaatgatttctggtatcagaagtcttcctttactctaatcatttgttttattactagatcctaatgaagagccttgttcatattgtcagtcagtattgttaagctctgttctgttcaagaaataaaatggagtataaaatgccttaagcacaaagaaatattttttctttttaatccaaatcaaaatcttsacgtattttcaccgttgctgagatgtagtgtgtttttttaatcctaaatttctaactgggaatcaagtgcccacttaaagcatacttttatatattatgtgaacattttaatcttaataagtatttaaaagaggcttgtgtacttaacccactctcctaaatacttcactaaagtcgttggatagagtcatgaaaacaaattggtttccagtgcacagttctcttttagtaatttctttgtattgcacatcttcagttattcatcagctgaaagggcaaagagttaccacacaaaagatc

SEQ ID NO: 183911 - DNA, 601 bp, Human
agaaatgagaaaaataattaccgaagaacaattccctagattcattatagtttgttcagtttttttcttagttaaataataaggtttgctatttttgggcaggaatcaaggtacctagagggacaggattataatagcataccttagaaatttgcaaaaattcataaattaactaaggatgatttcttgtatctaaatatactgtgctataagagtccatggccaagtagcttattaaacttttactgtttcatcattcctgacttgtggattggaatacatcctcagcttcacagagaayttggatataggtttttatgagaaaaaagaagggaagagaaagggagaggagaggagaagaggagaagagaagaaccccacaggaaatatataatctgtatgatcctttacacaaatttgatcaaaggcaaaacatttcaatgtgctaaactttctaggaaataaaaaagaagacttattttcatccagcactaataaaggggaacaaattacacttcatttaaaaaaatactaggaagaagacatactagctgcacataattttcaaactttaagaaaaattaacagctgtagtaaatgg

SEQ ID NO: 183912 - DNA, 601 bp, Human
aatacaacatatttccaccatgcacaattccaaaacactacatattttttatttcaaaattataacataaatttaaacatcttgactttgctatttctcaaagaattttttgttctcgtcacaaaataaatacttcaaaatagtaataactaaaactttccatgaagttgtatgtgttctattcttagtatcaggttctttttctactttgtggtataccaaaatgctctacagatcacccattagaattttcttcatatgtaggtttgaaaggttttaagacacagctaacttaacaacaaaaaaaagcagagtatcttttttttttacatctgtgttacagaaaattacttgcttgtcattgatatttcagcacatagttgataactcattttatgaacagattaaagaaaaagacatcaattgattcaggatgccctgatatgaagaaaaattatgcatctagcttcaaaaataaagtattcttggaattatagaatcctagtgctgcctacctaagcctaaaacgagaattaaaattatccttaggaattcagagacagttatttctaagtaagctatagtaatttttgagagaata

SEQ ID NO: 183913 - DNA, 601 bp, Human
tatgttattagtatgagttagacacagatctagcctctagaaatataaatatgaaacacaaagttttcctcagggaatttataagcaagaaaacccagggaaacaaagaactacaacataagatagcataaaccgagtctaaaaaaagggccacgaattgttcagaagaaggagcagtcattacatgcttgaaaggaaattacctgatggaatgggaatctggctgaaagagaggaaataaggacctgagctagaaaggaaagtcgggaaagctagaaaaagggatagaattaacatagayattaatgattaatctacttcttagttcaaataatgacgaaaaaactagttttgttgaattctaggatagaaggagatacaattgaatatatggacttaggatattagtgttgtcacattaaggtctaacagccctggaaaattgtttgaaatcgaacttgtaggcatttactactcttgaggaacttttgactaaatggctagtgtgagcataatattttagaaatattgatctgaaggtggtatttagaataatcaagaaactataaagtttttcagccttttctaacataaacaaaag

SEQ ID NO: 183914 - DNA, 601 bp, Human
tcaatatctacagtgttgagctcatttatacctttatagcactcaataatatattaatgccaaggtcacacaaacaggaactcagagatttttaaaagtggctctacacagtcactacatctgtagatttccttataatatatctttatgttattagtatgagttagacacagatctagcctctagaaatataaatatgaaacacaaagttttcctcagggaatttataagcaagaaaacccagggaaacaaagaactacaacataagatagcataaaccgagtctaaaaaaagggccacraattgttcagaagaaggagcagtcattacatgcttgaaaggaaattacctgatggaatgggaatctggctgaaagagaggaaataaggacctgagctagaaaggaaagtcgggaaagctagaaaaagggatagaattaacatagacattaatgattaatctacttcttagttcaaataatgacgaaaaaactagttttgttgaattctaggatagaaggagatacaattgaatatatggacttaggatattagtgttgtcacattaaggtctaacagccctggaaaattgtttgaaatcg

SEQ ID NO: 183915 - DNA, 601 bp, Human
tgtctaaactcattcaaaactttcatattatctttttatgatatttcccatgcttatagttgttatttgaaaatgaataactgtcgactctatcttttcaatatctacagtgttgagctcatttatacctttatagcactcaataatatattaatgccaaggtcacacaaacaggaactcagagatttttaaaagtggctctacacagtcactacatctgtagatttccttataatatatctttatgttattagtatgagttagacacagatctagcctctagaaatataaatatgaaacrcaaagttttcctcagggaatttataagcaagaaaacccagggaaacaaagaactacaacataagatagcataaaccgagtctaaaaaaagggccacgaattgttcagaagaaggagcagtcattacatgcttgaaaggaaattacctgatggaatgggaatctggctgaaagagaggaaataaggacctgagctagaaaggaaagtcgggaaagctagaaaaagggatagaattaacatagacattaatgattaatctacttcttagttcaaataatgacgaaaaaactagttttgttga

SEQ ID NO: 183916 - DNA, 601 bp, Human
tgctcaatgaactaagagtacataaacaaatggaaaaacatttcatcctcatggataggaagaatcaatattgtgaaaatggccatactgcccaaattaatttatagattcaatgctattcccataaactactattgactttcttcacagaattagaaaaatctactttaaatttaatatgtaaccaaaaaagagcctgcatagcaaaaacaatcttaagcaaaaagaagaaagctgtaggtatcatgctacctgacttcaaactatactacaaggctatagtaaccaaaacagcatggtrttactaccaaaagagacatatagaccaatgacacaaaacagaaatctcagaaataacatcatacatctacaaccatttgttctttgacaaacctgaaaaatcaagaatggggaaaagattccctatctaataaatggtgctgggaaaactggttagccatatgcagaaaactgaaactggactccttccttacactttatacaaagattaactcaagatggattaaagacttgatggtaaaacctcaaaaaataacaattctagaagaaaatctaagcagtaccattcaggaacaaggca

SEQ ID NO: 183917 - DNA, 601 bp, Human
ttaagaaaatgggaatctcaaatttctttgaccttcaaagaaaaatatttttggaaaaataaacatttaacaaatgattgtcctttcatcttctgcattaacttgaaatctatgcatttgttttcaccaaatgaatttaaggttagttagctctgataaacattgcagtagttgtcctgaaaaagagctaatgacctaaaagactaaaacaattcgatttatatacacgtttgaatgatttactctttaatgatcagggcctagatttgcttacttcatttattcagtccttgagtaacartgctgcttaggatgtattgtgacatacaaaaatgggattagaaagattggagtccactgccctgggaagggcacaatcagttgcttgtttgctttggatctttcttgtttcaatcccgaagcaaaatattgatttaacaaaatattacagtcactgttactacacagacaacttttgtgtctagctatcacaaatgctacacttcaaaatcaagtgtttcacccatgacgtggaaaatatttcattcatgcaatacacagttatagaatattgatcgatattaagaaacttttatttctc

SEQ ID NO: 183918 - DNA, 601 bp, Human
taaaatggtagatgagtatgatgaatatgatcccctatatgtatcagtgtgctttattaccccttttttttttttttgcaggggtgagcaggtctggctctttcagcaaggctgaagtgcagtggcacaatcatatcactggagccttgaactcctgggctccagtgatcctcccaccccagcctccagagtagctgggactatagacacatgccaccacacctagctaagtttgttgttgttgtttttgttgttttgctgtacactaaaattatctggggaccgactaagttgtttttatttttttttaatggagacagggtctcactatgttatccaggctggtatcaaacttctggcctcaagcaatcctccgcctcaggctcccaaagtgctggaattacaggcatgagccacccagccctacaatcccccttcttaaccttaattgttctcaacccactcactcctagcaataagtctacaataacctggttctaaaagtgctgtttagaaagacaaagtgaaatcactgatacttacttggtttccttttcaaattgactatatacatgaactgccaagatgccttccactgggt

SEQ ID NO: 183919 - DNA, 601 bp, Human
ctaaaatggtagatgagtatgatgaatatgatcccctatatgtatcagtgtgctttattaccccttttttttttttttgcaggggtgagcaggtctggctctttcagcaaggctgaagtgcagtggcacaatcatatcactggagccttgaactcctgggctccagtgatcctcccaccccagcctccagagtagctgggactatagacacatgccaccacacctagctaagtttgttgttgttgtttttgttgttttgctgtacactaaaattatctggggaccgactaagttgtttttrtttttttttaatggagacagggtctcactatgttatccaggctggtatcaaacttctggcctcaagcaatcctccgcctcaggctcccaaagtgctggaattacaggcatgagccacccagccctacaatcccccttcttaaccttaattgttctcaacccactcactcctagcaataagtctacaataacctggttctaaaagtgctgtttagaaagacaaagtgaaatcactgatacttacttggtttccttttcaaattgactatatacatgaactgccaagatgccttccactggg

SEQ ID NO: 183920 - DNA, 601 bp, Human
gcagaggttgcagcgagccaagatcgcgccacttcactccagcctaggcaacagagttagacttggtctcaaaaaaataaaaaataaaaataaataaattaatgaggccaggagcagtggctcacgtctgtaaccctagcattttgggaggcccaggcaggtggatcgcttgaggtcaggagttcgagaccagcctggctactaaaaacataaacattagccaggcatggtgacatgcgcctataatcccagctactcgggaggctgatgcaggagaatcacttgaacccaggaggcggargttgcagtgagccaagatcatgtcacttcactccagcctgggatggaaactccatctcaaaaatactactactactactaataataaatttggccaggcacgctggctcatgcctgtaatcccagcactttgggaggccgaggtgggcggatcacttgaggtcaggcattcacaagaccagcctggccaacatggcaaaactgcgtctctacaaaaattacctgggtgtggcagcgtgtgcctgtagtcccagctacttgggagggtgagacaggagaatcacttgaacccaggaagcag

SEQ ID NO: 183921 - DNA, 601 bp, Human
tagcactagatgcatacattagaaaagaagaaaagtctcaaaccagtaatgtaaattcctatttcaagaagctagaaatgtacagcaaaataaatgcaaagcaacaagaggaagaaaaaaaataaagagagcaaaaatcaattaaattgaaaataagaatataatagagaaaaatcaatgaaaccaaaagctggttcttcaacaaaatcaataaaatggataaatccctagcaagactgacaaaagtaaggccaggtgtggtggcttgtgcctataatctcagcactttgggaggcagagrcaggaggatcacttgaggccaggagttaagagaccagcctgggcaacatagtgagatctcgtctctacaggaaaaaaaaaaaaaaaagcaaaaacttagccaggtccaggtccatatggtggtgagcgcctgtagtcctatcaacttggtaggctaaggcaggaggatcactggagcctgggaggtcaaggctacagggagcagtgatcacaccactgcactccagcctgggtgacagagtgggaccttgtctcaaaaaaataaataaaatgaagtaaaaaggaactacccctttttgaa

SEQ ID NO: 183922 - DNA, 601 bp, Human
atgcatttattaacaaggaatgatgcttatatcgagcaaaaagttcatgagtagtatatatagttcttattttcacaagaaaaatatgtatatatattcacaggaaatgtctagaagaatatatatgaaaatgttattctcttttataatttttgtgtttctaaattatctacattaaataaaacttttgcaaaaagaaaaaataaatgtcattttaaaaacatacccagccaggcatggtggctcacacctgtgatcccaaaactttggaaggccgaggcaggcagatcatgaggttaakagaccaagaccatcctggccaacatggtgaaaccccatctctactaaaaatacaaaaattaggtgtggtggcacgcacctgtagtctcagcaagtcaggaggctgaggaaggagaatcacttgaacccaggaggcggagatcgcagtgagccgagatcgcgccattgcactccagcctggcgagagagcaagactctacctcaaaaaacaaaaaaaacaaaaaacaaaaacaaaaaatcagctggagcaggccaggcacggtggctcacgcctgtaatcccactttgggaggccaaggtg

SEQ ID NO: 183923 - DNA, 601 bp, Human
cagaggctgcagtgagacagagcaagactctctctgaaaacaaaaacaaaagaaaatttaaaaaattaaacacacacactcagacccacatatccttttcaagtcaaccaaaccacagccagtctttaatttctttatagcaccattgagactcttaaatttctttgaaataaactataaaaatcagactcttctacacattcttttttatggttattgattttggcaagataggaggattaaaagagggaatagtctatacagctatgtgaagtctaccaatctagatatccatcaattwtgaaataactaagaatcattttagttcaaactaccaccacataatcatgttcattcaacaactacatcccaggctctagactagggttcatggctcccagcgaggacatcatactattccagactagactaaactgagtcccttaggtccctaagactcttttttctatcatctgtataaccccaatacatttaacaattttacataaattataaatcgaccatgtaagataatatcctactgccaatgtgagggctaaaaatttgatcttgcaatttgtttagtctaactctcttccag

SEQ ID NO: 183924 - DNA, 601 bp, Human
aattagctgggtgtggtggtgtgcacctgtaatcccagctaccaggaggctgaggcaggagaactgcttgaacccgggaggcagaggctgcagtgagacagagcaagactctctctgaaaacaaaaacaaaagaaaatttaaaaaattaaacacacacactcagacccacatatccttttcaagtcaaccaaaccacagccagtctttaatttctttatagcaccattgagactcttaaatttctttgaaataaactataaaaatcagactcttctacacattcttttttatggttattgwttttggcaagataggaggattaaaagagggaatagtctatacagctatgtgaagtctaccaatctagatatccatcaattatgaaataactaagaatcattttagttcaaactaccaccacataatcatgttcattcaacaactacatcccaggctctagactagggttcatggctcccagcgaggacatcatactattccagactagactaaactgagtcccttaggtccctaagactcttttttctatcatctgtataaccccaatacatttaacaattttacataaattataaatcg

SEQ ID NO: 183925 - DNA, 601 bp, Human
aaattagctgggtgtggtggtgtgcacctgtaatcccagctaccaggaggctgaggcaggagaactgcttgaacccgggaggcagaggctgcagtgagacagagcaagactctctctgaaaacaaaaacaaaagaaaatttaaaaaattaaacacacacactcagacccacatatccttttcaagtcaaccaaaccacagccagtctttaatttctttatagcaccattgagactcttaaatttctttgaaataaactataaaaatcagactcttctacacattcttttttatggttattrattttggcaagataggaggattaaaagagggaatagtctatacagctatgtgaagtctaccaatctagatatccatcaattatgaaataactaagaatcattttagttcaaactaccaccacataatcatgttcattcaacaactacatcccaggctctagactagggttcatggctcccagcgaggacatcatactattccagactagactaaactgagtcccttaggtccctaagactcttttttctatcatctgtataaccccaatacatttaacaattttacataaattataaatc

SEQ ID NO: 183926 - DNA, 601 bp, Human
agggaacacaaacatcttggattcacagtctatgcaaatgctaatcaaatcacctttgaaaaccattcaatttccacacacacacacacacacacacacacacacacacttaggctggctgtggtggctcatgcctgtaatcccagcactttgggaggccaaggtggatggatcatctgaggtcaggagttcaagaccagcctgggcaacatggcaaaaccccgtctctactaaaaatacaaaaattagctgggtgtggtggtgtgcacctgtaatcccagctaccaggaggctgaggcakgagaactgcttgaacccgggaggcagaggctgcagtgagacagagcaagactctctctgaaaacaaaaacaaaagaaaatttaaaaaattaaacacacacactcagacccacatatccttttcaagtcaaccaaaccacagccagtctttaatttctttatagcaccattgagactcttaaatttctttgaaataaactataaaaatcagactcttctacacattcttttttatggttattgattttggcaagataggaggattaaaagagggaatagtctatacagctatgtgaagtct

SEQ ID NO: 183927 - DNA, 601 bp, Human
tcatttaatattcctgtattatctgattttcttagtgttgtttcaatttatcataaacttaaaaaaaaaaaaaaactatagaggacgtgcgcggtggcccacaactgtaatcccaacactttgggaggctgaggcaggcggatcacaggtcaagagatcgagaccatcctggccaacatggtgaaatccatctctactgaaactacaaaacttagctgggcatggtggcgcatgcctgtaatcccagctactcgggaggctgaggcaagagaatcgcttgaacccaggaggcagaggttgyggtgagctgagatcgcgccattgcactccagcctgggcaacaagagtgaaactccatctcaaaaaaaaaaaaaaggcagaaagccaaaactattctaaaagatttttctttaatccctcatatatcgcggtacaaaaattgacaaacagagaaaagaatggaagaatgagggaagggaacacaaacatcttggattcacagtctatgcaaatgctaatcaaatcacctttgaaaaccattcaatttccacacacacacacacacacacacacacacacacacttaggctggctgtggtgg

SEQ ID NO: 183928 - DNA, 601 bp, Human
tccagcctggcaaaagagcgagactccatctcaaaaaaaaaaaaaaaatagtaaagtcaaaaggcaaataacggagtagaagaaaatatttgtgttacatgtactacacaatggattaatttttataatatactaagtgctctcacaaacaaacagaacaactatcaacaacccaacagaaaaatgagtccaggacacaaactcttcatagaaatccaaataataaatgtgaaaaaaaaattcagcctctttcatctaaaaagaaatacaaattaaacaatgagatactatttttcatttmtcagaaagattcggttttcatttaatattcctgtattatctgattttcttagtgttgtttcaatttatcataaacttaaaaaaaaaaaaaaactatagaggacgtgcgcggtggcccacaactgtaatcccaacactttgggaggctgaggcaggcggatcacaggtcaagagatcgagaccatcctggccaacatggtgaaatccatctctactgaaactacaaaacttagctgggcatggtggcgcatgcctgtaatcccagctactcgggaggctgaggcaagagaatcgcttgaac

SEQ ID NO: 183929 - DNA, 601 bp, Human
tttacacttgttgacacaacatttggattggttcacattttgctgttttgaataagtctgctatgaacagttacgtacaagtttttaagtgaacataaattttattttatttggagtaaataaccaaaggagtgatttctgggtagtatggtaagtacatgtttaatttttaaagaaactgccagctggatccagcacctgtaatcctagcactttgggaggccaaggcaggaggatcgtttgagcctaggagtctgagaccagtctgagtaacataaccgtaccctgtctctacaaaaaatgcaaaaatcagccgggcatgatagtgcatacctatagacccagctacttgggaggatgaagtgggaagatcacttgagcccaggagttcaggttgcagtgagcaatgatggcaccactgcactccagccagggtaacagagtgagaccaggtctactaaaaaaattgactagtaaaaattaaattaaggccaggtgtggtggctcatgcctgtaatcccagcactttgggaggccaaggcaggcggatcgcgacgtcaggagtttgagaccagcctggccaacatagtgaaaccctgtc

SEQ ID NO: 183930 - DNA, 601 bp, Human
caggcacagtgtctcacacctgagatcccagcactttgggaagctgaggcaggcaaatcacctgaggtcaggagttcaagaccagcctggacaacatggtgaaaacccatctctactaaaaatacaaaaaattagtcaggcatggtggtgcatgcctataatcccagctgctagggagcctgaggcaggagaatcgcttgaacccaggaggcggaggttgcagtgagccgagatcgcaccactgtgttccagcctgggtgacaagagtgagactcagtctcaaaaaaaaaaaaaaaaaaaatttcattgaaacattaaaaactctgtcagttataattataggaaaattgaaagaacaggaaaactaatcattaatgcactaaagcaggaggtgagcgaagggcaggcgagcatctccgcctcctgtcacatcagtcgtggcattagattctcataagagcacaaaccctactgtgaactgtgcatgcgagggctctagactgtgcactctttatgagaatccaatgcctgatgatcttctgaggtggaagagttttatcccgaaaacatcccctcccccagcgtccccttccatggaaaa

SEQ ID NO: 183931 - DNA, 601 bp, Human
tgcttaaaatagcataaaaaaatacttaaaagaagtgaacaatttatttatttattttgagatggagttttgctcctgctgcccaggctggagtgcagtggcacaatcttggctcactgcaacctccgcctcccgggttcaagcgattctcctgcctcagcctcctgagtaacagagattacaggcacatgccaccatgcccggctaatttttgtatttttagtagaaatggggtttcataatgttggtcaggctagtctcaaactcctgacctcaggtaatccacctgccttggcctccyaaagtgctgagataacaggcataagccaccgtgcccggctgaagtgaacaatttatactctgaaaaattaaaaaaaaaaaattcctgaaagaaattaaggaagatttaaataaatggaaagacatttaagttcatggatcagaagatttaacattgctaagatggcaatgcttcccaaactgatctacagattcaggcacagtggctcactcctgtaatcccaacactttggtaggccaaactgggcattattacttgagcccaggagttcaagaccagcctgggcaacatggcaaaacc

SEQ ID NO: 183932 - DNA, 601 bp, Human
acagtggctcacgcctgtaatcccagcactttgggaggccaaggtgggtggatcacctgaggtcaggagtttgaaaccagcctggccaacatggcaaaatgccatctctactaaatatacaaaaattagccaagcattggtggcaggcgtctataatcccagctactcaggaggctgaggcaagagaatcgcttcaacccagcaggtggagtttgcagtgagccgagatcacgccattgcattccagcctgggcatcagagcaagactccatctccaaaaaaagaaaaaaaaaaaaaaaaggagtgaggattttcggaatatttggatgctcacccagcacctatcccagttccaggagcatggcagatgcaaaagaacgtatgaaagagtgaaggaaagaaaaatatgtgtttttctaattctcaagtcttcatttttttctttttatcaccatccatggcaaaaaaaaatttatattatgatccatattcacatacacatatataaatgaaacagaagttttataaatcaatactcatccatactatgtacaatgcactgaaactttttttttttttttttttgagatggagtcccact

SEQ ID NO: 183933 - DNA, 601 bp, Human
tacacagttaatgtatgacatgtgcttctactataccactttattatttatgtgcctattaccctctataaactgtgagctcaagagtgaggattttcggccaggcacagtggctcacgcctgtaatcccagcactttgggaggccaaggtgggtggatcacctgaggtcaggagtttgaaaccagcctggccaacatggcaaaatgccatctctactaaatatacaaaaattagccaagcattggtggcaggcgtctataatcccagctactcaggaggctgaggcaagagaatcgcttsaacccagcaggtggagtttgcagtgagccgagatcacgccattgcattccagcctgggcatcagagcaagactccatctccaaaaaaagaaaaaaaaaaaaaaaaagagtgaggattttcggaatatttggatgctcacccagcacctatcccagttccaggagcatggcagatgcaaaagaacgtatgaaagagtgaaggaaagaaaaatatgtgtttttctaattctcaagtcttcatttttttctttttatcaccatccatggcaaaaaaaaatttatattatgatccatattcaca

SEQ ID NO: 183934 - DNA, 601 bp, Human
tctacaattcccctgagaaacttaataaatatagacaaaagtgtgtatatcaattaacttacaagtctctaatcactgcaaactagctgactctcgttaaagcttcaaatcttaaagttctaccactggtactcttagaagctaacttacccttgttgatcacagagagacaacagtgaccaagtctaataaaagcttattcatgtacacagaaacaaaacaaagtaacttggtgatgtgcacatctaatatttccaaccaaatcacaaaactttagaaagggcatttgaatccaacctcyttattttaaaagtgagaaaagtccaaggagattaacaaatatatttgttcaaagtcatccctgagttctcaactaaaagtagaatttcttttctgtcctatatcccaaatcaggaagcaaggggaaaaggtaggaggtattatcattctgatcatcatttcctctgctaacttagaatgctttcgtttctcagggataaagaaggtaagtccagctatatctatgtattggaaatagcatcacatagctctcctttttaaaatggcatgccctcctcatgtggatttttatcttctattt

SEQ ID NO: 183935 - DNA, 601 bp, Human
tcgtagtaaaaagaggtaggtcgggcacggtggcttacgcctgtaatcccagcactttgggaggccgaggtgggaggatcacgaggtcaggggatcaaggccattctggctaacacggtgaaaccccgtctctattaaaatacaaaaaattagctgggcgtggtggcatgcacctgtagtcccagctactcaggaggctgaggtagggaaatcgcttgaacccaggaggcagaggttgcagtgagccgagatccctactgcacagagcaactgagcaagattccatctcaaaaaaaaaaawatatatatataatatatgtattatatattcatatgtaatattatgtattatatattacatattcacatgtaatatatattatatattttatatatatggcatttctggccaggtgtggtggctcacgtctgtaatcccaccactttgaaaggctgaggtgggaggatcatctaaggctaagaatttgatttcagtcttggcaacacagtgagaccctgtctcaattagaaaataaaaaaaaatttaaacacagcatttccagtcctttcaaactcagatgaagtttaattaaaatcttca

SEQ ID NO: 183936 - DNA, 601 bp, Human
aatcgtagtaaaaagaggtaggtcgggcacggtggcttacgcctgtaatcccagcactttgggaggccgaggtgggaggatcacgaggtcaggggatcaaggccattctggctaacacggtgaaaccccgtctctattaaaatacaaaaaattagctgggcgtggtggcatgcacctgtagtcccagctactcaggaggctgaggtagggaaatcgcttgaacccaggaggcagaggttgcagtgagccgagatccctactgcacagagcaactgagcaagattccatctcaaaaaaaaawaaatatatatataatatatgtattatatattcatatgtaatattatgtattatatattacatattcacatgtaatatatattatatattttatatatatggcatttctggccaggtgtggtggctcacgtctgtaatcccaccactttgaaaggctgaggtgggaggatcatctaaggctaagaatttgatttcagtcttggcaacacagtgagaccctgtctcaattagaaaataaaaaaaaatttaaacacagcatttccagtcctttcaaactcagatgaagtttaattaaaatctt

SEQ ID NO: 183937 - DNA, 601 bp, Human
aggaggctgaggcagagaactgcttgaacccaggaggcggaggtggcagtgagccaagattgcgccactgcactccagcctaggcaacagagtgagactccttctcaaaaaaaaaaaaggtaccacaaaactagtggtaattcctttagaacataatcagaacttcattcacacatccaaaatgtcttacttctggtcaggcaccgtggcaaaggtctgtaatcccagcatactgggaggccgaggcgggcagatcgcttgagcccaggagttcaagaccagcctgggcaacatggtgaamccctgcctcgataaaaaatacaaaaaaggttagctggttgtggtggcacacacctgtagtcccagctacttgggaggctgaggtgtgaggatcactggagtctgggaagttgaggatgagtgagccgaaattgtgccactgcactccagcctgggcaacagagtgagactctgtctcaaaattaaataagccaggtggggtggctcacacctgtaatcccagcactttgtgaggccaaagcgggcagatcacttgaggtcaggagttcaagaccagcctggccgacatggtaaaaccctg

SEQ ID NO: 183938 - DNA, 601 bp, Human
aacaggccccttggtgcagtggcccatatagtgttttgaaaaatggccaatatctccaaaatcagtaatctttgaatgaaaatacagttttacagcttttttaaaaaacagggccaggcgcgttggctcagtcctgtaatcccagaactttaggaggctgaaatgggaggatcccttaagcccaggggctcgagaccagcctgggcagcacagtgaaactccgtgtctacaaaaaataaaaaaaattagccgagcatgcacctgtggttccagctactcaggagactaaaatgggaggatygtttgagcccgggaggtcaaggctgcagtgagccatgattgcggaactgcacctcagccttgggtgatagtgtaagaccctgtctcaaaaaaataaaaaatccgaagatcaggccatgactatgtatttccacttagcaacaatatactggagctgagaaataactgcctctgtagatacccattcacacaatatctgcagcataagttcttaatcaagaccaacttcactcactttaacttcaagaacgttgcaggggccaggcactgtggctcacgcctgtaatcccagtactttggg

SEQ ID NO: 183939 - DNA, 601 bp, Human
tatatggttagagtgtaagaaaaacttatttcccttgtctttaagatttttctagaagaatcttaatcttcctataaaaccacctgtctgataaaaggaagtctgaaatcttatctccaaataaatcttatctcaaattaataaaagactaaatttcagaagtttctcagatttcatttttgctgttacagtaattaagttatgccattatcttatgcagttgattttaagtgatgaacacccacctacatcattatttccatatagaaccaccaacaattaattagttcaaactaaaaayaatgaaataaagtattaaaatgttctccataactaagaaaatactgtcactgtcagctttactatttctacccatcaccacgactaccccccaaaaaccctacatatcaatacagctttcatcaaattagaatcaatttgcttgaaaaaacagaaacatatgcatcacccattactatgtacacatctgccagataatgattagaggcggcaagtatgccaagagtccaaaaagcaggtgagaatcttctgtagcctagaaaaaagtgtatctagagaaaacataatagtctcctctatt

SEQ ID NO: 183940 - DNA, 601 bp, Human
tcaattacatgacagccacaggctaaacactcacactatgacgtgagcaagaaataaaccattattgtgttaagtcactgaaatgctagttatgttaaagagttagcatcaactatcctaattaatacagagatcttacatatctaacatcctcattttacaaataaggaaactgatgaacaatgagctttccaaaaattatactagttggtaggagaaacaggtctcctgactttctattcagggacttttacaaagtaaaagatttctgtgctacatttataagtaaaagttattatcmcaatatttgttccaaaaccaaaaaaaggcagtgcaatcatttctttttctttttttttttgaagcagggtctcactctggtgtccaggctcgagtgcagtggcatgaccatgacttactgcagcctcgacctcccagtcacctctgtttgcaaaaagaaaagaattctccacgaagttctttttcagtctaccattttatgatttgactctcttcatgtcgacaaaatttcttgagtatctattagaactgtataagattgtggatatctgaacatttatttactgacaaaatgtgattt

SEQ ID NO: 183941 - DNA, 601 bp, Human
cagcatcctattaaagctgcaatatccaaaaaatagtaccattagcctacaagagaaatgaaatgcaatcctaggatgacgataatgcactaggatctagaaacaactctgtccaaaattaacctttccatagtgtaatttaaaaagaccaatgacttagacatgtggtgcaaatggtatatgaaaaaaggtgcaattaaaaacaggggaggggagcagtttactgaaagagaactacacaagaaagtactaatccaaacataaggcaaactgaactatggcattattctgagataattayatattttaaggagacaaggcttagaattagaacactctcatcaaacttaccaacataagatggatccataaagaaggatattttgtatttacatacaaatgaacatgtacaatataatgtatcaagaaagaacaaaaaaggagaaaagagaaggaggcttcggaaagatggagatgactccaaaacagcagctgaaatcaactgaaagacttttgctgactctctgagtttactcttaagtgggcagaagtcaaagagaactttgcctgctcactggaatgtgtttctctattggtctct

SEQ ID NO: 183942 - DNA, 601 bp, Human
ttggctgggcgtggtggctcatgcctgtaatcccagcactttgcgaggctgaggcgagcggatcacaaggtcaagagatggagaccatcctagccaacatggtgaaaccccgtctctacgaaaaacacaacaaaattagctgtgcgtggtggcatgcgcctatagtcccagctactcagggggctgaggcagaagaatcacttgaacccgggaggcagaggttgcagtgagccaagattgcgccacggcactccagcctgggcaacagagcgacactccatctcaggggggaaaaaaaaaatttattttccaggcattctttctgaaaatgaacttcagcacagactccaggaaatgaaaaatgaacacagcatcctattaaagctgcaatatccaaaaaatagtaccattagcctacaagagaaatgaaatgcaatcctaggatgacgataatgcactaggatctagaaacaactctgtccaaaattaacctttccatagtgtaatttaaaaagaccaatgacttagacatgtggtgcaaatggtatatgaaaaaaggtgcaattaaaaacaggggaggggagcagtttactgaaagaga

SEQ ID NO: 183943 - DNA, 601 bp, Human
aaattcaaacacacaatttaaaaaaaattattggctgggcgtggtggctcatgcctgtaatcccagcactttgcgaggctgaggcgagcggatcacaaggtcaagagatggagaccatcctagccaacatggtgaaaccccgtctctacgaaaaacacaacaaaattagctgtgcgtggtggcatgcgcctatagtcccagctactcagggggctgaggcagaagaatcacttgaacccgggaggcagaggttgcagtgagccaagattgcgccacggcactccagcctgggcaacagagygacactccatctcaggggggaaaaaaaaaatttattttccaggcattctttctgaaaatgaacttcagcacagactccaggaaatgaaaaatgaacacagcatcctattaaagctgcaatatccaaaaaatagtaccattagcctacaagagaaatgaaatgcaatcctaggatgacgataatgcactaggatctagaaacaactctgtccaaaattaacctttccatagtgtaatttaaaaagaccaatgacttagacatgtggtgcaaatggtatatgaaaaaaggtgcaattaaaaa

SEQ ID NO: 183944 - DNA, 601 bp, Human
gaaaattatacaattggaaagtgggaaggtcatgaagctatgagcacatctagctagccacttagcatctgtatttcatcaacagttaagctattctttacttgtcaccacataaatagaatatgattttaaaatacacacacacacccccttatggaaaatgatcctagaaaggtaatgctagtgtcatctttcaagttaaagtactgttttttttttcccagaaatccccagttttcaataaattaaagcgattatccaattttatagttattttattctgaaacatgtataagtacartacactctttaaatgctctatagatgttaaactggttcaagtattccaaaattaattttaataaattcatgtatgaatttcatctcacacagaatcacttgaagttacttactattcggttatgccttaaatgcttagttacatattttatggataaaaggatatgacactattattttcaaatctggatgttcaggaggatcaaaaaatgaacccttgtgaatgagaagcatttactctaaaaaaaaaacctctcactgaccaattgaccatttatactattcctcttctatccataca

SEQ ID NO: 183945 - DNA, 601 bp, Human
tctcagatgacttcctgggctgcatgtggttcatggaatatgaacagtagctgaaattcagcctaagagggtaaaactgatagaaaattatacaattggaaagtgggaaggtcatgaagctatgagcacatctagctagccacttagcatctgtatttcatcaacagttaagctattctttacttgtcaccacataaatagaatatgattttaaaatacacacacacacccccttatggaaaatgatcctagaaaggtaatgctagtgtcatctttcaagttaaagtactgttttttttttcccagaaatccccagttttcaataaattaaagcgattatccaattttatagttattttattctgaaacatgtataagtacagtacactctttaaatgctctatagatgttaaactggttcaagtattccaaaattaattttaataaattcatgtatgaatttcatctcacacagaatcacttgaagttacttactattcggttatgccttaaatgcttagttacatattttatggataaaaggatatgacactattattttcaaatctggatgttcaggaggatcaaaaaatgaaccctt

SEQ ID NO: 183946 - DNA, 601 bp, Human
ccacacactctcagatgacttcctgggctgcatgtggttcatggaatatgaacagtagctgaaattcagcctaagagggtaaaactgatagaaaattatacaattggaaagtgggaaggtcatgaagctatgagcacatctagctagccacttagcatctgtatttcatcaacagttaagctattctttacttgtcaccacataaatagaatatgattttaaaatacacacacacacccccttatggaaaatgatcctagaaaggtaatgctagtgtcatctttcaagttaaagtactgtgttttttttcccagaaatccccagttttcaataaattaaagcgattatccaattttatagttattttattctgaaacatgtataagtacagtacactctttaaatgctctatagatgttaaactggttcaagtattccaaaattaattttaataaattcatgtatgaatttcatctcacacagaatcacttgaagttacttactattcggttatgccttaaatgcttagttacatattttatggataaaaggatatgacactattattttcaaatctggatgttcaggaggatcaaaaaat

SEQ ID NO: 183947 - DNA, 601 bp, Human
gctttgaccttttttgcatactcacaaaccaatgaccacacactcccattctgaaccaataaagagccccaggctcagccatattacggaactttcctgtcttcaggtagtagaaccacctaccatgttctctctttttgctaagagctttcctttcgattaatagattctactccactcactctttgatgtccacgtgcctaattcttccgctcctgagataagaacctggacctagttgagctaaggagcaaaaatcctgcatcagtttcatggtcaaagagaacttaaaaggacatckgtgccatccttaacaacataccataaaaatccaaaatttaattttccccagaaatacataatgacataagatgcaatctactcaaatcttttcctcatttaaggcacagggtaaaaatacagtcaaaaacaccaatacattttaaatatcatttatcagaatgcagattatcaaagggcagcttttatccattgtaatctttcccctatccaaccctcagcacccccaccccgcccccagccacacactctcagatgacttcctgggctgcatgtggttcatggaatatgaacagtagct

SEQ ID NO: 183948 - DNA, 601 bp, Human
caacactttgtgaggccgaggtgggcggatcacgaggtcaggagttcaagaccagtctggccaacatagtgaaaccctgtctctactaaaaatacaaaaaattagccgggcgtggtggtgcacccctgtaatcccagctactcggcaggctgaggcaggagaattgcatgaacccgggaggcggaggttgcagtgagctgagattgtgccactgcactctaacctgggcaacagaacgagactccctctaagaaaaaaaaaagaactgttctctaatttatataaacagcaatctggagamcaggcatgggaatgggtattaagggtatgggataatggtggaaggaacatagagttggatcaggctgaatttattgatttgggcccactaagtagggactctgcatttaatgttgcagctcggggagttaaaataaggttctaatagtttatttgcttggttagctgaaatatgcattaaaagatggcccactgtgagggagctggaaatgcctgatatctcttggtttaatgtagaggaaggcatccaaaagcttagggagattgaggtggtggagtggattactcactttagacctac

SEQ ID NO: 183949 - DNA, 601 bp, Human
gacccaggaggaggtgcgctacactcaaaaagaactgttctcggccaggcacggtggctcacgcctgtaatcccaacactttgtgaggccgaggtgggcggatcacgaggtcaggagttcaagaccagtctggccaacatagtgaaaccctgtctctactaaaaatacaaaaaattagccgggcgtggtggtgcacccctgtaatcccagctactcggcaggctgaggcaggagaattgcatgaacccgggaggcggaggttgcagtgagctgagattgtgccactgcactctaacctgggcaacagaacgagactccctctaagaaaaaaaaaagaactgttctctaatttatataaacagcaatctggagaccaggcatgggaatgggtattaagggtatgggataatggtggaaggaacatagagttggatcaggctgaatttattgatttgggcccactaagtagggactctgcatttaatgttgcagctcggggagttaaaataaggttctaatagtttatttgcttggttagctgaaatatgcattaaaagatggcccactgtgagggagctggaaatgcctgatatctcttggt

SEQ ID NO: 183950 - DNA, 601 bp, Human
ctcgggaggctgaggcaggagaatcgcttgaacccaggaggtggaggttgcagtgagcagagatcgcgccactgcactccagcctgggtgacagagtgagactccttctcaaaaaaaaaaaaaaaaacatattaaattgtacaaaactgttatgatcagccattccaaagcactggacatcaacaaactgtagaacacaagttgagaagctttgcattctcgaaatctgcttgagctttggttaagaccaggaagagtctatggcccttttgtctagagctgtttccactcccatcttagmccacagctcagtttggtcagcaagaattacacttttattagtgtgatggttaacactgagcatcaacttgattggaataaaggatgcaacattgatcctgggtgtgtctgtgagggtgttgccaaaggagattaacatttgagtcagtgggctggggaaggcagacacacccttaattgggtgggcaccatctaatcagccaccagcgaacataaagcaggcagaaaaatatgaagaggcaagaggggcctagcctcccagtctacatctttctcctgtgctggatactttctgccctcg

SEQ ID NO: 183951 - DNA, 601 bp, Human
atgggccgggcgcaatggctcacacctgtaatcccagcactttgggaggctgacgtaggcagatcacaaagtcagaagatcgagaccatcctggttaacatggtgaaacctcctctctactaaaaatacaaaatattagccaagcatggtggtgggcacctgtaatcccagctgctcgggaggctgaggcaggagaatcgcttgaacccaggaggtggaggttgcagtgagcagagatcgcgccactgcactccagcctgggtgacagagtgagactccttctcaaaaaaaaaaaaaaaaacatattaaattgtacaaaactgttatgatcagccattccaaagcactggacatcaacaaactgtagaacacaagttgagaagctttgcattctcgaaatctgcttgagctttggttaagaccaggaagagtctatggcccttttgtctagagctgtttccactcccatcttagcccacagctcagtttggtcagcaagaattacacttttattagtgtgatggttaacactgagcatcaacttgattggaataaaggatgcaacattgatcctgggtgtgtctgtgagggtgttgccaaa

SEQ ID NO: 183952 - DNA, 601 bp, Human
gaaaccccatttctactaaaaacacaaaaattagctgggcgtggtatcacatacttgtggtcccagttactcaggaggctgaggcatgagaatcactggaacctgggaggtggaggttgcagtgagccgagattgcaccactgtactccagcctgggtgacagaaaatttgtctcaaaaaacaaaaattaaatttaaaaacttttaaataaataagtaaaaaataaatcacactctggctgttaacattaaggccaaaaataaataaataaataaataaataaataaataaataaataaaattaattccatttagaaatatctaataactataataaagttaaatccaatttaatcagtctgttagaagaaaaatagcgacaagagcaaattatgtcaaagaaagacacgcactgagagagtttaataatagatgtcataaagaagctgttgaatcttctccataaaaaagtaaatatgggccgggcgcaatggctcacacctgtaatcccagcactttgggaggctgacgtaggcagatcacaaagtcagaagatcgagaccatcctggttaacatggtgaaacctcctctctactaaaa

SEQ ID NO: 183953 - DNA, 601 bp, Human
acattcattacatattctttatattatctaagaaaaaaatacaataccaagatttggaaagatattaaataatcaattatatttatatagacttccaaataaaatctaaaaatttcaaataaatttaagccttcttccatgtgcctaattttatgagttttcctatttgaaataacaaccttaattcctcatcaataattttaaatgattatcttttcaaattctaggtagtaccattatacaaaaatgtagtagaaaagagctgtttctctgatttcttttctttttgaggcagagtctygcctcactgcaacctccacctcccaggttcaagtgatcctcctgcctcagcctctctagtagctgggattacaggtacgcaccgccacacccagctaatttttgcatttttagtagagacagggtgccaccatgttggttaggctggtctcgaactcctgacctcaaagtgatccacccacctcggcctcccaaagtgccaggattacaggtgtgagcccctgcgcccagcctgcttacttttctcaaagcaaatgtgatatttaaatttcctgtgactatactaatgagttcctaaatc

SEQ ID NO: 183954 - DNA, 601 bp, Human
atgggaagcaggaggatattatccgcagcaaactgacgcaggaacagaaaaccaaataccacatgttcttacttgtaagtggaagctaaatgataacttacgaatacaaagaaactgcagacactggggtctcctggagggtggagggtgggaggagggaaaggagcagaaaagataactattgggtactagacttaattgaaataatctgtacaacaaacccttgtgacatgtgtttacctatgcaacaaaccttcacatatacccttgaacctaaaataaagtttaaaaaaaaaaaaaagtaaatctataagcaaaccataggtgaatagcctagaaaatacagaaataatgtagtaaaaagagccaaaggggccaggtgcagtggctcacacctgtaatcccagcactttgggaggccgaggcaggaggatcacttgagaccaggagttcaagaccagcctggccaacatggtgaaaccccatctctactaaaaatgcaaaaattagcaaggcatggtggtggacacctataatcccagctacttgtgaggctgaggtacgagaatcgcttgaacccgggagatggaggctacagtga

SEQ ID NO: 183955 - DNA, 601 bp, Human
gagaggcaaacagaaatgctagaaattaaaaacataaaaaatgctaaagtagataatgccactgaaagctcatcattagattcaacacaactatgaaaagatcagggaattggaagataggtcaaaagaaagtacccaaagtaaaacacaaacagaaataaagagagaaaaaaaccaacaatgcatccaagagatacaggacactatccaacaatttaacaaaaatataattggaatcccaggagaaaagaaaaagaatggggcagaagaaatattttaaaagataatggccaaaaatttyccagctgacttaaccacttcaaaagcacagatcaagaagctcagaaaagcccaagaagaaaacttccaaaatatcatctaaacacaacatatttaaactgctaaaaaaaaaaaaaaaaaaagataaaatcttaaaggcagacacaaagaggaattcacaaaggaaatatttttaaatatttttaaatgaatgaaaataaaaatacaacatatcaaaatccatgggacacagctaaaatggtgattagagggtaatttataacattaagtaattacattagaaaagaaatgtctcagatca

SEQ ID NO: 183956 - DNA, 601 bp, Human
gatcttacaagtaccacagaggaaagaggaaagttcagggaagaaaagcacttaccaagaggaagatgaaaagaaaggctggcagggtgtgggggtagtgggaggtctagaagggaaagggaacagaagtcagggaatgttctggaaagttacatctaaatccaatcttaaaggattttagaacaacaactctagcaaaagctttatataacatcaacctccagcccagaaccgtcctccaaactccggactccttatctgtgtatccatcttctccatttcgatgactagcaggtaactmaatgtgaacatatcccaagctaaatttcttctcttcccttcaaatcctactccttctgtagctttccccatctcagatgatggcaattctttcctttcagttgctcaggcaaaacccctggagtaatactggatttgtccttggcaacatcaaggccttatactttaggtaagagaagttttggggtcatgcatatgttaaagtctgatgagagtgaattcaagaggaaatggaaggaaaggaattggtgacaggtagtagaaacgtctctttaaaagaaggcaggccgggcacggtggc

SEQ ID NO: 183957 - DNA, 601 bp, Human
tcttaaaagatctacccttcttgaggaaataaataagattacatgaaaatgaagggagttttctttgttttttgtttgagacagagtctagctctatcgccaagactggagtgcagtggcgcaatcttggctcactgcaacctctgtctcccgggttcaagcaattctcctgtctcaacatcccaagtagctggtagctgggactacaggcgtgcgccaccactctcagctaatttttttatcttcattagagacaggttttcaccatattggccaggctgatgtcaaactcccgacctcwagtgatctgcctgcctcagcctcccaaagtgatagaattacaggcatgagccatggcacccggcaaagattttgacttaatttttaagagagagggttttgctctgttgcccaggctggaatgcagtggtataatcacacctcactgtaacctcaaaatgctgggttcaaatgatcctcctccctcagcctcccaagtatatggtgacaacaggtgtgcaccgccacagttggcttatttatttatttatttatttatttaatttgagactgagtctccctctgtcacccaggctggagt

SEQ ID NO: 183958 - DNA, 601 bp, Human
actcaactcaacaatcagttttaggtatttagttcaaaaagagacataaaagtataaaaaagtgaatataaacagaatgtttatgatggcactgcttaaaaacaacaaatgtccaccaacagattataatattgtaaaatagtacacagtaataaaagaaatgagagcacttcgtgttaccgatacaggaagataacaggtatctaatagctaaatatagataaaggccaagacaccctagggtatgcctatagtcccagctattagggaggctaaggcagaggggtgtcttgagtccagsaatttgagaccagcctgggcaacatagtgtgaccccatctctaaaaataaataaataaataaataaattagctgggtgtggtggcacacgcctatagtccttatctcgtaataaaaaataataataataaaaaagaacctggccaggtgcagtggctcaagcctataatcccagcactttgggaggctgaggcaggtggatcacttgaggtcaggagttcgagacctgcctggccaatgcggtgaaaccccatatctactaaaatacaaaaaattagccaggcatagtggcgtgtgaatc

SEQ ID NO: 183959 - DNA, 601 bp, Human
tacagtgataaaaccttttaaaatttgataaccagcattgacaagggtaatttcattacatcatttgggggaatgtaaataggaataacctttttatgagacaatttggcagcctatcaaattctgcaatactcaactcaacaatcagttttaggtatttagttcaaaaagagacataaaagtataaaaaagtgaatataaacagaatgtttatgatggcactgcttaaaaacaacaaatgtccaccaacagattataatattgtaaaatagtacacagtaataaaagaaatgagagcacytcgtgttaccgatacaggaagataacaggtatctaatagctaaatatagataaaggccaagacaccctagggtatgcctatagtcccagctattagggaggctaaggcagaggggtgtcttgagtccaggaatttgagaccagcctgggcaacatagtgtgaccccatctctaaaaataaataaataaataaataaattagctgggtgtggtggcacacgcctatagtccttatctcgtaataaaaaataataataataaaaaagaacctggccaggtgcagtggctcaagcctataatc

SEQ ID NO: 183960 - DNA, 601 bp, Human
gcttataagatttattcttcctcgctcaagaaagaatgcatatttttaaaaacttgcttcattaaagaatgcatattataagaaaatggaaattacaaaaactgatatccagcgagtggtataagagcagctattacagtgataaaaccttttaaaatttgataaccagcattgacaagggtaatttcattacatcatttgggggaatgtaaataggaataacctttttatgagacaatttggcagcctatcaaattctgcaatactcaactcaacaatcagttttaggtatttagttcamaaagagacataaaagtataaaaaagtgaatataaacagaatgtttatgatggcactgcttaaaaacaacaaatgtccaccaacagattataatattgtaaaatagtacacagtaataaaagaaatgagagcacttcgtgttaccgatacaggaagataacaggtatctaatagctaaatatagataaaggccaagacaccctagggtatgcctatagtcccagctattagggaggctaaggcagaggggtgtcttgagtccaggaatttgagaccagcctgggcaacatagtgtgacccc

SEQ ID NO: 183961 - DNA, 601 bp, Human
gtcgcccaggctggagtgcagtggcgcaatcttgacgctctgcaacctccacctcctgggttcaagagattctccaggctcagcctccccaagtagctgggactacaggcacgtgccaccacgtccagctaatttttttttgtatttttagtagagacgaggtttcactatgttggccaagctggtctcaaactcttgacctcaggtgatccgcctgcttcggcctcccaaagtgctgggattacaggcatgagccactgtgcccagccataagtcttaaataaggtaatatgagccctcyaacttgagtcttttccaaaaatgtttttgtttgttttgttttgttttttcgagacagggtctcattctgtcactcaggctggagtgcagtagtgcaatcgtggctcactggagcctcgactgctcaggctcaagcaatcctcccgcctcagcctcccaagtagctgggaccacaggtgcatgctaccacgcctgcctaatttttcattattattattttttggaaaaacggggtctccctatgtttcccagactgctctcaaactcctgacctcaagcaatcctcccaccttggcctccc

SEQ ID NO: 183962 - DNA, 601 bp, Human
taattaggtgattaggtagttacctaatcacctaataattaggtaattaggtaattattacagagtcatttgtggaaaaagtcatctgcattctattgaattgcctttgcacctttgtaaaaaaatcaactgaccatattacattgggtttatttctgggctgttatgttccatcaatttgtaaggctatccattttgccaataccatcctgtcttgattactgtatttgtacagtaagtcttcttgacagggagtctctctctgtcgcccaggctggagtgcagtggcgcaatcttgacrctctgcaacctccacctcctgggttcaagagattctccaggctcagcctccccaagtagctgggactacaggcacgtgccaccacgtccagctaatttttttttgtatttttagtagagacgaggtttcactatgttggccaagctggtctcaaactcttgacctcaggtgatccgcctgcttcggcctcccaaagtgctgggattacaggcatgagccactgtgcccagccataagtcttaaataaggtaatatgagccctccaacttgagtcttttccaaaaatgtttttgtttgttt

SEQ ID NO: 183963 - DNA, 601 bp, Human
ctggcttcctaacattgaactgtagaaagctaaacgcaatgtgattcagggaacagacctgctgttttaagagttgtagtggccaaattcctcccatgtaacatattttggtgatcattattctgcatctacaaaagtattttaaggttgatccagttcttgtgtggtacagctccaataaatattcaaaaaatatcaaagcaaactcattattctccttccattgttggagattttacatggcaatgtcctgggtttaaatacctccaacaaggacactaccaccctcagaaataattcrtatgcttccattaataatgctcttcaaaggagattatcaaggtgttcattgtaagtgcatcacctacacatttggggaatcctgggaatcacttacctgtagtatcgctcccttctactccatgaccaccattggctaggagtgttggtttagaagatggagtatctgcaacaatgacaaataattacccattgtgacagacagaaaaatgaaaaacagatccaaccactgtcttattaatggagtttttctcactctttgtagcattaggttaaagcaattaaaaactgttcaaaattt

SEQ ID NO: 183964 - DNA, 601 bp, Human
ataaataactcctaatttgttgttcactggcttcctaacattgaactgtagaaagctaaacgcaatgtgattcagggaacagacctgctgttttaagagttgtagtggccaaattcctcccatgtaacatattttggtgatcattattctgcatctacaaaagtattttaaggttgatccagttcttgtgtggtacagctccaataaatattcaaaaaatatcaaagcaaactcattattctccttccattgttggagattttacatggcaatgtcctgggtttaaatacctccaacaagracactaccaccctcagaaataattcgtatgcttccattaataatgctcttcaaaggagattatcaaggtgttcattgtaagtgcatcacctacacatttggggaatcctgggaatcacttacctgtagtatcgctcccttctactccatgaccaccattggctaggagtgttggtttagaagatggagtatctgcaacaatgacaaataattacccattgtgacagacagaaaaatgaaaaacagatccaaccactgtcttattaatggagtttttctcactctttgtagcattaggtta

SEQ ID NO: 183965 - DNA, 601 bp, Human
tttcaaaagcaacagttaagggaaagataaaggaaacacactgggggcaaaataaataactcctaatttgttgttcactggcttcctaacattgaactgtagaaagctaaacgcaatgtgattcagggaacagacctgctgttttaagagttgtagtggccaaattcctcccatgtaacatattttggtgatcattattctgcatctacaaaagtattttaaggttgatccagttcttgtgtggtacagctccaataaatattcaaaaaatatcaaagcaaactcattattctccttccaytgttggagattttacatggcaatgtcctgggtttaaatacctccaacaaggacactaccaccctcagaaataattcgtatgcttccattaataatgctcttcaaaggagattatcaaggtgttcattgtaagtgcatcacctacacatttggggaatcctgggaatcacttacctgtagtatcgctcccttctactccatgaccaccattggctaggagtgttggtttagaagatggagtatctgcaacaatgacaaataattacccattgtgacagacagaaaaatgaaaaacagatcc

SEQ ID NO: 183966 - DNA, 601 bp, Human
ttgaccaggctggagtgcagtggtgcgatctcggctcactgaaacctccgcctcctgggttcaagcgattcttctgcctcagcctcccaagtagctgggactacaggcacgtgccaccacgtccagctaatttttgtatttttagcagagatggggtttcaccatattggctaggctggtctcaaactcccaacctcaggtgatccgcccgcctcggtctcccaaagtgctgggattacaggcgtgagccaccgcgcccggcctagtatctattttaatacagttaagtggttcaattcaraactcaatccaggtgtgcaaactatatgctacctaagggcagagaggtatccaagaacagaacgacctactctcataatgccactgggtagttcataaagagccaggttcttttttgtcacaagggaatcctgaaacagtgagggccaggatacagtttttacccttctattctgtactactaaggcctggcagcggtaagcacctgctacacagagtttgagtctcttctggtcaggcatgacttcctactggagaagaaatctactcgtttttgtagttgtttccttcctggatgaaa

SEQ ID NO: 183967 - DNA, 601 bp, Human
tgctccaaaaacatgcactgccatcccctccctccaccttccctccccaaataaaacatgcatattttcagtaaagtatctttttttttttttttgagacggagtcttgctctgttgaccaggctggagtgcagtggtgcgatctcggctcactgaaacctccgcctcctgggttcaagcgattcttctgcctcagcctcccaagtagctgggactacaggcacgtgccaccacgtccagctaatttttgtatttttagcagagatggggtttcaccatattggctaggctggtctcaaactcccaacctcaggtgatccgcccgcctcggtctcccaaagtgctgggattacaggcgtgagccaccgcgcccggcctagtatctattttaatacagttaagtggttcaattcaaaactcaatccaggtgtgcaaactatatgctacctaagggcagagaggtatccaagaacagaacgacctactctcataatgccactgggtagttcataaagagccaggttcttttttgtcacaagggaatcctgaaacagtgagggccaggatacagtttttacccttctattctgtactactaagg

SEQ ID NO: 183968 - DNA, 601 bp, Human
gggattagaagctatattagacctagaacttgggcctcaagtctttacccaacttgtgttttagtaacattatatttcaacaattatgaccccaaccaaatccagtccataaggtgttaatgtaagatgtttattagtggaatttatttagtacagtaatcacattagaagtcccaatatacaaactgttgaagtccaaagtcacaaaaaatacaaacttaggtatacgaatgaaattataaaaacattatttaaaaacaaagttctacatcttcaacattgggccaaaaaaggaaaaaamaagagagagagaaagagaaagaaggcatatgaaaatcatcacatttcaacaaagcagccctgaccagtctggctgcctcaccattgagatactggaccacttgggtgtgaccactatggcaatacagcatttcattatgggactggctactttgtataaaactatatgtgaaacataaaatttctttctttcaaaatgaaacgtccaagtgaaacagatagagctaacatataccaaattttagctggctgttagtagaaaatttcaacaattctgtaagttcaaaaaggaaacatattt

SEQ ID NO: 183969 - DNA, 601 bp, Human
ctaaacgtaaatgtaacatcttgtatatgggtatatgtggacttttctgaagagaaattctgtatttttattagaaaaccatgaaccaaaaaaactttaagaaacattacgtgctgttaatttgctgatgtgtctccagcatgcaactcattaactggaaaatgaaagaaaagaaataaaactttgttccaggaatttggtggagttcggatggatgtcttgctgtctatacatagcaacataatgtgcagcttatgtctgggctccacttgtgagttatgatgccaatttacagcgtggytccaatagctgttcagaaactctaacacaccacagatttatttatctgttaatatttcacatttttggtgcttttgcatttttctgatgctaaatcctttgcatcctaccagatgagatagtgatgaagcacacagaataccttctgtgtcatgatattctaaaaaagtagatttactgtttcactgctggcatgactttacacatgcaaacagttatcacaatagtaaactgtttacctactctaattacgatggaaacaaccagtaacactgccatttgtacagcacttagtgcaatg

SEQ ID NO: 183970 - DNA, 601 bp, Human
attagcacctggctaggtgcagtggctcacgcctgtaatcccagcactttgggaggcgaacatgggtggatcacctgaggtcaggagctcaagaacagcctggccaacatgctgaaaccccatctctactaaaaacacaaaaattagccagacatggtggtgggagcctgtaaccccagctactcgggaggctgaggcaagagaatcacaagccctggaggcagaggttgcagtgagccaagatcacgccattgcactccagcctgggcaataagagcaaaactctgtctcgcggggcgcrgggagagaaaaaaaaaaaaaggattagtaccataatagatggagttccttcaaatttcctctacagagttgaaggatctcatcctctatggtaaggcataagcagacaaatcttatgttaagagaatcttgctttgaagtaacctcttggttagacacttcttgtgcccccacctcacactctgttaagttcactatttattctagctattgctacagcatccagctgcacataggtgtgatttgacagcactttgtatcaaccaaaccagagttttctgccctacaacttctctgacac

SEQ ID NO: 183971 - DNA, 601 bp, Human
aatttttaaaaagatagtcgagaagtactcattgagaaagtgaagagtcaatcatgaatatatcaaagggaagaacattccaggcagagaaaactgctagtgctcagagctcaaggcagatgcccacctggcttgttcaaggaacagtagcaagaacaccatgaagcaaagtaagtaaaggggtaactaagaaaagatctggtcagaaagatgacaacgacatcatagggccttgtggtatttcataaggactttggcttttactttgagatgggcaaccactggagggttctgtgcaaamgaacagcatgatcaatgtacaggaccactgtagatgtttttaagaatatgctgcagggagcaagcaaatggaagcagagagactaatttgggaagttattacagtagccaaggttaatgatggtggtccaatcagggagagagcagtggaggtggtgagatgtggtcaggttccaaatatctttttctgacaaactgggtgtggggtgtgagaggagcagaagaggatagggaaaccaaatgtttagccttaacaaccaggacagaatttccatttaaggagatggggaggcaggtggtt

SEQ ID NO: 183972 - DNA, 601 bp, Human
aagtatgtgcggctccactcactattatatctagcaatcactgaatttttgctttcactcctaacaactgagttctgctggcttggaagtgctagtccctaagcaggaaatatatctactagcatacacaacaatggttcaattgcattagaagatgagactgccacttggctacttgggactccttacaccactgaaccaacaggctgaacctactggttgggaaagattgagcccaattgtcaaggggaaacggttgctgctacacagtgaaagcaaggaggactatgtctgaaacccragggattatctaaggcacctcttaatacttccatgccaaaaataaagattaatggaaaactacagcaaccaaaaaaggactggactaatgagggaataaatgtttgagtcatttcaccaggtaaagaacctcaaccagctgaggttcgtgctgaaggcaagggaaacatgaaataggtaactgaagaaagaagcctagatatcaactgtggcctcattactaatcacagaaatgaggatgaactttctctttgttatatttggtatttgtttgtatattctaaccattttcttctttcct

SEQ ID NO: 183973 - DNA, 601 bp, Human
aagtgatcctcctgccttggcctcccaaaatgctggggttacaggcatatgccaccatgccaagcccacacagcattgctcctgaccaagaaagtcatttcatagtaaagaaatgcagaaatgggctcatgtccatggacttaactggtgttgtcacatcctatcacacagaatggttggcctaattaaaatagggaattgattactgaagactaagttacagtttcagggagacaacaccctgaaaggatggggtaatgatttcaatcagagacaccttacatggtgctgtctcctcccwcaatcagaatatacaggtctgggaatcaaagggtagaagtatgtgcggctccactcactattatatctagcaatcactgaatttttgctttcactcctaacaactgagttctgctggcttggaagtgctagtccctaagcaggaaatatatctactagcatacacaacaatggttcaattgcattagaagatgagactgccacttggctacttgggactccttacaccactgaaccaacaggctgaacctactggttgggaaagattgagcccaattgtcaaggggaaacggttgctgct

SEQ ID NO: 183974 - DNA, 601 bp, Human
ttctttttttgagatgaggtctccctctgtcgcccagtctggagtgcagtggcacgatcttgtctcactgaaacctctgccttctgggttcaagtgattctcccgcctcagcctcccaagtagctgggactacaggcatgtgccaccatgcccggctaattttttttgaatttttagtagagatggggtttcaccatgttagccaggctggtctcgaactcctaacctcaggcaatctgcccgcctcagcctcccaaagtgctgggattacaggtgtgagccaccatgcttggccaaaaaraaagatgtatttttaaaatagagacaaggtctcactatgttacccaggctggtctcaaactccttggctcaagtgatcctcctgccttggcctcccaaaatgctggggttacaggcatatgccaccatgccaagcccacacagcattgctcctgaccaagaaagtcatttcatagtaaagaaatgcagaaatgggctcatgtccatggacttaactggtgttgtcacatcctatcacacagaatggttggcctaattaaaatagggaattgattactgaagactaagttacagtttcagg

SEQ ID NO: 183975 - DNA, 601 bp, Human
cagctgatgccccagatatagcatctttactggagcaaatcaacatgggtcacggcacttggtatactgctattaacctgaataatgcctttttcttcatacaaatctgcaagaaccaccagaagcacattgcttttacctgccttttacgtgcctatgaatctagcctcagggctatgccattctcctaccataatgtagcccacagagatcttgatcgcgtgacattccaaaaaaataaataaataagcacgtacacacacacacacacacacacacacacacacacacacacacacaatagtcaactatactgacattatgctaattgggtctgataaatagcaagtagcaaatacgttagatgctttagtaagacatatacaaagtagttgatgcgagataaaccctacaaaaattcagagacccactgcagcaatgaaatgtcaggattcaattgctcaaaacatgtcaaaatttcccttccaaggtgattaagttgctctaattaacatcaccaacaatgaaaaagagggtacaatgtttggtaggcttcaacccagctacaaagttacctacaaggttgacagtttagagtggg

SEQ ID NO: 183976 - DNA, 601 bp, Human
actacttgagcctaggagttcgaaattacagtgagctatgatcacgccactgcactccagcctgagtgaccgagtgagagcctgtctctaaataaataaataaaactttctttaaaaaagagtccactatgtttaatgaggtggagatgccaaagtttccctagcaagatgtagaagaggcaattcaaaaacttagggagatagaaatgttggaatggatttttcatgtgtaacctatgttgcaaaaaaaagctcggaagataatcctttcactcaggcattgagaaatccattagtgagctgggcatggtggttcacacctgtaatcccagtactttgggaggccgagccaggtggatcacttgaggccaggagttcaagaccagcctggccaacatggtgaaaccccgactgtactaaaaatacaaaaattagccaggtgtggtggtgcacaactgtaatcccagctacttgggaggctgaggcatgagaattgcttgaacccaggaggcagaggttgcagttagccaagatcgtgccactgtactccagcctgggtgacagagtgagactctgtctcaaaaaaacaaaaaaaaaaaca

SEQ ID NO: 183977 - DNA, 601 bp, Human
caggcacagtgtcacatgcctgtaatcccagctactcaggaggctgaggaaggaggactacttgagcctaggagttcgaaattacagtgagctatgatcacgccactgcactccagcctgagtgaccgagtgagagcctgtctctaaataaataaataaaactttctttaaaaaagagtccactatgtttaatgaggtggagatgccaaagtttccctagcaagatgtagaagaggcaattcaaaaacttagggagatagaaatgttggaatggatttttcatgtgtaacctatgttgcamaaaaaagctcggaagataatcctttcactcaggcattgagaaatccattagtgaggtgggcatggtggttcacacctgtaatcccagtactttgggaggccgagccaggtggatcacttgaggccaggagttcaagaccagcctggccaacatggtgaaaccccgactgtactaaaaatacaaaaattagccaggtgtggtggtgcacaactgtaatcccagctacttgggaggctgaggcatgagaattgcttgaacccaggaggcagaggttgcagttagccaagatcgtgccactgt

SEQ ID NO: 183978 - DNA, 601 bp, Human
tggctaaactacatctggaaattgtattccattctaggcataggttaagaggtatgatatattagttatcaatttattgcctttcagttccaaatctatactttactgctctgctttgcaataatgaagctggactcttcaaatgtttttcttatgccaatagcaagcactggaggaatactacaggaggaagaggatttcctcctggttccactgtgttttcctcttctttctcccgtggcctcatgtgatgcgtgggacacccagcggtgctcacccaccagttttagggataccacaatgagtggcttcaggtgagttccagtcaccccagctaacttcccagtgattttcgacagcaccacccagagcagcttcctagacagttttgttggcactccagcaaacaatactcttgcttttaaccctcggctggtgccatcctcaggaacttaaaactgcaacagactacagctttacctcctcaaaaggtctgaatctccgccttgggtaggctctctctccaatctgtctctttctttcatactctgcctcaggcacagagggagtagctgctcctatagctgatacacctacatct

SEQ ID NO: 183979 - DNA, 601 bp, Human
ctttccaaggacagcaaatatgccctttatcaccttcttgccacccagtcctccaaccttctagacttaatttttcattccttctctcctcatttctccccctctggctatgagcacagttaaatctctggcatctttaaaacacaagtaaaatccaaactgtttatatatatatcccctatagaagaatctatggattaaaataaatttagattctaattctaacgagctagttttttttttttaattatgagataactggtgaattgaatactgactggatatttggtactagggaacyggtgtgtgtttgttaatggtattgcaattatgctctaaaaaggaacctttttttttttttttttgagatacatgctaatataaagatcaaatgatctggggtttgcttccaaaaaacacctagggttaaatggagggagtgattgggaacagatgaaatcagattgctggccaggcgcggtggctcacacctgtaatcctagcactttgggaggctgaggcgggtgaatcacctgaggtcaggagttcgagaccagcctgacccacagggtgaaacccctctctactaaaaatacaaaaa

SEQ ID NO: 183980 - DNA, 601 bp, Human
agccaggatttcaagattgcagtgagctatgatagaaccactgtattcctgggcaacagaccaagaccctgtctccaaaaacacaaaagaaaaaaaactttcaaaataaaaataaaagtatttcaataaaaaaagtgacaggagaaagcctactcctttctcagattttcagccgactccattttttataattaaatagatccaaatgttcatatccaactatattagcgtccttctccactgtattaaactagcaaaaagcccactaacctttcttgatttaaaataatattttaggccrgatgcggtggctcatgcctgtaatcccagcactttgggaggctgaggcccacagatgacatgaggtcaagagttcaagaccagtctgacccatgtggtgaaaccccatctctactaaaaatacaaaaattagccaggcgtgatggtgcatgtctgtaatcacagccactgagactgaggcagaagaattgcttgaactcgggaggcagagggtgcagtgagcccagatcccgtactgcattccagcctaggtgacaaaacaggactctttcccccactctccccaaaaaaggcttcaaac

SEQ ID NO: 183981 - DNA, 601 bp, Human
ctcggtggctcacgcctgtaatcccagcactttgggaggccgaggtgggcggatcaagaggtcaggagttcgagaccagcctggctaacatagtaaaacacagtctctactaaaaaaacaaaaacaaaaaaaaaaaaaactgggcatggtggcgtgtgcctgtaatcccagctactcaggaggttgaggcaggaggactgtttgaacccgggaggcagaggttgcaatgagctgagatcgtgccattgcactccagcctgggcaacagggcaagactccgtctcaaaaaaaaaaaaaaaaaggcgaaaacgctaccactgttcttactaatctccttcatttttgaaactatacttctcaataaaaatattgtttattattactttttaaaatgagataagtatttttcaggtttctccagttttagtttgataaatagatataaccctcacaaacacaagctctttgggggtctttactaagggctgtgctagtatttggtctctaaactcctttacagttttagaagtctgttagtccaaatccctatatactccagtgcaagctcacacttctagcctcctacagccccgttcttccc

SEQ ID NO: 183982 - DNA, 601 bp, Human
gatgtgtgccactatgcccttctaatttattattgttattattttgggggtagagacagggtctccatacattgcccaggctggcgttgaacaactgggctcaagcaatcctccggatttgacctcccaaagtgctaggattacatgcatgagcctctataccaggcccatatttgagttcttaaccctggctttgccacaggctaaccatgtaaatttgggacagccctttcatctctcttagtcacagtaatgacctctaaggatacttgttcagttctaaaattatggttaagtaaaraacattcttcaagtcacatcctatttagagaaggtgcacctatccatctatttcaaagcttataaagacgatgtgtttagggcttcaacaacacaaaacattattacggcaaatgttagatgctaatctaaagccttccttacccatcaaatgaacccatcccaggcttgttccctactactccaacaggaaagtcatgcagtaagtatgctgtcccctcatggctcctgctagagcctgtgctccactctgcccctgtgcctttgctcatgagatcactgatcccctgcttgaaatgtc

SEQ ID NO: 183983 - DNA, 601 bp, Human
aacaaacgaatcagtgactccttctatttcacaccctcagctctttccttgtttttttgtttttttcccccagtggtaacctcagaactttaaagtgaaaggaacctagaggatcacctaatccaaacctctgaagtttaaaccatgccacatttgtccagataattcatttaccaatttaagcacatactgtcaatcgctactccaggcattagtgattcagcagtaaaccaaatggtgaaatgtcctgctctcatggaacttagatcaccaccatcaccaccctatgcttaggcactaygaaaacacagaagcaagtattagcctagttgagagtttaagacatgcccaatgatgcaaacctctgcaagctttagttttcataactaatacctacttcataaggctaagatatgtgaagtgcttagaaaattatgagaaacatgctaaattattgctaatcctataataaccattatggtttatgtaggacaagtgtctacaatgcagtaagtgctacttataggagtttaaagaacagtcacataacacagtcgtgggatgatctaggatcttcctgtaggagactagaacttaattg

SEQ ID NO: 183984 - DNA, 601 bp, Human
agacagggtctcactctgtcacccaagctggagtgcggtagtacgatcatagctcactgcagcctcgacctccctgactcaagcaatcctctcacctcagcctgccaagtagctgggactactggcatatgccatcctgcccagctttttttttttttttttgagacagagtcttgctctgtcacccaggctggagtgcagtggcgcgatctgggctcactgcaagatccgcctcccagattcacgccattctcctgcctcagcctcccaagcagctgggactacaggcgcctgccaccaygcccggctaattttttgtatttttagtagagacagggtttcaccatgttggccaggctggtctcaaactcctcaacccaagtgatctgcctgcctcagcctcccaaagtgctgggatgacaggcatgtgtcactgcacctggccccaaaagccaactttaaatggcatttcaacacaagtaggttccccagagctgaatgtggtgaaattgggttaattatgtagtttaattttctgtactctatgtatgtattcatcaccatttcagtagatatgtaaggccaattttacataggtcac

SEQ ID NO: 183985 - DNA, 601 bp, Human
gacaagacaaagacctaatgtaagagttaaaactaaaaaaacttataaacaggaaaaaatctttgtgactttggattaggcaaagatttcttagacatgtcaccaaaagcactatctgtaagagacaaaatatataaatgggacaccatgaaaatttaaaacttttgcttttcaaagatgctattaaacggccaggcatggtggctcatgcctgtaatccctgcactttgggaggccgaggcaggcggatcacctgaagttaggaattcaagaccagcctggccaactgggtgacaccccrtctctactaaaaaatacaaaaattagctgggcctggtggcctgtgcctgcagtcccagctactcaggaggctgaggcaggataatcacctgagcctgggaggcgaaggttgcagtgagctgacattgtgccactgtactgcagcctggggcaacagagtgagactgcgtctcaaaaaacaaaaccaaacaaaaaaacaaaagacaggccgggcgcggtggctcacgcctgtaatcccagcactttgggaggccgaggcgggtggatcatgaggtcaggagatcgagaccatcctggctaa

SEQ ID NO: 183986 - DNA, 601 bp, Human
cattttctcttcaaggaattcagttggagacccttaaaatagagacacaaaacaaaagttacaagatattacagttttctcctccactacagtggaatttctacaaagtattacagctagtacaatataaaaaatcctatctagctagtgtcttacaagaaaacttttttcttttaattgaaagataaaaggagctgggtgcaatggtgcgtctgtagccccatttacttgggagactgagagaggattacctgaacccaggagtttgaggctgtagtgcactatgatcacacctgtgaayagctactgcactccaacctgggcaacatagcaagactctgtcactaaaaaaaattttagatagaaggaaataaagtaggtcattaaggttaaaaaaacactacagagtgacttctaggttatgcaggcacgaagagggtagtgatttctccacatgaaagaacaaggataaaactgtcaaaagcaacaatttcagggagctggaattaaaaaaaaaaaaagccagcctaaataagtggaaaggtataacatgctcaggaatgaaagattcaatactgttaagatggcaatcctgaaaatg

SEQ ID NO: 183987 - DNA, 601 bp, Human
ctatagtaaaaaactgcgagtcttaatttcttcatctgcaaaatgagattaacacctccctttccaacattagaagacaattttattaaaatactttgtagcagttttgttgttgttgttgttgttgtttgcccagctaattttcttatttttattatatttatttattaatttttgagatggattcttgctcgttgcccaggctggagtgcaatggcacaatctcagctcactgcaacctccacctcccaggttcaagtgattcttctgactcagcctcctgagtagctgggattatagstgtctgccaccactcccagctaatttttgtatttttagtcgagacagtgtttcaccatgttggccaggctggtctcgaactcctgacctcaggtgatctgcccacctccgtctcccaaagtgctgggattacaggcatgagccaccacactcggcctaatttttctatttttagtagagatggggtttcaccatgttggccaggctggtctcaaactcctgacctcaggtgatctgcccgcctctgcctcccaaagtgctgggattacaggcatgagccattaggcccagcctaattttt

SEQ ID NO: 183988 - DNA, 601 bp, Human
caagttttaaaggaaacactgctgacattcttcaggttttagctagttgttagtaggtggtatagtatatcccagtagtgccattaatcaacattcactggctactttctatataatatataaagggtaatataaagattcaaaatattaatgattgaactctagttccaacaccacaaccaacataatatactatagtaaaaaactgcgagtcttaatttcttcatctgcaaaatgagattaacacctccctttccaacattagaagacaattttattaaaatactttgtagcagtttttttgttgttgttgttgttgtttgcccagctaattttcttatttttattatatttatttattaatttttgagatggattcttgctcgttgcccaggctggagtgcaatggcacaatctcagctcactgcaacctccacctcccaggttcaagtgattcttctgactcagcctcctgagtagctgggattataggtgtctgccaccactcccagctaatttttgtatttttagtcgagacagtgtttcaccatgttggccaggctggtctcgaactcctgacctcaggtgatctgcccacctc

SEQ ID NO: 183989 - DNA, 601 bp, Human
gccgttggctgaggaggttctgcaacagcctctggggaaacaaaggactctgagtgtggagagtttaaggcttccacagaccacccctgaggtacaacagctgtgttgcagggagacatacctaatattgaaacacaaacaaatacattttgaaacttagtaaacattggaaacaaaaggtatttgatatatttttgttttgttttgttttgtttgttttttttttgagacagagtttcgctctgttgcccacgcagacagagtgaagtggcgtgatctcggctcactgcaagctccgctwcccgggttcacgccattctcctgcctcagtctcccgagtagctgggactacaggcgcctgccacagctcccggctaattttttgtatttttagtagaggcggggtttcaccatgttagcccggatagtctcgatctcctgacctcttgatccaaccgcctcggcctcccaaagtgctgggattacaggcgtgaaccaccgcgcccggcctaagaggtatttgatatttaaaatcagctgcatatattgccaggaagacacagactaataaaaaacaatgcaaaaaaagttttttttcttt

SEQ ID NO: 183990 - DNA, 601 bp, Human
tcctgacctcaggtgatctgcccgccttggcctcccaaagtgttgggattacaggcgtgagccaccgtgcctagaccaatttttgtattttttgtagaaatggggtttcaccatgttggctgggctggtctggaactcctgacctcaagtgatctgcctgcctcagcttcccaaagtgctgggattataagtgtgagccaccacaccaggccgtaaatctgtactgaattaaaaaaaaaaattctgatacctaatacaatgaaaatgtgatgaaaaaaatatatatatgttaaaaaatttwaaaaaagtatttatgtgcccgttaaccctaagtgttatagttcaacaatttaattcctccagtggtgatatcactaatataagcaaaacatttgtgattgttctgaaatttttatacctgctgtaagctgctaaaaaatacacctgatgatttatattgattaccaatactgcaaccattaactgataaagggagtctctaatagtttacctgccgttggctgaggaggttctgcaacagcctctggggaaacaaaggactctgagtgtggagagtttaaggcttccacagaccacccct

SEQ ID NO: 183991 - DNA, 601 bp, Human
tcaccatgttggccaggctggtctcgaactcctgacctcaggtgatctgcccgccttggcctcccaaagtgttgggattacaggcgtgagccaccgtgcctagaccaatttttgtattttttgtagaaatggggtttcaccatgttggctgggctggtctggaactcctgacctcaagtgatctgcctgcctcagcttcccaaagtgctgggattataagtgtgagccaccacaccaggccgtaaatctgtactgaattaaaaaaaaaaattctgatacctaatacaatgaaaatgtgatraaaaaaatatatatatgttaaaaaatttaaaaaaagtatttatgtgcccgttaaccctaagtgttatagttcaacaatttaattcctccagtggtgatatcactaatataagcaaaacatttgtgattgttctgaaatttttatacctgctgtaagctgctaaaaaatacacctgatgatttatattgattaccaatactgcaaccattaactgataaagggagtctctaatagtttacctgccgttggctgaggaggttctgcaacagcctctggggaaacaaaggactctgagtgtgg

SEQ ID NO: 183992 - DNA, 601 bp, Human
gccaccacgctgagcttatttatttatttatttagctctttcacccaggctggagtgcagtggcgcaatctcggctgacagcaacctctgccttccggtttcaagtgattctcctgcctcagcctccctagtagctgggattacaggcacctgccaccacgcccagctaattttttgtatttttagtagagacggggtttcaccatgttggccaggctggtctcgaactcctgacctcaggtgatctgcccgccttggcctcccaaagtgttgggattacaggcgtgagccaccgtgcctrgaccaatttttgtattttttgtagaaatggggtttcaccatgttggctgggctggtctggaactcctgacctcaagtgatctgcctgcctcagcttcccaaagtgctgggattataagtgtgagccaccacaccaggccgtaaatctgtactgaattaaaaaaaaaaattctgatacctaatacaatgaaaatgtgatgaaaaaaatatatatatgttaaaaaatttaaaaaaagtatttatgtgcccgttaaccctaagtgttatagttcaacaatttaattcctccagtggtgatatc

SEQ ID NO: 183993 - DNA, 601 bp, Human
ataactaagaattaatgttaggccgggcacagtggctcacgcctgtaatcccagaactttgggaggccgaggcggatggatcatctgaggtcaggagttcgagaccagcctgacaaacatggtgaaaccctgtctctactaaaaatacagaaattagccatgcagtggcaggcgcctgtaatcccagctacttgggaggctgaagcaggagaattgctagaacccaggaggcggagtttgcaatgaaccgagatcacggcattgcactccagcctgggggacagggcaagagtccgtctcaaaaaaaaaaaaaaaaaaagaagaagaagctaatgtcaagtaacatattctgcctactctttgacagtctcaacacttggaagaataagatgtaaaatactgggaggacaagtagtggaggagaaatggcaaagaagagagaaaacataggcttcaaaaataacacgggcacagaattagtattagaaagataatctgtgggacagcaggtcagtcatgcttcctatcaagaaaaactccagagttctaaatctgtactgaatttttgtttttgttttttgagacacggtctcacgctgtt

SEQ ID NO: 183994 - DNA, 601 bp, Human
cacttcacgcacacacacaaaatatactgaatccacattttggtcagagaaaaattctcatgattccagaaccagagcatcctactttgaaagacaaatatgttaaatttcaacattctgctcctaaatgtacttcccaaaagacagagaaatatatataatgttaagtaggataattaattttaacaattaagatgagtacctttggaagagtttcagcaggtgatctggtctaaccttcctcccagttaatataatatggatccaagatcctggcaagagtctcattaagagcaggtayatgccagctcctgtcaagtctgacccaataaattgatttccaagaatattataatatgtaaatagtggatttcattcttgtccttacccctccaatatcctctaaatcctagcctttgtttaatatctcaggttaattattgcatcgctcaaaaaattgctaggctatagtatcccccagtatttataacatttaattcagcaattaatcagcagctattcagtgccatcttttatactattttattcaattattatgtaaatcttgggtttcagagttcatgcctgagaacttatctct

SEQ ID NO: 183995 - DNA, 601 bp, Human
tcttttgctttggtttcttcttctttttcttcatcattattggtgtgctttctatatcccaggcctccctgccaagatccctctggggttcaagtgagtcaacatgaatactttttctttggttcccaggcccaccacaggaggatgaaccagagacccaacctgactcagacaaagagcagtggcccagcctgtgatcaagagtcttccatggaggagagcctcccagcagctcaggagggaccctggcaggcttgggccgggttgacctgcggtcactgggtctgcaaacttgtttggyttgtgtgggaggggtaccgcaatacatgaagttggctaaaattccaaacaaaaaactcctcgttattgtttcttaaaaacaacaaaaaacaaacaaacaaacaaaaaaaccagaccatataaatgactaatttaaggaggctattttcactaatacatatagtacttactgtaatttgctcaggaaaacagtcttttctaaaacatttctcacttttaactggcgctagcaaaaatatttaacagatcatcatctcaggtaaagattgttttcaaacatttataaaatatttgaaatttc

SEQ ID NO: 183996 - DNA, 601 bp, Human
tacaagtccatattctgtacccatagtggtaggctggctggggagaacacctgatttttgtgtgtcagctgcaaatggatgacctttaggcttatctgcattgtcatcatccgaaggtcctccagcccgtggttgagaatatctcttttgctttggtttcttcttctttttcttcatcattattggtgtgctttctatatcccaggcctccctgccaagatccctctggggttcaagtgagtcaacatgaatactttttctttggttcccaggcccaccacaggaggatgaaccagagacmcaacctgactcagacaaagagcagtggcccagcctgtgatcaagagtcttccatggaggagagcctcccagcagctcaggagggaccctggcaggcttgggccgggttgacctgcggtcactgggtctgcaaacttgtttggcttgtgtgggaggggtaccgcaatacatgaagttggctaaaattccaaacaaaaaactcctcgttattgtttcttaaaaacaacaaaaaacaaacaaacaaacaaaaaaaccagaccatataaatgactaatttaaggaggctattttcactaataca

SEQ ID NO: 183997 - DNA, 601 bp, Human
cattgtatgcagaaacttctgctaggggtcctttcagattgagagggcctactgactggcttttatctacaggagtcttcaggtggggtgcaggctgtggtttgtattcatgttgcttcagcaatttcttgtcttggttttgtagtactgacttgttacttttgctctcttcctctactctcagcttagactgagaacttattgcagttttgggggcttcttcagaaggatataaaggaattctgagactctctgagacaaagttctcagctaccagtctggctgcactggagttaactamacattcccttttcaagttttctccagatacaagtccatattctgtacccatagtggtaggctggctggggagaacacctgatttttgtgtgtcagctgcaaatggatgacctttaggcttatctgcattgtcatcatccgaaggtcctccagcccgtggttgagaatatctcttttgctttggtttcttcttctttttcttcatcattattggtgtgctttctatatcccaggcctccctgccaagatccctctggggttcaagtgagtcaacatgaatactttttctttggttcccagg

SEQ ID NO: 183998 - DNA, 601 bp, Human
aacgaaagaactggatagaacactggaaatctcaatgaatgctggaaagccctctacatactatttcattttctgccttggtaatagggtagctaatagaagataaaaacagagaagatgagaatgtcttatgcaaataacaacctttagcattctttactcacacagcagtattccttagtgggtacatactcatgcatagacaagctttacccaaaagaacaagtccataccatgcagaacacaatcccatgatgaaacctctctaaaagcctgactggctactaaaaccaattggtgttttttttaaattctggagttagtagctacatcatgcaagctgggaaacagtgattaagaaatagtgtcacttgtaggctgtgaaaaatctcaaagacaagggaacattttttgaaagctagattcagggaagccacgattaaatgtatacttttttggggaattgggggtggggggaaacggggctaccatttctaaatcttaaaggaatcatcttcttaatctcattccaattacttgactgaatagagccaaaaaagagtaaaattatgaggaacacaacatgggcaagttttatgga

SEQ ID NO: 183999 - DNA, 601 bp, Human
aatagaccaaatacatgcagaaatttagggtatgacaaaggtggcagttcagtgggagatcgattataaacatgatggtgggatgaccaagtaaccctgcctcacaaccttataaacaaaacataccaaaacaacaacaacaacaaaaaaaaaaaaccccacaaacaagcaaattctagattggccaacaatttaaaatgaaaaatattaatagaagagaaaagaaaatattttcataatttcagagcatggattggcttttataaacttgttaatacatgaagaagtcattaaaaaaaaataaaacacagccaggcatggtagctcatgcctgtaatcccagcactttgggaggctgaggcaagtggatcgcctaaggtcaggagttcaagaccagcctggccaacatagtgaaacccagctctactaaaaatacaaaaaattagctgagcgtggtggtaggcacctataatcctagctactagggaggctgaggtaggagaatcgcttgaacctgggaggtggaggttgcagtgagccaagatcgtgccattgcactccagcctgggcaacaagagtgaaactccatctcaaaaaacaa

SEQ ID NO: 184000 - DNA, 601 bp, Human
aaagtccagaaatagaccaaatacatgcagaaatttagggtatgacaaaggtggcagttcagtgggagatcgattataaacatgatggtgggatgaccaagtaaccctgcctcacaaccttataaacaaaacataccaaaacaacaacaacaacaaaaaaaaaaaaccccacaaacaagcaaattctagattggccaacaatttaaaatgaaaaatattaatagaagagaaaagaaaatattttcataatttcagagcatggattggcttttataaacttgttaatacatgaagaagtcaytaaaaaaaaataaaacacagccaggcatggtagctcatgcctgtaatcccagcactttgggaggctgaggcaagtggatcgcctaaggtcaggagttcaagaccagcctggccaacatagtgaaacccagctctactaaaaatacaaaaaattagctgagcgtggtggtaggcacctataatcctagctactagggaggctgaggtaggagaatcgcttgaacctgggaggtggaggttgcagtgagccaagatcgtgccattgcactccagcctgggcaacaagagtgaaactccatct

SEQ ID NO: 184001 - DNA, 601 bp, Human
cctcagcctcccaaagtgctgggactacaggtgtgagccactgtgcccagccaacaccatttgtaatatctttactgtccaaacaatggaaaccatgggtgacaccatttgaccacaagacgaatgagaacaagatatgtgagaattggtagcaatatgggggcagggcagttaacatgaatgattcaaagtgaggaacaaagataaacaccagtgatggactaacaaaacatgtgaacacattatgctgttcgacagaaaaactcgatatgcaagacataaactctccctacgataagcyagaaacagtgacttcaagaaaaatattgagtggattaatttttcttctacaaaactaaaaaataagaataggacaactctgaaaaagaataatagggcaaggggttgggctagccctattagatattaaaatatattaggaagcctggtggaaagatcaatggatcaggaaagaaagtccagaaatagaccaaatacatgcagaaatttagggtatgacaaaggtggcagttcagtgggagatcgattataaacatgatggtgggatgaccaagtaaccctgcctcacaaccttataaac

SEQ ID NO: 184002 - DNA, 601 bp, Human
tgtttactaattgtcaaccttcatctttttctttttaagtacctgaaacttccggaagcttctgaagcaagtctaagaaaagcatggatcttagaaacataaagacttggattcaaattctaaccctggcacttcaccagctatgtgaccttgacagcctccattttctcacctgaaaaatggagataatctttaatagtgttattttatgtgtgtgtgtatgatctatttacctatttccagataaccaggcaaataaaatcaactcaataggtggtaggtgctattattattattattwttttttgagatggagtctcactctgtctcccaggctggagtgcagtggtgcgatcttggctcactgcaacctctgcctcctaggttcaagaaattctcctgagcctcctgagtagctgggattacaggcgtgcgctgtcatacccagctaatttttgtatttttagtagagatggggtttcaccatgttggccaggctggtctcgaactcctgacctcaggtgatctgctgcgcctggccagtgctattattattaacacccggattagttagaggtactattatttttactaacaccac

SEQ ID NO: 184003 - DNA, 601 bp, Human
tacatatatatatatgaagtaggttttcctactccctatagggaatctgatgtgtagtaataataacaacaacaacaacaaaagtgagaaagcctaagtccctggactggagaactgctgcactctggtaaagacagacaaaaacaaaacaaaacaaccactactactcacaagaaacaacatataaatcgtaattgcaatcactaacagataagagaaaaagaaaagctaaatttcaaaatctggggcactgcctaaggaaagtaaataacctattccctgaatcccttttaggacaagsgtccattatatccatcaacagtactgcaaagacactaaagtatgtgtgacagtacagagtcagaatgctgaggcttccctaacagacccctcattttatagaggaacaaaatggtgtccagagaaaaaaagtggtttgcccatgatcacatggtgaaaacttaatggaaaagccacaaagaagatgctaggtttctgactgccagtcttcccaaaccgctgagcaaaaattaatcttagtcactagatgactctccttttcgatgtatctttatttttttgagagggggtctcgctttgt

SEQ ID NO: 184004 - DNA, 601 bp, Human
caacaagagcgaaactccatctccaaacaaacaaacaaaaaaacaaccaagaaactgtacatatatatatatgaagtaggttttcctactccctatagggaatctgatgtgtagtaataataacaacaacaacaacaaaagtgagaaagcctaagtccctggactggagaactgctgcactctggtaaagacagacaaaaacaaaacaaaacaaccactactactcacaagaaacaacatataaatcgtaattgcaatcactaacagataagagaaaaagaaaagctaaatttcaaaatcyggggcactgcctaaggaaagtaaataacctattccctgaatcccttttaggacaagcgtccattatatccatcaacagtactgcaaagacactaaagtatgtgtgacagtacagagtcagaatgctgaggcttccctaacagacccctcattttatagaggaacaaaatggtgtccagagaaaaaaagtggtttgcccatgatcacatggtgaaaacttaatggaaaagccacaaagaagatgctaggtttctgactgccagtcttcccaaaccgctgagcaaaaattaatcttagtcac

SEQ ID NO: 184005 - DNA, 601 bp, Human
tttaactgctcttagcttcagtttcttcctctataaaaggaggggaatctttaaggtgctcttggattcagttttaccactttcacttctgaagttgaaacagccattcaagtaatcacaggcccactgctatgtccagctcaaagtatgacttcaacctgggactccactaggcagtatcttcagtaacctttctgtctcatgcgggagtgctgcctattggcagaggcatgactgggcatggcggacgttgcagcatgtctgaagaaagtggtagttggcccttatattctgaagaagyggaaaataccaaggcaaagaacaagcatagaaacttgttccttatagccaaattatttttagttctggccagcctacccagacccacttcactagttcatccctacccaacagctaaggcaataactaaaattacaggtctctgctaccttcagatatcacatattctgcctcagtaattctatccataaacagcagactgcaaaatgtgaaccagccaaaagaccaagagcagaaaccagaagaatgaagctagtcaggcacaaagaagtgcatattccagactacagttcatactgtg

SEQ ID NO: 184006 - DNA, 601 bp, Human
tttccccactcaccagagcttactgcccccatttaactcagcatggtcctttgctgccctgggctttgagctcaaatattgtatattcaaactgaaggaaccataaaacaaaactgtgagaaaaaaattacactataaggacaggctatactcttactttgaacaaagctgatttttcttgtctagctgtaagttactgtcttgcaataacatagcatactggaaatattctatcagaaatccaagagaagtctttttccaagatgaagaaaagatttagattgctttttttttttttttwaaaaaaggccatttgccataaactgcaatgatttgattacagtttttaaacaatgcctttagaaaaaagggcaagttaagattgttctttggtctataaaatgtaaagaaattaccaaggtccgcataggaaagcttgctaaactgtagcctctgtccccaagaactcaccttctctattcataccactcaagttcccaacaagagtacagggatcaaccttatataccttttccattaccttcagtacctgacacagggctacactcatgatgatgagtggcaatgttgcaatgctgaa

SEQ ID NO: 184007 - DNA, 601 bp, Human
tactttaatctgagaatgtaatttcccgtgaactagcactctgtttagatctgcaatttaaaacacagtatggtgccaatccaagcactaaggatagtaattattttggctttcactgatatagatacgtgcatacccacacactcatttatctgataccatgcccacccttccacattcaaccactcagaaaactgttttaaaaataaccgagactcatttgccaatccccagctataaccctgaagaacaatgaatccaggaaattgttcaaaattggactaaaaaaaaaaaaaaaaaaccacaccttaacgtagtattaagattgcaggcattcattctcagaggaagagtgggtttgctgtcatagcaacttatcaaactaacttgaaaactgacttgagtggggtccccaaaacccgtaagagctccatctgtagctctgcataatggaagagtttaataaagggttcatttaaagacttcagtgatcagggctttggggatagatattctaattataagacatttgtgtgacaacataccccttatgcatttacgcctgtccctgcccccacttggttccttggatgagctgggt

SEQ ID NO: 184008 - DNA, 601 bp, Human
aaacgttctcaaaagcaaaaacagaaaacagagcttccacccagattgtgcaacttaatgagaggaggttagtgctgataaacccattgtgaatctatataaagtgacagattttcaagcaaggaaatcaatcagttgggattgaaggatttagagctcaggaatcatctggttcaaaccaacagggagctgagggctgggtggatgggggatgggttggacagggtgacatgaggtcaagaaagggggtctagtttttatacccaccattctctgaccccattccaccccaaacttgcayactcaattcacattatctgtcatgctagcaagacattcagcttgaccctgcaagattcactttgttctcttccttgcctcactcccagcaagcttccaacacaagggaattaagctttccccaggcagtcacagaacccagctgtaaaaagctgcttagtgctctgccggtaatctgtcactttggttccttccttgctgtctgcttgttcccaatggaggcaaaatttagaaacataccatcacgtgggggcttttcaaacaggaacgatggagtgctctgggttgcagtgacctcaat

SEQ ID NO: 184009 - DNA, 601 bp, Human
agaccaccacaataagagctgtggggggatgggagatggggaagaaaagaaagggccaggaagaaagacacaaaaggctgtcacaaagaccgcaaaatttagctgtttattaggttgcaagtctctccttctctccctgctttctctttcttctttttctccccacaaatcctctcaaaacacatacaaaaagagaaaactagaagcaagattgggtcaaacatgaagaacacagaaagaatattaaatagctagctttaaagggctctttttcagtttgaacaaaagtaaaacgttctcmaaagcaaaaacagaaaacagagcttccacccagattgtgcaacttaatgagaggaggttagtgctgataaacccattgtgaatctatataaagtgacagattttcaagcaaggaaatcaatcagttgggattgaaggatttagagctcaggaatcatctggttcaaaccaacagggagctgagggctgggtggatgggggatgggttggacagggtgacatgaggtcaagaaagggggtctagtttttatacccaccattctctgaccccattccaccccaaacttgcatactcaattca

SEQ ID NO: 184010 - DNA, 601 bp, Human
cagtcaccacagtttcagaacatggtagtgagaggtgacagcgtgctggcagtcctcagagccctcgcttgctctcggcgcctcctctgcctgggttcccactttggcggcacttgaggggccctttggcccgccgctgcactgtgggaccccctttctgggctggccaaggccagagccagctccctcagcttgcagggaggtgtggaaggagaggcgcgagcaggaaccggggctgcgcgcagcacttgcgggtcagctggagttccgggtgggcgtgggcttggtgggccccgcactyggagcagccagccagccctgctggccccgggcaatgggggacttagcacccgggccagtggctgcagagggtgtactgagtcccccagcagtgccggcccataagtgctgcgctcgatttctcactgagccttagctgctttcccgcggggcagggctcgggacctgcagcccgccatgcctcagcctcccacccctccatgggctcctgtgccgcccgagcctccctgacaagcaccaccccctgctccacggcgcccagtcccatcaaccacccaaaggctgaggaatgcgaacgcac

SEQ ID NO: 184011 - DNA, 601 bp, Human
tgcagccttgtccttttgggctcgagcaatcctcccacctcagcctcccaaacagttgggactataggtacatgccactatgcccacctaatttttgtatttttccatagagatgggttttttgccatgttgctcaggctggtctcaaactcctggcctcaagtaatctgcctgccaaggcctcccaaagtgctgagattacaggcatgagccaccaagcccagctatcaggcaatttctagagaccaccacccacatatccccagagtttcacaaaagcaatgtctgatgtggaacttaytaactccttcaatgaactgtgctcttctgttgggtctttccattacctatactaccactggctgggaaaaccagcctcacatcacagcatgaccttcaattcctttttctcacacaccttccaaattccagtttcactttatcttcacctgttatatttcccctctcatatcctcagcgtttcatctgccactacctgaatcaaatttctaacaggattgtttgctttcaactctttgtcttccagttcatcacacttactgagaacaagtaaatcttcctaaagctgacctggagctac

SEQ ID NO: 184012 - DNA, 601 bp, Human
tggaattatcttcaattatttccagactatttagttgtatttacaggggaggagcagaaaacaatgagatgataccatcttgtcttggtaggaggtttttgtaatggagagcactttgtactttttgatgtttgaaccatatgtacttttagtcaaaaactgagtatttttctagttttaaaatgtaatggggaaaaaccatagccaacaactgtgcaaatttgttaacgcctttgttcttttttttttttttttgagacggaatctcgctctgtcacccaggctggagtgcagtggcgcyatctcggctcactgcaagctccgcctcctgggttcatgccattctcctgcctcagcctcccgagtagccgggactacaggcgcctgccaccacgcccaactaattctttgcatttttagtagagttggggtttcgctgtgttagccaggatggtctcgatctcctgacctcatgatccgcccgcctcggcctcccaaagtgctgggattacgggcgtgagccaccgcgcccggctaatgcctttgttctacagcaagctcaaagaagatcttacttgtgtaactagctgccactggcccc

SEQ ID NO: 184013 - DNA, 601 bp, Human
ctacggggataggggatgaagacactattttgataaacaaattaccacattacaaaagagagtatgccaaatcacagacacagtgggctcagctctcttcctccaagagaagtggctataaagagggcagtatgtaggtagcgacaagcaggatatcgttaaatggaaaaatcagctaaggaggtactagaaattaagggctggcatccaaagtctaactctgcaaatgtagggtaatgacaatttccacaaataaaggccttaagtatggtgtgaagaacgctaaggctggaatcagggraagtggttctgctaccagctctgctggaaacatgtaggattttggccagaggattcccttttctattgctctaaaatttgaggactaaaccagatgctctctgggatgtgcatcaaatttttaagactatgactattattcagaataatctagcatagtcttattattttgccatgagggtaataatgataaaataagttagaaaaaagttatgtgggatagaaatctcaaaaggatgttgcatcttttagatgtcaggctcttggcttcaaaaacctgcagaagttaactggagctatt

SEQ ID NO: 184014 - DNA, 601 bp, Human
tatcacagctacagtctgaaagcaaaagggaaaaagtctctcaagtatagatgcttggcatctgggtcactctagttccttttacatggaggctgagaatgacgtctctagtgaataagggaaagaatcagtttagcctggtttctacggggataggggatgaagacactattttgataaacaaattaccacattacaaaagagagtatgccaaatcacagacacagtgggctcagctctcttcctccaagagaagtggctataaagagggcagtatgtaggtagcgacaagcaggatatygttaaatggaaaaatcagctaaggaggtactagaaattaagggctggcatccaaagtctaactctgcaaatgtagggtaatgacaatttccacaaataaaggccttaagtatggtgtgaagaacgctaaggctggaatcaggggaagtggttctgctaccagctctgctggaaacatgtaggattttggccagaggattcccttttctattgctctaaaatttgaggactaaaccagatgctctctgggatgtgcatcaaatttttaagactatgactattattcagaataatctagcat

SEQ ID NO: 184015 - DNA, 601 bp, Human
acacctgtaatcccagcactttgggaggccaaggcgggcagatcacaaggtcaggagttcaaggccagcctggccagcatgatgaaaccccgtctctactaaaaatacaaaaattagctgggcgtggtggcgcatgcctgtagccccagctactcgggaggctgaggcaggagaattgactgaccctggtaggtggaggttgcagtgagctgagatcacaccactgcacgccagcctgggcaacagagtgaactctgtatcaaaacaaaaacaaaacaaacaaacaaacaaacaaacaaamaaaaaaacaggaaaagggactaaaaaaggaggggaagaaaaaggaggaagggattagaaaatggacaaaaaaaaggagagcagaaagggaaatgggagggccgggcgcagtgtttcatgcctgtaatcccagcactttggcaggccaaagtgggtggatcatgaggtcaggagttcaagaccagcctggccaacatagtgaaatcccgtctctactaaaaatacaaaaattagccgggcatggtggcgagtacctgcagtcccggctactcgggaggctgaggcaggagaatagcttgaa

SEQ ID NO: 184016 - DNA, 601 bp, Human
acctccctgtgagctgggatcacctgtgtccctaatacacatcatagagctggcacacaatggcagcaagacaaaaagaaggatgtttgggtggaagaggaaagaggacaaaaagataaggagggaaagtctgggcgcagtggctcacacctgtaatcccagcactttgggaggccaaggcgggcagatcacaaggtcaggagttcaaggccagcctggccagcatgatgaaaccccgtctctactaaaaatacaaaaattagctgggcgtggtggcgcatgcctgtagccccagctactygggaggctgaggcaggagaattgactgaccctggtaggtggaggttgcagtgagctgagatcacaccactgcacgccagcctgggcaacagagtgaactctgtatcaaaacaaaaacaaaacaaacaaacaaacaaacaaacaaacaaaaaaacaggaaaagggactaaaaaaggaggggaagaaaaaggaggaagggattagaaaatggacaaaaaaaaggagagcagaaagggaaatgggagggccgggcgcagtgtttcatgcctgtaatcccagcactttggcaggccaaagtggg

SEQ ID NO: 184017 - DNA, 601 bp, Human
taaaaagcttaactgagcctcactcactttaataaagtccaccacctctaggctacagctctccctccttaggtggctatgtggaggagtctacaatctgcttccaaacgattcccccacaccaccctgcctccactctatgctccagcctcagggaaccatgtgcggcgcctccttcatgggctggcccaagtgtcccctcctcggggactgcagaagccacgctggctctctgtggtcctaggagcaatcacggcatcacacaccttgctctgcttgtgcttacacaggctgcctgccrctctatgagagcctgcaggcacactccaggtaccaaaacatgctgtcagcaggtctcagtgcccactacacatgcacagccccttgcaagggtgaaatggaaccaaaacggacacaaaatcttaactgggaccagccacagaagaagccactacattggcactggctcatcactcccctccctcccctccgctggtgtcctcctggctctcatcaaggggtatgtctgtctgtctgtcgggggcatttttggagcactaactaggatcctgtttggagcctctcatccctgtggtaactg

SEQ ID NO: 184018 - DNA, 601 bp, Human
aaaagttaggctgggcgcagtggctcatgcctgtaatcccagcactttgggaggctgaggtgggtggatcacctgaggtcaggagttcaagaccagcctgaccaatatggtaaaaccccatctctacaaaaaatacaaaaattagctgggtgtggtggtgggcactgtagtcccagttactcgggaggctgagacagaattcttgaacccaggaggcagaggctgcaatgagccgagatcgtgccattgcactccaccctgggtgacaaaacgagactccgtcttttttttttttttttttgagaccaaatctcactttgtcgccaggctggagtccaatggcatgatttcaactcactgcaacctccgactgcctggttcaagcgattctcctgcctcagctttccaagtagctgggattataggcacgcaccaccacgcccagctgatttttgtatttttagtagagccggggtttcactgtgttggccaggatggtctagaactcctgaccttgtgacccacctgcctcagcctcccaaagtgttgggattacaggtgtgagccaccacgcccagccaagactctgtctttaaaacaa

SEQ ID NO: 184019 - DNA, 601 bp, Human
cttatcccccataagagagggcatagggaagggtacttttaccagccaaagatctggtagctgcttaaaccaacccaacatgggtcttcaagcaatggtgacaagctcatcttagctgtaaccacaacagcacctgcaagaagttaacagtcactctccaagcccagggccctcaccaagatgtagagccacagatttctttcttgttttcttttgagacagggtctcactctgccacccaggatgaagtgcagaggcatgaccttagctcactgtagcctcaacctcccaggctcaagcmcctcaagtggctgagactacaggcgcacaccaccatgcccagctaatttttgcatttttttgtagagaaggggtttcgccaagtggcccaggctggtctcgaatttctgggctgaagcaacccacttgccttggcctcccaaagtgcttggattacaagtgtgagccactgcatcggccagggccacagatttctagacagtgttccatatttgaagcctctatctcttgaccttttgtctagtatgcaattaaagaatagttgaggggcagtcagtttcacattatggatgtattccag

SEQ ID NO: 184020 - DNA, 601 bp, Human
ggtcaggagatcgagaccatcctggctaacatggtgaaaccccgtctctactaaaaatacaaaaaaaattagccgggcgtggtggcaggtgcctgtagtcccagtactcgggaggctgaggcaggagaatggcatgaactcgggaggcagagcttgcagtgagccgagatcgtgccactgcactccagcctgggcaacagaaagagactccgcctcaaaaaaaaaaggtggtgcatctttaagtctatagccatgcatgccctctgggttgctggatggggattccagcattcctgtgagyggccccgctgtcctctggtaggtactgtgggagagcctgactttccaacacatcaactccatgcagtgttgcaccattctggtgggtttcaccacaagctgttaaatggtgagctaccttcttgagccctgttttcccttctttggtgtcaggaaatatagtcttcaccatgtttccagaggacagatataatgccaccagtatttttgtatttgcacccacagcccaaggcctggcacagaataactacccacaatccccagcttgccagagccattctcaatctttcctctaaaactt

SEQ ID NO: 184021 - DNA, 601 bp, Human
accccagcctccatctcccgggttcaagtgattcttctgcctcagcctctggagtagctaggattacaggcatgcgccaccacgcccagctaattttgtatttttagtagagacagggtttctccatattggtcaggctggtctcgaactcctgacctcaggtgatccgcctgcctcaggatcccaaagtgctggaattacaggtgtgagccaccacgcccggccaccagccttcacttctaaccccacctccagccagaccaaaccaccatttccacaccccacaggtctttctgtgcakaccctgtccatgcatgctccagacagctcttctgtcatttcaccaggtccaaacaccagcaccaaggctcccatgaaatatcccctttattccatctcaaatccttacctatcaactccttgcccagagaacctggaataacatatttacttctagtccttttcaatgcattttccccttgggagaggtgagggggtggtgtgtgtgtgtgtgtgtgtgtgtgtgtgtgcgcgttgtgtgtgtgtgtgtgtgtgtgtaatcatagtattcctgcttaatccatgttataacaattttccc

SEQ ID NO: 184022 - DNA, 601 bp, Human
ctctgttgcccaggctggagtacagtggtacgatctcagctcgctataacctccgcctcctggggtcaagcaattctcctgcctcagcctcccgagtagctgggattacaggcgtgtaccaccacatctggctaattttttgtatttttagtagagacaaggtttcaccatgttggccaggctggtctcgaactcctgacctcaggagatccacccacctcagatttccagagcccagagtgttgggattacaggcgtgagccaccacgcctggccttcacttttttttttttttttttttaagacagagtttcactcttgttgcccaggctggcacgatcttggctcaccccagcctccatctcccgggttcaagtgattcttctgcctcagcctctggagtagctaggattacaggcatgcgccaccacgcccagctaattttgtatttttagtagagacagggtttctccatattggtcaggctggtctcgaactcctgacctcaggtgatccgcctgcctcaggatcccaaagtgctggaattacaggtgtgagccaccacgcccggccaccagccttcacttctaaccccacctcc

SEQ ID NO: 184023 - DNA, 601 bp, Human; identical to SEQ ID NO: 183918

SEQ ID NO: 184024 - DNA, 601 bp, Human; identical to SEQ ID NO: 183919

SEQ ID NO: 184025 - DNA, 601 bp, Human; identical to SEQ ID NO: 183920

SEQ ID NO: 184026 - DNA, 601 bp, Human; identical to SEQ ID NO: 183921

SEQ ID NO: 184027 - DNA, 601 bp, Human; identical to SEQ ID NO: 183922

SEQ ID NO: 184028 - DNA, 601 bp, Human; identical to SEQ ID NO: 183923

SEQ ID NO: 184029 - DNA, 601 bp, Human; identical to SEQ ID NO: 183924

SEQ ID NO: 184030 - DNA, 601 bp, Human; identical to SEQ ID NO: 183925

SEQ ID NO: 184031 - DNA, 601 bp, Human; identical to SEQ ID NO: 183926

SEQ ID NO: 184032 - DNA, 601 bp, Human; identical to SEQ ID NO: 183927

SEQ ID NO: 184033 - DNA, 601 bp, Human; identical to SEQ ID NO: 183928

SEQ ID NO: 184034 - DNA, 601 bp, Human; identical to SEQ ID NO: 183929

SEQ ID NO: 184035 - DNA, 601 bp, Human; identical to SEQ ID NO: 183930

SEQ ID NO: 184036 - DNA, 601 bp, Human; identical to SEQ ID NO: 183931

SEQ ID NO: 184037 - DNA, 601 bp, Human; identical to SEQ ID NO: 183932

SEQ ID NO: 184038 - DNA, 601 bp, Human; identical to SEQ ID NO: 183933

SEQ ID NO: 184039 - DNA, 601 bp, Human; identical to SEQ ID NO: 183934

SEQ ID NO: 184040 - DNA, 601 bp, Human; identical to SEQ ID NO: 183935

SEQ ID NO: 184041 - DNA, 601 bp, Human; identical to SEQ ID NO: 183936

SEQ ID NO: 184042 - DNA, 601 bp, Human; identical to SEQ ID NO: 183937

SEQ ID NO: 184043 - DNA, 601 bp, Human; identical to SEQ ID NO: 183938

SEQ ID NO: 184044 - DNA, 601 bp, Human; identical to SEQ ID NO: 183939

SEQ ID NO: 184045 - DNA, 601 bp, Human; identical to SEQ ID NO: 183940

SEQ ID NO: 184046 - DNA, 601 bp, Human; identical to SEQ ID NO: 183941

SEQ ID NO: 184047 - DNA, 601 bp, Human; identical to SEQ ID NO: 183942

SEQ ID NO: 184048 - DNA, 601 bp, Human; identical to SEQ ID NO: 183943

SEQ ID NO: 184049 - DNA, 601 bp, Human; identical to SEQ ID NO: 183944

SEQ ID NO: 184050 - DNA, 601 bp, Human; identical to SEQ ID NO: 183945

SEQ ID NO: 184051 - DNA, 601 bp, Human; identical to SEQ ID NO: 183946

SEQ ID NO: 184052 - DNA, 601 bp, Human; identical to SEQ ID NO: 183947

SEQ ID NO: 184053 - DNA, 601 bp, Human; identical to SEQ ID NO: 183948

SEQ ID NO: 184054 - DNA, 601 bp, Human; identical to SEQ ID NO: 183949

SEQ ID NO: 184055 - DNA, 601 bp, Human; identical to SEQ ID NO: 183950

SEQ ID NO: 184056 - DNA, 601 bp, Human; identical to SEQ ID NO: 183951

SEQ ID NO: 184057 - DNA, 601 bp, Human; identical to SEQ ID NO: 183952

SEQ ID NO: 184058 - DNA, 601 bp, Human; identical to SEQ ID NO: 183953

SEQ ID NO: 184059 - DNA, 601 bp, Human; identical to SEQ ID NO: 183954

SEQ ID NO: 184060 - DNA, 601 bp, Human; identical to SEQ ID NO: 183955

SEQ ID NO: 184061 - DNA, 601 bp, Human; identical to SEQ ID NO: 183956

SEQ ID NO: 184062 - DNA, 601 bp, Human; identical to SEQ ID NO: 183957

SEQ ID NO: 184063 - DNA, 601 bp, Human; identical to SEQ ID NO: 183958

SEQ ID NO: 184064 - DNA, 601 bp, Human; identical to SEQ ID NO: 183959

SEQ ID NO: 184065 - DNA, 601 bp, Human; identical to SEQ ID NO: 183960

SEQ ID NO: 184066 - DNA, 601 bp, Human; identical to SEQ ID NO: 183961

SEQ ID NO: 184067 - DNA, 601 bp, Human; identical to SEQ ID NO: 183962

SEQ ID NO: 184068 - DNA, 601 bp, Human; identical to SEQ ID NO: 183963

SEQ ID NO: 184069 - DNA, 601 bp, Human; identical to SEQ ID NO: 183964

SEQ ID NO: 184070 - DNA, 601 bp, Human; identical to SEQ ID NO: 183965

SEQ ID NO: 184071 - DNA, 601 bp, Human; identical to SEQ ID NO: 183966

SEQ ID NO: 184072 - DNA, 601 bp, Human; identical to SEQ ID NO: 183967

SEQ ID NO: 184073 - DNA, 601 bp, Human; identical to SEQ ID NO: 183968

SEQ ID NO: 184074 - DNA, 601 bp, Human; identical to SEQ ID NO: 183969

SEQ ID NO: 184075 - DNA, 601 bp, Human; identical to SEQ ID NO: 183970

SEQ ID NO: 184076 - DNA, 601 bp, Human; identical to SEQ ID NO: 183971

SEQ ID NO: 184077 - DNA, 601 bp, Human; identical to SEQ ID NO: 183972

SEQ ID NO: 184078 - DNA, 601 bp, Human; identical to SEQ ID NO: 183973

SEQ ID NO: 184079 - DNA, 601 bp, Human; identical to SEQ ID NO: 183974

SEQ ID NO: 184080 - DNA, 601 bp, Human; identical to SEQ ID NO: 183975

SEQ ID NO: 184081 - DNA, 601 bp, Human; identical to SEQ ID NO: 183976

SEQ ID NO: 184082 - DNA, 601 bp, Human; identical to SEQ ID NO: 183977

SEQ ID NO: 184083 - DNA, 601 bp, Human; identical to SEQ ID NO: 183978

SEQ ID NO: 184084 - DNA, 601 bp, Human; identical to SEQ ID NO: 183979

SEQ ID NO: 184085 - DNA, 601 bp, Human; identical to SEQ ID NO: 183980

SEQ ID NO: 184086 - DNA, 601 bp, Human; identical to SEQ ID NO: 183981

SEQ ID NO: 184087 - DNA, 601 bp, Human; identical to SEQ ID NO: 183982

SEQ ID NO: 184088 - DNA, 601 bp, Human; identical to SEQ ID NO: 183983

SEQ ID NO: 184089 - DNA, 601 bp, Human; identical to SEQ ID NO: 183984

SEQ ID NO: 184090 - DNA, 601 bp, Human; identical to SEQ ID NO: 183985

SEQ ID NO: 184091 - DNA, 601 bp, Human; identical to SEQ ID NO: 183986

SEQ ID NO: 184092 - DNA, 601 bp, Human; identical to SEQ ID NO: 183987

SEQ ID NO: 184093 - DNA, 601 bp, Human; identical to SEQ ID NO: 183988

SEQ ID NO: 184094 - DNA, 601 bp, Human; identical to SEQ ID NO: 183989

SEQ ID NO: 184095 - DNA, 601 bp, Human; identical to SEQ ID NO: 183990

SEQ ID NO: 184096 - DNA, 601 bp, Human; identical to SEQ ID NO: 183991

SEQ ID NO: 184097 - DNA, 601 bp, Human; identical to SEQ ID NO: 183992

SEQ ID NO: 184098 - DNA, 601 bp, Human; identical to SEQ ID NO: 183993

SEQ ID NO: 184099 - DNA, 601 bp, Human; identical to SEQ ID NO: 183994

SEQ ID NO: 184100 - DNA, 601 bp, Human; identical to SEQ ID NO: 183995

SEQ ID NO: 184101 - DNA, 601 bp, Human; identical to SEQ ID NO: 183996

SEQ ID NO: 184102 - DNA, 601 bp, Human; identical to SEQ ID NO: 183997

SEQ ID NO: 184103 - DNA, 601 bp, Human; identical to SEQ ID NO: 183998

SEQ ID NO: 184104 - DNA, 601 bp, Human; identical to SEQ ID NO: 183999

SEQ ID NO: 184105 - DNA, 601 bp, Human; identical to SEQ ID NO: 184000

SEQ ID NO: 184106 - DNA, 601 bp, Human; identical to SEQ ID NO: 184001

SEQ ID NO: 184107 - DNA, 601 bp, Human; identical to SEQ ID NO: 184002

SEQ ID NO: 184108 - DNA, 601 bp, Human; identical to SEQ ID NO: 184003

SEQ ID NO: 184109 - DNA, 601 bp, Human; identical to SEQ ID NO: 184004

SEQ ID NO: 184110 - DNA, 601 bp, Human; identical to SEQ ID NO: 184005

SEQ ID NO: 184111 - DNA, 601 bp, Human; identical to SEQ ID NO: 184006

SEQ ID NO: 184112 - DNA, 601 bp, Human; identical to SEQ ID NO: 184007

SEQ ID NO: 184113 - DNA, 601 bp, Human; identical to SEQ ID NO: 184008

SEQ ID NO: 184114 - DNA, 601 bp, Human; identical to SEQ ID NO: 184009

SEQ ID NO: 184115 - DNA, 601 bp, Human; identical to SEQ ID NO: 184010

SEQ ID NO: 184116 - DNA, 601 bp, Human; identical to SEQ ID NO: 184011

SEQ ID NO: 184117 - DNA, 601 bp, Human; identical to SEQ ID NO: 184012

SEQ ID NO: 184118 - DNA, 601 bp, Human; identical to SEQ ID NO: 184013

SEQ ID NO: 184119 - DNA, 601 bp, Human; identical to SEQ ID NO: 184014

SEQ ID NO: 184120 - DNA, 601 bp, Human; identical to SEQ ID NO: 184015

SEQ ID NO: 184121 - DNA, 601 bp, Human; identical to SEQ ID NO: 184016

SEQ ID NO: 184122 - DNA, 601 bp, Human; identical to SEQ ID NO: 184017

SEQ ID NO: 184123 - DNA, 601 bp, Human; identical to SEQ ID NO: 184018

SEQ ID NO: 184124 - DNA, 601 bp, Human; identical to SEQ ID NO: 184019

SEQ ID NO: 184125 - DNA, 601 bp, Human; identical to SEQ ID NO: 184020

SEQ ID NO: 184126 - DNA, 601 bp, Human; identical to SEQ ID NO: 184021

SEQ ID NO: 184127 - DNA, 601 bp, Human; identical to SEQ ID NO: 184022

SEQ ID NO: 184128 - DNA, 601 bp, Human; identical to SEQ ID NO: 183918

SEQ ID NO: 184129 - DNA, 601 bp, Human; identical to SEQ ID NO: 183919

SEQ ID NO: 184130 - DNA, 601 bp, Human; identical to SEQ ID NO: 183920

SEQ ID NO: 184131 - DNA, 601 bp, Human; identical to SEQ ID NO: 183921

SEQ ID NO: 184132 - DNA, 601 bp, Human; identical to SEQ ID NO: 183922

SEQ ID NO: 184133 - DNA, 601 bp, Human; identical to SEQ ID NO: 183923

SEQ ID NO: 184134 - DNA, 601 bp, Human; identical to SEQ ID NO: 183924

SEQ ID NO: 184135 - DNA, 601 bp, Human; identical to SEQ ID NO: 183925

SEQ ID NO: 184136 - DNA, 601 bp, Human; identical to SEQ ID NO: 183926

SEQ ID NO: 184137 - DNA, 601 bp, Human; identical to SEQ ID NO: 183927

SEQ ID NO: 184138 - DNA, 601 bp, Human; identical to SEQ ID NO: 183928

SEQ ID NO: 184139 - DNA, 601 bp, Human; identical to SEQ ID NO: 183929

SEQ ID NO: 184140 - DNA, 601 bp, Human; identical to SEQ ID NO: 183930

SEQ ID NO: 184141 - DNA, 601 bp, Human; identical to SEQ ID NO: 183931

SEQ ID NO: 184142 - DNA, 601 bp, Human; identical to SEQ ID NO: 183932

SEQ ID NO: 184143 - DNA, 601 bp, Human; identical to SEQ ID NO: 183933

SEQ ID NO: 184144 - DNA, 601 bp, Human; identical to SEQ ID NO: 183934

SEQ ID NO: 184145 - DNA, 601 bp, Human; identical to SEQ ID NO: 183935

SEQ ID NO: 184146 - DNA, 601 bp, Human; identical to SEQ ID NO: 183936

SEQ ID NO: 184147 - DNA, 601 bp, Human; identical to SEQ ID NO: 183937

SEQ ID NO: 184148 - DNA, 601 bp, Human; identical to SEQ ID NO: 183938

SEQ ID NO: 184149 - DNA, 601 bp, Human; identical to SEQ ID NO: 183939

SEQ ID NO: 184150 - DNA, 601 bp, Human; identical to SEQ ID NO: 183940

SEQ ID NO: 184151 - DNA, 601 bp, Human; identical to SEQ ID NO: 183941

SEQ ID NO: 184152 - DNA, 601 bp, Human; identical to SEQ ID NO: 183942

SEQ ID NO: 184153 - DNA, 601 bp, Human; identical to SEQ ID NO: 183943

SEQ ID NO: 184154 - DNA, 601 bp, Human; identical to SEQ ID NO: 183944

SEQ ID NO: 184155 - DNA, 601 bp, Human; identical to SEQ ID NO: 183945

SEQ ID NO: 184156 - DNA, 601 bp, Human; identical to SEQ ID NO: 183946

SEQ ID NO: 184157 - DNA, 601 bp, Human; identical to SEQ ID NO: 183947

SEQ ID NO: 184158 - DNA, 601 bp, Human; identical to SEQ ID NO: 183948

SEQ ID NO: 184159 - DNA, 601 bp, Human; identical to SEQ ID NO: 183949

SEQ ID NO: 184160 - DNA, 601 bp, Human; identical to SEQ ID NO: 183950

SEQ ID NO: 184161 - DNA, 601 bp, Human; identical to SEQ ID NO: 183951

SEQ ID NO: 184162 - DNA, 601 bp, Human; identical to SEQ ID NO: 183952

SEQ ID NO: 184163 - DNA, 601 bp, Human; identical to SEQ ID NO: 183953

SEQ ID NO: 184164 - DNA, 601 bp, Human; identical to SEQ ID NO: 183954

SEQ ID NO: 184165 - DNA, 601 bp, Human; identical to SEQ ID NO: 183955

SEQ ID NO: 184166 - DNA, 601 bp, Human; identical to SEQ ID NO: 183956

SEQ ID NO: 184167 - DNA, 601 bp, Human; identical to SEQ ID NO: 183957

SEQ ID NO: 184168 - DNA, 601 bp, Human; identical to SEQ ID NO: 183958

SEQ ID NO: 184169 - DNA, 601 bp, Human; identical to SEQ ID NO: 183959

SEQ ID NO: 184170 - DNA, 601 bp, Human; identical to SEQ ID NO: 183960

SEQ ID NO: 184171 - DNA, 601 bp, Human; identical to SEQ ID NO: 183961

SEQ ID NO: 184172 - DNA, 601 bp, Human; identical to SEQ ID NO: 183962

SEQ ID NO: 184173 - DNA, 601 bp, Human; identical to SEQ ID NO: 183963

SEQ ID NO: 184174 - DNA, 601 bp, Human; identical to SEQ ID NO: 183964

SEQ ID NO: 184175 - DNA, 601 bp, Human; identical to SEQ ID NO: 183965

SEQ ID NO: 184176 - DNA, 601 bp, Human; identical to SEQ ID NO: 183966

SEQ ID NO: 184177 - DNA, 601 bp, Human; identical to SEQ ID NO: 183967

SEQ ID NO: 184178 - DNA, 601 bp, Human; identical to SEQ ID NO: 183968

SEQ ID NO: 184179 - DNA, 601 bp, Human; identical to SEQ ID NO: 183969

SEQ ID NO: 184180 - DNA, 601 bp, Human; identical to SEQ ID NO: 183970

SEQ ID NO: 184181 - DNA, 601 bp, Human; identical to SEQ ID NO: 183971

SEQ ID NO: 184182 - DNA, 601 bp, Human; identical to SEQ ID NO: 183972

SEQ ID NO: 184183 - DNA, 601 bp, Human; identical to SEQ ID NO: 183973

SEQ ID NO: 184184 - DNA, 601 bp, Human; identical to SEQ ID NO: 183974

SEQ ID NO: 184185 - DNA, 601 bp, Human; identical to SEQ ID NO: 183975

SEQ ID NO: 184186 - DNA, 601 bp, Human; identical to SEQ ID NO: 183976

SEQ ID NO: 184187 - DNA, 601 bp, Human; identical to SEQ ID NO: 183977

SEQ ID NO: 184188 - DNA, 601 bp, Human; identical to SEQ ID NO: 183978

SEQ ID NO: 184189 - DNA, 601 bp, Human; identical to SEQ ID NO: 183979

SEQ ID NO: 184190 - DNA, 601 bp, Human; identical to SEQ ID NO: 183980

SEQ ID NO: 184191 - DNA, 601 bp, Human; identical to SEQ ID NO: 183981

SEQ ID NO: 184192 - DNA, 601 bp, Human; identical to SEQ ID NO: 183982

SEQ ID NO: 184193 - DNA, 601 bp, Human; identical to SEQ ID NO: 183983

SEQ ID NO: 184194 - DNA, 601 bp, Human; identical to SEQ ID NO: 183984

SEQ ID NO: 184195 - DNA, 601 bp, Human; identical to SEQ ID NO: 183985

SEQ ID NO: 184196 - DNA, 601 bp, Human; identical to SEQ ID NO: 183986

SEQ ID NO: 184197 - DNA, 601 bp, Human; identical to SEQ ID NO: 183987

SEQ ID NO: 184198 - DNA, 601 bp, Human; identical to SEQ ID NO: 183988

SEQ ID NO: 184199 - DNA, 601 bp, Human; identical to SEQ ID NO: 183989

SEQ ID NO: 184200 - DNA, 601 bp, Human; identical to SEQ ID NO: 183990

SEQ ID NO: 184201 - DNA, 601 bp, Human; identical to SEQ ID NO: 183991

SEQ ID NO: 184202 - DNA, 601 bp, Human; identical to SEQ ID NO: 183992

SEQ ID NO: 184203 - DNA, 601 bp, Human; identical to SEQ ID NO: 183993

SEQ ID NO: 184204 - DNA, 601 bp, Human; identical to SEQ ID NO: 183994

SEQ ID NO: 184205 - DNA, 601 bp, Human; identical to SEQ ID NO: 183995

SEQ ID NO: 184206 - DNA, 601 bp, Human; identical to SEQ ID NO: 183996

SEQ ID NO: 184207 - DNA, 601 bp, Human; identical to SEQ ID NO: 183997

SEQ ID NO: 184208 - DNA, 601 bp, Human; identical to SEQ ID NO: 183998

SEQ ID NO: 184209 - DNA, 601 bp, Human; identical to SEQ ID NO: 183999

SEQ ID NO: 184210 - DNA, 601 bp, Human; identical to SEQ ID NO: 184000

SEQ ID NO: 184211 - DNA, 601 bp, Human; identical to SEQ ID NO: 184001

SEQ ID NO: 184212 - DNA, 601 bp, Human; identical to SEQ ID NO: 184002

SEQ ID NO: 184213 - DNA, 601 bp, Human; identical to SEQ ID NO: 184003

SEQ ID NO: 184214 - DNA, 601 bp, Human; identical to SEQ ID NO: 184004

SEQ ID NO: 184215 - DNA, 601 bp, Human; identical to SEQ ID NO: 184005

SEQ ID NO: 184216 - DNA, 601 bp, Human; identical to SEQ ID NO: 184006

SEQ ID NO: 184217 - DNA, 601 bp, Human; identical to SEQ ID NO: 184007

SEQ ID NO: 184218 - DNA, 601 bp, Human; identical to SEQ ID NO: 184008

SEQ ID NO: 184219 - DNA, 601 bp, Human; identical to SEQ ID NO: 184009

SEQ ID NO: 184220 - DNA, 601 bp, Human; identical to SEQ ID NO: 184010

SEQ ID NO: 184221 - DNA, 601 bp, Human; identical to SEQ ID NO: 184011

SEQ ID NO: 184222 - DNA, 601 bp, Human; identical to SEQ ID NO: 184012

SEQ ID NO: 184223 - DNA, 601 bp, Human; identical to SEQ ID NO: 184013

SEQ ID NO: 184224 - DNA, 601 bp, Human; identical to SEQ ID NO: 184014

SEQ ID NO: 184225 - DNA, 601 bp, Human; identical to SEQ ID NO: 184015

SEQ ID NO: 184226 - DNA, 601 bp, Human; identical to SEQ ID NO: 184016

SEQ ID NO: 184227 - DNA, 601 bp, Human; identical to SEQ ID NO: 184017

SEQ ID NO: 184228 - DNA, 601 bp, Human; identical to SEQ ID NO: 184018

SEQ ID NO: 184229 - DNA, 601 bp, Human; identical to SEQ ID NO: 184019

SEQ ID NO: 184230 - DNA, 601 bp, Human; identical to SEQ ID NO: 184020

SEQ ID NO: 184231 - DNA, 601 bp, Human; identical to SEQ ID NO: 184021

SEQ ID NO: 184232 - DNA, 601 bp, Human; identical to SEQ ID NO: 184022

SEQ ID NO: 184233 - DNA, 601 bp, Human; identical to SEQ ID NO: 183918

SEQ ID NO: 184234 - DNA, 601 bp, Human; identical to SEQ ID NO: 183919

SEQ ID NO: 184235 - DNA, 601 bp, Human; identical to SEQ ID NO: 183920

SEQ ID NO: 184236 - DNA, 601 bp, Human; identical to SEQ ID NO: 183921

SEQ ID NO: 184237 - DNA, 601 bp, Human; identical to SEQ ID NO: 183922

SEQ ID NO: 184238 - DNA, 601 bp, Human; identical to SEQ ID NO: 183923

SEQ ID NO: 184239 - DNA, 601 bp, Human; identical to SEQ ID NO: 183924

SEQ ID NO: 184240 - DNA, 601 bp, Human; identical to SEQ ID NO: 183925

SEQ ID NO: 184241 - DNA, 601 bp, Human; identical to SEQ ID NO: 183926

SEQ ID NO: 184242 - DNA, 601 bp, Human; identical to SEQ ID NO: 183927

SEQ ID NO: 184243 - DNA, 601 bp, Human; identical to SEQ ID NO: 183928

SEQ ID NO: 184244 - DNA, 601 bp, Human; identical to SEQ ID NO: 183929

SEQ ID NO: 184245 - DNA, 601 bp, Human; identical to SEQ ID NO: 183930

SEQ ID NO: 184246 - DNA, 601 bp, Human; identical to SEQ ID NO: 183931

SEQ ID NO: 184247 - DNA, 601 bp, Human; identical to SEQ ID NO: 183932

SEQ ID NO: 184248 - DNA, 601 bp, Human; identical to SEQ ID NO: 183933

SEQ ID NO: 184249 - DNA, 601 bp, Human; identical to SEQ ID NO: 183934

SEQ ID NO: 184250 - DNA, 601 bp, Human; identical to SEQ ID NO: 183935

SEQ ID NO: 184251 - DNA, 601 bp, Human; identical to SEQ ID NO: 183936

SEQ ID NO: 184252 - DNA, 601 bp, Human; identical to SEQ ID NO: 183937

SEQ ID NO: 184253 - DNA, 601 bp, Human; identical to SEQ ID NO: 183938

SEQ ID NO: 184254 - DNA, 601 bp, Human; identical to SEQ ID NO: 183939

SEQ ID NO: 184255 - DNA, 601 bp, Human; identical to SEQ ID NO: 183940

SEQ ID NO: 184256 - DNA, 601 bp, Human; identical to SEQ ID NO: 183941

SEQ ID NO: 184257 - DNA, 601 bp, Human; identical to SEQ ID NO: 183942

SEQ ID NO: 184258 - DNA, 601 bp, Human; identical to SEQ ID NO: 183943

SEQ ID NO: 184259 - DNA, 601 bp, Human; identical to SEQ ID NO: 183944

SEQ ID NO: 184260 - DNA, 601 bp, Human; identical to SEQ ID NO: 183945

SEQ ID NO: 184261 - DNA, 601 bp, Human; identical to SEQ ID NO: 183946

SEQ ID NO: 184262 - DNA, 601 bp, Human; identical to SEQ ID NO: 183947

SEQ ID NO: 184263 - DNA, 601 bp, Human; identical to SEQ ID NO: 183948

SEQ ID NO: 184264 - DNA, 601 bp, Human; identical to SEQ ID NO: 183949

SEQ ID NO: 184265 - DNA, 601 bp, Human; identical to SEQ ID NO: 183950

SEQ ID NO: 184266 - DNA, 601 bp, Human; identical to SEQ ID NO: 183951

SEQ ID NO: 184267 - DNA, 601 bp, Human; identical to SEQ ID NO: 183952

SEQ ID NO: 184268 - DNA, 601 bp, Human; identical to SEQ ID NO: 183953

SEQ ID NO: 184269 - DNA, 601 bp, Human; identical to SEQ ID NO: 183954

SEQ ID NO: 184270 - DNA, 601 bp, Human; identical to SEQ ID NO: 183955

SEQ ID NO: 184271 - DNA, 601 bp, Human; identical to SEQ ID NO: 183956

SEQ ID NO: 184272 - DNA, 601 bp, Human; identical to SEQ ID NO: 183957

SEQ ID NO: 184273 - DNA, 601 bp, Human; identical to SEQ ID NO: 183958

SEQ ID NO: 184274 - DNA, 601 bp, Human; identical to SEQ ID NO: 183959

SEQ ID NO: 184275 - DNA, 601 bp, Human; identical to SEQ ID NO: 183960

SEQ ID NO: 184276 - DNA, 601 bp, Human; identical to SEQ ID NO: 183961

SEQ ID NO: 184277 - DNA, 601 bp, Human; identical to SEQ ID NO: 183962

SEQ ID NO: 184278 - DNA, 601 bp, Human; identical to SEQ ID NO: 183963

SEQ ID NO: 184279 - DNA, 601 bp, Human; identical to SEQ ID NO: 183964

SEQ ID NO: 184280 - DNA, 601 bp, Human; identical to SEQ ID NO: 183965

SEQ ID NO: 184281 - DNA, 601 bp, Human; identical to SEQ ID NO: 183966

SEQ ID NO: 184282 - DNA, 601 bp, Human; identical to SEQ ID NO: 183967

SEQ ID NO: 184283 - DNA, 601 bp, Human; identical to SEQ ID NO: 183968

SEQ ID NO: 184284 - DNA, 601 bp, Human; identical to SEQ ID NO: 183969

SEQ ID NO: 184285 - DNA, 601 bp, Human; identical to SEQ ID NO: 183970

SEQ ID NO: 184286 - DNA, 601 bp, Human; identical to SEQ ID NO: 183971

SEQ ID NO: 184287 - DNA, 601 bp, Human; identical to SEQ ID NO: 183972

SEQ ID NO: 184288 - DNA, 601 bp, Human; identical to SEQ ID NO: 183973

SEQ ID NO: 184289 - DNA, 601 bp, Human; identical to SEQ ID NO: 183974

SEQ ID NO: 184290 - DNA, 601 bp, Human; identical to SEQ ID NO: 183975

SEQ ID NO: 184291 - DNA, 601 bp, Human; identical to SEQ ID NO: 183976

SEQ ID NO: 184292 - DNA, 601 bp, Human; identical to SEQ ID NO: 183977

SEQ ID NO: 184293 - DNA, 601 bp, Human; identical to SEQ ID NO: 183978

SEQ ID NO: 184294 - DNA, 601 bp, Human; identical to SEQ ID NO: 183979

SEQ ID NO: 184295 - DNA, 601 bp, Human; identical to SEQ ID NO: 183980

SEQ ID NO: 184296 - DNA, 601 bp, Human; identical to SEQ ID NO: 183981

SEQ ID NO: 184297 - DNA, 601 bp, Human; identical to SEQ ID NO: 183982

SEQ ID NO: 184298 - DNA, 601 bp, Human; identical to SEQ ID NO: 183983

SEQ ID NO: 184299 - DNA, 601 bp, Human; identical to SEQ ID NO: 183984

SEQ ID NO: 184300 - DNA, 601 bp, Human; identical to SEQ ID NO: 183985

SEQ ID NO: 184301 - DNA, 601 bp, Human; identical to SEQ ID NO: 183986

SEQ ID NO: 184302 - DNA, 601 bp, Human; identical to SEQ ID NO: 183987

SEQ ID NO: 184303 - DNA, 601 bp, Human; identical to SEQ ID NO: 183988

SEQ ID NO: 184304 - DNA, 601 bp, Human; identical to SEQ ID NO: 183989

SEQ ID NO: 184305 - DNA, 601 bp, Human; identical to SEQ ID NO: 183990

SEQ ID NO: 184306 - DNA, 601 bp, Human; identical to SEQ ID NO: 183991

SEQ ID NO: 184307 - DNA, 601 bp, Human; identical to SEQ ID NO: 183992

SEQ ID NO: 184308 - DNA, 601 bp, Human; identical to SEQ ID NO: 183993

SEQ ID NO: 184309 - DNA, 601 bp, Human; identical to SEQ ID NO: 183994

SEQ ID NO: 184310 - DNA, 601 bp, Human; identical to SEQ ID NO: 183995

SEQ ID NO: 184311 - DNA, 601 bp, Human; identical to SEQ ID NO: 183996

SEQ ID NO: 184312 - DNA, 601 bp, Human; identical to SEQ ID NO: 183997

SEQ ID NO: 184313 - DNA, 601 bp, Human; identical to SEQ ID NO: 183998

SEQ ID NO: 184314 - DNA, 601 bp, Human; identical to SEQ ID NO: 183999

SEQ ID NO: 184315 - DNA, 601 bp, Human; identical to SEQ ID NO: 184000

SEQ ID NO: 184316 - DNA, 601 bp, Human; identical to SEQ ID NO: 184001

SEQ ID NO: 184317 - DNA, 601 bp, Human; identical to SEQ ID NO: 184002

SEQ ID NO: 184318 - DNA, 601 bp, Human; identical to SEQ ID NO: 184003

SEQ ID NO: 184319 - DNA, 601 bp, Human; identical to SEQ ID NO: 184004

SEQ ID NO: 184320 - DNA, 601 bp, Human; identical to SEQ ID NO: 184005

SEQ ID NO: 184321 - DNA, 601 bp, Human; identical to SEQ ID NO: 184006

SEQ ID NO: 184322 - DNA, 601 bp, Human; identical to SEQ ID NO: 184007

SEQ ID NO: 184323 - DNA, 601 bp, Human; identical to SEQ ID NO: 184008

SEQ ID NO: 184324 - DNA, 601 bp, Human; identical to SEQ ID NO: 184009

SEQ ID NO: 184325 - DNA, 601 bp, Human; identical to SEQ ID NO: 184010

SEQ ID NO: 184326 - DNA, 601 bp, Human; identical to SEQ ID NO: 184011

SEQ ID NO: 184327 - DNA, 601 bp, Human; identical to SEQ ID NO: 184012

SEQ ID NO: 184328 - DNA, 601 bp, Human; identical to SEQ ID NO: 184013

SEQ ID NO: 184329 - DNA, 601 bp, Human; identical to SEQ ID NO: 184014

SEQ ID NO: 184330 - DNA, 601 bp, Human; identical to SEQ ID NO: 184015

SEQ ID NO: 184331 - DNA, 601 bp, Human; identical to SEQ ID NO: 184016

SEQ ID NO: 184332 - DNA, 601 bp, Human; identical to SEQ ID NO: 184017

SEQ ID NO: 184333 - DNA, 601 bp, Human; identical to SEQ ID NO: 184018

SEQ ID NO: 184334 - DNA, 601 bp, Human; identical to SEQ ID NO: 184019

SEQ ID NO: 184335 - DNA, 601 bp, Human; identical to SEQ ID NO: 184020

SEQ ID NO: 184336 - DNA, 601 bp, Human; identical to SEQ ID NO: 184021

SEQ ID NO: 184337 - DNA, 601 bp, Human; identical to SEQ ID NO: 184022

SEQ ID NO: 184338 - DNA, 601 bp, Human; identical to SEQ ID NO: 31871

SEQ ID NO: 184339 - DNA, 601 bp, Human; identical to SEQ ID NO: 31872

SEQ ID NO: 184340 - DNA, 601 bp, Human; identical to SEQ ID NO: 31873

SEQ ID NO: 184341 - DNA, 601 bp, Human; identical to SEQ ID NO: 31874

SEQ ID NO: 184342 - DNA, 601 bp, Human; identical to SEQ ID NO: 31875

SEQ ID NO: 184343 - DNA, 601 bp, Human; identical to SEQ ID NO: 31876

SEQ ID NO: 184344 - DNA, 601 bp, Human; identical to SEQ ID NO: 31877

SEQ ID NO: 184345 - DNA, 601 bp, Human; identical to SEQ ID NO: 31878

SEQ ID NO: 184346 - DNA, 601 bp, Human; identical to SEQ ID NO: 31879

SEQ ID NO: 184347 - DNA, 601 bp, Human
aatggagagactgaactgagcctcagtggaggtttattgggccagagcttgagggcgtgccctggaaaatacaagtgacagaaacatctgtggcctgtgctcgatggagtggttccagaaggctggtgtttatatatttcattaaaaggggaaaaagcatgcaggaaaaagtgcagtaggcctcgtggcaggtagttacattcttgtgaggttttaattcgtgcccagtatatctacactattcagaaaataaagtaaacattcaaaagagggaataaaggaagaattaattaggcagacktctcagggtaggagaggaaggactatctcatcccatctttgtttggcatgtgggaggataagcttgtaatggacatggtcagtgtggcgtttaacagacatcagtaatagggaaggagttagactgaggttacagtcctaaagttacagttggcatgtccttgtttatgggaggatactcatcttcaaagatttaggggccagcaaaggagttccttaggagcaacttgtgagggcagtcatcccacaatggattgcatggggcctttggccttttgcaggtgtctggttaatgtagaat

SEQ ID NO: 184348 - DNA, 601 bp, Human
ttgtgagggcagtcatcccacaatggattgcatggggcctttggccttttgcaggtgtctggttaatgtagaatgctttgacacaaggttgggaagtaacagctgtctgttgatggggaggaggacagcagtgttgggaggtttccaggcttaactttcacttgagtttggccagtcatgagactttttaatttcctttatacctcgtgtattgttttaaggatttgaaataagatagtttcattggcagatacttagtatgtgcctgctgtctatcagagtttctcaacctcagcactgytgacatttggggcaggatcactctttgttgtggggggctgtcctgtgcattgtaggacatttagcacaatctgggctgtacccattaaatgccagcagtacctctcctgtgacaatgaaaagtgtctccaggctgagcatggtggctcacacctgtaattccaacactttgggaggccaaggtgggtggatcacttgaggttggaagttcgagactagcctggccaacatagagaaacaccgtctctattaaaaatacaaaaattagccaggcatggtggcaggcacctgtaatcccagc

SEQ ID NO: 184349 - DNA, 601 bp, Human
agatcacgccactgcactccatcctgggcgacagagcaacactctgtctcaaaaaaaaaagaaagaaagaacagtgtctccagacattaccaaatgtctctgggggattttgtccccaagttggtgaccattgctgtttgcaaagttctcttctggagctgggaatacagcactgaaagcttcagacagttcctacctttgtggagactatgttctagttgggggagacaaacgtgtaaaccaataaatgagaccccttcaagtgtgataatagccttattttcttcctagcacttatttstaccattgtctgagaggtatttcagaggatcgttttaaacagccccaggactagtactaggactaggacttagctctttctagttgactggaagcgtgacattcgaggtttggtgtgggacctcatcccctgaactttggttttctttgcagctatagaggaaatcaaagagaaaatgaagactgtaaaacacaaaatcttggtattgtctgggaaaggcggtgttgggaaaagcacattcagcgcccaccttgcccatggcctagcagaggatgaaaacacacaggtgagacctcagga

SEQ ID NO: 184350 - DNA, 601 bp, Human
agatgagtttgtagcctacccaaggtatagtactgggcagattcaaaatacacttgttgggcagggcatggtggcttacactgtaatcacagcactttgggaggctgaggcaggcggatcacttgaggtcaggagtttgagaccagcctggccaacatggtgaaaccctgtctccactaaaaaatacaaaaattagctgggcatggtggtacgtgcctgtagtcttagctactcgggaggccgaggcatgagaatcgtttgaacccaggaggcggaggtcgcggtgggccaagattgcccyactgcactccagcctgggtgacagacaagactccatttaaaaaaaaaaaaggatatagatagatacacagacacatacacacacacacacacacacacacacacacacacacacacacacgttgattcgtcattctgtgagtcagcgatctcttgccatttgagggtcaaatctgtactggcctagtgggctggccaagaaatctgctttctcagattgtctgtatcgtttagaagaatctttgcttttcgaagctgtcaggaatattcctaaacagctcactggagatgggctttcatc

SEQ ID NO: 184351 - DNA, 601 bp, Human
tacactgtaatcacagcactttgggaggctgaggcaggcggatcacttgaggtcaggagtttgagaccagcctggccaacatggtgaaaccctgtctccactaaaaaatacaaaaattagctgggcatggtggtacgtgcctgtagtcttagctactcgggaggccgaggcatgagaatcgtttgaacccaggaggcggaggtcgcggtgggccaagattgccctactgcactccagcctgggtgacagacaagactccatttaaaaaaaaaaaaggatatagatagatacacagacacayacacacacacacacacacacacacacacacacacacacacacacgttgattcgtcattctgtgagtcagcgatctcttgccatttgagggtcaaatctgtactggcctagtgggctggccaagaaatctgctttctcagattgtctgtatcgtttagaagaatctttgcttttcgaagctgtcaggaatattcctaaacagctcactggagatgggctttcatctcaccacttgcaagtaaccacttgtgagtagacaactgtttacatccttcactttcatgtaattacgttctgaagt

SEQ ID NO: 184352 - DNA, 601 bp, Human
cactgtaatcacagcactttgggaggctgaggcaggcggatcacttgaggtcaggagtttgagaccagcctggccaacatggtgaaaccctgtctccactaaaaaatacaaaaattagctgggcatggtggtacgtgcctgtagtcttagctactcgggaggccgaggcatgagaatcgtttgaacccaggaggcggaggtcgcggtgggccaagattgccctactgcactccagcctgggtgacagacaagactccatttaaaaaaaaaaaaggatatagatagatacacagacacatasacacacacacacacacacacacacacacacacacacacacacgttgattcgtcattctgtgagtcagcgatctcttgccatttgagggtcaaatctgtactggcctagtgggctggccaagaaatctgctttctcagattgtctgtatcgtttagaagaatctttgcttttcgaagctgtcaggaatattcctaaacagctcactggagatgggctttcatctcaccacttgcaagtaaccacttgtgagtagacaactgtttacatccttcactttcatgtaattacgttctgaagtct

SEQ ID NO: 184353 - DNA, 601 bp, Human
ccataaattaaacatttatgatctttgtgatctgaaaggcaaactgtcataacaaggtcagcactaggtgtttcaggactgagtgtgcgaggccctcctctgggtcctgggactgcagagctgagaggggccttgatgaccccggagcagttgtctcacagatcagaagcccagacagccaaggcttcgaaagcagaagcaacttgtgcaaggactaaaagttaggactaaatccctcttcccctaccctcctcatcaggggcagtttggggtgctgagtaaaggagacgctttgggtccygacagccttgcagcatctccaccttctgcagcaaacgcggcctcttcccatcagctgcaaacacaggcccagaggtcctgctgggaggaacgcaggcgcattgctctcagctttgcttttctggcctaacctaagcaaaattaaatggacagattttggggtagtaataagatcaacaggaagtctgaacagacaggacccagggccgtcctggccatctgggtagcaggagcttgtcaacagcctctcgggcctgccacgggagtgagagagtgcgctggatctgcttctcatatcctt

SEQ ID NO: 184354 - DNA, 601 bp, Human
tttccatcttactttaagtttctgttctgtaagtttagcctaaaccatcattcaccttcaggatcaaaggaaaacagggcttggtcagggttcagctagaggctccactctggtcctccacagcaggcccgtggtgtactggaaagagccccagttggggccgaaagacctcagtttatgtcccagctctgttccctgcttattgaactggtcccctctgaacctcagtttcctcctctgtaaaccagagataatgatacttaccttctaggcacatggccgcctcagcctcccaaagtgytgggattacaggcgtgagccactgcacccagcccccaatattttttaatacattcatattctgcttaaatagtctagatttggcttgtatctgagactcctgaacaagataggatgagtttgagaaaaatttaagatgcagagaccaaggcttggtgaggggtgagcaaaagagagctgtttagggtggctccaacactgccgtctcttggctgttccatccattctgtcacacaagccaaacaggcgctaggtccctttccccgtctcctccaaccagggctcagtaaacaaggtctga

SEQ ID NO: 184355 - DNA, 601 bp, Human
tgagacaaggtctcactcttgtcgcccgggctggagtgcagtggtgcaacctcagctcactgcaacctccacctcctgggttcaagcgattcttgtgctcagcctcctgagtagctgggactacagtggtgtgccatcatgcccaactaatttttgtatttttggtagagaccaggtttcactacgttggccaagctgggctccacctcctgacctctagtgatcacctgcctcagcctcccaaagtgctaggattacaggcgtgagccaccgcacctggcctgtaaatgtttatgtggasatgaggagctcatacatgctcagtagtccatctgtctacttttaacaacaactgtgagtcttggcgggggaggggcgggattgtatatgaagtctgtctacaccattggagaagcattggtttcgatgcctcctcagaggggaagggaaacagccagtgaaatgcagaagtaagacacggaaatttagctctgactgggaacattagaccagggcttgctatgggtctgtaccctggaagcaagggaatatttctgcccttgtggtctcccctggggaactgagactgcagggcgggtga

SEQ ID NO: 184356 - DNA, 601 bp, Human
agggtgcagtggctcacacctgtgatcccagcactttaggaggccaagccaggcagatcacttgaggccaggagttcgagaccagcctggccaacatggcgaaatcccatctctactaaagatacaaaaattagccgagcatggtggcacgcgcctgtaacactggctactcgggaggctgaggcaggagaattgcttgaacccgggaggcagaggctgcagcaagctgagattgcaccatgcactccagcctgggcaacagagccagacttcatctcaaaaaaatgaaaaataaaaaaataaaagagttaaggagatgacatttacttattttagctgagttccctgtcattgccgtcactgcagcccatggacatacagtgcctctttcaaatcccccaacatggtacccttttttttttttccaaaaatgatttaggagcaaagagtgaatatgctcataggtcacatggtagttttgtcctgaaaatgtttttttcagtcagagctcaaacagaagacctgggggagggcctcactgtgtggttttgagtaaagcgtgtcttgccctcaccctgttccctctgcagtacgtggaaga

SEQ ID NO: 184357 - DNA, 601 bp, Human
gacctgggggagggcctcactgtgtggttttgagtaaagcgtgtcttgccctcaccctgttccctctgcagtacgtggaagacaacctgggggtgatgtcagtgggcttcctgctcagcagtcctgatgatgctgttatctggaggggacccaagaaaaacggtttgccactctgcctttttttgtctctcacattcttccacgagcgttgtggctcttggctttatctgctccctgtcctgccagtctcagcctgctggacttcacagtatattatttttaaccatccagtgcctctttyttcactggttgaaaagagctaatagaaataccagtttccattacgtaattataaatatctgctgtgagtttttctctccttaaaagctgtagaaccctggtcgggtgtggtagctcacgcctgtaatcccagcactttgggaggccgaggcaggtggatcacctgaggtcaggagttcaagaccagcctcgccgacatggtgaaaccctgtctctaccaaaaacataaaaaattagccgagcatggtggcacgtacctgtaatcccagctactcgagaggctgaggcaggagaacccagg

SEQ ID NO: 184358 - DNA, 601 bp, Human
aggcaggagaacccaggaggcggaggttgcagtgagccaagatcatgccactgcactccagcctgtgtgacagagcgagactttttctcaaaaaaaaagctatagaaccctgaaattatttttatcatggttttatagtggcttatttgggtcagagaggtgagatcaacaggaggttgatctggtactgagacttaaggtaataatgtgaaagtgttatcagggcaagctttagcctcagcactattgatattttgagccagataagtctttgttggggggaggagtagaccgtgttctrcaccatagggtgttaaacagtgtccctggcctttacccacaagatgccagtagcaccccctactctatttgtgacaacccaaaatgtctccagacattgcaattcactcccagttgagagccactgacttacagcatagaccaaaggcacaaaaagatcagatcatgcttctccgtgagctgggcacagtggcacgcacttatagtcctagttacttgggaggctgaggtgggaggattgcttgagcctcagagttaagagccaacctgggcaacatagcaagaccccatcctttaaaaa

SEQ ID NO: 184359 - DNA, 601 bp, Human
gagagcgataggaagtttcctctctgtaagtcctgcagagagcaactgcaggcaggaccatggtgctatccatctcaggggcctgagaaactgagggctcttctccatctccacagttacgcctgacttctcttcatgacgttctcctccacacttaagaaagcccagcaaaggaggtttgatttgatctcactggccagaatcagtcaggacgacccatagtctcacctcatccagcactcactgagctctgactctgacatgccgggcaccagggcagtaaaaaggcctggctctcccyggtggcccctgtggctccctgaggaacacaggtgctggacacagggatgagggtacagccaatggagtggcaggcccagcggccatgggaagggtgtccgggtcagaaaatggtgcaagattcatgtccaccctggcatcctgcagagaggggacatggggacgcaaggaggagcaggacaccagctgggaccctggacaggagggaggatggcctggcccgggtgatggcagtggagagaaagtgtatttgtccttaggaatgttttctgtcccatttttaaaaagtggttggtgctgg

SEQ ID NO: 184360 - DNA, 601 bp, Human
ccttaggaatgttttctgtcccatttttaaaaagtggttggtgctgggcacactggctcatgtctgtaatcccagcactttgggaggccgaggcaggcagattacttgaggtcaggagttcgagaccagactggccaatatggcaaaaccctgtctctaccaaaaaaatacaaaaattagccaggcgtggtggtgggcacctgtaatcccagctacttgggaggctgaggtgggagaagtgcttgaatccaggagacagaggttgcagtgagccgagatcgcgccactgcactccagcctsggcgacagagcaagactctgtctcaaaaaaagaaagaaagaaatgagagactgagtcgcagcccattgactttctagctgagcgccccttcctccgcatcccagcctcagtgtcaagagccaaacaggcatctcaggaaaagaacaggcccaaagctgcgagcctttcgggctcacgtgagtggtgaagctccaggtgctaaggagtcactacacctgacagtgacaagccacagcaggacttgggtacagggatctgtgataacattaactgaggaaaatagggagctactgagcggtg

SEQ ID NO: 184361 - DNA, 601 bp, Human
ggacgggcatggctggttccggaggaactttatttataaaaccagccagattcagcccccaggctggggtttgccaagctctggtctagaaaacagtgcacacactggcttaatatagtatagtatagggacatggagcatgtagatgcgttaaaaggtcattttcagataggcacagtggctcacgcctctaaccctaacactctgggaggccgaggcaggaggatcacttcacaccagaagcttaagaccagtctgggcaacaaccatctctataaaaaattaaaaagttagccaggcrgagtagcacatgcctgtagtcccagctactctggaggctgaggcaggaggattgcctgagcccaggaggtcaaggctgcagtgagcaatgattatgccactgcactccagactgggcagcagtgagatcctgtctctaaaaaaaaaagtcattttcttttaggttgatttcttgctatttggctgtgtgggaagtaaatagcacctcgaacaaacagggcttagcactagtaggtactaaataaatatggatttggcagagggcatacattagttcattttcacactgctgtaaagaact

SEQ ID NO: 184362 - DNA, 601 bp, Human
atggggattacagttcgagctgagatttggatggggacacagagccaaaccctatcagggcagaaacctctaaggctttatgatcgcagatccactgcattgcagccatcccctcggttgcacagacattccctttctcgcactttgatgctggaatcactggtcttttcaccttcgtaggaggtgtcactccaggatgtccggaaagaaatcaacttctgccgcaaggtgaagctgcccatcatcggggtggtggagaacatgagtggcttcatctgtcctaagtgcaaggtgagggcgygtggggctgccaggcgagcaagatcttgctctcatggatgaggaaacgatcggaaggctgctctgcaaactatttctgctttccctgtcattttgggaagtggaatcacaattaaaatccctttctgctgactaaaggaaagttctttaggtgttaagggttccacattcaaactaagccttttttttttttttaagtttctttaaaatgtggtccatccttgtgattctgcaaaaaaattatgtttcctcccctttgaatttgccttgcagaaagaatctcagatattccctcccacaa

SEQ ID NO: 184363 - DNA, 601 bp, Human
aggtgtcactccaggatgtccggaaagaaatcaacttctgccgcaaggtgaagctgcccatcatcggggtggtggagaacatgagtggcttcatctgtcctaagtgcaaggtgagggcgcgtggggctgccaggcgagcaagatcttgctctcatggatgaggaaacgatcggaaggctgctctgcaaactatttctgctttccctgtcattttgggaagtggaatcacaattaaaatccctttctgctgactaaaggaaagttctttaggtgttaagggttccacattcaaactaagccttttttttttttttaagtttctttaaaatgtggtccatccttgtgattctgcaaaaaaattatgtttcctcccctttgaatttgccttgcagaaagaatctcagatattccctcccacaaccgggggcgcggagctcatgtgccaggacttggaggtccctctcctcggcagagtgcccctggatccgctcataggtgggtgaccccagtgtggggcggcacctcactcctcggtcagccccacaggcacgggtcgggcacaacagggggcggctacagagaggggcaatggaaggaggag

SEQ ID NO: 184364 - DNA, 601 bp, Human; identical to SEQ ID NO: 122129

SEQ ID NO: 184365 - DNA, 601 bp, Human; identical to SEQ ID NO: 122128

SEQ ID NO: 184366 - DNA, 601 bp, Human; identical to SEQ ID NO: 122127

SEQ ID NO: 184367 - DNA, 601 bp, Human; identical to SEQ ID NO: 122126

SEQ ID NO: 184368 - DNA, 601 bp, Human; identical to SEQ ID NO: 122125

SEQ ID NO: 184369 - DNA, 601 bp, Human; identical to SEQ ID NO: 122124

SEQ ID NO: 184370 - DNA, 601 bp, Human; identical to SEQ ID NO: 122123

SEQ ID NO: 184371 - DNA, 601 bp, Human; identical to SEQ ID NO: 122122

SEQ ID NO: 184372 - DNA, 601 bp, Human
atttcaaagcgggcagatgaatgtcttatttaggagtaggattgggttcactcaaatataagttttatttgaattgcaaaaggcggcaggttagatgcttgtatacattctcatgtattttttattttaaactctgctgtgccttggttacatctttgaccttcttaagaatgagtgaagacatttgtttcatttagcattggttgagcctcagatggaggttggatatttgattatgaaagatggaacgaaatgttagaatttcattttgaaggagaagaacaaccactttccatgatgmaaaagtttttaaaaagttcttgggtaaggattggatttgtgcctgaggaagaaagaaacgtgctgcgggtaagtccactgcttgtaagaagtgacagctgactggggaaagtgacagaacagtttgaaaagcaggcagaaggagaatgctcaacattttgaggcattgggctcaaagttctcctcccccgaatattggagcattgagtaaatgcttgtagtaatgtcctaacataaaggccaggtcttcaaataagggtgtagttgggattcctgcaaagggagcagaggcggccactgg

SEQ ID NO: 184373 - DNA, 601 bp, Human
tgcacgccaccactcctggctaattttttttttttgtatttttgtggagacagggtttcaccatgttggccaggctggtctcgaactcctgaccttaagtgatccgcctgcctcagcctcccaaagtgctgagattacagacgtgagccacggcgcctggcctgacttttaccttttaaaaagaacattgcagttgctgtatggagaatgggttgtaggcgtacaagaatggaagcagggctatcaggcaagagactatagcagtaaacgcccacttgctttttaaatttttgcgccaccrtttctggatgtgagatctttggcaaattgcttaatttctgtgagaatctgttacctcttccattagacgggaatggcaccacccttgctggtagttaatacctagtctataaccgcctgataatagtagctgttaatattagcctaggggtaatatacatctcttagggtgagctttatgagtagcgctgagttcagtgacatggtgcatgggtttgaggaatgggaaaggagggagagagaatccttaatgtttaatttgaacttttttgtattgtggtctgaaataatttcccttaag

SEQ ID NO: 184374 - DNA, 601 bp, Human
ctgacttttaccttttaaaaagaacattgcagttgctgtatggagaatgggttgtaggcgtacaagaatggaagcagggctatcaggcaagagactatagcagtaaacgcccacttgctttttaaatttttgcgccaccgtttctggatgtgagatctttggcaaattgcttaatttctgtgagaatctgttacctcttccattagacgggaatggcaccacccttgctggtagttaatacctagtctataaccgcctgataatagtagctgttaatattagcctaggggtaatatacatytcttagggtgagctttatgagtagcgctgagttcagtgacatggtgcatgggtttgaggaatgggaaaggagggagagagaatccttaatgtttaatttgaacttttttgtattgtggtctgaaataatttcccttaaggtcactgagctctagttcaggtggctggaatgctgttcctgttttcatgctgtgtagagaaattttggagtaggaaaattgggttaccagcaatcaatattggttccattttgtgaacgccccaggctttctctttatttttttgtgaaccagggagttgt

SEQ ID NO: 184375 - DNA, 601 bp, Human
taccttttaaaaagaacattgcagttgctgtatggagaatgggttgtaggcgtacaagaatggaagcagggctatcaggcaagagactatagcagtaaacgcccacttgctttttaaatttttgcgccaccgtttctggatgtgagatctttggcaaattgcttaatttctgtgagaatctgttacctcttccattagacgggaatggcaccacccttgctggtagttaatacctagtctataaccgcctgataatagtagctgttaatattagcctaggggtaatatacatctcttaggrtgagctttatgagtagcgctgagttcagtgacatggtgcatgggtttgaggaatgggaaaggagggagagagaatccttaatgtttaatttgaacttttttgtattgtggtctgaaataatttcccttaaggtcactgagctctagttcaggtggctggaatgctgttcctgttttcatgctgtgtagagaaattttggagtaggaaaattgggttaccagcaatcaatattggttccattttgtgaacgccccaggctttctctttatttttttgtgaaccagggagttgttagattgt

SEQ ID NO: 184376 - DNA, 601 bp, Human
aacgcccacttgctttttaaatttttgcgccaccgtttctggatgtgagatctttggcaaattgcttaatttctgtgagaatctgttacctcttccattagacgggaatggcaccacccttgctggtagttaatacctagtctataaccgcctgataatagtagctgttaatattagcctaggggtaatatacatctcttagggtgagctttatgagtagcgctgagttcagtgacatggtgcatgggtttgaggaatgggaaaggagggagagagaatccttaatgtttaatttgaactyttttgtattgtggtctgaaataatttcccttaaggtcactgagctctagttcaggtggctggaatgctgttcctgttttcatgctgtgtagagaaattttggagtaggaaaattgggttaccagcaatcaatattggttccattttgtgaacgccccaggctttctctttatttttttgtgaaccagggagttgttagattgtgatctattgactactaagttcccattagtgcttactctactgatcaggctctgcaaggcctgttttcctccagagctctcctttcagggtgtgtgtg

SEQ ID NO: 184377 - DNA, 601 bp, Human
taaggtcactgagctctagttcaggtggctggaatgctgttcctgttttcatgctgtgtagagaaattttggagtaggaaaattgggttaccagcaatcaatattggttccattttgtgaacgccccaggctttctctttatttttttgtgaaccagggagttgttagattgtgatctattgactactaagttcccattagtgcttactctactgatcaggctctgcaaggcctgttttcctccagagctctcctttcagggtgtgtgtgtgtgtgtgtgtgtgtgtgtgtgtgtgtgtgtataaaacaggaaaaacttatgaagaagcacatttttggttaagatgacaaaaggggcttgtcttgccccctacagtaatttaaatatagtcagttctggccattaagacatactaatgggaagagtagaatattgagatcttcccatagtaaaaggacagaaaagtatttttctgagagaaattaaaaaaaaaaaaagaatagacaaattcccagtccactatagaggtaaaagaatgctgggtggatattagaatcacagagtaaagttctaaaggattttaggcttcgtcttcctttt

SEQ ID NO: 184378 - DNA, 601 bp, Human
aggtcactgagctctagttcaggtggctggaatgctgttcctgttttcatgctgtgtagagaaattttggagtaggaaaattgggttaccagcaatcaatattggttccattttgtgaacgccccaggctttctctttatttttttgtgaaccagggagttgttagattgtgatctattgactactaagttcccattagtgcttactctactgatcaggctctgcaaggcctgttttcctccagagctctcctttcagggtgtgtgtgtgtgtgtgtgtgtgtgtgtgtgtgtgtgtgtaaaaaacaggaaaaacttatgaagaagcacatttttggttaagatgacaaaaggggcttgtcttgccccctacagtaatttaaatatagtcagttctggccattaagacatactaatgggaagagtagaatattgagatcttcccatagtaaaaggacagaaaagtatttttctgagagaaattaaaaaaaaaaaaagaatagacaaattcccagtccactatagaggtaaaagaatgctgggtggatattagaatcacagagtaaagttctaaaggattttaggcttcgtcttcctttttg

SEQ ID NO: 184379 - DNA, 601 bp, Human
aacaggaaaaacttatgaagaagcacatttttggttaagatgacaaaaggggcttgtcttgccccctacagtaatttaaatatagtcagttctggccattaagacatactaatgggaagagtagaatattgagatcttcccatagtaaaaggacagaaaagtatttttctgagagaaattaaaaaaaaaaaaagaatagacaaattcccagtccactatagaggtaaaagaatgctgggtggatattagaatcacagagtaaagttctaaaggattttaggcttcgtcttcctttttgctgattttttaaaaaccccttcaaatggcatttagtcttatcttaatcattaaggtcaaagaactcaaggaaggtggttccttgcaattctgtatctgaaatgtattcaaatgtgtgaatccatctaccaagaagaaatactacaaaattgaattgttcattttaaaaagccactgtgcactgttgttcttagtggtcataaatctctcaaaacaagactttgcatctttttatgatcaaagttaaagttttgctgtcagttcagccagtgacaggtttaatgtttttccttgttcctttttt

SEQ ID NO: 184380 - DNA, 601 bp, Human
aggaaaaacttatgaagaagcacatttttggttaagatgacaaaaggggcttgtcttgccccctacagtaatttaaatatagtcagttctggccattaagacatactaatgggaagagtagaatattgagatcttcccatagtaaaaggacagaaaagtatttttctgagagaaattaaaaaaaaaaaaagaatagacaaattcccagtccactatagaggtaaaagaatgctgggtggatattagaatcacagagtaaagttctaaaggattttaggcttcgtcttcctttttgcttatattttaaaaaccccttcaaatggcatttagtcttatcttaatcattaaggtcaaagaactcaaggaaggtggttccttgcaattctgtatctgaaatgtattcaaatgtgtgaatccatctaccaagaagaaatactacaaaattgaattgttcattttaaaaagccactgtgcactgttgttcttagtggtcataaatctctcaaaacaagactttgcatctttttatgatcaaagttaaagttttgctgtcagttcagccagtgacaggtttaatgtttttccttgttccttttttggg

SEQ ID NO: 184381 - DNA, 601 bp, Human
aaaacttatgaagaagcacatttttggttaagatgacaaaaggggcttgtcttgccccctacagtaatttaaatatagtcagttctggccattaagacatactaatgggaagagtagaatattgagatcttcccatagtaaaaggacagaaaagtatttttctgagagaaattaaaaaaaaaaaaagaatagacaaattcccagtccactatagaggtaaaagaatgctgggtggatattagaatcacagagtaaagttctaaaggattttaggcttcgtcttcctttttgcttattttttaaaaaccccttcaaatggcatttagtcttatcttaatcattaaggtcaaagaactcaaggaaggtggttccttgcaattctgtatctgaaatgtattcaaatgtgtgaatccatctaccaagaagaaatactacaaaattgaattgttcattttaaaaagccactgtgcactgttgttcttagtggtcataaatctctcaaaacaagactttgcatctttttatgatcaaagttaaagttttgctgtcagttcagccagtgacaggtttaatgtttttccttgttccttttttggggacc

SEQ ID NO: 184382 - DNA, 601 bp, Human
atggttcttgataattattgttatattttctaaaatataatattagttcatagtatcaccagtagtatatgaatttatcagttttatcataatctcatcagtgattttgatggtgtcctgttgtttcaatttttacttaattttttttatcgtttgaacattttttctgatttgttcactgtttctatattgctttatatgaatcatccatacatgtttttgtccattactattggcgtcttaatatttttccagtggtttttaatgagtaaattttattatatatacatgtattaatctyttgttctatttcatatgtctttcccaaagtattgttttagtttttatttttaaaattaattttttaactttctaattttcggttggcactttaaaaatgtgatattttctattgaaagttttttatttttcaactgcttttgctgctttagatttaagaaagaagtttttacatgattctgatgaattcagtgttttgtttgctgccatttaaattatttgatgtactaaaaagttctttgcagtttgtcctgagtcacttttaatggatagtatgtaatcatcaacagttgggggataa

SEQ ID NO: 184383 - DNA, 601 bp, Human
ttcagtcattatatataaattggggtttttttttgagtttccatactggttttattttatttttatttctttttggtgacaaatctacatattcatacattgaaagaagtgttaagaaggactaaatgtgttcctatgtctttatggcagaacaggtttactcaggagaggattatggtttatttcatgttgcattttctttctgaagttgaagtggaattacagacctgaaatagttatgttgttatctttaaatgatattacagatttgctaagactctcattgacttccagaagcattcacagtttctgaaatagttacattagttttgttcagttctccagatttgaaggcagagactcatttttgatgtgtgtgtgtcttctttggttcttagtttaacgctgggtgtgttaacagaattgattgttttgaactcgattgctttgcagatacagtggaaggtcttgatgcccaggttgtaaatggttacatgattcatgatcaggaaagcaaatcagaggttcagattccttaccctctgtcagaaaacaatcaagtgcagagtggaagagctttccatcacggaagattcatcat

SEQ ID NO: 184384 - DNA, 550 bp, Human
cagtttcaaatatataattactaaagaatcaatgcatttaaatttgacctttgtacaaataagattttataaattttaatgaatttttggggcatagtctagaacatatgtatattaaaataaactgtcagtcaaaagagtgttagatattcagtgcttttgttaagaatatcatatagagaattttcctttgacatggaactatgaagagttctcctttgactaaatgaaaattacataatttttatgtgacgggaatttagaggatatatttgtaactaaggcataagtccatttgtgyacattttggagtttgagtttgtggttacgatactttctattagaagtcaggatacaaaactgcaaggagaaatccctgtttcattctcactaaagacccagtctgttaggactggcttcttctcttgtttattaacttatatttaccagtaacctttaaaacactaattgaagaagttttaagcgtgagaaccctcatgtgactgacacagactaaagtattgacaaagcaagtgaagaagcaagtgga

SEQ ID NO: 184385 - DNA, 522 bp, Human
tcaatgcatttaaatttgacctttgtacaaataagattttataaattttaatgaatttttggggcatagtctagaacatatgtatattaaaataaactgtcagtcaaaagagtgttagatattcagtgcttttgttaagaatatcatatagagaattttcctttgacatggaactatgaagagttctcctttgactaaatgaaaattacataatttttatgtgacgggaatttagaggatatatttgtaactaaggcataagtccatttgtgcacattttggagtttgagtttgtggttaygatactttctattagaagtcaggatacaaaactgcaaggagaaatccctgtttcattctcactaaagacccagtctgttaggactggcttcttctcttgtttattaacttatatttaccagtaacctttaaaacactaattgaagaagttttaagcgtgagaaccctcatgtgactgacacagactaaagtattgacaaagcaagtgaagaagcaagtgga

SEQ ID NO: 184386 - DNA, 601 bp, Human
tctttagtgcaaagtttattgaaggtgttgtgttacagttattagaggaagatgatgttgtgatgggagttcagtacaaggataaagagactggagatatcaaggtgagaaataccaaatgtcacctcttcctaagagatgttgtttttcctgctttttcacttacccctttaaaaaagtaggcttaccggtttacatgttgagtatctcttatctgaaatgctagggatcagaagtgtttcagattttttatttttttcagatgtttgcattatacttaccagttgagcatctctaatcygaaaatctgaaatttgaaatgatctaatgagtattttgtttgtcacattactgctcaaaaagttttggatttcagatttttggattagagatactcagcctgtgttatttatcaaatgaactgagttctttctaagccatatgcaacaggatgggtttcagattgcaacacattgttctttagaggacttcagaatgctatgcaaaaaacattttaaacagaactaatgtgaatagtttttgaaacagtaatatacatcagcagagaagcagaggggaactagcaggggaaagaaggcaa

SEQ ID NO: 184387 - DNA, 601 bp, Human
agatattctggaactgaactatttaaactagcacttaaaaacagcaaaacaaactcccaaattaataaaaaaaagtttcgggccgggcacagtaggtcatgcctgtaatcccaccactttgggaggctgaggtgggcagatcacctgaggttgggagttcaagaccagcctgaccaacatggagaaaccccgtctctactaaaaatacaaaattagccgagtgtggtggtgcatgcctgtaatcccagctactcaggaggctgaggcagaagaatcgcttgaacgggaggcagaggttgtrgtgagccgagatcgtgccattgcactccagcctgggcaacaagagcgaaactccgtctcaaaaaaaaaaaaaagttttgatatgtttttgtcacataatagcatagtttttagaataattgtttttattggcatatatggtatttttaaaggtagtctctggacacgaatctgactctgaattctttatctcttatacctaaatatttttgtgcttggtttttgtagtaatgacagctaccatttcttgaatgcttactataaagtgtttagcaaacataatttcatttaatctatgtaa

SEQ ID NO: 184388 - DNA, 601 bp, Human
gtaagggatcttcaggatcatgttagttttgagttgaatataaaggcttcatgagatttagatagctttgtaaaaacattaataaaaattactttttcacaaatctaaagttttcatggtacagtttttaggatctttttttgagaatgggatgatataggaaagaaaagtaaaaaaaatttaagaattttgataaaattgaagggaaaccctcattgtcaattatgatatgattagagtaataggaaactatttttggtatgagtacattttgtttaaatattccgtttttttcaagttwttttttaaactaagtgaaaccactttagtaacaaattattaacagaaatgaagtgaaatgaagtgggcaaacttagattttaaataatgacattttcaacatgtacatggaaacatttcaataaattttcatttagttaagccacttttgaagctttcagatggggaaattatgaatatttatgaaaagggtcatccattacctgatatttttagcatttatttttcttttattgtaaatgtggtggtttttcttttttttttcttttttccaatccagaggttaattggagtagagtgc

SEQ ID NO: 184389 - DNA, 601 bp, Human
attgaagggaaaccctcattgtcaattatgatatgattagagtaataggaaactatttttggtatgagtacattttgtttaaatattccgtttttttcaagttattttttaaactaagtgaaaccactttagtaacaaattattaacagaaatgaagtgaaatgaagtgggcaaacttagattttaaataatgacattttcaacatgtacatggaaacatttcaataaattttcatttagttaagccacttttgaagctttcagatggggaaattatgaatatttatgaaaagggtcatcsattacctgatatttttagcatttatttttcttttattgtaaatgtggtggtttttcttttttttttcttttttccaatccagaggttaattggagtagagtgccctgaaattatggagagaaaccattggtaggtttatattaatattagttagattaccaagattctactccttaatatgaatggaataatttttaacagaggcttctgctcctctattcccagatcacactgggaattgtatgacagttcattttctatataagtagcacagaaatttaaagcttgtttggaagtatc

SEQ ID NO: 184390 - DNA, 601 bp, Human
ataggaaactatttttggtatgagtacattttgtttaaatattccgtttttttcaagttattttttaaactaagtgaaaccactttagtaacaaattattaacagaaatgaagtgaaatgaagtgggcaaacttagattttaaataatgacattttcaacatgtacatggaaacatttcaataaattttcatttagttaagccacttttgaagctttcagatggggaaattatgaatatttatgaaaagggtcatccattacctgatatttttagcatttatttttcttttattgtaaatrtggtggtttttcttttttttttcttttttccaatccagaggttaattggagtagagtgccctgaaattatggagagaaaccattggtaggtttatattaatattagttagattaccaagattctactccttaatatgaatggaataatttttaacagaggcttctgctcctctattcccagatcacactgggaattgtatgacagttcattttctatataagtagcacagaaatttaaagcttgtttggaagtatctcagagatgagctgatcaaaccatttcatttttatagatgaaga

SEQ ID NO: 184391 - DNA, 601 bp, Human
gaagtgggcaaacttagattttaaataatgacattttcaacatgtacatggaaacatttcaataaattttcatttagttaagccacttttgaagctttcagatggggaaattatgaatatttatgaaaagggtcatccattacctgatatttttagcatttatttttcttttattgtaaatgtggtggtttttcttttttttttcttttttccaatccagaggttaattggagtagagtgccctgaaattatggagagaaaccattggtaggtttatattaatattagttagattaccaarattctactccttaatatgaatggaataatttttaacagaggcttctgctcctctattcccagatcacactgggaattgtatgacagttcattttctatataagtagcacagaaatttaaagcttgtttggaagtatctcagagatgagctgatcaaaccatttcatttttatagatgaagaaattgaagctcagagaggtagggctggcctcgaattccttttctagtgtacataccctcctgctgtttgtgaattggtagtgtatttcatctgattattacaagaatatattgattata

SEQ ID NO: 184392 - DNA, 601 bp, Human
gggatggtctcgatctcctgacctcgtgatccgcccgcctcggcctcccaaagtgctgggattacaggcgtgagccaccgcgcccggcccgagaaggcaattttctacttaggaatgtagacagataattttacaacactgttgataaataaaacccacagattcagtgtcaagaagtgtgcagagcagggagggaagcttgtgaaatgggaggggtagttagggaggacgttgttcaggaaacagtggaaacaaaggaccttggacctggaggatgagtgggagttcatgaggtggacastaagatgaggaacttctaggtagatggaataacattgccaaaggatgagaaatggtggcactttcaaggaactcaagcagtttcctatggcaggagcatagggtgggtgtcagagtgggagacagaccattaacatttaatcttacagacaatggaaagtcatttgaagtgttttcttgttactaactttattgatatataattcacaaatcagtttgcccatttaaagtgtacagtacagtgacttttttagtatattcacagtgtgtgcatcaccaccacaatcaaatttagaacatt

SEQ ID NO: 184393 - DNA, 601 bp, Human
acacttgtattatctttgtgtgcatagccatcctagtagtgtgaactaggccttttatcattgtgctgatttgcatttctctcatagataatgatgttgaacatcttttcatatgcatataggccatttgttgtttggagaaatgtatatttagactttgcatatttttttaattgggcagatttaaaatttatgtattgttgagtttcaagagtcctttatatattttaggtacaagtcccttattagatatgtgatttgcaaaatttttctcattctgtgggttttctttccattcttmttaatggtttccattgaagtacacatggtttaaattttcatgtttattttttctttcgttgcttgtgcttttgatgtcatatttaggaaggctttgtccaatctaagttcaaaaagatttactcctatgttttctttttctttttctttttttttttttttttttgagatggagtttcgctcttgtcgcctaggctggagtgcgatggtgcgatctcggctcattgcaacctcggcctcccaggttcaagcaattctcctgcctcagcctcccgagtagctgggattataggtgctcgcc

SEQ ID NO: 184394 - DNA, 601 bp, Human
ttttctttttctttttctttttttttttttttttttgagatggagtttcgctcttgtcgcctaggctggagtgcgatggtgcgatctcggctcattgcaacctcggcctcccaggttcaagcaattctcctgcctcagcctcccgagtagctgggattataggtgctcgccaccgtgcccagctaatttttgtatttttagtagagacggggtttcgccatgttggccaggctggtctcaaactcctgacctcaggtgatccacccacctcagcctcccaaagtcctgggattacaggcaygagccaccatgcctggcctgttactcctatattttcttctaagagttttatagttttacctcttaaatttagctctttgatccattttgagttaaattttgtgtctgttgagaggaaggggtccagcttgatttgtttgtgtgtggatattcagttgtcccagtatcatttgttgaaaagactgtttgttccccagtgaattttcttgcccttgtggtcaaaattcccttgactgaaaggtaagggtttctttcaacaatattttgtagttttcagagtataagttttgcatttcttttg

SEQ ID NO: 184395 - DNA, 601 bp, Human
aatttttgtatttttagtagagacggggtttcgccatgttggccaggctggtctcaaactcctgacctcaggtgatccacccacctcagcctcccaaagtcctgggattacaggcatgagccaccatgcctggcctgttactcctatattttcttctaagagttttatagttttacctcttaaatttagctctttgatccattttgagttaaattttgtgtctgttgagaggaaggggtccagcttgatttgtttgtgtgtggatattcagttgtcccagtatcatttgttgaaaagactrtttgttccccagtgaattttcttgcccttgtggtcaaaattcccttgactgaaaggtaagggtttctttcaacaatattttgtagttttcagagtataagttttgcatttcttttgttaaatttattcctaagtattttaccttttttgatacttttgtaaatggaattttcttaaagaggcagtggcatgattagacttttatttcaggaatatactctgacatttttgtggaggatggtttggaggaaagtctagtaaaacatacactaagattaattattctgtcaatgatgataaa

SEQ ID NO: 184396 - DNA, 601 bp, Human
ctctttgatccattttgagttaaattttgtgtctgttgagaggaaggggtccagcttgatttgtttgtgtgtggatattcagttgtcccagtatcatttgttgaaaagactgtttgttccccagtgaattttcttgcccttgtggtcaaaattcccttgactgaaaggtaagggtttctttcaacaatattttgtagttttcagagtataagttttgcatttcttttgttaaatttattcctaagtattttaccttttttgatacttttgtaaatggaattttcttaaagaggcagtggcrtgattagacttttatttcaggaatatactctgacatttttgtggaggatggtttggaggaaagtctagtaaaacatacactaagattaattattctgtcaatgatgataaaaggccagaactagggttgtaaaatgaaaggtaatgaataaatttgggtaatatctaggatgtagaatgtaaaaaacgtgatgatttggatattataatgagagtgaaatctcttgatgtaaattccaggtttctggcttagatagttttgccagccatttgctgacataggaacaggaaaaggagttaa

SEQ ID NO: 184397 - DNA, 601 bp, Human
tgtgtggatattcagttgtcccagtatcatttgttgaaaagactgtttgttccccagtgaattttcttgcccttgtggtcaaaattcccttgactgaaaggtaagggtttctttcaacaatattttgtagttttcagagtataagttttgcatttcttttgttaaatttattcctaagtattttaccttttttgatacttttgtaaatggaattttcttaaagaggcagtggcatgattagacttttatttcaggaatatactctgacatttttgtggaggatggtttggaggaaagtctrgtaaaacatacactaagattaattattctgtcaatgatgataaaaggccagaactagggttgtaaaatgaaaggtaatgaataaatttgggtaatatctaggatgtagaatgtaaaaaacgtgatgatttggatattataatgagagtgaaatctcttgatgtaaattccaggtttctggcttagatagttttgccagccatttgctgacataggaacaggaaaaggagttaattgggttttctttcttttttcttagtttgtcttaaaggtttgctgattttatcttttcaaagaacca

SEQ ID NO: 184398 - DNA, 601 bp, Human
acccatgatctatccttgtgaatgatcgatttgctgaggagaagaatgtgtattctgcagttgttggatgaaatgttctgtgaatatttgttaggtctgtttggcctgtagtccagattaagtctgatgtttgttgtttatctgtctggatgatctattcagtgctgaaggtggggtgttgaagtctccagccatgattgtattggggtctgtctccttagctctaataatatttcctttatatatctgagtgctccggtattgggtgcatatgtaattgttacatcctcttgctgaattracccctttatcattatctaatgaccttctttgcctctttttatagtttttgtcttgaaatctattttactgatgtaaatatcactatgctcttttttggtttccatttgcatggaatatctttttccatcccttcattttcagtctctttgtggctttataggtgaagtgtgtttattttaggcagcagatcgttggttctttttttaaatccattcagccacttacgcctttcgagtggagtttagtccatctacattgaatgttattattggtaagtgcgtactattgccattttgtt

SEQ ID NO: 184399 - DNA, 601 bp, Human
atgatctattcagtgctgaaggtggggtgttgaagtctccagccatgattgtattggggtctgtctccttagctctaataatatttcctttatatatctgagtgctccggtattgggtgcatatgtaattgttacatcctcttgctgaattgacccctttatcattatctaatgaccttctttgcctctttttatagtttttgtcttgaaatctattttactgatgtaaatatcactatgctcttttttggtttccatttgcatggaatatctttttccatcccttcattttcagtctctktgtggctttataggtgaagtgtgtttattttaggcagcagatcgttggttctttttttaaatccattcagccacttacgcctttcgagtggagtttagtccatctacattgaatgttattattggtaagtgcgtactattgccattttgtttttgttttctgattgttttgctgtcttttcttccgtcctgtttcctttctgtgaaggtaattttctctggtagtatgttttaatttcttgcttttaatttttttgcctacctcttgtaggcttttgatttgaaattaccaggaagcttg

SEQ ID NO: 184400 - DNA, 601 bp, Human
taatatttcctttatatatctgagtgctccggtattgggtgcatatgtaattgttacatcctcttgctgaattgacccctttatcattatctaatgaccttctttgcctctttttatagtttttgtcttgaaatctattttactgatgtaaatatcactatgctcttttttggtttccatttgcatggaatatctttttccatcccttcattttcagtctctttgtggctttataggtgaagtgtgtttattttaggcagcagatcgttggttctttttttaaatccattcagccacttaygcctttcgagtggagtttagtccatctacattgaatgttattattggtaagtgcgtactattgccattttgtttttgttttctgattgttttgctgtcttttcttccgtcctgtttcctttctgtgaaggtaattttctctggtagtatgttttaatttcttgcttttaatttttttgcctacctcttgtaggcttttgatttgaaattaccaggaagcttgcaggtcatatcttataaccgattattttaaactgatgacaactgattccacaaacgagcagagaaaactaataaaaac

SEQ ID NO: 184401 - DNA, 601 bp, Human
ggctttataggtgaagtgtgtttattttaggcagcagatcgttggttctttttttaaatccattcagccacttacgcctttcgagtggagtttagtccatctacattgaatgttattattggtaagtgcgtactattgccattttgtttttgttttctgattgttttgctgtcttttcttccgtcctgtttcctttctgtgaaggtaattttctctggtagtatgttttaatttcttgcttttaatttttttgcctacctcttgtaggcttttgatttgaaattaccaggaagcttgcagrtcatatcttataaccgattattttaaactgatgacaactgattccacaaacgagcagagaaaactaataaaaactctacactttatcctccttgctttttaacttttgtgagttttgtaccttcatgtaattgcttactgctcgttaaggtccttttcttttagattgaagaactcacttcggcatttcttgtgggaaagtttggtgttgatgaagtccctcggcttttgtttgtctgggaaagtctttatttctccttcatgtttgaaggatattttcactggatatactattgtagca

SEQ ID NO: 184402 - DNA, 601 bp, Human
ttttttaaatccattcagccacttacgcctttcgagtggagtttagtccatctacattgaatgttattattggtaagtgcgtactattgccattttgtttttgttttctgattgttttgctgtcttttcttccgtcctgtttcctttctgtgaaggtaattttctctggtagtatgttttaatttcttgcttttaatttttttgcctacctcttgtaggcttttgatttgaaattaccaggaagcttgcaggtcatatcttataaccgattattttaaactgatgacaactgattccacaracgagcagagaaaactaataaaaactctacactttatcctccttgctttttaacttttgtgagttttgtaccttcatgtaattgcttactgctcgttaaggtccttttcttttagattgaagaactcacttcggcatttcttgtgggaaagtttggtgttgatgaagtccctcggcttttgtttgtctgggaaagtctttatttctccttcatgtttgaaggatattttcactggatatactattgtagcataaaagttcttttccttcagcactttcagtgtgtcttgcccctctctcc

SEQ ID NO: 184403 - DNA, 601 bp, Human
tattttaaactgatgacaactgattccacaaacgagcagagaaaactaataaaaactctacactttatcctccttgctttttaacttttgtgagttttgtaccttcatgtaattgcttactgctcgttaaggtccttttcttttagattgaagaactcacttcggcatttcttgtgggaaagtttggtgttgatgaagtccctcggcttttgtttgtctgggaaagtctttatttctccttcatgtttgaaggatattttcactggatatactattgtagcataaaagttcttttccttcrgcactttcagtgtgtcttgcccctctctcctggcctgtaagatttccactaagtctactgccagacatactagagctccattgtttgttgtttcctttctcttgttgctcttaggatcttttctatatccttgacctttgggagtttgattattaaatggcttgaactagtcttgtttggattaaatcaatcaccaatccttgcttggtgttctgtagctttcttgtgcttgaatattgatatctttctctagatttgggaagttctctgttattttttcttcaaataaactttctaccc

SEQ ID NO: 184404 - DNA, 601 bp, Human
ggaaagtctttatttctccttcatgtttgaaggatattttcactggatatactattgtagcataaaagttcttttccttcagcactttcagtgtgtcttgcccctctctcctggcctgtaagatttccactaagtctactgccagacatactagagctccattgtttgttgtttcctttctcttgttgctcttaggatcttttctatatccttgacctttgggagtttgattattaaatggcttgaactagtcttgtttggattaaatcaatcaccaatccttgcttggtgttctgtagcyttcttgtgcttgaatattgatatctttctctagatttgggaagttctctgttattttttcttcaaataaactttctaccctcatctttctctatctccttttaaaggccaagaacttagatttgctcttttgaaattattttctagatcttgtaggtgtgcctcattcttgattattcttttttcttttgtctcctctgtgtattttcaaatagcctgttttcaagcttactaattctttcttctgcttgatcagttctactgttgagattctgccatgttcttcagtaagttaattgaa

SEQ ID NO: 184405 - DNA, 601 bp, Human
cttctgcttgatcagttctactgttgagattctgccatgttcttcagtaagttaattgaattttttatctccagaatttctgcttgattcttttaaattatttcagttgttttgttaaacttacctgatagcattctgagttccttctctgtgttgtcttgaattttgttgagcttctccaaaacagctattttgaattctctgaaagctcacatctctgttactctgggattggtcactggtgccttatttattattgttaatttagtgagttcatgttttcctggatggttttgatgastgtggatgttcaccaatgtctgggcattgatgagttaggtatttattgtggtcttcggagtctgggcttgtttgtacccatccttcttgggaacgcttttgaagtattcaaagggaagtgagtgttgtgatctaagtctttggtcatagcagccgtatctgtattaaggggcaccccaagtccagtaacattgtgacccttgcagacttgtagaggtaccgccttggtggtcttgggtaatatctgggagaattccctggattatcaggaaaagaactcttggttctcttcccttacttt

SEQ ID NO: 184406 - DNA, 601 bp, Human
ttgattcttttaaattatttcagttgttttgttaaacttacctgatagcattctgagttccttctctgtgttgtcttgaattttgttgagcttctccaaaacagctattttgaattctctgaaagctcacatctctgttactctgggattggtcactggtgccttatttattattgttaatttagtgagttcatgttttcctggatggttttgatgagtgtggatgttcaccaatgtctgggcattgatgagttaggtatttattgtggtcttcggagtctgggcttgtttgtacccatcyttcttgggaacgcttttgaagtattcaaagggaagtgagtgttgtgatctaagtctttggtcatagcagccgtatctgtattaaggggcaccccaagtccagtaacattgtgacccttgcagacttgtagaggtaccgccttggtggtcttgggtaatatctgggagaattccctggattatcaggaaaagaactcttggttctcttcccttactttcccccaaacagagtctgtccttctttgttgagctgcctggagctgtgggggacgggtgacacaggtatgcctgtggccaccat

SEQ ID NO: 184407 - DNA, 601 bp, Human
atgatgcagctattttcgaggtaagatcaattattttgacaaaaatgtctcaaaatggatttatttctgggggttaagagcagtggggctctgatggggagatctgtactaaggaacctgatgctttataatagctcttaggcatcttgcttaggcttaaagaacctgacttgcaacctgtgaatcttagagaatttctaaatttgaatattatgtaacacttgattgctatgggccacttagctcatagtggttgtaaatttagcttcagtgtcatataacccattgctctgaaggtgaytttttattttttttgtaaatgataaacataaggcaatattacttgcagatagtccttagaaggataagtatcagtttgaggggactataaacatcagtttgtgcttttttatccttaccatataataaatgagctatttcttttttaggccaaaaaatcattttactgggcaagaaaaacatctcattcctttgtcgtgaatatccttgctcaggctctttatgaattattttctgccacagatggtaagtgtagacactttttagtgaatattactcaattgcagatttttagcgtagg

SEQ ID NO: 184408 - DNA, 601 bp, Human
gggctctgatggggagatctgtactaaggaacctgatgctttataatagctcttaggcatcttgcttaggcttaaagaacctgacttgcaacctgtgaatcttagagaatttctaaatttgaatattatgtaacacttgattgctatgggccacttagctcatagtggttgtaaatttagcttcagtgtcatataacccattgctctgaaggtgattttttattttttttgtaaatgataaacataaggcaatattacttgcagatagtccttagaaggataagtatcagtttgaggggaytataaacatcagtttgtgcttttttatccttaccatataataaatgagctatttcttttttaggccaaaaaatcattttactgggcaagaaaaacatctcattcctttgtcgtgaatatccttgctcaggctctttatgaattattttctgccacagatggtaagtgtagacactttttagtgaatattactcaattgcagatttttagcgtaggaaaggaataaacaagttagtgatttgtccagaaataaaaatgttacctgagtttgctaactcccaagttggtagttttttaaaat

SEQ ID NO: 184409 - DNA, 601 bp, Human
aaagttacaagattggaggaggaaagacctttattggagcaaaagtttacctgttgcatcctttactttttaaaatctgttgtaaagaaaaatctgggcatacctgaacagaacattgattctaaatggttaaaaaggttatcaattgattacactacattgtgagggttttatgagttactttgaaaggtattaaaaactttatagatataaggaattattatttatcgctactcacagctctcttcacttgataatttactgcttagttagagatactggttggacatcttagagactrggaatttggtttctagaattgtgttaaaaagagcttccaaagtattttgcatcacttaatgaattaacagcaaaatcaaggaagtaccttttaaacaactcttccaagacctaaatattagtagttttttactaacagaaaaaagtttattcatatttatattactctccataatgctgattatggaattcagaagaaatcctggttgttgaaattctaggactagatatttaaaaattatctgcaagatgtagcgtttgttatttctcattttttctgatatatcattagcatcctaca

SEQ ID NO: 184410 - DNA, 601 bp, Human
ggttaaaaaggttatcaattgattacactacattgtgagggttttatgagttactttgaaaggtattaaaaactttatagatataaggaattattatttatcgctactcacagctctcttcacttgataatttactgcttagttagagatactggttggacatcttagagactaggaatttggtttctagaattgtgttaaaaagagcttccaaagtattttgcatcacttaatgaattaacagcaaaatcaaggaagtaccttttaaacaactcttccaagacctaaatattagtagttwtttactaacagaaaaaagtttattcatatttatattactctccataatgctgattatggaattcagaagaaatcctggttgttgaaattctaggactagatatttaaaaattatctgcaagatgtagcgtttgttatttctcattttttctgatatatcattagcatcctacataagtgtgtacacatatttgattattttacaattttattttagattccctgcatcaactaagaaaagcctgttttctttatttcaaacttggtggcgaatgtgttgcgggtcctgttgggctgcttt

SEQ ID NO: 184411 - DNA, 601 bp, Human
aattctaggactagatatttaaaaattatctgcaagatgtagcgtttgttatttctcattttttctgatatatcattagcatcctacataagtgtgtacacatatttgattattttacaattttattttagattccctgcatcaactaagaaaagcctgttttctttatttcaaacttggtggcgaatgtgttgcgggtcctgttgggctgctttctgtgtaagttgtgatggcacagaggatacaaacctgccagattttcttaggactgttcagttgatgaattactgcaaatctttcytccttacacattttgatattttattatctgttagtatcccaatgagaaggtggcccaaagaaatgaagaaacgcaatatttagtactgttttctttctagggaacagcagttaaaggtggtggtagaggaagctataacccttgattaaaatagaagcttgttttttgcctatggatttatccatatgttctggtctgtgggagccaggaataattgagaaattttaatttaagaattagtttcattgaagtacagggacttatacaacccagtattagttttgagcgtacagacatatg

SEQ ID NO: 184412 - DNA, 601 bp, Human
gattttcttaggactgttcagttgatgaattactgcaaatctttcctccttacacattttgatattttattatctgttagtatcccaatgagaaggtggcccaaagaaatgaagaaacgcaatatttagtactgttttctttctagggaacagcagttaaaggtggtggtagaggaagctataacccttgattaaaatagaagcttgttttttgcctatggatttatccatatgttctggtctgtgggagccaggaataattgagaaattttaatttaagaattagtttcattgaagtacrgggacttatacaacccagtattagttttgagcgtacagacatatgtggaactattcttggaaagtctacaaagtgaaatctatcgagttatttctcatttgcaaagtgatcctttgagtcatttctcataatctataatctgaatgttaatactggtatttttaaaagccctacatcccaacagaccaggccatctagatatttcagcgtggtgtctcaggatgagtaaacaaacagctaaaaatatatgacttatgtaaactagagttacaggagttactagcttttctgaaagggata

SEQ ID NO: 184413 - DNA, 601 bp, Human
ttaaaggtggtggtagaggaagctataacccttgattaaaatagaagcttgttttttgcctatggatttatccatatgttctggtctgtgggagccaggaataattgagaaattttaatttaagaattagtttcattgaagtacagggacttatacaacccagtattagttttgagcgtacagacatatgtggaactattcttggaaagtctacaaagtgaaatctatcgagttatttctcatttgcaaagtgatcctttgagtcatttctcataatctataatctgaatgttaatactgrtatttttaaaagccctacatcccaacagaccaggccatctagatatttcagcgtggtgtctcaggatgagtaaacaaacagctaaaaatatatgacttatgtaaactagagttacaggagttactagcttttctgaaagggatatattctaagtattttttcttaaaaaaaaaaaaaggggggtggggggtttgctcctgccatcaaacttaacatgcagacatatttgtgacgtcctctaaaatgtagaatgtttcatacagaattatgatgcttgggtaaaaaaaagtaggatgtttg

SEQ ID NO: 184414 - DNA, 601 bp, Human
tttagctagacacagagtgctgattggtgcatttacaatcctctaactagacagaaaagttctccaagtccccactccacccaggaagtccaggtggcttcacctctcactgagatcaggaggtgctgactgcctggggtcagggatgggaagcttgggctgagcctgaggggtcctggagcctgagactaactattttctaaaagaaatggcaaatacaaccattatttgttgtttttttttcctttattaagtaagcaatgaatgttcttagtagaaagtgtagaaattgcagatgcaygaaatgaactaaatgaaaccattccacaaaaataatccccaaaccaagggacccttaccatttgtatttgagtaggcctcattcatgtcttatgtctacatgagccccctccccattatcccataggaaagagagaatgagtccttaaaaagttgttcatggggtaagggtttctctcaacttcattttgaattgcaaaaggaagtttagagaagatgcatgggctttaaaggacctctattaacatgaatactgggacctaaagaggtgtcccaggaaaccaggaaaacaagtggtaaa

SEQ ID NO: 184415 - DNA, 601 bp, Human
ggttcttggtctgctgacttctagaatgaagccacggaccctcgtggtgagtgttacagttcttaaagatggtgtgtccggagtttgttccttcagatgttcagatgtatccggagtttcttccttccagtgggttcgtggtctcgctgagttcaggagtgaagtcgcagaccttcacagtgagtgttatagctcttaaaggtgaggcatccagagttgtttgtttctcccggtgggttcgtggtctcgcagacttcaggaatgaaaccacagaccctgcggtgagtgttatagctcatamaggtagtgcagacccaaacagtgagcagcagcaagatttactgtgaagagtgaaagaacaaagcttccacagcgtggaaggggacccaagtgggttgccgggctggctcgggtggccagcttttattcccttatttggccccacccacgtcctgctgattgctccattttacagagcgctgattcgtccatttaaagagtgctgattggtctgttttacagagtgctgattggtgcatttacaaacctttagctagaccacagggtgctgattggtgtgtttttacagagtgctgattgg

SEQ ID NO: 184416 - DNA, 601 bp, Human
agggcaggcagccagctgccctaccagccccctgcagggggcgctgtggagcaaagctttcacgggtaacgggcaaaggggagcagtagtgtcaagtcaggtcttggcagcacagcgaggttggcgagttctccttggctgccaactcagccaaaggctcatcctgcactgttgggcctgttgctgggatgcacctttggaatgtgtgagccaagaatgggcgcgcatgctcatggaacccgcaaggaaggcgcaccggggaggaaagggagggggcagagatcaccctaggaatgtgcayagggggcagctgccggtggagggtgtttggtatgagggagacaggctcatggggaaatgcagctggccctcccgcactggggccccagcgctgacaggggacggcgtaggacggggatcccttgggctaggagggcgagaactgctgcgccatcaggtggcagctttggggtcagcaccctcgagatgtcctgccctttctccagcggaattgggaagagcccctcaagggctaaacagattctgacggggtctcttgtggtggggaggacaggtggagagagacatgcttcccttataa

SEQ ID NO: 184417 - DNA, 601 bp, Human
atctgtgcacccccagtatcatcaggcccctttctctaattatcgagaacctctgtgactccaaggtccttgtcctgctcaggtatccatttcctcagggtccatttgagggccctcagagggccttcaaaaccaaaaacaaaacacagggtctgcagtatcttaggatgttgtctccaagaggctctaagaaaagccagtgtaaagtcactgaattcttggagttggtccaggaccaagggtaagtgcagaagccggggcagccaaggaacgggccaagggcaggcagccagctgccctrccagccccctgcagggggcgctgtggagcaaagctttcacgggtaacgggcaaaggggagcagtagtgtcaagtcaggtcttggcagcacagcgaggttggcgagttctccttggctgccaactcagccaaaggctcatcctgcactgttgggcctgttgctgggatgcacctttggaatgtgtgagccaagaatgggcgcgcatgctcatggaacccgcaaggaaggcgcaccggggaggaaagggagggggcagagatcaccctaggaatgtgcacagggggcagctgccggtggagg

SEQ ID NO: 184418 - DNA, 601 bp, Human
ctcttttttgctgcagtgctctgtatctgcctgatgatgaggagggagcagggtcagcaaggctgagaccaggaagtatgaagaggtgactggatggagctctaagggggagaacaggggccctggtgagctgtgcttcctcccagacacaggaggcatagaggtagccactgcagcagattccaggagggctactgggcctgggcagtcttgcgtcctgcgtccctcctcctgtgcattagtcccagagggtggagggggtctggagaggcagtgggcagaggagccattgctgccgcasgtggtggcaaaatatgggaaggctgcaaggctccccagtcccggatggccttggcctcaccccacaatgcacttttgatgcatagcagcactgtttccttctccaggtccaggtcttcagccgtgagtcggaaccccagctgggagggaggtacagcgtcagaggctcccctcgcctgcatggcagcagaggaaacttgcatcgaaggggccagtactgtggatgcgagggagccattcttggaggtgagtttctgcccttgtgttgcatctgctgccttttcactccagatcttcctct

SEQ ID NO: 184419 - DNA, 601 bp, Human
tcagtattctaagtgtgtaataatgacccttggtggtctccttcttactctcctagacccagctcaaatattacttattctgattccctgagacgaggaagtcatcttttgggctctcttaggaacctgtctgtaccactagttccccatttctggttaagcatgtgtctgtgtctgtatgtgtgtgcgtgtgtgtgtacatgcgcacatgtggagattgcacaataatcaatatatgttattttaaactgataaatttgtggtaatttgctacacgatcatctgtagcaattacattaartaacctgtgaaaggctgcccaactcctcagtgatggagctgtgaagaatgagaagagggaaccaacatacttcttggaagattctcagccacaggaactgaaaggcaaaggattttctgattagtactcaaataactggaaaattcaattaatcagagcctcattccaggccctaagattcatcaggagtttctggatttgaaatcatagtttctgtagcaattgggacaaacactggggctaccttgatgcagctgagaagtacagtgactgcagagctgggggaagaaagttctacat

SEQ ID NO: 184420 - DNA, 601 bp, Human
gtggatagtggatagtctcatgttccctctagatagctctgggcctgggagctctcagaaggatatctgtgggagcagaacctgtcttgtgagtcaaaaacttaggtttccccttcttttcttttttcctcggtttctgttccttgcttagttactgcctaggcttggcatcagcagctgctagaaatctgaaccactatccacgttgccaggaagtgtacaaatttgccttatagggatgactgcccttttgatatctaccttataattttggtgtaataattaatatttggataaggaygataagtttttcatgttacagatgaccacccaggtgagaaaagctgcttttgagtgtttttctgtcatgttttttgagcagtaaatcttaattcacttcagtcagtattctaagtgtgtaataatgacccttggtggtctccttcttactctcctagacccagctcaaatattacttattctgattccctgagacgaggaagtcatcttttgggctctcttaggaacctgtctgtaccactagttccccatttctggttaagcatgtgtctgtgtctgtatgtgtgtgcgtgtgtgtgta

SEQ ID NO: 184421 - DNA, 601 bp, Human
cccgcgccgacttggcgatggccagctacacaggtccggcgggggcggcagccatgtggggcgcgggctggcgtggggagcagcccacagctgggcctcccattgaactttgatgtgtttttctttggaaaactttcaactctcttgtatttttctctccaagatactccaagtatattttcacctgtgaggcaatatctgaaaattgtaggctacagcctccaaagtgagtcttcctctcagtacctctcttctggacacactgagccctttctttaaactctgatttttactttcttgwccgacttgttataacatgacacaataaaaccatcttgttacagaaattgggaaaaggatgttttgggggaacaggtttgatacgtttccaatgcaccttctttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacacccggctaattttttgtatttttagtagaga

SEQ ID NO: 184422 - DNA, 601 bp, Human
ggtggctcatatgagtaaaaatcatttttcctgggtagctgattcctagaaactcgcagggcggcacagcacggcggctcgtggcagcagaagaggaagatgccgcggtggaaggcgtcttcgcggccgggcagcgacgcgtacacctgccgccggaagaagagcgacggtcgcacagctctcaggccgggggccggagccccggcagcccggccgcgcccatccacgcccagccacgcccagccacgttggccgcccgcccagcctgctgggaaactgctcgctgcgcattcgcccgccsgcgccgacttggcgatggccagctacacaggtccggcgggggcggcagccatgtggggcgcgggctggcgtggggagcagcccacagctgggcctcccattgaactttgatgtgtttttctttggaaaactttcaactctcttgtatttttctctccaagatactccaagtatattttcacctgtgaggcaatatctgaaaattgtaggctacagcctccaaagtgagtcttcctctcagtacctctcttctggacacactgagccctttctttaaactctgatttttactttcttgacc

SEQ ID NO: 184423 - DNA, 601 bp, Human
agagttcttagtgtgggtatatgactacatcaagagttttttacttttgatgattagggactgcttcttaaaacttattttaaaactgattttagtatcttaaaatactcacacagttccgaagtcacatttacataaacaaggcatatttgaagtccaggtttcatccttgaccctcctactctaggctcttccttctcctaaaggtaagcattttcattctttatccttttcatcttattggtatgaacacatgtgtgtccccttccaggcagtcttcagtaatgtcacatgttcccaygacacctgtattgtactcttatcagtcattacatggaatttatcttccataagtattatttggggtcctccatgagactgtgagcatgaccactggagggttgcttcccattatatccatattatcaagcacaaggtcaggcacagagtaagactcaaacatgttttggaatgtatgactggtatgaactacaaaccagtaagctgatgttttcattttgagtctataaatctaatgtttatggtggctttgtgtatggctcaaggctcaaattgtaaaacttaacattatgtgaccaaa

SEQ ID NO: 184424 - DNA, 601 bp, Human
ccacgtaccattaatcagcttcaacactatcaagtccagtgtttcctttctctgccacttccaactcgattactctgaagtaaatcccacagatatcacttcattcataattaagttatgtacccctataatgcaaactctttccttttatttaccaatttgaaaataatgaatctgttcccaagtatcctacaaagatgattactgagttcttttaagtattattttgaactcgttaaacatatctgatgcaggatgtgcaaactgtctatcttttgccaacaggagccttttcatgttrcttgagttcttctgacatggccctagtaatccttgctagcttccttaatctttcatatgaccttgttgatgtgaccatgttcccacattatttgaacatttcctgacccagttctggaatcaacgacctctccaaagagcctggagttccttttagagagaatggtatgtagacacaatcaacaaaatcttcctcccatgcccaacacctcagttctcagtaacaccaacataattactcatttgctttatcccccaatacacacacaaccatctcaaaataacagcaacagtctagtaa

SEQ ID NO: 184425 - DNA, 601 bp, Human
tgagccacaccacattacgccaaaacttaattcttaatcctattttgttaccttcaatatcagctgaaattgaaacaaacactcaggcacagacatacaaacaagaaagcctggcttttgttttcttttgttttttagtggcagggtctcagtctgtcacccaggctggagtgcagtggtgctatcagagctcactgcaggcttgaagtcctgggctcaaccagtcttcttgtcttgtcctcccaaaatgctgagattacaggcatgagccaccatgcccagcttttttaaaaaaaatgcytttttgggtaaaagccaaataagacaaccaaagccatgtatcactactgtgctatgaaaatgagtctcagtagttctttaatataaacattcctatgtagaagtaagtaatgcaaacggccctgttccaaagtcaaaaggaatttgacttttgcattatttttaaaaaataattaaaatcagagttatttttaaattcttattctaaaaatagggaagagaaattgcctaaaaaatacagaggtggataaaagaagagagattaaaatttcaaatggatttgggaagttaagtgctgatt

SEQ ID NO: 184426 - DNA, 601 bp, Human
tgcttacttggggttactaccctataaacatcttgtcctatcgacattttttcctcctaacactcaacacatttcttgtatggcttacgaagtacactttctaggtgtgatccagcttggcagtacaatgagaagcatgcctttatagtctccttgaaaggttgaggactgttaattgactgtggggtggaaattatattctgagaaggattttagcaaacattttgatttcacttatgaaacaagtccttacatcatataagtagaccttatttttactggttgttgttgttttgtttgyttgtttgcttgttttttgagatgcagtctcgctctgtcaccagacagtggtgcaatcttggctcactgcaacctctgcctccccggttcaagcgattctcctgcatcagcctcccaagtagctgggactacaggcatgcgccaccatgtccagctaatttttgtatttttagtagagatggggtttcaccatgttagccaggatggtctcaatctcttgacttcgtgatctgcccacctcagcctcccaaagtgctgggattacaggcgtgagccatcgcgcccggccactggttgttct

SEQ ID NO: 184427 - DNA, 601 bp, Human
ggaagagtatggaagtttatgggctgaacagttgagctgcccggtactttgaggttccaggtcactgtgtctttctcagaagtctttatctttggaggagttacacgtctccaggctgaaacatgaagggcctggaatggatgagctttggaaccctctccaatcctagctcccatgaggcctgagcctgaacatctcttggtatatcttgtttgcattttctcttgtctttgttcttagaaacactgaaaaactttcatacttttccagtgacaaatcctgaatcatgccattatatacrtcactatatatctctatatatcacaatatctatcattatgtatcactatatcactatatatcacaatatacattacaatatatatcacaatacagatggctatatatcctgacttatcactatgtatctctctacataccattatataccactatatatatcactatatatataactatacatcactatatatatcactattgtattaatcagggttctctagagggacagacttaataggatagatgtatatataaaggagagtttatattaaggagtatcgactcacacgatcacaag

SEQ ID NO: 184428 - DNA, 601 bp, Human
cggcccatgcatggcttcttgaacacttgccttgaccgccctgcagtgcctccatctgattttgtctaaacatgtggaacccaccctcgctaccagtactgtggaaccaaatgcagactcctttctggtctacggggtcctggctttctcaactggcagctctcccctttccaacccattcattcacacgttctgtccttttctttcctctgcaagttggattcctttgttcagctccttcccacaccaccctccttccaaccccgcagtttagctgccagtcagcattgattcgctcaagctttacttagtgcctagatccccactcactgtagattccaaggaggggaatgtgggtctcattcactgctgggtccttagttctgaaactagcactgccacattaacagatgctcacaaaattatttctttctttttcttttctttttaataatcttttcatcttcaaatgatctttttaattttaatttttaaatgtttagtttttgtggatacatagtagatgtatatatttatggggtacatgaaatattttgatacaggcatgcaacgcataagaatcacatcagggtaaataggg

SEQ ID NO: 184429 - DNA, 601 bp, Human
taaagcagcgtgaatgagctaagacaatcagtttgttctttgtgttgcctccagactctcagaatctgtgtgcttccccaaagcatctggactttccatgtgctttttacacatctccaagcatggctaaaatttaaaagtcagaaaataccaattgatggagaggctggggaacaaccaatctcttgtccatggctggcgtgagcatcagatgggcatttcatttggaaaactcttggtcagaatccactaaaggtggacaaaagcatccctgtgcccttgcgaatcctttgatgaaggracagccaaaagaaatgcatgcatagattaatgacaaatgaccaacaggaggcagcatctgctatggctacgcacacaggctctggggtcagacaacttcatgttgattcaggctctgacacttgctgtatggatgactttgcaccaatcacagccctaatttcctcatctactaaatagggagaataattgtatctctttcagagggtcaatgaaaggatgacacaatagtgttgctgtaacagcacagtacttgggccataaaaaagcattccgttctgagtagatattgtaattattt

SEQ ID NO: 184430 - DNA, 601 bp, Human
actaaatctgtcagtgccttgatcttggacttcccagcctccggaactatgagaaatacgtttttgttgtttataagccactaactatatggtctcttgttaaagcagcgtgaatgagctaagacaatcagtttgttctttgtgttgcctccagactctcagaatctgtgtgcttccccaaagcatctggactttccatgtgctttttacacatctccaagcatggctaaaatttaaaagtcagaaaataccaattgatggagaggctggggaacaaccaatctcttgtccatggctggcrtgagcatcagatgggcatttcatttggaaaactcttggtcagaatccactaaaggtggacaaaagcatccctgtgcccttgcgaatcctttgatgaaggaacagccaaaagaaatgcatgcatagattaatgacaaatgaccaacaggaggcagcatctgctatggctacgcacacaggctctggggtcagacaacttcatgttgattcaggctctgacacttgctgtatggatgactttgcaccaatcacagccctaatttcctcatctactaaatagggagaataattgtatctcttt

SEQ ID NO: 184431 - DNA, 601 bp, Human
gtgcccttataaaaaagaccccagagagctctctcaccccttcccctatgtgaggacacaaagagaaggcaccatacctaacaagcttcttggttcatagatgtcctcactggacactaaatctgtcagtgccttgatcttggacttcccagcctccggaactatgagaaatacgtttttgttgtttataagccactaactatatggtctcttgttaaagcagcgtgaatgagctaagacaatcagtttgttctttgtgttgcctccagactctcagaatctgtgtgcttccccaaagcayctggactttccatgtgctttttacacatctccaagcatggctaaaatttaaaagtcagaaaataccaattgatggagaggctggggaacaaccaatctcttgtccatggctggcgtgagcatcagatgggcatttcatttggaaaactcttggtcagaatccactaaaggtggacaaaagcatccctgtgcccttgcgaatcctttgatgaaggaacagccaaaagaaatgcatgcatagattaatgacaaatgaccaacaggaggcagcatctgctatggctacgcacacaggctctgg

SEQ ID NO: 184432 - DNA, 601 bp, Human
agattctgatcctgcagctctaggctggtctgcaaatctagatttctctcccaggtgcccagatgatgctgttgcagctggttcccacacacaccgaatagcaagggcctggtatcagctgcatctgagcttctctctggctgtgaggctcatgactgcaatatttagaagcagtctggtgatttgtaacaacccacaatgagtcttggcaaccattatgatcaatgaatttattccagggctaatgcccctcagcaaacagtgataaaagtgcatgtggttattgatcctgtacatataratttggttgtgaattctggcccagagcactacatcatgtgctaaccacatgtagcaggcactaaaggaaataatgctcgattcaatatcgcaacttaactcggagtaatttttgtaacccaatttggtggaatgtgtatatttaaagtgaattatcataactcagctgcctgtgtaatgtgctaaagtcagcatgccagcctatacctaccagattcctgaacgcagactcatttgaatgtgctaagtcttcctgcatctctctctgttcctagtgtctattacaatgtgtcatagaatt

SEQ ID NO: 184433 - DNA, 601 bp, Human
aaaaatgctctccattaaatataggagtcagctgaattttggcacctaattttttttttttttttttgagacagagtatcgctctgtctcccaggctggagtgaagtggcctgatctcgatctcggctcactacaacctccacctcccaggttcaagtgattctcttgcctcagcctcccgagtagctgggactacaggtgtctgccaccactcccggctaatttttgtatttttagtagagacagggtttcaccatattggccaggctggtctcaaactcctgaccttgtgatccgcccrccttggcctcccaaagcgctgggattacaggcgtgaaccaccgtgccccgccaaatgttggcacctaatgttcttatgctctttaagcaacactagttctctctcctgagtatgggttagaaccacctggattttttgaaggatgcgtaatgtttaggtcatgccctatacctgtgctgtccaacatgatagccactgtaaccattaagaacttgaaatgtggttacagccacatatggaaagagaatatgtttgatcaagttaaataaaaatattattaaaattaattcacctgtttct

SEQ ID NO: 184434 - DNA, 601 bp, Human
tacaaaagacaaatataagagagcaacatccagggaatgaagtaattaatgctgcaagtatgatctgaggccaactcaatgccaggcacagtgggagcacttagggacacgggatcctctgcccagaagctgaaggcaggactagattctcaatacacaggctgggagtctgacagattctttcaatcaaatcatagcttgggctactctaggagatgataacttgagtttcccccattgacttaacccttcagctgctgctatgggtctgtgcccagccaggtgggaccagatgaagagytggaggggctctgggtctaggctagggatgtctcagacaaaataatgtaattcatatatgtagctatgtatttcctgatagccaagttaaaaaatgtaacaagaaacaagataaattaattttaatatccaaaggattataatttttaacatgtaaatcaattttcaccttattaatgaaacatttttctgataatgtcttcaaaatcctgggcagatttcacactcaaagcatgtctcactgtagataagcctcattgcaggtgacaagagccacatgtggttggcagctcctatatta

SEQ ID NO: 184435 - DNA, 601 bp, Human
caacctttgtatgatttatattcttttcaatatgtgaaggtgtgttttatggcccagaatatggtctatattgaatattccttgagggcagaccgggcaccggacctcaatctcgggcgccatcttctggttgttagaacaaactgcccgagaaaggctccctcaaatcccctcattgctgggttccccacatggcaaactggatgaacaccaaggagctccttttgctccatgcagttcaacagaaaagccctgtgggtgggcatttgtcaacttctcctctggacaaagatgcccgggycagaaacactccctgagaccctcccagcatccagatagcagcccaggctgtgacatctcaccctcaggccagattcaagcagtgaaatatataatctaatttcttccccagcccagccccttgagtcccagtttttcattctcccattctcaactctcccaccactgaatgatctaaaaccacagggaaaccttttattgaattatattttaataaagagagccatctcatttcatgtagtttgtgatataaggaaaatagtaagattataaaaatatcttttacttttgacatggttac

SEQ ID NO: 184436 - DNA, 601 bp, Human
caatcacactgataatctattttaggattctaagcaaagcttgatgtgtatagtatatatcagcaaaaccattgctactaaaaaatgctggaataatccctaaaataggcttataatattagtaggttaggtctaatctaatctaaagtgatggcaatttaatcttatcttctttttcaaggtaaatattatcaggatgaagggttttactaagaatattgtggactgcagatttatcaccaataaaaacctcattcccgatataattaaataaacgcctgattaggttagagggggtggyagggtgtgatcatggaggattagagggagtggaagggtgtgatcatggagggttgggcaatcttgccaataaaaggctctcctatgccctttccccaccatacctgagctcttggtggaagaggatggcgtacaaagatttcagcggaagaggtgagtccacatctgtgtgctttgcttttccttctcagatgtctagaattggggttataacatagggggatgaatgaaagaaattagtaattaatgctttcaacaaaggctgtctgagtgctgcctcggagttgaaatcagtcaccct

SEQ ID NO: 184437 - DNA, 601 bp, Human
cacatgccaccacacctggctaatttttgtatttttagtagagacagggtttcaccatgttggccaggataggccagaactcctaacctcaagtgatccacctgcatgggcctcccaaagtgctgagattacaggcgtgagccaccccacccagcctcatccacaaacttatgtgtgccaattccctgaatgttctgcgctctacttccgtaactggagccagcctctccaggggtcacgctgctgcctggacagacgccttagatggggtctgttcctcccatcaccattggctttgtgsattcattccttctcgtgagagctgccagcgctttgccatcattgctctagggtgtcagctcctagttttctgcttttttaccaaaccatgaccatctcaatgctgggtgcaccaccgggcatcttctgcaacacgacattctcattcccctgctgggactactgcagataaatacattatgcagcaggttatagaatattgttttcttgacatctagtgggaatcttgagcatttgctcattaacgtggtcatcaggactcccaaattccctacaaggtaaatgtacaggatcaataaat

SEQ ID NO: 184438 - DNA, 601 bp, Human
gtgcagtggagtgcagatcttggctcactgcaacctctgcctcctggctcctgggttcaagagattctcctgcctcagtcttccgagtagctaggactacaagcacatgccaccacacctggctaatttttgtatttttagtagagacagggtttcaccatgttggccaggataggccagaactcctaacctcaagtgatccacctgcatgggcctcccaaagtgctgagattacaggcgtgagccaccccacccagcctcatccacaaacttatgtgtgccaattccctgaatgttctgygctctacttccgtaactggagccagcctctccaggggtcacgctgctgcctggacagacgccttagatggggtctgttcctcccatcaccattggctttgtgcattcattccttctcgtgagagctgccagcgctttgccatcattgctctagggtgtcagctcctagttttctgcttttttaccaaaccatgaccatctcaatgctgggtgcaccaccgggcatcttctgcaacacgacattctcattcccctgctgggactactgcagataaatacattatgcagcaggttatagaat

SEQ ID NO: 184439 - DNA, 601 bp, Human
gagtgcagtggagtgcagatcttggctcactgcaacctctgcctcctggctcctgggttcaagagattctcctgcctcagtcttccgagtagctaggactacaagcacatgccaccacacctggctaatttttgtatttttagtagagacagggtttcaccatgttggccaggataggccagaactcctaacctcaagtgatccacctgcatgggcctcccaaagtgctgagattacaggcgtgagccaccccacccagcctcatccacaaacttatgtgtgccaattccctgaatgttcygcgctctacttccgtaactggagccagcctctccaggggtcacgctgctgcctggacagacgccttagatggggtctgttcctcccatcaccattggctttgtgcattcattccttctcgtgagagctgccagcgctttgccatcattgctctagggtgtcagctcctagttttctgcttttttaccaaaccatgaccatctcaatgctgggtgcaccaccgggcatcttctgcaacacgacattctcattcccctgctgggactactgcagataaatacattatgcagcaggttataga

SEQ ID NO: 184440 - DNA, 601 bp, Human
gagagatgtaaatgtcatgaaaactgagcatggacggcgtcgtgttggtcctggctcagtggtgggtgtttcaggaaggggtggacctgtaccagcaccggggcgccccagatccctttttgaatctcaactcagtgcctcctgggggtggctgcaggttttatttgtatcctaaatgagtggcatgttaacagggtctgcaactgtcactaagtaaaacctccacaggatcttaggcacaaaccattcaaatcatagtggaaaggtcgcccagtaatttctttttctttttctttctttytttttttttctggagacagggtcttgctctgtcacccaggctggagtgcagtggtgtgatctcagctcactgcaacctctgcctcctgggttcaagcgattctcctgcctcagcctcctgagtaactgggatgacaggcgtctgccaccacacctggctaatttttgcatgtttagtagagatgggggtttcaccatgttgcccagactggtcttgaactcctgacctcaagtgatctgcctacctcaatctcccaaagtgctgggattacttgcttgtgccactgtgtctggcccaggc

SEQ ID NO: 184441 - DNA, 601 bp, Human
tgtgagtgtgtgcgtgtgtgtgttagaaaaagagtgggtatgtctctttaagggagaaaaggctagagacaaaggaaatgtgtttttgagaaagtgaattcctttatttaatagttgtgtgtgtcacagaggaagaggtctcccatgggaagggatcccagccatgtcccatcaaacctaacctgctcctgccctgtccccaaaccccagttcccagggccccatctgccccatcggcctctctggctgtaccatagacctcaaagtcaagaaaaggtcttttcggcttccttccctagcrccctagagctgtgctacaccatttggtaacaattagttgcatgtagtttgttaaatgaaaatgaattaagattagaaattcagtccttaattatgctaagggaactaggacagatgcagaaagaaaaaaatattgcatgatctcacatgtgaaatctaaaaacgcaaaagtcagttatacagaaatagtgaataaaacagggctgatgggccggaggtggggagagggaatggagagacgtaggtcacaggatgcaaagtagcagctatggatgacgaataagtctagagatctaatgca

SEQ ID NO: 184442 - DNA, 601 bp, Human
gggcagagcgtggacgagagagaccgggatgaggtataagagtgtgtgtgagagaggctggaggagagagtgtgaaagtgtatacaagaccctgtgacaaagggtgtgagtgtgtgcgtgtgtgtgttagaaaaagagtgggtatgtctctttaagggagaaaaggctagagacaaaggaaatgtgtttttgagaaagtgaattcctttatttaatagttgtgtgtgtcacagaggaagaggtctcccatgggaagggatcccagccatgtcccatcaaacctaacctgctcctgccctgwccccaaaccccagttcccagggccccatctgccccatcggcctctctggctgtaccatagacctcaaagtcaagaaaaggtcttttcggcttccttccctagcgccctagagctgtgctacaccatttggtaacaattagttgcatgtagtttgttaaatgaaaatgaattaagattagaaattcagtccttaattatgctaagggaactaggacagatgcagaaagaaaaaaatattgcatgatctcacatgtgaaatctaaaaacgcaaaagtcagttatacagaaatagtgaataaa

SEQ ID NO: 184443 - DNA, 601 bp, Human
aaaacatactttaaatcaaaacttttacaatagaaatagaggacattatatattaataaaagggccaattcatacataagatataacaattataaatatatacacaccaaataatggggtcctaaaacatatgaggcaaacaatgaatgaactgaagtaagaaatagacagttctacaataacagttgctgatttcaacattccaccttcagtgatgggtagaacagccagacagaaggtcaataaagaaatagaggacttgaacaacattaaaaaccagctagacctaacagacctctcyagaacgtgccacccaacaacttcagaatacacattttttcaagtgcacatggaacattttccagaatgaggcatgttaggctacaaaagaagtttgaacaaattcataaagattgaaattatatgaattatattctccaaacgcaatgaaaggaggtaggaatcaataccagaagcaaaactagttaattaaaaaagcatgcagacattaaacaatacactcttaaacaaccgatgggtcaaagaaaaaaaattataagggaaataagtcattctgggaatgaatgaaaatgaaaacata

SEQ ID NO: 184444 - DNA, 601 bp, Human
cacaataatcttatgcatccactgtcatataaaacagtctgtcattgaccaaaatgtcataatgtggcaaatgactgtgcatcacattgtctgtactcattcatccattagtggacacgttggttgattccatatctcagctagtgtgaataatgtattgaacatgggcgttcagatatctctttgagatactgattttatttcctttggctatatgcccagtaatgggatttctggatcatgtgatggctctatttgcaatcttttgaggaaacttcacattattttccataatggctgyagtaatttacattcccaccaatgtgtgcataggttcccttctgccacatcctcgccaatacttactatgtttagtctttttgataatggccattttaatgagtgtgaggtgatattgtggtttaatttgcatttccctgatgacttgtgatgttgggcatttttccatgtacctgtcggtaatttgtattagacaaaacatactttaaatcaaaacttttacaatagaaatagaggacattatatattaataaaagggccaattcatacataagatataacaattataaatatatacaca

SEQ ID NO: 184445 - DNA, 601 bp, Human
aatgcagtcatttattattgagcattatgtactgtacataattgcatgtgctagacttttgttatgatggacagaacagtaggtttgttaacatcagcatcaccataaacatgtaagtaatgcattgcactacaatattgagacagctatgatgtcactaggtgatacaaaattatcagctccacaataatcttatgcatccactgtcatataaaacagtctgtcattgaccaaaatgtcataatgtggcaaatgactgtgcatcacattgtctgtactcattcatccattagtggacackttggttgattccatatctcagctagtgtgaataatgtattgaacatgggcgttcagatatctctttgagatactgattttatttcctttggctatatgcccagtaatgggatttctggatcatgtgatggctctatttgcaatcttttgaggaaacttcacattattttccataatggctgcagtaatttacattcccaccaatgtgtgcataggttcccttctgccacatcctcgccaatacttactatgtttagtctttttgataatggccattttaatgagtgtgaggtgatattgt

SEQ ID NO: 184446 - DNA, 601 bp, Human
ctgaacatctgaaggaacaaactctggacacaccatctttaagaactataacactcactgcgagggtctgtcgcttcattcttgaaatcggctagaccaagaacccaccaattccagacacaaaatcatgagtgaactcccattcacaattgctacaaagagaataaaatacctaggaatccaacttacaagggatgtgaaggacctctttaaggagaactacaaaccactgttccactggtcaaggaaataagataggacacaaacaaatggaaaaacattccatgcttatggataggargaatcaatattgtggaaatggccatactgcccaatgtaatttatagattcaatgctatccccatcaagctactattgactttcttcacagaattagaaacaactactttagatttcatatggaaccagaaaagagcccgtatagccaagacaatcctaagcaaaaaggacaaagctggaggcatcatgctacctgacttcaaactatgctacaaggctacagtaaccaaaacagcatggtactggtaccaaaacagatatgtagaccaatggaacagaacagaggcctcagaaataacgc

SEQ ID NO: 184447 - DNA, 601 bp, Human
aagagctgcaacactcaccgtgaaggtctgcagcttcattcctgaagtcagcgagaccacgaacccaccagaaggaagaaactctggacacatctgaacatctgaaggaacaaactctggacacaccatctttaagaactataacactcactgcgagggtctgtcgcttcattcttgaaatcggctagaccaagaacccaccaattccagacacaaaatcatgagtgaactcccattcacaattgctacaaagagaataaaatacctaggaatccaacttacaagggatgtgaaggacctytttaaggagaactacaaaccactgttccactggtcaaggaaataagataggacacaaacaaatggaaaaacattccatgcttatggataggaagaatcaatattgtggaaatggccatactgcccaatgtaatttatagattcaatgctatccccatcaagctactattgactttcttcacagaattagaaacaactactttagatttcatatggaaccagaaaagagcccgtatagccaagacaatcctaagcaaaaaggacaaagctggaggcatcatgctacctgacttcaaactat

SEQ ID NO: 184448 - DNA, 601 bp, Human
acaataaatcttgctgctgctcactctttgggtccgcgtcacctttatgagctgtagcactccctgcaaaggtctgcagcttcacttctgaggccagcgagaccacaaacccaccagaaggaacgaacaactccagacacgctgcctttaagagctgcaacactcaccgtgaaggtctgcagcttcattcctgaagtcagcgagaccacgaacccaccagaaggaagaaactctggacacatctgaacatctgaaggaacaaactctggacacaccatctttaagaactataacactcacygcgagggtctgtcgcttcattcttgaaatcggctagaccaagaacccaccaattccagacacaaaatcatgagtgaactcccattcacaattgctacaaagagaataaaatacctaggaatccaacttacaagggatgtgaaggacctctttaaggagaactacaaaccactgttccactggtcaaggaaataagataggacacaaacaaatggaaaaacattccatgcttatggataggaagaatcaatattgtggaaatggccatactgcccaatgtaatttatagattcaatgctat

SEQ ID NO: 184449 - DNA, 601 bp, Human
caggtaggggacttggagaacttttgtgtctagctaaaggtttgtaaacgcaccaatcagcactctgtcaaaacggaccactcagcactctgtaaaatggaccgatcagctctctgtaaaatggaccagtcagcattatgtgggtggggccaaataagggaataaaggcaggccaccgggagccagctgcggcaacccgctctggtctccttccacggtgtggaagctttgttctttcgctcttcacaataaatcttgctgctgctcactctttgggtccgcgtcacctttatgagctgtrgcactccctgcaaaggtctgcagcttcacttctgaggccagcgagaccacaaacccaccagaaggaacgaacaactccagacacgctgcctttaagagctgcaacactcaccgtgaaggtctgcagcttcattcctgaagtcagcgagaccacgaacccaccagaaggaagaaactctggacacatctgaacatctgaaggaacaaactctggacacaccatctttaagaactataacactcactgcgagggtctgtcgcttcattcttgaaatcggctagaccaagaacccaccaattc

SEQ ID NO: 184450 - DNA, 601 bp, Human
ggagcccttcagccggcctctgtgcactctgctccaggggaagtgtgaagagagaggcgcgggagggagcccgggctgggcgccgcgctcgcgggcaggcgcgggttccaggtgagcgcggctccgcaagccccgcactcaggcgtggccggcctcacctgctaggcttgataggaagctgaattccctgcgtagaccgccgttccctcttcacgggatcgttggccaagatagcaggtctccgtctctttctgcttcccctctttccctcttgattgtctgggaggagctccctctgggmtgctggagtgcccgggctaggtgtcgcaaagtcccgctgccctgccaatgccagtgagagatgaagccggctgggcttctgggacggatggggacttggagaacttttctgtctagctaaaagattgtaaacgcaccaatcagcactgtgtctagctaaaggtttgtaaacgcaccagtcagcgctctgtgtctagctaatcaggtaggggacttggagaacttttgtgtctagctaaaggtttgtaaacgcaccaatcagcactctgtcaaaacggaccactcagcactctgtaaaatg

SEQ ID NO: 184451 - DNA, 601 bp, Human
ggctggttcaacataagcaagtcaataaacataatccatcacataaacagaaccaatgacaaaaaccacatgattacctcaatagatgcagaaaaggccttcaataaaattcaacaccccattcatgctcaaactctcaataagctaggtattgatggaacatagctcaaaataataagagctagttatgacaaacccatagacagtattatactgaatgggcaaaagctggaaacattccctttgaaaacctgcacaagacaaggatgccctctctcaccactcctattcagcatagtaytggaagttctggccagggcaatcaggcaagagaaagtaataaagggtattccaataggaagagaggaagtcaaattgtctctgtttgcagatcacatgattctatatttagaaaaccccactgtctcaagccaaaatcccgtcaagctgatcagcaatttcagcaaaggctcaggatacaaaatcaatgtgcaaaaatcacaagcattcctacacaccaataatagataaacagagagccaaattgagaggtgacaaagtgctagcagccctcgctcgctctcggcgcctgccggcgcct

SEQ ID NO: 184452 - DNA, 601 bp, Human
aggaagaagtcaaatccctgaatagactaataataagttctgaaattgaggcagtaattaatagcctaccaaccaagaaagcccaggaccagacagattcaaggccaaattctactagaggtacaaagaggagctggtaacatttcttctgaaactattccaaacaatagaaaaagagggactcctccctaactcattttatgaggcaaacatcatcctgataccaaaagctggcagagacacaacaaaaaaagagaatttgaggccaatatccctgatgaacactaatgtgaaaatactsaataaaatactggaaaaccaaatgcagcagcacatcaaaaagcttatccaccatgatcaagtcggctgcatccctgggattcaaggctggttcaacataagcaagtcaataaacataatccatcacataaacagaaccaatgacaaaaaccacatgattacctcaatagatgcagaaaaggccttcaataaaattcaacaccccattcatgctcaaactctcaataagctaggtattgatggaacatagctcaaaataataagagctagttatgacaaacccatagacagtattatactg

SEQ ID NO: 184453 - DNA, 601 bp, Human
tggcaactgggataactgtgagaaggagtttcagaatgatttcatttaacatagattactatgtacttgactttgttctaaaatttttacaaatgttaaactcgtgtactattcagaacaactctagaggtaaattctgttatcatctgcactttgaagaagaagagactgaggttgagagaggatacattttgcaggtcatgcagcaggaagatatgaggctaaaaggaggaagtggctggataacatcagcaagacagcatggatccaaatgaccatctcagacttttcaccaaattaytagagagaaatcctgaggagtccgaccacctgctttaagtggttggaggaatgatgacttttgttcaacagtgtcatgcaaaggcagagagaagggtatctggcacatagttggtatacaattaaaggaaaaataaatatataattaccataatatcaccatatttacagaagggaccaattaactcttttgctttatggcttcataggcacatattgtatgcattaaattcactaattttaagtgttttgaattattcaaactttagtaaatatatatagtcataaaatcctcatgaca

SEQ ID NO: 184454 - DNA, 601 bp, Human
ataactgtttctaaattgccaagtaaaattgtatcacttgatatgatattgaacattgttctaagtactacaagcaatggcaactgggataactgtgagaaggagtttcagaatgatttcatttaacatagattactatgtacttgactttgttctaaaatttttacaaatgttaaactcgtgtactattcagaacaactctagaggtaaattctgttatcatctgcactttgaagaagaagagactgaggttgagagaggatacattttgcaggtcatgcagcaggaagatatgaggctraaaggaggaagtggctggataacatcagcaagacagcatggatccaaatgaccatctcagacttttcaccaaattattagagagaaatcctgaggagtccgaccacctgctttaagtggttggaggaatgatgacttttgttcaacagtgtcatgcaaaggcagagagaagggtatctggcacatagttggtatacaattaaaggaaaaataaatatataattaccataatatcaccatatttacagaagggaccaattaactcttttgctttatggcttcataggcacatattgtatgc

SEQ ID NO: 184455 - DNA, 601 bp, Human
cgcaagagtctggtaattaattggaaattcaataaagaggtctaagaaacaaagattaaccaaagtctcaaataatgtatctattacaatatgcattattaagcatgcaataaatacacacacacacacacacacacacacacacacgagagagagagagagagagagagagagagaaaatataaggaagcttcctcaatctgataaagagtatccactaagattcttctgctataattatgcttaattgtgaaagattgaatgattttgccactaagatctggaacaagacaaggacagyggtcttattcaatatcatatcatcaacttagccagtgcaataaagtgagaaacagaaaaggaaaggtatacagattggaaagaaagaaataaaaccacctttaatttcagatgacatgactaaaaattctgtaaaatcaattttaaaagctattagaacaaataagtgagtttaacaaggttttagaaaacaaggccagtatttaaaaaattagttgtatgtctacacactggcaatgaacaactggaaactgaaatttgaaaaacattactatttacagtagctcaaaaatatccccag

SEQ ID NO: 184456 - DNA, 601 bp, Human
ttttttattgcattcaaatttatcttctgctttacatgagattttatgctcttaacatttaattagccacacaatcagttgggtccatgcaaatgtttttcatttatgaatgcagtaataaataagataactcctaggagaaaaatacgcaagagtctggtaattaattggaaattcaataaagaggtctaagaaacaaagattaaccaaagtctcaaataatgtatctattacaatatgcattattaagcatgcaataaatacacacacacacacacacacacacacacacacgagagasagagagagagagagagagagagaaaatataaggaagcttcctcaatctgataaagagtatccactaagattcttctgctataattatgcttaattgtgaaagattgaatgattttgccactaagatctggaacaagacaaggacagcggtcttattcaatatcatatcatcaacttagccagtgcaataaagtgagaaacagaaaaggaaaggtatacagattggaaagaaagaaataaaaccacctttaatttcagatgacatgactaaaaattctgtaaaatcaattttaaaagctat

SEQ ID NO: 184457 - DNA, 601 bp, Human
ccttttttattgcattcaaatttatcttctgctttacatgagattttatgctcttaacatttaattagccacacaatcagttgggtccatgcaaatgtttttcatttatgaatgcagtaataaataagataactcctaggagaaaaatacgcaagagtctggtaattaattggaaattcaataaagaggtctaagaaacaaagattaaccaaagtctcaaataatgtatctattacaatatgcattattaagcatgcaataaatacacacacacacacacacacacacacacacacgagasagagagagagagagagagagagagaaaatataaggaagcttcctcaatctgataaagagtatccactaagattcttctgctataattatgcttaattgtgaaagattgaatgattttgccactaagatctggaacaagacaaggacagcggtcttattcaatatcatatcatcaacttagccagtgcaataaagtgagaaacagaaaaggaaaggtatacagattggaaagaaagaaataaaaccacctttaatttcagatgacatgactaaaaattctgtaaaatcaattttaaaagct

SEQ ID NO: 184458 - DNA, 601 bp, Human
tgccttttttattgcattcaaatttatcttctgctttacatgagattttatgctcttaacatttaattagccacacaatcagttgggtccatgcaaatgtttttcatttatgaatgcagtaataaataagataactcctaggagaaaaatacgcaagagtctggtaattaattggaaattcaataaagaggtctaagaaacaaagattaaccaaagtctcaaataatgtatctattacaatatgcattattaagcatgcaataaatacacacacacacacacacacacacacacacacgasagagagagagagagagagagagagagaaaatataaggaagcttcctcaatctgataaagagtatccactaagattcttctgctataattatgcttaattgtgaaagattgaatgattttgccactaagatctggaacaagacaaggacagcggtcttattcaatatcatatcatcaacttagccagtgcaataaagtgagaaacagaaaaggaaaggtatacagattggaaagaaagaaataaaaccacctttaatttcagatgacatgactaaaaattctgtaaaatcaattttaaaag

SEQ ID NO: 184459 - DNA, 601 bp, Human
ctaatttttgtatttttagtagagacggggtttcaccatgttgggcaggatggactcaatctcttgacctcttgagccactgtgtgcggccacaattcagttgcttaacactagtatcctttataaaaatctctgattcccaggggaatccagaatggagtggtgcattgggaagagaacatcttttattaactaaagtggttttcaatttaaagtgtgttcattaaaagccttcataaaggcaatcatagcacactgtgttttctttttcttttttctttttctttttttttttttttttgagaaggagttttgctcttgtctcccaggctggagagcaatggcacaatctcggctcattgcaacatccacctcccaggtttaagcgattctcctgcttcagcctccccagtagctgggattgcaggtgctcgccaccatacccagctaatttttgtatttttagtagagatggggttttgccatgttagccaggctggtctcgaactcctgacctcaggtgatccacctgcctcggcctctcaaagtgctgggattacaggcgtgagccactgtgcccggcccacaatgtgttttcaat

SEQ ID NO: 184460 - DNA, 601 bp, Human
taagtgctagatacattttctgtgtgggcctactatgctcaaaattgtttcttctgagatttgagaagaagggtctttgaaaactgctctcagtttatacatgtttaattcagtgaaaaaagacagcacttcatacattatttgtgtgtcatatattgctttaagtatttagggtgtctatgcatatgttcctggaagctctaactgggctcccaaatgttattttctgagtgtgtacaaaacatatttttaaaaagtgatcaatgtcaaaacatgttgaatttagtgaaagaaaactgcrtatcatctaggtttttggcacaaagcttgcatgtactttttatgcctagatacttgcatgtttcgtgtgggtgaactgtgctcataattgtgttttctgagatttgacaagttgtgtcttttaaaattgctcttaattaatacgtgttgagttcagagaaagaaaacagcacatcatacattatctgtgtgccatatattgctattagcatttatgactatatatgcatctcttcctggaagtgctaactgggctttaacattttttgtgtgtgtgcttgtacaaaacatgatttcgaaa

SEQ ID NO: 184461 - DNA, 601 bp, Human
tctagttgtctaacataaatcttgtgtttaccttttagggctagatattagcattttctgtgtaagcctactatggtcacaatagtgttttctgagatttgacaagatgtctttttgaaaactggtcttggttaataaatattgaattcactgaaagaacaaagtacatcatacattatttgtatgtcatatcttgcttttagcatttagtggtgtgtatgcatatcttcctggaagtgctaactgggctccaaaatgtaattttctgagcttgtagaaaacgtgttatttaaaggtgatmaatttcaaaataccctgaattcagtgagagaaaacaacacatcatctaggtttttgggataaagtttgcatttaacttttagggataaatactctcatgttctttgtgagcctactgtgctcagaattgtgttttctgagatttgccaagaagtgtcttcaaaaactgctcttagttaatacattttgaattcagtgaaagaaaatagcacatcatacattattggtgtgccatatcttgcttttagcatttagggctctatatgcatatcttcctggaagcacgaactaggctctgaat

SEQ ID NO: 184462 - DNA, 601 bp, Human
aagtgatcaatgtcaaaatatgttggattcaatgaaagaaaaccacttcatctaggtttttgacacaaagcttgcatttatttattgcagctgcatactcgcatgttgtgtgtgaacctactctgctcagaattgtgttgtctgagatttaacaagttgtttctttagaaactgctcttccttaatacatgttgaatttagtgaaagaaaagggcacatcataaattatttgtgtgccatacattgcttttagcatttagggctctatatgcacgtctttctggaagcagtaactgtgctyggaaatattttttctgggcttgtacaaaacgtgtttttgaaaagtgatcaatgtcaaaacatgttgaatttagtgaaagaaaacagcacatattctttgtttttgcacaaaccttgagtttacttttcagctctggaatgcatatgttctgtgtcagcctactgtggtcagaattgtgttttctgagatttgacaagctgtgtctttgaaaactgctcttggttaatacatattgaactcagtaaaaaagcacatcttacattatttgtgcaccatatcttgcttttaacatttgggaat

SEQ ID NO: 184463 - DNA, 601 bp, Human
tagcttgtactaaacgtctttttaaaaagtgatcaatgtcaaaatatgttggattcaatgaaagaaaaccacttcatctaggtttttgacacaaagcttgcatttatttattgcagctgcatactcgcatgttgtgtgtgaacctactctgctcagaattgtgttgtctgagatttaacaagttgtttctttagaaactgctcttccttaatacatgttgaatttagtgaaagaaaagggcacatcataaattatttgtgtgccatacattgcttttagcatttagggctctatatgcacrtctttctggaagcagtaactgtgctcggaaatattttttctgggcttgtacaaaacgtgtttttgaaaagtgatcaatgtcaaaacatgttgaatttagtgaaagaaaacagcacatattctttgtttttgcacaaaccttgagtttacttttcagctctggaatgcatatgttctgtgtcagcctactgtggtcagaattgtgttttctgagatttgacaagctgtgtctttgaaaactgctcttggttaatacatattgaactcagtaaaaaagcacatcttacattatttgtgcacc

SEQ ID NO: 184464 - DNA, 601 bp, Human
tctttgaaaactgctcttaggtaatacatgttgaatttagggaaagaaatagcacatcatgcattatttgtgtgccatatcttgctttttgcatttagggctgtatatgcatatcttcctggaagcacgaactggacttttaaaagttttttttgagctttacaaaacgtttcttgaaaagtaatcaatgtcaaaacatgttgagttcacttgggaaaaaaaagcacatcatctacattgttaacacaaagcttgcgtttacctttcaggactagatattcacattttctgtgtcggcctrttatgtttgcaattatttcttccgatatttgacaagaggtgtctttgaaaactgctcttagttaatacatgttaagttcagtgaataaaacagcacagcatacattatttatgggccatatcttgcctttagcattcaggactgtataagcatatctccctggaagcactaactgggctgcgaaattttttttttagcttgtactaaacgtctttttaaaaagtgatcaatgtcaaaatatgttggattcaatgaaagaaaaccacttcatctaggtttttgacacaaagcttgcattta

SEQ ID NO: 184465 - DNA, 601 bp, Human
ggcctactatgctcaccattgttttttcttgtatttgacaaggtgtctctttgaaaagtgcttttagttaacacatgttgaattcagtgaaagaaaacggcacatcacatattatttttgtgccatagcttgctgtcagcatttaaggagttaaaacatatcttcctggaagcactaactgggctttcaaatgttattttctgcgcatgtacaaaacgtgtttttgaaaaatgataaaagtcaaaacatgatgaattcagtgaaagacaagagcacatcatctgagtttttggcacaaagyttgaggttaccctttagggttagatatttgcattttctctgtgaaactactatgttcagaattgtgtttcctgagatttgacaagatgtgtctttgaaaactgctcttaggtaatacatgttgaatttagggaaagaaatagcacatcatgcattatttgtgtgccatatcttgctttttgcatttagggctgtatatgcatatcttcctggaagcacgaactggacttttaaaagttttttttgagctttacaaaacgtttcttgaaaagtaatcaatgtcaaaacatgttgagttcac

SEQ ID NO: 184466 - DNA, 601 bp, Human
ataagaaaacagagtccctgctttcctcatgcactaaacaggtgtatcttgtttaattgcactttgttttattctgctttgcagatattgcatttttttaaccaatttaaggtttatgtcaaccgtgcatagagcaagtctatttgggacattttttctgatagtatgtgttcactttttgtcagtgtctcatttttgtaattctcgtagtagctcaaatttttcattattattattattatatctgttatgatgatctgtgatgagtgatcttttatgttagtattgtaattgacagagsagaagcatcaccatcttggacaagccctcattctaaagttcaccttactcaaaaaccacctaaatccaaagggcatcagcctaatggttaaggtcagcatgaccataaaccacatataacatctccagccagaaacattccaaacttgtccccaaccagagacatgctagccccaaaataacacccctccagccagaaagaggtcagccccaagataaccaacctcccctctgcccagagacattccacaatgttatgtgacattccaaccccaccataaattcctcccccacacagaaa

SEQ ID NO: 184467 - DNA, 601 bp, Human
ctggagtgggcccctccaactggggtggtctcccgaggggcgcggctgcttggagtagacaggatttgtgggattttcctcccgtcctaggaggagcgaggctggggacagggcggtaggtttgagatctggcttcctgtgaacttggaaacccgtcaccccccccgccgggggaaaaaggagggactgagcatgagccccggactccgagtgggattctcccaggatcctcccgcggccctgaacatccaggagacccgggagactggcaggacgccccatccagctgctcgcccagccmactctgcggccggagggaaccctggggggcaagccatgaccggggtcccaggtcacagccccagagctgaccgcgggagggacggggccaccagctccatatgcggcccgccagccgcatcccgccggctccaccagcccatccccagtctggggacgcctgcccctttcactcaccattctcgtcttcggggctgtcctggcgtcctccctatggctcctggagtgtgcagatctcagcgaacagcagagacgccaaacccagtgcagcgggcgcgagaagcaggactctgccagaaac

SEQ ID NO: 184468 - DNA, 601 bp, Human
tgcgctcaccgcccagggagcagaggcattggtgttagagttcccatacctggggaatcgaggggcctcctggtggtccctcacgagaaggggcgggcacagggggaggaggagcgcgtcccggtgtagcggtggctggagtgggcccctccaactggggtggtctcccgaggggcgcggctgcttggagtagacaggatttgtgggattttcctcccgtcctaggaggagcgaggctggggacagggcggtaggtttgagatctggcttcctgtgaacttggaaacccgtcaccccccccgccgggggaaaaaggagggactgagcatgagccccggactccgagtgggattctcccaggatcctcccgcggccctgaacatccaggagacccgggagactggcaggacgccccatccagctgctcgcccagccaactctgcggccggagggaaccctggggggcaagccatgaccggggtcccaggtcacagccccagagctgaccgcgggagggacggggccaccagctccatatgcggcccgccagccgcatcccgccggctccaccagcccatccccagtctggggacgcctgccc

SEQ ID NO: 184469 - DNA, 601 bp, Human
gctgcgctcaccgcccagggagcagaggcattggtgttagagttcccatacctggggaatcgaggggcctcctggtggtccctcacgagaaggggcgggcacagggggaggaggagcgcgtcccggtgtagcggtggctggagtgggcccctccaactggggtggtctcccgaggggcgcggctgcttggagtagacaggatttgtgggattttcctcccgtcctaggaggagcgaggctggggacagggcggtaggtttgagatctggcttcctgtgaacttggaaacccgtcacccccyccgccgggggaaaaaggagggactgagcatgagccccggactccgagtgggattctcccaggatcctcccgcggccctgaacatccaggagacccgggagactggcaggacgccccatccagctgctcgcccagccaactctgcggccggagggaaccctggggggcaagccatgaccggggtcccaggtcacagccccagagctgaccgcgggagggacggggccaccagctccatatgcggcccgccagccgcatcccgccggctccaccagcccatccccagtctggggacgcctgc

SEQ ID NO: 184470 - DNA, 601 bp, Human
gtgcgcaggaacgcggtggtggcagggtcccagactgcccagcctaggacgggcgggataccggactgtagagcagacgaagggcggggtctcagctacggagctatggacccaaggatgggcgtgcgcacgccgcgctgcctgaccagtctgcgggccggttgtgcttgccgggggacaagggctccagaagcagtcaagggattctcctgcctcagtctcctgagtagctgggactagaggcgcccgccacccgcaccatcacgcccagcaaatttttttttttaaatttttttttttrttatactctaagttttagggtacatgtgcacattgtgcaggttagttacatatgtatacatgtgccatgctggtgcgcaaatttttttgtatgtttagtagagatgggggtttcgccattttggccaggctgctctcgaactcctgtcctcaagtgatccgcccgcctcggccttccaaagtgctgagattacaggtgtaagccaccgcgtccggccctttttcgggtccgggatggaaatcgaggcagcccagcccctggccgaaggacccgtgggcgctgcgctcaccgcccagggag

SEQ ID NO: 184471 - DNA, 601 bp, Human
cgcgcggcacaggtgcgcaggaacgcggtggtggcagggtcccagactgcccagcctaggacgggcgggataccggactgtagagcagacgaagggcggggtctcagctacggagctatggacccaaggatgggcgtgcgcacgccgcgctgcctgaccagtctgcgggccggttgtgcttgccgggggacaagggctccagaagcagtcaagggattctcctgcctcagtctcctgagtagctgggactagaggcgcccgccacccgcaccatcacgcccagcaaatttttttttttaawtttttttttttgttatactctaagttttagggtacatgtgcacattgtgcaggttagttacatatgtatacatgtgccatgctggtgcgcaaatttttttgtatgtttagtagagatgggggtttcgccattttggccaggctgctctcgaactcctgtcctcaagtgatccgcccgcctcggccttccaaagtgctgagattacaggtgtaagccaccgcgtccggccctttttcgggtccgggatggaaatcgaggcagcccagcccctggccgaaggacccgtgggcgctgcgctca

SEQ ID NO: 184472 - DNA, 601 bp, Human
agacgcgcggcacaggtgcgcaggaacgcggtggtggcagggtcccagactgcccagcctaggacgggcgggataccggactgtagagcagacgaagggcggggtctcagctacggagctatggacccaaggatgggcgtgcgcacgccgcgctgcctgaccagtctgcgggccggttgtgcttgccgggggacaagggctccagaagcagtcaagggattctcctgcctcagtctcctgagtagctgggactagaggcgcccgccacccgcaccatcacgcccagcaaatttttttttttaaatttttttttttgttatactctaagttttagggtacatgtgcacattgtgcaggttagttacatatgtatacatgtgccatgctggtgcgcaaatttttttgtatgtttagtagagatgggggtttcgccattttggccaggctgctctcgaactcctgtcctcaagtgatccgcccgcctcggccttccaaagtgctgagattacaggtgtaagccaccgcgtccggccctttttcgggtccgggatggaaatcgaggcagcccagcccctggccgaaggacccgtgggcgctgcgc

SEQ ID NO: 184473 - DNA, 601 bp, Human
aggaatccgagtagaagtggtcagggatggagcccagggccacctcatccttcttcctcctggagccaaacagcttcttcatcgcggcagcttcggagaagcctcagctaccctgcagctccccttcgccttttcgcggaatccggagtccagtcacaattagctaagcccggggcaccaaagcctttagcagcgaaaccgccgcttccgacctctcggacctagtgagccaggcagagcctttaggcccacgcctgggcaccacagccagcccgaggcccaggaagccgctcccaggctrcgcgcggctggcgctgggcttccagtgccggactgccagaacaggctgggagcgctggggtcttggcgctctgcagccaccagagatctggccgagtgggtctggttacccccacccctgtgctgccacagcccggcagatcgcctagcttggctgccccagctgccgcatctgtccctctgtccgcgtctctgggagcccggcggggtgggaggttgctggctgttgctgtccactccggatcctgaggccgcccagggcactcctaccccgcctgcctcggtgcccctgacctgcagt

SEQ ID NO: 184474 - DNA, 601 bp, Human
gtacattatgtgtattgttagattttcacatctaaattgagaagggaggaaatcaggaaagcaacatttctttagaagacaaagagagtgggtattacctgggcacgatcttcttcatcctttgatttcatagatgttacactgaaaattttcaggaaatgtttaaaagaaacagaaaaaagaaaaaagaaacctgatttttaatagcaaaatgtttgaaatgacaattcagcaaagaagatatacagatggcaaataaacacataaaaagaagcttaatattattagtcattcaggtaayaaacatgaaaaacataatgatgtgcacaacacacacccttcagaatgactcaaaatataaaataaatgctgatgctaagtgtttgtgatgacacacagagcaactggaattgtcatatacagctgcagaaacagaaaatggtacatatactttggaaaataattcagcagtttcctgataaaagaacataaagtggcacaatgagacttctgtggatgatgaatatcttaacttccttgattacggtgatgatttcatatttgcatatatttcaaaacttatcaaatcatacatcttata

SEQ ID NO: 184475 - DNA, 601 bp, Human
ataacataaaacacccaacccaaaacatctcacacagaatccccatggggtgctaactaatccaaaccaaaagcattgctattttacagtagcagtggcagaaaaaagccggtgttctcagaaaaatcaactttaaataataaagcaagaaaagatgatcacaaacacagcacactcaaagctccaaggaggaaaactgatgctgaggaaaatgcctctacattacacttgataatgaatactgtcattttaaaatgtcttagggtatcaggtgtcagttgggaggagagtcccactgaayaccacccccacaaagagaattgtatatgttgtacattatgtgtattgttagattttcacatctaaattgagaagggaggaaatcaggaaagcaacatttctttagaagacaaagagagtgggtattacctgggcacgatcttcttcatcctttgatttcatagatgttacactgaaaattttcaggaaatgtttaaaagaaacagaaaaaagaaaaaagaaacctgatttttaatagcaaaatgtttgaaatgacaattcagcaaagaagatatacagatggcaaataaacacataaaaa

SEQ ID NO: 184476 - DNA, 601 bp, Human
ttaacaccagggccacatgcctaggcacatgttacctcctttccttaggggcttgtatgcttgggcatatgcatttagcaccttagtttcttcatctgaggagtacagatagtgaacaaccacaactcaggtgagggctgccgtgagggttgaatgggttaattaaataaaatgtgtattgtatatcttgaagaaagtagaggtgtatcaacttgcttggtatctcgcagcttagcaagttccagaggggcactcaaacccaggagataagcttccaagtcagggctaatgccatgacacagctgctttgtaccaaaataaccactttaacttaaccccaacctgatgttgaaggaatcagacacaggtatcaaaaatgcttttggtgacatcctgattctacacagtgactacttacaattttttaaaaattatattttctacaaaatgaatgagttacctgaccaaagatcaacaaatacctggtcaaataagatgaacaccagtttacctggggagatgaattgtcttctataacatcttggtgttctaaaaatatgacataatatcatcctgtatgatttactcctcctaaatagaa

SEQ ID NO: 184477 - DNA, 601 bp, Human
tatggttacaactgatggcagggttgtgagccaccctttttggggtgataactgcagttcaataattgattgtattaacaccagggccacatgcctaggcacatgttacctcctttccttaggggcttgtatgcttgggcatatgcatttagcaccttagtttcttcatctgaggagtacagatagtgaacaaccacaactcaggtgagggctgccgtgagggttgaatgggttaattaaataaaatgtgtattgtatatcttgaagaaagtagaggtgtatcaacttgcttggtatctcrcagcttagcaagttccagaggggcactcaaacccaggagataagcttccaagtcagggctaatgccatgacacagctgctttgtaccaaaataaccactttaacttaaccccaacctgatgttgaaggaatcagacacaggtatcaaaaatgcttttggtgacatcctgattctacacagtgactacttacaattttttaaaaattatattttctacaaaatgaatgagttacctgaccaaagatcaacaaatacctggtcaaataagatgaacaccagtttacctggggagatgaattg

SEQ ID NO: 184478 - DNA, 601 bp, Human
cttacacatccctcctcacaaattctatcaactataacattatttttaaactgctatttttttttcttttgagacagagtcttgctctgtcaccgggctggagtgcagtggtgcgatcttggctcactgcagcctccgcctcctgggttcaagtgattctcctgtctcagcctctggagtagctgggactacaggcacatgccaccagacccagctaatttttgtatttttagtagagataggatttcaccatgttggccaggatggtctcaatctcttgacctcgtgagccacccgcctsggcatcccaaagtgtttatgaatatttctaagtgctgcttcctaatattcagaaacttgtatttgtccctagtatcagaggtatacgggccttctatgtccttttatcaccaatggctatgttaaatcttgcagtttcaaatgctgatgttttccctaagctctgtgactactgtagccaccttgtagacgatgtttgggatttctgtagacccatgtaaacctaggactggcatgggtaagggaatcaccttatggttacaactgatggcagggttgtgagccaccctttttggggtga

SEQ ID NO: 184479 - DNA, 601 bp, Human
aaataacatgcttaaaattcatctttctgtattcataattttaaaaagtcaactatttatcacaaaattctcccacttgtctctaccataaaactcttattagctccatcatcattattttccatttgtctattggttatgtttataacttgtaaagtgtgttctaaagctccttgtgtgatgtatctatgtaaatagtcacaaagtcccaaaacaattgaaatccttacatgtcccttacacatccctcctcacaaattctatcaactataacattatttttaaactgctatttttttttcttttgagacagagtcttgctctgtcaccgggctggagtgcagtggtgcgatcttggctcactgcagcctccgcctcctgggttcaagtgattctcctgtctcagcctctggagtagctgggactacaggcacatgccaccagacccagctaatttttgtatttttagtagagataggatttcaccatgttggccaggatggtctcaatctcttgacctcgtgagccacccgcctgggcatcccaaagtgtttatgaatatttctaagtgctgcttcctaatattcagaaacttgtattt

SEQ ID NO: 184480 - DNA, 601 bp, Human
atatcaacaccaaaatcagctgatctcatcttttctcttctgcatttatattgatttgttcctctgtatagttcagaggaactaaggacaggtgacggggctgaacagaaaccaaacacaaatatgttagtgatgggggaatatttacaataatacaaggtacgttcatttattgtgtggtgcaaagaattcaaaatttaaagaagagcaagataatacagaaaagagctcctaccacacccactcggctataggcacagtttttgtttctgttattagttgttctggtacttcctaagaytctaaataacatgcttaaaattcatctttctgtattcataattttaaaaagtcaactatttatcacaaaattctcccacttgtctctaccataaaactcttattagctccatcatcattattttccatttgtctattggttatgtttataacttgtaaagtgtgttctaaagctccttgtgtgatgtatctatgtaaatagtcacaaagtcccaaaacaattgaaatccttacatgtcccttacacatccctcctcacaaattctatcaactataacattatttttaaactgctattttt

SEQ ID NO: 184481 - DNA, 601 bp, Human
caagccaggcacagagatcccacatgaaaactgaatgtaaatcagatattacccatatcaacaccaaaatcagctgatctcatcttttctcttctgcatttatattgatttgttcctctgtatagttcagaggaactaaggacaggtgacggggctgaacagaaaccaaacacaaatatgttagtgatgggggaatatttacaataatacaaggtacgttcatttattgtgtggtgcaaagaattcaaaatttaaagaagagcaagataatacagaaaagagctcctaccacacccactcrgctataggcacagtttttgtttctgttattagttgttctggtacttcctaagattctaaataacatgcttaaaattcatctttctgtattcataattttaaaaagtcaactatttatcacaaaattctcccacttgtctctaccataaaactcttattagctccatcatcattattttccatttgtctattggttatgtttataacttgtaaagtgtgttctaaagctccttgtgtgatgtatctatgtaaatagtcacaaagtcccaaaacaattgaaatccttacatgtcccttacac

SEQ ID NO: 184482 - DNA, 601 bp, Human
tattttaaactttcaattttccatagatcattttctcagaagttgactgtattgtcactttgaatcattaaaccaagccaggcacagagatcccacatgaaaactgaatgtaaatcagatattacccatatcaacaccaaaatcagctgatctcatcttttctcttctgcatttatattgatttgttcctctgtatagttcagaggaactaaggacaggtgacggggctgaacagaaaccaaacacaaatatgttagtgatgggggaatatttacaataatacaaggtacgttcatttatwgtgtggtgcaaagaattcaaaatttaaagaagagcaagataatacagaaaagagctcctaccacacccactcggctataggcacagtttttgtttctgttattagttgttctggtacttcctaagattctaaataacatgcttaaaattcatctttctgtattcataattttaaaaagtcaactatttatcacaaaattctcccacttgtctctaccataaaactcttattagctccatcatcattattttccatttgtctattggttatgtttataacttgtaaagtgtgttctaaagc

SEQ ID NO: 184483 - DNA, 601 bp, Human
tttaattaacccattcaaccctcaaggcagccctcacctgagttgtggttgtgggcttagtgcttcatcgcaatcaaggttgatttttgaacctttaatatgagagtaggaacagaagggttttgaattcattaccacctcagaagctaacaccaagatccatggataaacagtgagtggacggacaggcagatgaacaggcagatttgatatgaaacaagtcctcttcaaagttaggaggaagaaaatattttaaactttcaattttccatagatcattttctcagaagttgactgtatygtcactttgaatcattaaaccaagccaggcacagagatcccacatgaaaactgaatgtaaatcagatattacccatatcaacaccaaaatcagctgatctcatcttttctcttctgcatttatattgatttgttcctctgtatagttcagaggaactaaggacaggtgacggggctgaacagaaaccaaacacaaatatgttagtgatgggggaatatttacaataatacaaggtacgttcatttattgtgtggtgcaaagaattcaaaatttaaagaagagcaagataatacagaaaag

SEQ ID NO: 184484 - DNA, 601 bp, Human
acacgacacctcctctccctggttgctcaggtcaaaaccctgagccaccgctggttcctttctatcttgtcctgccaccaatccacccataaatcatgggtgtcatggcattagccctgacttggaagcttatctcctgggtttgagtgcccctctggaacttgctaagctgcgagataccaagcaagttgatatacctctactttcttcgagatatataatacacattttatttaattaacccattcaaccctcaaggcagccctcacctgagttgtggttgtgggcttagtgcttcatygcaatcaaggttgatttttgaacctttaatatgagagtaggaacagaagggttttgaattcattaccacctcagaagctaacaccaagatccatggataaacagtgagtggacggacaggcagatgaacaggcagatttgatatgaaacaagtcctcttcaaagttaggaggaagaaaatattttaaactttcaattttccatagatcattttctcagaagttgactgtattgtcactttgaatcattaaaccaagccaggcacagagatcccacatgaaaactgaatgtaaatcagata

SEQ ID NO: 184485 - DNA, 601 bp, Human
gttcaaagaattgtgtctttcctatctgtctacacgacacctcctctccctggttgctcaggtcaaaaccctgagccaccgctggttcctttctatcttgtcctgccaccaatccacccataaatcatgggtgtcatggcattagccctgacttggaagcttatctcctgggtttgagtgcccctctggaacttgctaagctgcgagataccaagcaagttgatatacctctactttcttcgagatatataatacacattttatttaattaacccattcaaccctcaaggcagccctcacytgagttgtggttgtgggcttagtgcttcatcgcaatcaaggttgatttttgaacctttaatatgagagtaggaacagaagggttttgaattcattaccacctcagaagctaacaccaagatccatggataaacagtgagtggacggacaggcagatgaacaggcagatttgatatgaaacaagtcctcttcaaagttaggaggaagaaaatattttaaactttcaattttccatagatcattttctcagaagttgactgtattgtcactttgaatcattaaaccaagccaggcacagaga

SEQ ID NO: 184486 - DNA, 601 bp, Human
cctttcaaagagggagcccaccagagtcacctggaagacgggtgatgagacaaaccatcttcatccttgctgccttgactatctgagtcccaaatgtgttcaaagaattgtgtctttcctatctgtctacacgacacctcctctccctggttgctcaggtcaaaaccctgagccaccgctggttcctttctatcttgtcctgccaccaatccacccataaatcatgggtgtcatggcattagccctgacttggaagcttatctcctgggtttgagtgcccctctggaacttgctaagctgygagataccaagcaagttgatatacctctactttcttcgagatatataatacacattttatttaattaacccattcaaccctcaaggcagccctcacctgagttgtggttgtgggcttagtgcttcatcgcaatcaaggttgatttttgaacctttaatatgagagtaggaacagaagggttttgaattcattaccacctcagaagctaacaccaagatccatggataaacagtgagtggacggacaggcagatgaacaggcagatttgatatgaaacaagtcctcttcaaagttaggagg

SEQ ID NO: 184487 - DNA, 601 bp, Human
gggtctgtgagtaaggaggtccccagcgtgccgagaagactgaccaggagcagcatcaagatgaagtagaggcagtgctgtacactgcagatgagcaaaaggcccttgctgttctccatgcagctcagggtgtctggaggcccacttgacccccagtcaaaagaagccaaccgctagcctgaaagtcagcccccagaaggcaccctttcaaagagggagcccaccagagtcacctggaagacgggtgatgagacaaaccatcttcatccttgctgccttgactatctgagtcccaaatgtrttcaaagaattgtgtctttcctatctgtctacacgacacctcctctccctggttgctcaggtcaaaaccctgagccaccgctggttcctttctatcttgtcctgccaccaatccacccataaatcatgggtgtcatggcattagccctgacttggaagcttatctcctgggtttgagtgcccctctggaacttgctaagctgcgagataccaagcaagttgatatacctctactttcttcgagatatataatacacattttatttaattaacccattcaaccctcaaggcagccctcacc

SEQ ID NO: 184488 - DNA, 601 bp, Human
tgcagggtccaccccagagcaccctacctggcagcacttaacttgtttaacaggaattgggtctgtgagtaaggaggtccccagcgtgccgagaagactgaccaggagcagcatcaagatgaagtagaggcagtgctgtacactgcagatgagcaaaaggcccttgctgttctccatgcagctcagggtgtctggaggcccacttgacccccagtcaaaagaagccaaccgctagcctgaaagtcagcccccagaaggcaccctttcaaagagggagcccaccagagtcacctggaagacrggtgatgagacaaaccatcttcatccttgctgccttgactatctgagtcccaaatgtgttcaaagaattgtgtctttcctatctgtctacacgacacctcctctccctggttgctcaggtcaaaaccctgagccaccgctggttcctttctatcttgtcctgccaccaatccacccataaatcatgggtgtcatggcattagccctgacttggaagcttatctcctgggtttgagtgcccctctggaacttgctaagctgcgagataccaagcaagttgatatacctctactttcttcga

SEQ ID NO: 184489 - DNA, 601 bp, Human
gtttacccactgcccatgttcactgaaagttattccagttcagctttttcagtccagctgagcaatgaactccacctaaattctgcccctcctctgctataaaacaaagtagaagaagaaaaatgtagaagtggcaaagagatccattgagtaacccatccaagaaatacatgtggcaggtctgtcatagtaatggagtgatgctgggtattgtggggcacagataattcggttcttgctcttcaaggattgtttattaatagtaacaataacagcagctaatactaagatgaggcgtacrtatgcgaaacactgttctaagtgctttacattgattaactcatttaatcctcataactgatctttgaggtagatattattacatccatttaactgagccacagaaaagttaaatattcatccgggatcacacacactagtaagggcaaggctaggatcggcatcctggcagtctgctccagagcctgccatgctctcacctactgcactacagtgggggctgaatgtccattggcttcattccccctgggtgggtaacagctgggagtgccctgattgtattaattcatactaaggttgg

SEQ ID NO: 184490 - DNA, 601 bp, Human
tggtgttgctactaacttagaggatgtgtgctcgagagaggactcatttgaaagtctgcaaattcccaatgtttacccactgcccatgttcactgaaagttattccagttcagctttttcagtccagctgagcaatgaactccacctaaattctgcccctcctctgctataaaacaaagtagaagaagaaaaatgtagaagtggcaaagagatccattgagtaacccatccaagaaatacatgtggcaggtctgtcatagtaatggagtgatgctgggtattgtggggcacagataattcrgttcttgctcttcaaggattgtttattaatagtaacaataacagcagctaatactaagatgaggcgtacatatgcgaaacactgttctaagtgctttacattgattaactcatttaatcctcataactgatctttgaggtagatattattacatccatttaactgagccacagaaaagttaaatattcatccgggatcacacacactagtaagggcaaggctaggatcggcatcctggcagtctgctccagagcctgccatgctctcacctactgcactacagtgggggctgaatgtcca

SEQ ID NO: 184491 - DNA, 601 bp, Human
caggtgttctcattgttcaattcccacctatgagtgagaacatgcagtgtttggttttctgcctttgtgatagtttggtcagaatgatggtttccagcttcatccatgtccatacaaaggacatgaactcatccttttttatggctgcatagtattctatggtgtatatgtgccacactttcttaatccagtctatctttgttggacatttgggttggttccaagtctttgctattgtgaatagtgccacaataaacatatgtaaagacaggaggatcccttgagccaaggagtttgaggstgcagtgagccatgattgcaccactgcaatccagactgggccacagagcagcatgctgtctcaaaaaaaaaaaaaaaaagaaaagaaaagacttttgtagtaaggaacatttaaaatttgtgtgtgtttgtgtgggggacacactataaatcaattgacccattaaaataatggactagtagttaaaaatatattgtttaaaaggacaaataataaggcaatcatgatgtctcatatgaaaatcaagactcaagttgacaagtaaaacatttaacacccaattaaactcaacatcagcaa

SEQ ID NO: 184492 - DNA, 601 bp, Human
gcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgtggtggcgggcgcctgtagtcccagctactcgggaggctgaggcaggagaatggcgtgaacccgggaagcggagcttgcagtgagccgagattgcgccactgcagtccgcaatccggcctgggcgacagagcgagactccgtctcaaaaaaaaaaaaaaaaaaagctggtccattgtcactctgtaagctttggggaagtccaaatctaggaattatttcatgaactaagactttaaccacctcttgggtcttttctgttctacaagggaaggcttccacccaatttgtaaaggtatcaacacagaccagtaagtactgaaatcctcctgactttggcatatgggtaaaatctaactgccagtcctctccaggataatgtcctgttctttgtctgcctggagaggccttatgatgggctaaggggttatacttctggcacacttcacaggctttcattacttgc

SEQ ID NO: 184493 - DNA, 601 bp, Human
aacacagcacatgtctctgcgagcacaaagttaaaggtaaggttacagattaacagcatctcaaagcagaagaatttttcttagtacagaacaaaatggagtctcttatgtctacttctttctacatagacacagtaacagtatgatctctctttcttttccccacaaatatcttgttggatatgccattctttagcctcatcttggaggccccctcagtcagacatacctatatgggtataatatgtccaacaagcattggccccccatttctcagggcagtcagatcagatcatttttycttggcgatatgtacggccattgtgagaacagagagaagcagttttacaacattttgttctcatgtaagtatacacggcaaaagatgtgggtgcttggaaggggctacctaatccccaagagtttctgagggaatgctggttgactcccccaagggaggcacactgacatggggggtgtgttgcagttggagaaagggacataagtacgaagaggatggcaggaaacgtaaaaggagtcaagacgtgttgtaggtggaatggtcgtaggaaagaggagggaaaaaggagtaaattgctgt

SEQ ID NO: 184494 - DNA, 601 bp, Human
gctgtgctttgatgtgcacatacataaacatctttggtgcattaaagagcagtattgctgccagcatatctcacctccagccttaaggtggttttctcttacctcagtagagggaacatacaatcgagttttacacagagacattccatttcctagggaccagcaggagacagatgccttcctcttatctcaactgcaaagaggctttcctcctttactaatcctcctcagcacagaccttttacaggtgtcaggctgggggatggtcaggtctttcccttcctatgaggccatatctcaractatcacatgagaagaaaccttagacaatacctagctttcctaggcagaggtccctgtggccttccgcagtgtattgtgtccttaagtactcgagattaaagagtggtgatgacttttaacaagcatactgccttcaagcatttgtttaacaaagcacatcctgcatggccttaaatctattgaaccttaagtcaacacagcacatgtctctgcgagcacaaagttaaaggtaaggttacagattaacagcatctcaaagcagaagaatttttcttagtacagaacaaaatggagtctc

SEQ ID NO: 184495 - DNA, 601 bp, Human
gttactgatatacaggactgacatcagaaggtgttcttattgacagccatgctgaagtttatgcacgtgagatttgaggcctgtgtggctggtaaattggtgactatgggactgattgatttggtgatgtttagtactggggtggataagttccactgtccagggacagggactgggacatacattgaaaatgcaaggggagacacatccagcagttggttggattaccaggagaggcttcttgtattcctgtaagggtggtgttaaagaggctccagagatgagaatgagagttaagggyttcctgtagcctggaaaggtctaatttcttgtatggactgggagtactggagggctggactaagtttttaattttgtgggggaaaagaaagagagatcagactattgctgtgtctatgtagaaagaagtagacataagagactattttcttctattgtttgaaatagcatgattagattttttgtagagactctaactccccctctttttcaaagaattttaatagagctgagataagaggcatatttacttttagtttgctctattgctaccttaggtccttctgatcacacaagctta

SEQ ID NO: 184496 - DNA, 601 bp, Human
taaaggctcatgtgtggcgagattggggtataaggagactttgtaactctcgttcagtatatatggacatgggaggtgctagaaaggagtgaaagcatagttctttcagagtgctgtttaggcatcaataccctgtgtaatcacagatgaaaaaaaaatgcctgaagttaggtgaaacctggggttactgatatacaggactgacatcagaaggtgttcttattgacagccatgctgaagtttatgcacgtgagatttgaggcctgtgtggctggtaaattggtgactatgggactgattratttggtgatgtttagtactggggtggataagttccactgtccagggacagggactgggacatacattgaaaatgcaaggggagacacatccagcagttggttggattaccaggagaggcttcttgtattcctgtaagggtggtgttaaagaggctccagagatgagaatgagagttaagggcttcctgtagcctggaaaggtctaatttcttgtatggactgggagtactggagggctggactaagtttttaattttgtgggggaaaagaaagagagatcagactattgctgtgtctat

SEQ ID NO: 184497 - DNA, 601 bp, Human
ggctggcctcactgtttaagggtagttgcggcggtggttgtcttagtgtcagaggctatcaaaataatacaaggaaaggatctcactgtctggactactcatgatgtaaatggcatacgaggtgccaaaggaagtttatggctatcagaaaaccacctacttccctacaataaaggctcatgtgtggcgagattggggtataaggagactttgtaactctcgttcagtatatatggacatgggaggtgctagaaaggagtgaaagcatagttctttcagagtgctgtttaggcatcaatascctgtgtaatcacagatgaaaaaaaaatgcctgaagttaggtgaaacctggggttactgatatacaggactgacatcagaaggtgttcttattgacagccatgctgaagtttatgcacgtgagatttgaggcctgtgtggctggtaaattggtgactatgggactgattgatttggtgatgtttagtactggggtggataagttccactgtccagggacagggactgggacatacattgaaaatgcaaggggagacacatccagcagttggttggattaccaggagaggcttcttgtatt

SEQ ID NO: 184498 - DNA, 601 bp, Human
gaagaatgcttaggactctaacaggttttcgagaatgcgtcggtaagggccaataaatctgatttttctcagtcctctctgtggtctaggaggacaggcaaaggtgcaggttttcgagaatgcatcggtaagggccactaaatacaacattcctcggtcctccttgtggtctaggaggaaaactagtgtttctgctgctgcgtcagtaagagcaactattccgatcagcagggtccagggaccgttgcaggttctcgggcaagaggtatttctgctgctgcgtcagtgagcgcaactattytcatcagcagggtccagggaccgttgtgggttcttgggcagggggcaaaacaaacaaaccaaaactgtgggcgattttgcctttcagatgggaaacacccaggcatcaacaggctcacccttgaaatgcatcctaagccattgggaccaatttgacctgcaaaccctgaaaaagaggtggctcatttttttctgcactgtggcttggccccagtattctctctttgatgggggaaaatggccacctgagggaagtataaattacaatactatcctgcagcttgaccttttgctgtaagag

SEQ ID NO: 184499 - DNA, 601 bp, Human
cttcagagctggcagcattggtttgcctagaaccagcttccacttttcatgtacttctgggctgagccgagcatcaacagagagggaagtcattcagctccagggtcccgaaaacaagttggttgaccctgcagccatgagcagaactctcaaagccttgtcgcccaagcgagactcgcccatctatcctatttatcctgacccttgcctcctgggtcctagcgcctgtcagacaaacttcctctcgcctcttttctctgagactagtcctgcttctaaaaaccactccctgtctctggtkctttcctagttcctcctataagaatgatttctagtataaatttcaggactgtgttaccttctttaggcacccagactcaccaatcagaaagacataatttttgcccaaagccccgtcgggcaggggactatctggaattttaggatcccttctcagaccagcaggcctaacaaaagctattcctgaagctaggatatggggagcttcagaaatgatatccttcctattcaagtgaggacaaaaggcgttactcttccaaccctggatatcccttccctccctcagggtatggcccttcac

SEQ ID NO: 184500 - DNA, 601 bp, Human
tggccactggactacagacacgggtgtcaagctttctgggaaagggctaacaacccctgactcttcagagctggcagcattggtttgcctagaaccagcttccacttttcatgtacttctgggctgagccgagcatcaacagagagggaagtcattcagctccagggtcccgaaaacaagttggttgaccctgcagccatgagcagaactctcaaagccttgtcgcccaagcgagactcgcccatctatcctatttatcctgacccttgcctcctgggtcctagcgcctgtcagacaaacytcctctcgcctcttttctctgagactagtcctgcttctaaaaaccactccctgtctctggtgctttcctagttcctcctataagaatgatttctagtataaatttcaggactgtgttaccttctttaggcacccagactcaccaatcagaaagacataatttttgcccaaagccccgtcgggcaggggactatctggaattttaggatcccttctcagaccagcaggcctaacaaaagctattcctgaagctaggatatggggagcttcagaaatgatatccttcctattcaagtgagga

SEQ ID NO: 184501 - DNA, 601 bp, Human
ttgaaagcgactagtgtggccactggactacagacacgggtgtcaagctttctgggaaagggctaacaacccctgactcttcagagctggcagcattggtttgcctagaaccagcttccacttttcatgtacttctgggctgagccgagcatcaacagagagggaagtcattcagctccagggtcccgaaaacaagttggttgaccctgcagccatgagcagaactctcaaagccttgtcgcccaagcgagactcgcccatctatcctatttatcctgacccttgcctcctgggtcctagygcctgtcagacaaacttcctctcgcctcttttctctgagactagtcctgcttctaaaaaccactccctgtctctggtgctttcctagttcctcctataagaatgatttctagtataaatttcaggactgtgttaccttctttaggcacccagactcaccaatcagaaagacataatttttgcccaaagccccgtcgggcaggggactatctggaattttaggatcccttctcagaccagcaggcctaacaaaagctattcctgaagctaggatatggggagcttcagaaatgatatcctt

SEQ ID NO: 184502 - DNA, 601 bp, Human
aacccaataacgaacacacagcttggctgcctggaacctgattgctgtttcataaggagtccttgttaggatcatcacaatggtggccataatagccacaactacccaggattaaatgtgagcgcttatgcaagcgctcacaaacatcctaccctcagacactgtgctgtgaataatactgtcatctgacctgagggttaaagaggttaagtaacagctagggagtgatggggttcaaatttgaacttagagctgtctgatctgattcatggatggctaatgtggttttccgaaactaccrcttgtctagaccagcttttctcaacctcagcattataattccttgtagtgaggggtctctgggcattataggatgcttataagtaaccctgacccctacccagttgtgacaaccaaacatttccaggttgccgtatgtccccttggggaatgggacaacatcaccctggtggagaaccactggtctagactctgttattggtgtccttttgtcatttgaatttgtgttcacttttttttttttttttgagacagagtttcactcttgttgcccaggctgtagtgaattggcgcagtctcg

SEQ ID NO: 184503 - DNA, 601 bp, Human
tatagaaatggaaacttttcataatattaattgataatgatactgggatgggcttgacacccccctgccagtacctggcccccacctggtgtcctggggccctctccatcctccccttgcctacctgctccctacacttccagccagagtcggtgcaggtcctcagcagtaaagacgttcttgaccattaccccttacatctcccaaacccaataacgaacacacagcttggctgcctggaacctgattgctgtttcataaggagtccttgttaggatcatcacaatggtggccataatakccacaactacccaggattaaatgtgagcgcttatgcaagcgctcacaaacatcctaccctcagacactgtgctgtgaataatactgtcatctgacctgagggttaaagaggttaagtaacagctagggagtgatggggttcaaatttgaacttagagctgtctgatctgattcatggatggctaatgtggttttccgaaactaccgcttgtctagaccagcttttctcaacctcagcattataattccttgtagtgaggggtctctgggcattataggatgcttataagtaaccctgacc

SEQ ID NO: 184504 - DNA, 601 bp, Human
cttttacatttatcaaataacaattccagttaaatgtaaaaaaaatagttttatcatgatggacagtaatccggctatgttaagtcaaaattctggatttaatgggattttaaagcaatagactgatgtttccctttattgctttagtctgctccatgatacatattctaaaatattgtgctcaattttgacagcagactctatgaaaaacataattgatggatatagttgctaaaatcattcagtatatatgtgcaagttctatgaagcatcattttatggaaataaaacaaaagctatrtaagcgctagctatgattactgaaagaaatagatggtaatacattttttacctggcagtctgtgcttacattttctcattaatatgtactatctatgaatgagctacataagaaccaaagaaagaaaaagcttacttgtgacctagctagccagtataagaatttatatagaaatggaaacttttcataatattaattgataatgatactgggatgggcttgacacccccctgccagtacctggcccccacctggtgtcctggggccctctccatcctccccttgcctacctgctcccta

SEQ ID NO: 184505 - DNA, 601 bp, Human
aacagtctttttttatccttttcatgagctaactactctttacggtttaacaaccctgaaatgtttcctgtttaaattactggtgtggttcatctcctgataccaccctgattgacaaatatctcagtatcaaaagatggtataggaaaaagggtcatctctcaactgttgctataattgacttaaaacccaaactcaaataaaaatatcttcttccaaagataagtgggagatggagaaaagttcaacaaaccataatcacaaaaacatgaaaaaaaccatactgaggcacatcataatcatcaaatttctccaaccaactcatctaagagaaaattttaagtggccagaagaaaaaaaaaattacagcttatacagaagaacaaaggtaaaaatgacagcaaatttctcacagaaataatgcaagtggccaggtacagtggctcatacttataatcccagcactgtgggaggcccaggcaagaggattacttgaggccagtagctcaagaccagcctaggtaacatagagagacctcatctctacaaaaattaaaaaaaaaaattagccaggtggtggggcatgcctgtggtcccaggc

SEQ ID NO: 184506 - DNA, 601 bp, Human
cctaaatgaacttaatgattaaattttcacactaccttcatgttcaccagggagaattttttcccataggcagatttttttcacccactatttgaagtggcaactgatctttgaagccaatgtggacagcttcttgcatcttcatttcaagatgctagaaaatgtgttataataaagacagctcttgacatcttgctggcagatgaccacagagaaattagtaaaaacttattcacagatcaaacttttgatcccatttttcaccatctgcttttcaatgtcacctgaagcagagttggaygctaggaagatcttgcaaggttgattgcacttaaagccagactgactgtgcaggcagatgcatttatttagatgagacaatatagaaaggcagcagatccaagtcaccaagaatggcctgggttcaaatcctacttagaatctgcacatacctgggagagagatatgaacccctctgtgcctcagtttcctattctgaaatgtggaaatgttagtatggtctatgctatggcatagggctaaaatggatgaaatacagataaagccttcagaagactcatgccttgtaaatgcccaatca

SEQ ID NO: 184507 - DNA, 601 bp, Human
gatttgcctgcctcagcctcctgagtagcttggactacaggcatgcaccaccacgcctagctaatttttgtatttttagtagagatagagtttcactgtactggccagtccggtctcaaattcctgacctcaaatgatctgcccacctcggcctgtactgggattacaggcgtgagccaccatgcccagccatggtcagattttcctatcttcatttcattaataaggaaagaagcccctgaaaaaacatttcttttccagacaaggaaatgcaacttaccttgatagatgacacttcctyctctggattatcacctgcacactcctcctgtaggtctaggagaacatagagtgacagttggtgcatttgtgctgttgaggaatcctacaaaaggagccttgggggatgtggaccagggctggagtatatggaggtgggtggttgacaagcatggactgagctgctcccgggccattctccttggtggtgaaggaaggaaaatgagagagtcagaaagaaatgaagacagaaccttggctttctagtgagggcaacttcatccatgtgaaatagtcaccttaagaaccagtctgtaatctc

SEQ ID NO: 184508 - DNA, 601 bp, Human
cagatttttttatttttttattttatttttattttagatggggtctcgctggctcacccagtctggcgtgcagtgatgtaatcttggctcactgcaacctccacctcccgggttcaagagatttgcctgcctcagcctcctgagtagcttggactacaggcatgcaccaccacgcctagctaatttttgtatttttagtagagatagagtttcactgtactggccagtccggtctcaaattcctgacctcaaatgatctgcccacctcggcctgtactgggattacaggcgtgagccaccrtgcccagccatggtcagattttcctatcttcatttcattaataaggaaagaagcccctgaaaaaacatttcttttccagacaaggaaatgcaacttaccttgatagatgacacttcctcctctggattatcacctgcacactcctcctgtaggtctaggagaacatagagtgacagttggtgcatttgtgctgttgaggaatcctacaaaaggagccttgggggatgtggaccagggctggagtatatggaggtgggtggttgacaagcatggactgagctgctcccgggccattctcct

SEQ ID NO: 184509 - DNA, 601 bp, Human
agttctttattgggacttctgtttctcacaccacaccccagatcctcactcctatcaggaagctgaagccaggaagggtctccagacaaaagcaggcaagagagttcctcctttctcatcacttagatttgttgtcagcaagggagtactcttagaatacgtacggtgttttttggctgtgaactccacctgcaatgggagaaaggaaaacaccctgtggatcagatcatgccatgtcctgtttgcacaggtcttttattcacttggtgacattagagaaccagatggcaaaaagtggccwaggcaccagccctatcataaagtatagaggatgcttgtggaaaaggcagtcggttttcatggaatgttttgcaagtccatgttgactggaaaatacaaaacgttttctcaagaagaaaaagttgctactgagaaatatgctcactaccagacagtttgtaagtggtgctgtcatttttgactctgtcatccatcaggcctcagttggtcatggactctagctaaaggtcactaaaggtcactagagcccatgaccaactgtggcctgatgaacgatgaatatcaagtgcaaatgatattc

SEQ ID NO: 184510 - DNA, 601 bp, Human
ccttagttacttcccaaccctcctgcatacaaacccacaccatctaaatgatatggctgtttccagagactatagtggatggtcatagttctttattgggacttctgtttctcacaccacaccccagatcctcactcctatcaggaagctgaagccaggaagggtctccagacaaaagcaggcaagagagttcctcctttctcatcacttagatttgttgtcagcaagggagtactcttagaatacgtacggtgttttttggctgtgaactccacctgcaatgggagaaaggaaaacaccytgtggatcagatcatgccatgtcctgtttgcacaggtcttttattcacttggtgacattagagaaccagatggcaaaaagtggcctaggcaccagccctatcataaagtatagaggatgcttgtggaaaaggcagtcggttttcatggaatgttttgcaagtccatgttgactggaaaatacaaaacgttttctcaagaagaaaaagttgctactgagaaatatgctcactaccagacagtttgtaagtggtgctgtcatttttgactctgtcatccatcaggcctcagttggtcatgga

SEQ ID NO: 184511 - DNA, 601 bp, Human
gtccacatttcctgggggaaacacacacattgacaaacacattcacaatcaccacacattaactcacccttagttacttcccaaccctcctgcatacaaacccacaccatctaaatgatatggctgtttccagagactatagtggatggtcatagttctttattgggacttctgtttctcacaccacaccccagatcctcactcctatcaggaagctgaagccaggaagggtctccagacaaaagcaggcaagagagttcctcctttctcatcacttagatttgttgtcagcaagggagtrctcttagaatacgtacggtgttttttggctgtgaactccacctgcaatgggagaaaggaaaacaccctgtggatcagatcatgccatgtcctgtttgcacaggtcttttattcacttggtgacattagagaaccagatggcaaaaagtggcctaggcaccagccctatcataaagtatagaggatgcttgtggaaaaggcagtcggttttcatggaatgttttgcaagtccatgttgactggaaaatacaaaacgttttctcaagaagaaaaagttgctactgagaaatatgctcactac

SEQ ID NO: 184512 - DNA, 601 bp, Human
aatgacatgattgaggtttgagggtcactataggacaggaattcaagaaaagtgacacttgtactgtgctgtgcatgtgggtccacatttcctgggggaaacacacacattgacaaacacattcacaatcaccacacattaactcacccttagttacttcccaaccctcctgcatacaaacccacaccatctaaatgatatggctgtttccagagactatagtggatggtcatagttctttattgggacttctgtttctcacaccacaccccagatcctcactcctatcaggaagctgaakccaggaagggtctccagacaaaagcaggcaagagagttcctcctttctcatcacttagatttgttgtcagcaagggagtactcttagaatacgtacggtgttttttggctgtgaactccacctgcaatgggagaaaggaaaacaccctgtggatcagatcatgccatgtcctgtttgcacaggtcttttattcacttggtgacattagagaaccagatggcaaaaagtggcctaggcaccagccctatcataaagtatagaggatgcttgtggaaaaggcagtcggttttcatggaatgt

SEQ ID NO: 184513 - DNA, 601 bp, Human
ctctgcctgcagacctccttctcaatttcctaccagacctgggtgttgcatgttgctgtgccagggtctaaccacaaaggaatgagccctgctccactctcactgtgtgtgcatccatcgagtcagtggctggtcatgctcacaccagcccctgacagtgggacagtccatcctggggttcagcacatggtgagtgctgagcctcactaacctagctgtgcgggagatctccagctagggtgatgggcaccaggctaacaacaaggttgtgtctgagttctgatgcagtggaccttgtccrtctgctatggattggagcatttctttggcttgaggtggtcatgttattaaatacaatacagtatcttcctgattcttccctgctttgaccaagtgctgaggaatgaccccagcacgcacagatgttgacctacactgttctatgtggggccatacacttctcagaatctgtgagctgaccagaagcctgtgggctttctatgtgtatttcacagtaatgaccatgccagtgtctgtttttccctgtaccttttgctaccctgggttatgtgaccactgggcccaccttatgatgatgggc

SEQ ID NO: 184514 - DNA, 601 bp, Human
gctttattctgggggaaaacctggtgactttcatcactttttttttttttttttttttgagtaggagtttcgctcttgtcacccaggctggagtgcagtggcgccatctcagctcactgcaaacttcacctcctgggttcaagcgattctcctgcctcagcctcccgagtagctgggattacaggcatccaccagtatgcccagctaatttctgtatttttaatagaaacggggtttcaccatgttggacaggctggtctcgaactgtgacctcaggtcatccacccgcctcagcctcccraagtgctgggattacaggcatgagtcaccgcgcctggcctcatcacattttcaaaaatgtccatggtctatgaaaggcttagcaaccttaaacctagagggctctacacccagctctgtgagcctgggcaggctactgcaactattgtgttcctgtatgtgaaccacaagcccactccatggagttattacaaagatgacatagcctgtagtgcaggcctcacagggtggaaatgaggttgaagggaggagaggaattagagggtgctcttgcctggctcttcttcagagggatgatggt

SEQ ID NO: 184515 - DNA, 601 bp, Human
gtaaaaccctgtctctagtaaaaatacaaaaattagctgggcatggtggcgcatgcctgtaatcccagctactcagggggctgaggcaggagaatggcttgaacctgggaggctgaggttgctgtgagtcgagatcgcgccactgcactccagcctaggcaacaagagcgagcctctgtctcaaaaaaaaaaggggctgaggacttggtcttgccagaggcagcttctggttgtgcggcactggctgaacctctgtccagtcccaggagtggacaaaaggccacgggtatcccatcctgaygggttctagggccctagaggtcgcaggagcgctccccgtgaccccactcctgaggtcggctccttttccctgggtagcccccaggacatgcccctgccctcctctggacctcagcttcgccatccacaaaaggaagcagcctggccagagctggggagggtccctcaatctcggtccctcaggatccagggtgggctgtcttggccccactgcagaggggacccagagaaccacggaaagctgggtgctggaggggcagtcccacgatggcagcagggcttccccggcctcgtgtctgca

SEQ ID NO: 184516 - DNA, 601 bp, Human
gcactctgggaggccaaggcaggtgaatcacttgaggtcaggagtttgagatcagcctggccaattggtaaaaccctgtctctagtaaaaatacaaaaattagctgggcatggtggcgcatgcctgtaatcccagctactcagggggctgaggcaggagaatggcttgaacctgggaggctgaggttgctgtgagtcgagatcgcgccactgcactccagcctaggcaacaagagcgagcctctgtctcaaaaaaaaaaggggctgaggacttggtcttgccagaggcagcttctggttgygcggcactggctgaacctctgtccagtcccaggagtggacaaaaggccacgggtatcccatcctgacgggttctagggccctagaggtcgcaggagcgctccccgtgaccccactcctgaggtcggctccttttccctgggtagcccccaggacatgcccctgccctcctctggacctcagcttcgccatccacaaaaggaagcagcctggccagagctggggagggtccctcaatctcggtccctcaggatccagggtgggctgtcttggccccactgcagaggggacccagagaacca

SEQ ID NO: 184517 - DNA, 601 bp, Human
atggtgtggatttggagaaaggggtgctcataccctgtaggtgggaatgaatattagtaaactgtggaaaagagttacaggttcctcaaagaattgaaaatacatataccatatgatttagccatctcccttctgggtatacattcaaaataaatgaaatctgtattttctgaaatctgccttcctaggtttcttgcagcatcattcacaaaagctacgtttatggaatcaatctagctgtctatccacagataaatggatcaagaatctctagtatatatatatatgacaaaacacttcygtcatcaaaataatgacatcatgtcacttgaagcaacagggttgaacctggaaaacgttatgttaaatgaaatatgccaggcctggaaagataaacagtggatgatatcactcaaatctacaaaaaagattatcataaagaagcagaagggacaatattggttaccagaggctgggggatagatggggaataggaaggattggttaagaaaacaaagttactctcacatgaaaggaataaattctagtgttctatttcacagctcagtcactttggttaacaattttgtagtttttggct

SEQ ID NO: 184518 - DNA, 601 bp, Human
ggaaactgaatagaccactttgaaaaaacaaacaaataaacacacacacatacaaagctgaccaacaggtaaaagaaaaggacctcaatatcactattaattccacaaatgtaattaacaaccacattcagataatatttcactattattgaaataaatattgctaaatgaatgaaggtttctaaaaataagaattatggtgtggatttggagaaaggggtgctcataccctgtaggtgggaatgaatattagtaaactgtggaaaagagttacaggttcctcaaagaattgaaaatacawataccatatgatttagccatctcccttctgggtatacattcaaaataaatgaaatctgtattttctgaaatctgccttcctaggtttcttgcagcatcattcacaaaagctacgtttatggaatcaatctagctgtctatccacagataaatggatcaagaatctctagtatatatatatatgacaaaacacttccgtcatcaaaataatgacatcatgtcacttgaagcaacagggttgaacctggaaaacgttatgttaaatgaaatatgccaggcctggaaagataaacagtggatg

SEQ ID NO: 184519 - DNA, 390 bp, Human
gcttactagagacttttaatactttcactaatttgctactgctatctaaaaggcagagcctggtgtacaggatggaacatgaaggcggactaggagcgtgaccactgaagcacagcatcacagggagacagttaggcctcctgataactgcaggcgagtctgactaatgtcaggccctccacaagagttggaggagtagagtcttctctaaactcccccggggaaagggagactccctttcccagtctgctaagtagtggatgtttttccttgacgcttacgctaccgctagaccacggtmtgcttggcaacgagcgtcttcccagacgctggcattaccactacaccaaggagccctactggtcgccctgtactgggcataacagaagg

SEQ ID NO: 184520 - DNA, 421 bp, Human
agagagagagacagcttatgccattatttctgcttactagagacttttaatactttcactaatttgctactgctatctaaaaggcagagcctggtgtacaggatggaacatgaaggcggactaggagcgtgaccactgaagcacagcatcacagggagacagttaggcctcctgataactgcaggcgagtctgactaatgtcaggccctccacaagagttggaggagtagagtcttctctaaactcccccggggaaagggagactccctttcccagtctgctaagtagtggatgtttttcyttgacgcttacgctaccgctagaccacggtatgcttggcaacgagcgtcttcccagacgctggcattaccactacaccaaggagccctactggtcgccctgtactgggcataacagaagg

SEQ ID NO: 184521 - DNA, 549 bp, Human
caaaggggcaggataaggagagtgagccacctccaatgataggtaaggccacgtgagtcacatgtccactggacagggggcccttccctgcctgacagctgaggcagagagagagacgagacagagagagagagagagacagcttatgccattatttctgcttactagagacttttaatactttcactaatttgctactgctatctaaaaggcagagcctggtgtacaggatggaacatgaaggcggactaggagcgtgaccactgaagcacagcatcacagggagacagttaggcctcckgataactgcaggcgagtctgactaatgtcaggccctccacaagagttggaggagtagagtcttctctaaactcccccggggaaagggagactccctttcccagtctgctaagtagtggatgtttttccttgacgcttacgctaccgctagaccacggtatgcttggcaacgagcgtcttcccagacgctggcattaccactacaccaaggagccctactggtcgccctgtactgggcataacagaagg

SEQ ID NO: 184522 - DNA, 570 bp, Human
tgatatttactggatacaagacaaaggggcaggataaggagagtgagccacctccaatgataggtaaggccacgtgagtcacatgtccactggacagggggcccttccctgcctgacagctgaggcagagagagagacgagacagagagagagagagagacagcttatgccattatttctgcttactagagacttttaatactttcactaatttgctactgctatctaaaaggcagagcctggtgtacaggatggaacatgaaggcggactaggagcgtgaccactgaagcacagcatcayagggagacagttaggcctcctgataactgcaggcgagtctgactaatgtcaggccctccacaagagttggaggagtagagtcttctctaaactcccccggggaaagggagactccctttcccagtctgctaagtagtggatgtttttccttgacgcttacgctaccgctagaccacggtatgcttggcaacgagcgtcttcccagacgctggcattaccactacaccaaggagccctactggtcgccctgtactgggcataacagaagg

SEQ ID NO: 184523 - DNA, 601 bp, Human
agagtgtagaaataaagacacaagacaaagagataaaagaaaaggcagctaggcccaggggaccactaccaccaagtcacggagaccagtagtggccccgaatgccaggctgcactgatatttactggatacaagacaaaggggcaggataaggagagtgagccacctccaatgataggtaaggccacgtgagtcacatgtccactggacagggggcccttccctgcctgacagctgaggcagagagagagacgagacagagagagagagagagacagcttatgccattatttctgcttaytagagacttttaatactttcactaatttgctactgctatctaaaaggcagagcctggtgtacaggatggaacatgaaggcggactaggagcgtgaccactgaagcacagcatcacagggagacagttaggcctcctgataactgcaggcgagtctgactaatgtcaggccctccacaagagttggaggagtagagtcttctctaaactcccccggggaaagggagactccctttcccagtctgctaagtagtggatgtttttccttgacgcttacgctaccgctagaccacggtatgctt

SEQ ID NO: 184524 - DNA, 601 bp, Human
ggtctctccccgtgtgcggagatgagagagtgtagaaataaagacacaagacaaagagataaaagaaaaggcagctaggcccaggggaccactaccaccaagtcacggagaccagtagtggccccgaatgccaggctgcactgatatttactggatacaagacaaaggggcaggataaggagagtgagccacctccaatgataggtaaggccacgtgagtcacatgtccactggacagggggcccttccctgcctgacagctgaggcagagagagagacgagacagagagagagagagaggcagcttatgccattatttctgcttactagagacttttaatactttcactaatttgctactgctatctaaaaggcagagcctggtgtacaggatggaacatgaaggcggactaggagcgtgaccactgaagcacagcatcacagggagacagttaggcctcctgataactgcaggcgagtctgactaatgtcaggccctccacaagagttggaggagtagagtcttctctaaactcccccggggaaagggagactccctttcccagtctgctaagtagtggatgtttttccttgacgctta

SEQ ID NO: 184525 - DNA, 601 bp, Human
ggaatcttcttcagccatagaaattcgcaaaatcacgttatctgcagccacatggagagacctggaaggcatgatgttaaatgaaatgagccaggcagagaaacacaaacgtggcatgatctcacacatgtgcaatctaaacaactttatcttgtagaagtacaaagtttaatggtggataccagaggcttgggggcagggggcactagacagggattgcaaatggatacaaagttacacttacctgagaggaataaattctcctgttctattccacaacaggatgactagtgtaggcacmagccccacagggtcggtgggtctctccccgtgtgcggagatgagagagtgtagaaataaagacacaagacaaagagataaaagaaaaggcagctaggcccaggggaccactaccaccaagtcacggagaccagtagtggccccgaatgccaggctgcactgatatttactggatacaagacaaaggggcaggataaggagagtgagccacctccaatgataggtaaggccacgtgagtcacatgtccactggacagggggcccttccctgcctgacagctgaggcagagagagagacgag

SEQ ID NO: 184526 - DNA, 601 bp, Human
agaaataaacctttcaacactactaatcagactgtatattactatgtacactataaaaaacagttgcagtttcctctaaaaagaaaaaaaaaatacaactgctctttagtgtagcaatcctacccctgaatatacactgaaagcacttgaaatgtgtattttggagaactatcagcctttgcatggtgaccaaagcactatttacagtagccaagatatggaatcaacctacttgtccatacacagatgaaaggataagaaactgcagtgcacaatggaatcttcttcagccatagaaatycgcaaaatcacgttatctgcagccacatggagagacctggaaggcatgatgttaaatgaaatgagccaggcagagaaacacaaacgtggcatgatctcacacatgtgcaatctaaacaactttatcttgtagaagtacaaagtttaatggtggataccagaggcttgggggcagggggcactagacagggattgcaaatggatacaaagttacacttacctgagaggaataaattctcctgttctattccacaacaggatgactagtgtaggcaccagccccacagggtcggtgggtctc

SEQ ID NO: 184527 - DNA, 601 bp, Human
tttgagtaaaatggatttctacctgcaaaacagtgaaatgggccctcacattacacaggacacaaaaaccaatgcaaagtatattaaagatctccacccaaacctgaaaacacaaaactcctagaagaaaacagggtgagcatttacttcagtaaacctgaatctatgcacacagattgccaaaaggaaagaaaacaaaagggaaaagtaggaggaagaaacccatagacaatgcaatcttttttccttttttttttgtgatggaacacccaaacaccatgaacacatgcaaatataaacrtgtaggactatggaaacctttagatgtgttccactggaatgaaaccaatgaactgaaagagaagatgtcctgcagagttggagacagatctgaaaaactgtatctctgaaagtggttgttatctaacatgtcccagaaactaaaaccactgtgtttgaaaaaaacaaaacaaacaaaaaaatccactaataccaaagctaaaaatgggcaaaggcccttaatagacatttctgaaaagatgacatgaattgactaaggagtcaaaaagaagttgctcaacttcatcatttctcccacaaa

SEQ ID NO: 184528 - DNA, 601 bp, Human
caaatatcacaacagtgaagagagaagtttgctctgtaatagtctttgagtaaaatggatttctacctgcaaaacagtgaaatgggccctcacattacacaggacacaaaaaccaatgcaaagtatattaaagatctccacccaaacctgaaaacacaaaactcctagaagaaaacagggtgagcatttacttcagtaaacctgaatctatgcacacagattgccaaaaggaaagaaaacaaaagggaaaagtaggaggaagaaacccatagacaatgcaatcttttttccttttttttttgtgatggaacacccaaacaccatgaacacatgcaaatataaacatgtaggactatggaaacctttagatgtgttccactggaatgaaaccaatgaactgaaagagaagatgtcctgcagagttggagacagatctgaaaaactgtatctctgaaagtggttgttatctaacatgtcccagaaactaaaaccactgtgtttgaaaaaaacaaaacaaacaaaaaaatccactaataccaaagctaaaaatgggcaaaggcccttaatagacatttctgaaaagatgacatgaattgactaa

SEQ ID NO: 184529 - DNA, 601 bp, Human
gcatttttcaagagaacaccaaatatcacaacagtgaagagagaagtttgctctgtaatagtctttgagtaaaatggatttctacctgcaaaacagtgaaatgggccctcacattacacaggacacaaaaaccaatgcaaagtatattaaagatctccacccaaacctgaaaacacaaaactcctagaagaaaacagggtgagcatttacttcagtaaacctgaatctatgcacacagattgccaaaaggaaagaaaacaaaagggaaaagtaggaggaagaaacccatagacaatgcaawcttttttccttttttttttgtgatggaacacccaaacaccatgaacacatgcaaatataaacatgtaggactatggaaacctttagatgtgttccactggaatgaaaccaatgaactgaaagagaagatgtcctgcagagttggagacagatctgaaaaactgtatctctgaaagtggttgttatctaacatgtcccagaaactaaaaccactgtgtttgaaaaaaacaaaacaaacaaaaaaatccactaataccaaagctaaaaatgggcaaaggcccttaatagacatttctgaaaa

SEQ ID NO: 184530 - DNA, 601 bp, Human
cttttctggcaaacacgcagaaagattaacctatggacaaaatgagaaagccaaaaaatgcagcccaaaattacatatggtgaacgcatttttcaagagaacaccaaatatcacaacagtgaagagagaagtttgctctgtaatagtctttgagtaaaatggatttctacctgcaaaacagtgaaatgggccctcacattacacaggacacaaaaaccaatgcaaagtatattaaagatctccacccaaacctgaaaacacaaaactcctagaagaaaacagggtgagcatttacttcaggaaacctgaatctatgcacacagattgccaaaaggaaagaaaacaaaagggaaaagtaggaggaagaaacccatagacaatgcaatcttttttccttttttttttgtgatggaacacccaaacaccatgaacacatgcaaatataaacatgtaggactatggaaacctttagatgtgttccactggaatgaaaccaatgaactgaaagagaagatgtcctgcagagttggagacagatctgaaaaactgtatctctgaaagtggttgttatctaacatgtcccagaaactaaaaccactgt

SEQ ID NO: 184531 - DNA, 601 bp, Human
gctaaaattcacgtggaaccatgaaacaccctgaatttcttccaaagcaatcctgagacatccagactatgtgagatgcatctcacccaccgatttcaaattttatggaaaagttagagacccgcttccacacagagcagtggaacacgagagaggaccaagaggtaaactcacacacccgactgatcctctacagaatccacaacaataagcaagggggaaaagatgccctattcaatcaatgatggtgggataagtggctagtcatgggtggaagagaaacactgggtcccgacctctygccagacacaaaaaggaactccagatgaataaaagatctaaatggaagacctcaaactattaaaatcctgcaagaaaacatacaaaatacctttcttcacataggttttggcaaagaatctatgtggctacgtccccaaaagcaatggcaacaaaaattgacatgtcagacctaatactgtaaagagcttccacacagcaaaagaaattagcaacaaacagatagcctacagagtgggagaacatgttcccaaactgcatctgaccaaggtctaatatccagaatcttcaaggacccttg

SEQ ID NO: 184532 - DNA, 601 bp, Human
tcggcaaatttgtttaaagaaacttaaatacatgatgctaaaattcacgtggaaccatgaaacaccctgaatttcttccaaagcaatcctgagacatccagactatgtgagatgcatctcacccaccgatttcaaattttatggaaaagttagagacccgcttccacacagagcagtggaacacgagagaggaccaagaggtaaactcacacacccgactgatcctctacagaatccacaacaataagcaagggggaaaagatgccctattcaatcaatgatggtgggataagtggctagycatgggtggaagagaaacactgggtcccgacctctcgccagacacaaaaaggaactccagatgaataaaagatctaaatggaagacctcaaactattaaaatcctgcaagaaaacatacaaaatacctttcttcacataggttttggcaaagaatctatgtggctacgtccccaaaagcaatggcaacaaaaattgacatgtcagacctaatactgtaaagagcttccacacagcaaaagaaattagcaacaaacagatagcctacagagtgggagaacatgttcccaaactgcatctga

SEQ ID NO: 184533 - DNA, 601 bp, Human
atcccagctactcaggaggctgaggcaggagaatcacttgaacctgggaggcagtggttgcagtgagctgagatcgtgccactacactccagtgtgggtgacagaatgagactccatctcaaaaaaaaaaagagagaaagaaagaaaagaaagaaagaaaggaagagagaaagaaaaagaaagaaagaaagaaacatacattctttacttaccacaggccaggaaccctatatggggactgtgtagacaaggtatgaggccaattttcctaaggggcttttattggctttgcaaatcaagmttgacttcttaaagggaagcatacccttccagtcaaagccttggtaaaacaactcatttgtctgttgcaaaagaaaatggattcttgttgcacagatgcaaacaactatattgccataagttaggaatactcacaactagtttctaaattctggagaagccaggcagagagagaaagacaaatatgctcaaaattttattcacaggaatataccttactcaattattaaaggccataaataactcaaaataagtttccttgactctgaaaaacaagacaaagatcagcaatgttccaagc

SEQ ID NO: 184534 - DNA, 601 bp, Human
atattagagacagggagtctcactatgttgcctagactggtctggaactcctggcttcccaaagtgctgggattataggcatgagccaccatgcttggcctgtttctgaatttttatttatttacttttattttttgagacacagtctcactctgttgtccagggaggagtccagtggtgcgatctcaggtcactgcagcctccatctcccaggttcaagcaattttcgtgtctcagcctcccaatagctgggattataggcgagcaccaccatgcctggctaatttttgtatttttagtrgagatggggtttcatcatgttgcccaggctggtcttgaactcctggcctctagtgatcctccctcgttgtcctcccaaagtgctgggattacaggtgtgagccactgtgcccagcctgtcatgtcttttcaaatttcttcaatctgaaacagtttgtcatcatcctttccctgtctttcatttccttgacagttttaagcatgcaggccttacattctgtaggacaaccctcaactcaggtccatctgatgttcactcattcatggcaggaacattgcagagatggcgatgtgctcctct

SEQ ID NO: 184535 - DNA, 601 bp, Human
gtaatcaagcatattttaagattgacattaagtctccctgtaagctcttcttatttgagacctatagttgtcatacagcttagtatccacacaataaaatgaggtacaggtggaataaagtggatttggggtcctggttgcttggggaattcttgttaacccccattcatattcacagcaactgaggttgattcagaacatttcctgatatatttctggtttgacatctgaagggagggcaaagtgttctctccagaaagctcatgactatagttaaccttgacaaagtagaaaggacctrggttccagtcctgatattacccccttaagggctatgtttccttggcaagtgacatgacctctctgaacctatttccccatttgtcaagtagaacacctattccatctcatagggttgtggtaaaagtgaaattaggttacataaataaaagagctctataaagagctgttatcactatgaactcatgtgcaaacaaattctctaatggaagtttgagatagctttgcagagaaaatacaactacagtactctggcatgtagaaaaattcaaagcaatatggtcagtcatgttgattaaat

SEQ ID NO: 184536 - DNA, 601 bp, Human
ggcccttgtaaatactattcccatctgatcttcacaaccatcctacaagccatgtattctatttcacttccattttaaagttgaggaaactgagacttagagaggttgagacacatcacacaggttaagtggtagtaaaccacatcttgttgcaaaacctgtgctctaagcctctattatgtcattcatttgggcttcctccatctgtctgtccattcgtcaatcagcaaatagttactgattgcttataggaagcttaatgataatggctaaaaagaaaaatagaggatttttgttgttyaatgacttttaatccttactttccaccaacatctgtttcctgtctctgttctgaggctcagtgctgaccacattcaaatgactagacaactttcagttgtaatcaagcatattttaagattgacattaagtctccctgtaagctcttcttatttgagacctatagttgtcatacagcttagtatccacacaataaaatgaggtacaggtggaataaagtggatttggggtcctggttgcttggggaattcttgttaacccccattcatattcacagcaactgaggttgattcagaacatt

SEQ ID NO: 184537 - DNA, 601 bp, Human
gtaagccatgatcgtgcctctgcctgcactccagcctgggcaacagagtaagactactatttaaaaaaatagtaataattaaatgaactccttccgcaatcatataactttttaaaagaagaaatcttgcagtttttctgagaccttccccatgacttacaggaggagcaccaatccgggaatgagacctttaaaaaggtttgacctcttttccggcgaatgatcacttcattaaccctagaacaatttgactttcaaaaggaacaaaataaatttccagtgaattttgtggaagcaagartggaggggagttttatggcaatgaagcattcataaaaggagaaagattttcatgtccttcaacatcttccctttttttatttttcccactcagcccagacatatcccttgatcacacttgattgcttttagaatactccctgtggttggcaacctgagtaattgctgcgacaccccatcccaccccaccccaccccgagcgtgcaaagcaggagctgcgttgggatgtggcagagcgtgccctggccctggggctggatccagctcttgccactcactgacttggtgactttgagcaagt

SEQ ID NO: 184538 - DNA, 601 bp, Human
tctcccctgcccttattggttacgtgcctgcaacttataggtgcttattaaggagactcttttcctatacttctaaaatgcaaactgtttcagattctgagcacctcattgtaaatacgattattctaaaaactcaaagggcgagaacaactggaatttcccaccttccgtggtgtgggtaaatggtatacataaacattaaaccttaaccaaagaagaactttaccgccaccaaaacagaaacaaccccaaacagccaaaaacagtccttaaaaatgagaggaacattttcttgcattcyttccttcgggaattgtattcaaaatgtaatggaaagtaattgttgacctcctgctttgggtgaaggagactgtaagctggtacttgagaacgaatttgccagcatgtgctgttgttgactgtgtgaatgatggtgccagggaatccgtggcttggtacacactgtttcatccagtggccacgtggaagctttgtagcattgagcagatagtaaaatatcttagaattaatgatctctttggaagagagcccagatttgtatgaaaacttgtttttcctctcaattgttttgtccactgtt

SEQ ID NO: 184539 - DNA, 601 bp, Human
cctcgccccgggtcttccttgacttgacacattttataaccgcaagagagcagtttttcctttgatgaggctaagaccccagaaatgaaagagcaagtttaagtttgcaaacactctaaaagctccttccattagacctggtcgcgggaaaccacaaaggacagtcaagtgattttcaaggagaaagcctctggtccactttccctccgccgccagatctgcaggttcctgggaggagctcttctcaaatcctgaagattgctaggctcttggcgaacgactcatctcttgaagacctagrgtggtggattacaggcattgaaaagcttttggtggctttggaagatgactctggtgtgagctcacctttccaggctgggggaccaggcagaggaaccccctttgttatcttctgaaagaagatcagtggggaagacggggtttgaagtgtggattaggagatcctacgtctttgcctaccacctctgcctaaatcataaaaagatcgaggagtgcaatgaacttcaggaatcatgcaccgtttccctgaagcctgtccaggaacctaacttctggacccagaaacttctgcaaagacaga

SEQ ID NO: 184540 - DNA, 601 bp, Human
ggacttgccaaactaaaaagaaaaacatgttagggcagcaccttgtctgctgaggaataggcaaaagctctcatcataaatgtagggggtttttgcttctcttgtttttaagtaggacttttaaagtagaagacacctttaatgtactggtttgcagaagaggaaatctgattttcagtgtgataacatattctttgacgttaaccagtacagttggatttttaatgacactttaatcttcaaaggtttaccaacacggatggattaattattcattttggaggggttgtgtcttaaaaagacaagtcttcaaagacatcatcctttctccttggaacttggagtctccacctttcaaatgttgctttcctgcccccaagagagaaaataaatgacattttttaaagaagaagaatccaatggaaaaacactctttgcgctatggaaagatgatgtccttatatcctgggtgagattagaagaggaggctgggaagcagtatttaagctgtgtttacagtaagcactgtgagaaataaccggctaagcgcgtttgttattgttcagtcttttgatgtgcttttaaaaagtcgcatctccat

SEQ ID NO: 184541 - DNA, 601 bp, Human
gagataggaggatcccttgagcctgggaggcggaggttgcagtgagccgagatcgcatcactgcaccccagcctgggtgacagtgagacctgtctcaaaataataataataataataataataataataataataattttaatagtttcttgaagcaatttatgctcccaccctttcctcaaatccttgcctcccctgaatcttagcaatcttttaaacttttgccaatctgagaaggagaaatggcatctcaactgttcttccttttgctctcttccaatctagtcctcaatctgcagayacagttatcttttttgaaacacaaatcttcaaatgtcacctccctgcttaaaatatttcattatcttcctgtcactcttaaaagttaaaatctttgacatggccaaaaagcaccttgtggtataacagcctacctgcctgagtggtggacttttctcctaatagaaagggctttctcaattctactgagaaattgtgatgatatattaggctatttgccagtacaaacctcatcaggagctacaacttttaatttttctttcttctttttaaaagatgggggtcttgctatgttggccag

SEQ ID NO: 184542 - DNA, 601 bp, Human
tgaccagtttttttttttttttttttttgacggagttttgctcttgtcgcccaggctggagtgcaatggcatgatctcagctcaccacaacctccgcctcctgggttcaagtgattctcctcctgcctcagcctcccaagtagctgggattacaggcatgtaccaccacgcccagctaattttgtatttttagtagaaacggggtttctccatgttggtcaggctggtcttgaactcctgacctcaggtgatcctcctgccttggcctcccaaagtactaggattacaggcatgagccacygcgcccggccttgaccaattttgattgtggtattagcagtgagagagagagagagagagagaaagtcttgtagatacttcgtcctcagagacagaatttacaaggagccagaaaacctggtctaagagttctaatttctaatggtaaatctgttggtttgggccagatcagggggtgtcatttgaactttctacacattttatcttattaagtttcactgggttataaaaataagaaagtaatagtgttggtattaacaagttaaacagtagaaagatttataaagaaaaatgaacatcc

SEQ ID NO: 184543 - DNA, 601 bp, Human
ctctgtcagcattctttgtgaccatgcagttaggtcattatattacttggatcctataaaaagaccactgtaggatcaggatttgaccagtttttttttttttttttttttgacggagttttgctcttgtcgcccaggctggagtgcaatggcatgatctcagctcaccacaacctccgcctcctgggttcaagtgattctcctcctgcctcagcctcccaagtagctgggattacaggcatgtaccaccacgcccagctaattttgtatttttagtagaaacggggtttctccatgttgktcaggctggtcttgaactcctgacctcaggtgatcctcctgccttggcctcccaaagtactaggattacaggcatgagccaccgcgcccggccttgaccaattttgattgtggtattagcagtgagagagagagagagagagagaaagtcttgtagatacttcgtcctcagagacagaatttacaaggagccagaaaacctggtctaagagttctaatttctaatggtaaatctgttggtttgggccagatcagggggtgtcatttgaactttctacacattttatcttattaagtttca

SEQ ID NO: 184544 - DNA, 601 bp, Human
tagccagccttaggacagctttaggttggagagaatgtttatctgggtcaaaactgactggagagtaatcaggagtcaaaacttcttcttttgatctcttatgtaaagaaggtaacccccaccccataccctgcacatcatgtgagtaaaacagtcctattcctactggaaaagccacttattttcaatgcttttgttctttaggaaaggctctgtcagcattctttgtgaccatgcagttaggtcattatattacttggatcctataaaaagaccactgtaggatcaggatttgaccagtttttttttttttttttttttgacggagttttgctcttgtcgcccaggctggagtgcaatggcatgatctcagctcaccacaacctccgcctcctgggttcaagtgattctcctcctgcctcagcctcccaagtagctgggattacaggcatgtaccaccacgcccagctaattttgtatttttagtagaaacggggtttctccatgttggtcaggctggtcttgaactcctgacctcaggtgatcctcctgccttggcctcccaaagtactaggattacaggcatgagccaccgcgcccg

SEQ ID NO: 184545 - DNA, 601 bp, Human
cagcctcgatctccagggctcaatcaatccaccccccttagcctcctgagttgttgcgacctcagatgcatgccatcatgcctgactattttttgtatttttttgtattgatggggtctccccatgttgctcaggctggtcttaaactcctgggctcaagtgatctgcctgtataagcttcccaaagtgttggaattacaggtatgagccactgcacctggcccaatttctttctatttaacacagcctcagttagaatctcaagtggtaatttcttcctcatggatattaaaagtgcacrttgtgttcttttgtcttcttttccaaatttgggaaatccttgcccaaaagttcttccagatgaattttagagtcagccattcattctccaagccttgagtttggtgcctcttcataattcacaccaaggtgttatatagacaagaggaggccttgtaaaacttgcggtaggagaaggtagccttaaacaggggagaaaagacaaaagctagaaggaaaggattaaaatatacctgcccatctgccccctttcatgagcagacccaaataggactacacaaacccagcccagttactcttg

SEQ ID NO: 184546 - DNA, 601 bp, Human
ttgctctgttgcccaggctggagtgctgtggcatgatcacagctcactgcagcctcgatctccagggctcaatcaatccaccccccttagcctcctgagttgttgcgacctcagatgcatgccatcatgcctgactattttttgtatttttttgtattgatggggtctccccatgttgctcaggctggtcttaaactcctgggctcaagtgatctgcctgtataagcttcccaaagtgttggaattacaggtatgagccactgcacctggcccaatttctttctatttaacacagcctcarttagaatctcaagtggtaatttcttcctcatggatattaaaagtgcacgttgtgttcttttgtcttcttttccaaatttgggaaatccttgcccaaaagttcttccagatgaattttagagtcagccattcattctccaagccttgagtttggtgcctcttcataattcacaccaaggtgttatatagacaagaggaggccttgtaaaacttgcggtaggagaaggtagccttaaacaggggagaaaagacaaaagctagaaggaaaggattaaaatatacctgcccatctgcccccttt

SEQ ID NO: 184547 - DNA, 601 bp, Human
ccaaagaaattttaatgttgatatctctgaattttaacctaaaaggataaggttatttaagctttgggttttaatttatgcctagcaatttgagaatgaggatttttttttaatttggaggattgttctatgggtaatttatttgactgcataacctcaggccaactatactggaatggccttcattagaaatagcaaataaaatcaggagtgagtttttggcctggggtccaccatattttggggttaatttaacagatgtactgttctgattcattttagaagtttaaggggcaaaaaytaaactgcctatctgtgagtctaagatgataaacaaaggagcagtagttgccattgaaggaagctggaaactcaagaaagaaagacaagatcattgtctttgttaatggcctcctaaaattccaacagcaatgataaaagaaatgaaaaagtaactgaaaatttacctccaaagaaggtccatagccgggcacagtggctcacacctgtcatcccaacacttgggaggctgtggcaggtggatcacctgagctcaggagttcgagactaacctgagcaacacattgaagcctcatctcta

SEQ ID NO: 184548 - DNA, 601 bp, Human
tcctcttgggcctttaacggagacattattggataggcatgactgactaccatgtagaaatgtaattggcccgaaaagcatgtgatcgaatactaataaactcagtggggaaacccagcaaggcctgtctgttcacattcttcctagtctcttccatgcagcattccttcctccagcggatggggcaggactcctgaattgagggtctcatgacccacaattacaaaggtggtggaagataagagttctgctgtgggctggtgaaagaagggcaggggaagttcacagagacagagagagatctgttttctgaggcctgcttctgagtgccctaacattataacgaaagactgtaacaagagctaagggagttataagccaggaactgtggacaaaacccaatatatcataatatcacagaggggaaatgatttgtaggagtttagccaaagaaattttaatgttgatatctctgaattttaacctaaaaggataaggttatttaagctttgggttttaatttatgcctagcaatttgagaatgaggatttttttttaatttggaggattgttctatgggtaatttatttgactgcataac

SEQ ID NO: 184549 - DNA, 601 bp, Human
ctaactagactgagcagaatcagaaatcaaagagtgagcagaaataaacacaacatcatcaacaccacaacacagaagacttctgtgaccaaatgtggggtggttttccccacacaccaagcaagcaatcagttctgcaacacacaccaactgggtaccctccaatttaattccaacactatctacctggagatagcgtcagatcccacaggttgagggatcagtcccatcagacttccccccaacccttcctcatcagacaccagtcacaagtccaggcctgtggaacttctgaccaatyggcttcaaattgggatttccatgaccccctctttgggtcccattaatttgctaaagtggcttacataactcaaggagacacttaacttacatttactggtttattacaaaggacattacaaaggatacagatgaagagatgcacagagcatggcacagggatggggtgcagagcttccatgccctccctgggcgtgccaccctccaggaaccctcaggggttcagctatccagaagctctccaaactctgtcctcttgggcctttaacggagacattattggataggcatgactgactac

SEQ ID NO: 184550 - DNA, 601 bp, Human
ttttctaaatgcagtgtatgtggtagtagaactggggtgatcttgtgtgttctgttagctcttacgatttttttctttttttgagacagagtcttgctctgtcgcccaggctggagtacagatggcgtgatctcggctcactgcaacctctgactcctaggctcaagcagtcttcccacctcagcctcccgagtagctgggattacaggcatgcaccaccacacccagctaatttttgtatgttttgtggagacggggttttaccatgttgcccaggctggtcttgagtgatccttctgcyttggcctcccaaagtgctgggattacaggcatgaaccaccatacccgaccaagtcttaggactttaaagggtgaacacatatggtttcaaactaattcagtttctcagatctgaaggaactgctaatttctgtgaggatcacgcagaatgaatctacactctactcagtcttttgaacaacacccctctaactagactgagcagaatcagaaatcaaagagtgagcagaaataaacacaacatcatcaacaccacaacacagaagacttctgtgaccaaatgtggggtggttttccccac

SEQ ID NO: 184551 - DNA, 601 bp, Human
agaattacttgttttctaaatgcagtgtatgtggtagtagaactggggtgatcttgtgtgttctgttagctcttacgatttttttctttttttgagacagagtcttgctctgtcgcccaggctggagtacagatggcgtgatctcggctcactgcaacctctgactcctaggctcaagcagtcttcccacctcagcctcccgagtagctgggattacaggcatgcaccaccacacccagctaatttttgtatgttttgtggagacggggttttaccatgttgcccaggctggtcttgagtratccttctgctttggcctcccaaagtgctgggattacaggcatgaaccaccatacccgaccaagtcttaggactttaaagggtgaacacatatggtttcaaactaattcagtttctcagatctgaaggaactgctaatttctgtgaggatcacgcagaatgaatctacactctactcagtcttttgaacaacacccctctaactagactgagcagaatcagaaatcaaagagtgagcagaaataaacacaacatcatcaacaccacaacacagaagacttctgtgaccaaatgtggggtg

SEQ ID NO: 184552 - DNA, 601 bp, Human
ttaggaaactgatacaggggtatagaggattaagcactggtacttggaacagtatttctcttaatgtcccaagtactttttcaactcctctaaaagctgtagaattacttgttttctaaatgcagtgtatgtggtagtagaactggggtgatcttgtgtgttctgttagctcttacgatttttttctttttttgagacagagtcttgctctgtcgcccaggctggagtacagatggcgtgatctcggctcactgcaacctctgactcctaggctcaagcagtcttcccacctcagcctccygagtagctgggattacaggcatgcaccaccacacccagctaatttttgtatgttttgtggagacggggttttaccatgttgcccaggctggtcttgagtgatccttctgctttggcctcccaaagtgctgggattacaggcatgaaccaccatacccgaccaagtcttaggactttaaagggtgaacacatatggtttcaaactaattcagtttctcagatctgaaggaactgctaatttctgtgaggatcacgcagaatgaatctacactctactcagtcttttgaacaacacccctct

SEQ ID NO: 184553 - DNA, 601 bp, Human
agacaaccagataacaaccactaagatttttcctggacatcagggatagacacagagagcaaattacctttaaacattatttcctagcactaaagacgagaacagtaatgggtaaacttggccccagatttagctgatcagggtatcttacttttaactgaccctaattaagttttcaaatcttgcttcctattccttatggtaaggaggatctggaaataaagaccttttatgtgggtaaacctgctctttggcattcttgggattcctgcccataagtttgatacaattataatgtatmatgtaaggactgacctcctttatttaatatttgcagagaggcatagagtttattctacaaatgtttgttgagtgtctactctgtgccaggcattgctctaggaactgggagtatatagtaaacaaaacaggcaaaaaataccagttcctctggagcttacattataatggaagaagatagataataaagaaataaataattaaaatacacaatattccagatagcaataaataacattaaaaaaaagaatggctggaaaaatggacagaaaatgcctggggatgggcctgcaattttaat

SEQ ID NO: 184554 - DNA, 601 bp, Human
atccagtctgtcgttgaccaaaacatcattgtatggcacaggactgtattagtatgactgtgaaataatgatggagagtatagtcaagggtagagcttagaggtaatatcagtgaagacaaccagataacaaccactaagatttttcctggacatcagggatagacacagagagcaaattacctttaaacattatttcctagcactaaagacgagaacagtaatgggtaaacttggccccagatttagctgatcagggtatcttacttttaactgaccctaattaagttttcaaatcttgyttcctattccttatggtaaggaggatctggaaataaagaccttttatgtgggtaaacctgctctttggcattcttgggattcctgcccataagtttgatacaattataatgtataatgtaaggactgacctcctttatttaatatttgcagagaggcatagagtttattctacaaatgtttgttgagtgtctactctgtgccaggcattgctctaggaactgggagtatatagtaaacaaaacaggcaaaaaataccagttcctctggagcttacattataatggaagaagatagataat

SEQ ID NO: 184555 - DNA, 601 bp, Human
atggtatggcctatagctcctaggctacaaacctgcacagcatgttactgtactgaatactccagacaactgtaacatcgtggtatttgtgtatctaaacatatctaaacatagaaaaagtacagtaaaaatacagataaaagattaaaaaatggtatgcctgtatagggcagcttcattataatcttatgggaccactcttgtatatccagtctgtcgttgaccaaaacatcattgtatggcacaggactgtattagtatgactgtgaaataatgatggagagtatagtcaagggtagascttagaggtaatatcagtgaagacaaccagataacaaccactaagatttttcctggacatcagggatagacacagagagcaaattacctttaaacattatttcctagcactaaagacgagaacagtaatgggtaaacttggccccagatttagctgatcagggtatcttacttttaactgaccctaattaagttttcaaatcttgcttcctattccttatggtaaggaggatctggaaataaagaccttttatgtgggtaaacctgctctttggcattcttgggattcctgcccataagt

SEQ ID NO: 184556 - DNA, 601 bp, Human
ggcaaaaatctttgtgaccttgataggacaaaaaaatcacaaactattaaaaaattggagcaagtgcagtggctctctcctcagcactttgggaagctgaggtaggaggatcgcttgagcccaggagtttgagaccatcctgggcaacaaagtgagaccctgtctctacaaaaaataaaaaaaattagctgggcatggtggtatgcacgtgtagccccagctacttgggaggctgagacaggaggatagcttgtgcccaggagtatgaggttgcaatgagctaagattgtgccactgcackccagctcaggtgacagagagagaccctatctcaaaaaaaaaaatgacaaatcgaacttcatcaaaattaaaatggttgatcttgaaaagatactgtcaacaaaatgagtcaagtgagagactgggagaaaatattttcaaaacaaatatctgacaaaggatttgtatcttgactatataaagaaccctttaaacacaataataagaagacaattaaatttaaaaacttaggcaaaaatttcaacagccatttcaccaaagaagctatatggatggcgattaagcacacaaaaagatgtgc

SEQ ID NO: 184557 - DNA, 601 bp, Human; identical to SEQ ID NO: 36818

SEQ ID NO: 184558 - DNA, 601 bp, Human; identical to SEQ ID NO: 36817

SEQ ID NO: 184559 - DNA, 601 bp, Human; identical to SEQ ID NO: 36816

SEQ ID NO: 184560 - DNA, 601 bp, Human; identical to SEQ ID NO: 36815

SEQ ID NO: 184561 - DNA, 601 bp, Human; identical to SEQ ID NO: 36814

SEQ ID NO: 184562 - DNA, 601 bp, Human; identical to SEQ ID NO: 36813

SEQ ID NO: 184563 - DNA, 601 bp, Human; identical to SEQ ID NO: 36812

SEQ ID NO: 184564 - DNA, 601 bp, Human; identical to SEQ ID NO: 36811

SEQ ID NO: 184565 - DNA, 601 bp, Human; identical to SEQ ID NO: 36810

SEQ ID NO: 184566 - DNA, 601 bp, Human; identical to SEQ ID NO: 36809

SEQ ID NO: 184567 - DNA, 601 bp, Human; identical to SEQ ID NO: 36808

SEQ ID NO: 184568 - DNA, 601 bp, Human; identical to SEQ ID NO: 36807

SEQ ID NO: 184569 - DNA, 601 bp, Human; identical to SEQ ID NO: 36806

SEQ ID NO: 184570 - DNA, 601 bp, Human; identical to SEQ ID NO: 36805

SEQ ID NO: 184571 - DNA, 601 bp, Human; identical to SEQ ID NO: 36804

SEQ ID NO: 184572 - DNA, 601 bp, Human; identical to SEQ ID NO: 36803

SEQ ID NO: 184573 - DNA, 601 bp, Human; identical to SEQ ID NO: 36802

SEQ ID NO: 184574 - DNA, 601 bp, Human; identical to SEQ ID NO: 36801

SEQ ID NO: 184575 - DNA, 601 bp, Human; identical to SEQ ID NO: 36800

SEQ ID NO: 184576 - DNA, 601 bp, Human; identical to SEQ ID NO: 36799

SEQ ID NO: 184577 - DNA, 601 bp, Human; identical to SEQ ID NO: 36798

SEQ ID NO: 184578 - DNA, 601 bp, Human; identical to SEQ ID NO: 36797

SEQ ID NO: 184579 - DNA, 601 bp, Human; identical to SEQ ID NO: 36796

SEQ ID NO: 184580 - DNA, 601 bp, Human; identical to SEQ ID NO: 36795

SEQ ID NO: 184581 - DNA, 601 bp, Human; identical to SEQ ID NO: 36794

SEQ ID NO: 184582 - DNA, 601 bp, Human; identical to SEQ ID NO: 36793

SEQ ID NO: 184583 - DNA, 601 bp, Human; identical to SEQ ID NO: 36792

SEQ ID NO: 184584 - DNA, 601 bp, Human; identical to SEQ ID NO: 36791

SEQ ID NO: 184585 - DNA, 601 bp, Human; identical to SEQ ID NO: 36790

SEQ ID NO: 184586 - DNA, 601 bp, Human; identical to SEQ ID NO: 36789

SEQ ID NO: 184587 - DNA, 601 bp, Human; identical to SEQ ID NO: 36788

SEQ ID NO: 184588 - DNA, 601 bp, Human; identical to SEQ ID NO: 36787

SEQ ID NO: 184589 - DNA, 601 bp, Human; identical to SEQ ID NO: 36786

SEQ ID NO: 184590 - DNA, 601 bp, Human; identical to SEQ ID NO: 36785

SEQ ID NO: 184591 - DNA, 601 bp, Human; identical to SEQ ID NO: 36784

SEQ ID NO: 184592 - DNA, 601 bp, Human; identical to SEQ ID NO: 36783

SEQ ID NO: 184593 - DNA, 601 bp, Human; identical to SEQ ID NO: 36782

SEQ ID NO: 184594 - DNA, 601 bp, Human; identical to SEQ ID NO: 36781

SEQ ID NO: 184595 - DNA, 601 bp, Human; identical to SEQ ID NO: 36780

SEQ ID NO: 184596 - DNA, 601 bp, Human; identical to SEQ ID NO: 36779

SEQ ID NO: 184597 - DNA, 601 bp, Human; identical to SEQ ID NO: 36778

SEQ ID NO: 184598 - DNA, 601 bp, Human
gcttgttttgcttcaagaatagcaaaggttgttttcaagagctctatttccagccttttggcctctttccatcatttgttcctatagactttttctcattgcatttgctgctttttgctttatttaaaattctactttatgtatcagatcaaatctcccccttcacccttctctaagtattatggccatgcaagttcccatagtgccaagacatcgaatgaggcatcgatgtaaaggactctgggagtgggagtttctagacatgcatggaattgacagacttttttttttttttttttttgaggtggagtctcactctgtcgcccaggctggagtgctgtggcgtgattttggctcactgcaacctctactttctgggttcaagtgatcctcttacctcagcctccctactagctgggatcacaggtgcctgccaacatgcccggctaatttttgtgctttttgtagagacagggtttcaccatgttggctaggctggttttgaactcctgacctcaggtgaccctcctgccttggcctgtcaaagtggtgggattacaggtgtaagccaccatgcctggccaacaaacattcttgcttt

SEQ ID NO: 184599 - DNA, 601 bp, Human
gcaaaggttgttttcaagagctctatttccagccttttggcctctttccatcatttgttcctatagactttttctcattgcatttgctgctttttgctttatttaaaattctactttatgtatcagatcaaatctcccccttcacccttctctaagtattatggccatgcaagttcccatagtgccaagacatcgaatgaggcatcgatgtaaaggactctgggagtgggagtttctagacatgcatggaattgacagacttttttttttttttttttttgaggtggagtctcactctgtygcccaggctggagtgctgtggcgtgattttggctcactgcaacctctactttctgggttcaagtgatcctcttacctcagcctccctactagctgggatcacaggtgcctgccaacatgcccggctaatttttgtgctttttgtagagacagggtttcaccatgttggctaggctggttttgaactcctgacctcaggtgaccctcctgccttggcctgtcaaagtggtgggattacaggtgtaagccaccatgcctggccaacaaacattcttgctttaataacctgaacatgtcatat

SEQ ID NO: 184600 - DNA, 601 bp, Human
ggcataggcacagccagttctccttctatggtacctaattctgcacaaaatatctgtttttctaaataaagggtcacatagatcattccagaagaaatttcaccctccaagtcacaaggtcagacagtgaattttttttaatgataagtctattttcaaagccaaaccaaatctgagaatttgtacatattcgcctattcttatcaaaagacatcaagttgttcaaagaacattaacgtttgctctaattatctttatattatatgtttaagatagaatttcagtcattaactaattcaayaaatgtttactgagcacctggtatttgctagctccttgttctaggctctggaaatgcaatggtggataaggtagaccaagaagaggagctgatgacaggggaaaaaggggaaatatctatatctatgtctatatctatctatatctatatctatctatatctatatctatatctatatctatatctatatctatatctatatctattttttgagatggagttttgctcttgttgcccaggctggagtgcaatggcgtgagctcggttcactgtaacctccgcctcttgggttcaagtgat

SEQ ID NO: 184601 - DNA, 601 bp, Human
tcagacagtgaattttttttaatgataagtctattttcaaagccaaaccaaatctgagaatttgtacatattcgcctattcttatcaaaagacatcaagttgttcaaagaacattaacgtttgctctaattatctttatattatatgtttaagatagaatttcagtcattaactaattcaataaatgtttactgagcacctggtatttgctagctccttgttctaggctctggaaatgcaatggtggataaggtagaccaagaagaggagctgatgacaggggaaaaaggggaaatatctrtatctatgtctatatctatctatatctatatctatctatatctatatctatatctatatctatatctatatctatatctatatctattttttgagatggagttttgctcttgttgcccaggctggagtgcaatggcgtgagctcggttcactgtaacctccgcctcttgggttcaagtgattctcctgcttcagcctgccgagtagctgggattacaggcatgcaccaccatacccggctaatattttatttttagtagagacagggtttctccgtgttggtcaggctggtctcaaactc

SEQ ID NO: 184602 - DNA, 601 bp, Human
tcaaagccaaaccaaatctgagaatttgtacatattcgcctattcttatcaaaagacatcaagttgttcaaagaacattaacgtttgctctaattatctttatattatatgtttaagatagaatttcagtcattaactaattcaataaatgtttactgagcacctggtatttgctagctccttgttctaggctctggaaatgcaatggtggataaggtagaccaagaagaggagctgatgacaggggaaaaaggggaaatatctatatctatgtctatatctatctatatctatatctatmtatatctatatctatatctatatctatatctatatctatatctatatctattttttgagatggagttttgctcttgttgcccaggctggagtgcaatggcgtgagctcggttcactgtaacctccgcctcttgggttcaagtgattctcctgcttcagcctgccgagtagctgggattacaggcatgcaccaccatacccggctaatattttatttttagtagagacagggtttctccgtgttggtcaggctggtctcaaactctggacctcatgtgatccaccttcctcagcctctcaa

SEQ ID NO: 184603 - DNA, 601 bp, Human
aaagccaaaccaaatctgagaatttgtacatattcgcctattcttatcaaaagacatcaagttgttcaaagaacattaacgtttgctctaattatctttatattatatgtttaagatagaatttcagtcattaactaattcaataaatgtttactgagcacctggtatttgctagctccttgttctaggctctggaaatgcaatggtggataaggtagaccaagaagaggagctgatgacaggggaaaaaggggaaatatctatatctatgtctatatctatctatatctatatctatctmtatctatatctatatctatatctatatctatatctatatctatatctattttttgagatggagttttgctcttgttgcccaggctggagtgcaatggcgtgagctcggttcactgtaacctccgcctcttgggttcaagtgattctcctgcttcagcctgccgagtagctgggattacaggcatgcaccaccatacccggctaatattttatttttagtagagacagggtttctccgtgttggtcaggctggtctcaaactctggacctcatgtgatccaccttcctcagcctctcaaag

SEQ ID NO: 184604 - DNA, 601 bp, Human
aaagacatcaagttgttcaaagaacattaacgtttgctctaattatctttatattatatgtttaagatagaatttcagtcattaactaattcaataaatgtttactgagcacctggtatttgctagctccttgttctaggctctggaaatgcaatggtggataaggtagaccaagaagaggagctgatgacaggggaaaaaggggaaatatctatatctatgtctatatctatctatatctatatctatctatatctatatctatatctatatctatatctatatctatatctatatctaatttttgagatggagttttgctcttgttgcccaggctggagtgcaatggcgtgagctcggttcactgtaacctccgcctcttgggttcaagtgattctcctgcttcagcctgccgagtagctgggattacaggcatgcaccaccatacccggctaatattttatttttagtagagacagggtttctccgtgttggtcaggctggtctcaaactctggacctcatgtgatccaccttcctcagcctctcaaagtgctaggattacaggtgtgagccaccgtgcccgtatatatatgtcatta

SEQ ID NO: 184605 - DNA, 601 bp, Human
aagacatcaagttgttcaaagaacattaacgtttgctctaattatctttatattatatgtttaagatagaatttcagtcattaactaattcaataaatgtttactgagcacctggtatttgctagctccttgttctaggctctggaaatgcaatggtggataaggtagaccaagaagaggagctgatgacaggggaaaaaggggaaatatctatatctatgtctatatctatctatatctatatctatctatatctatatctatatctatatctatatctatatctatatctatatctatcttttgagatggagttttgctcttgttgcccaggctggagtgcaatggcgtgagctcggttcactgtaacctccgcctcttgggttcaagtgattctcctgcttcagcctgccgagtagctgggattacaggcatgcaccaccatacccggctaatattttatttttagtagagacagggtttctccgtgttggtcaggctggtctcaaactctggacctcatgtgatccaccttcctcagcctctcaaagtgctaggattacaggtgtgagccaccgtgcccgtatatatatgtcattaa

SEQ ID NO: 184606 - DNA, 601 bp, Human
agacatcaagttgttcaaagaacattaacgtttgctctaattatctttatattatatgtttaagatagaatttcagtcattaactaattcaataaatgtttactgagcacctggtatttgctagctccttgttctaggctctggaaatgcaatggtggataaggtagaccaagaagaggagctgatgacaggggaaaaaggggaaatatctatatctatgtctatatctatctatatctatatctatctatatctatatctatatctatatctatatctatatctatatctatatctattatttgagatggagttttgctcttgttgcccaggctggagtgcaatggcgtgagctcggttcactgtaacctccgcctcttgggttcaagtgattctcctgcttcagcctgccgagtagctgggattacaggcatgcaccaccatacccggctaatattttatttttagtagagacagggtttctccgtgttggtcaggctggtctcaaactctggacctcatgtgatccaccttcctcagcctctcaaagtgctaggattacaggtgtgagccaccgtgcccgtatatatatgtcattaaa

SEQ ID NO: 184607 - DNA, 601 bp, Human
catcaagttgttcaaagaacattaacgtttgctctaattatctttatattatatgtttaagatagaatttcagtcattaactaattcaataaatgtttactgagcacctggtatttgctagctccttgttctaggctctggaaatgcaatggtggataaggtagaccaagaagaggagctgatgacaggggaaaaaggggaaatatctatatctatgtctatatctatctatatctatatctatctatatctatatctatatctatatctatatctatatctatatctatatctattttttgagatggagttttgctcttgttgcccaggctggagtgcaatggcgtgagctcggttcactgtaacctccgcctcttgggttcaagtgattctcctgcttcagcctgccgagtagctgggattacaggcatgcaccaccatacccggctaatattttatttttagtagagacagggtttctccgtgttggtcaggctggtctcaaactctggacctcatgtgatccaccttcctcagcctctcaaagtgctaggattacaggtgtgagccaccgtgcccgtatatatatgtcattaaacta

SEQ ID NO: 184608 - DNA, 601 bp, Human
gttccgcagtcccggcctacttgctgccaacacatgccccctccgtgccccgccctcgcccgccacccttgccgcccttacccagagctccttgtacgccttctgggtggggacgttttcccttccagcaatttactgaagaaatgaggctcttccaaaaaggaggacagaagatcaaattgtcactttcgggggggattggggggagattttcctttcttttgaaaaaaattaaattgaggacttgggtggttgacaagctatcaatattccaaattaatatgaaacaaaagaaatttakaatttctctttagaatgttctggaaggtcataggtaagacattgggtttggcactgttccaaagaagaaatacattgacattttagaccagatcacagctgctagatcagactcattggatgtaaccgataactgacattttgcacccttttgtgacttgattcttactcaacagtgacagaacattgctttcataatgtgagttaggtaacatggttctaaaaagggaggctgaacacttttagctctgaacacaaccagtgttgatagataatgccactagatgtgactgtgtccctc

SEQ ID NO: 184609 - DNA, 601 bp, Human
gccactagatgtgactgtgtccctccggatgacctcagctacagatggagaaaggtcagttaagctggacaacccaatgccaagggcagaaatttctcagggaatgagatgctgtgttgtggaaccacaactttttttaaaaaaagtattttgtgctgtgggtaaatgtgtcaaatggtaaagccatttgacgggcaattttgcaatccattagcatttgaagcacatgcagccagcagctgtgcttcttgatgctggcagggagaaacactcccacacaggtgtgtaagggggcacataygaagatgttctgcggggccttattcataatggcaaagtgcagtagagatgagtagagtactgggtataggtggaaagggaccactgaggaggtagcttctggtaggggatggtgccaaaatcacctcagctactgtccaggacaaccagagctctgggctgcaaacctgtagcctaggccccaaaagaagcattcggaaccaaatggaaattgcaacactgtgcttaatacattgcctagttttatccaaaaaaaaaaaaaaaaaaaaaaaaaaagaggggacttgaataaccaaaaact

SEQ ID NO: 184610 - DNA, 601 bp, Human
cgatccagttggctggaaagaggtatacgtgtgggaaagcaggacggaaaaggagccaggggccttggatgccacggtcaggaatccagacttttgtggagagggaacagggagccgttgacgggtgtagactactgtcttgtcctgattgcttagcaagggttttttttttttctacatagtttacagtctcagatctctgtgacaacttcagtgataagttaaaatagttaatatttttaaaaatcctgttgtcttgtaaagtctgggctttctgtaaaaaaaaaaaatcctgtggggktttttttttttttttttggtaaaagagaatgaaaaagtttctgttcttgacatgtgtgcaagaacttgaggagtgggcactttgaactgacgcagagcgacctttcctaagaatacatcgatcatgctgcccccatgctataaaacatctaatcagtttaaaagatctctgcatatacatataagaaatcacaggtttaaaatgaggacagtgggaaatgatgccaggtgccgaaacatttgcttttcattgtaaagtgctgatacaaagcttcctccatgtgccttaggaggccacatg

SEQ ID NO: 184611 - DNA, 601 bp, Human
tctacatagtttacagtctcagatctctgtgacaacttcagtgataagttaaaatagttaatatttttaaaaatcctgttgtcttgtaaagtctgggctttctgtaaaaaaaaaaaatcctgtggggttttttttttttttttttggtaaaagagaatgaaaaagtttctgttcttgacatgtgtgcaagaacttgaggagtgggcactttgaactgacgcagagcgacctttcctaagaatacatcgatcatgctgcccccatgctataaaacatctaatcagtttaaaagatctctgcrtatacatataagaaatcacaggtttaaaatgaggacagtgggaaatgatgccaggtgccgaaacatttgcttttcattgtaaagtgctgatacaaagcttcctccatgtgccttaggaggccacatgctgaaaccttgtgaggaagtcttcttaaaaatatataactcagataatgactcatgttagctagcagactgagctcattatctctccataataggataggctcaattcaaatataatcaagttgttaaatagaagataaggaaaatggaagaagtgggaatttttttgtgatc

SEQ ID NO: 184612 - DNA, 601 bp, Human
attcaacaagtcctaattaatcagccactatgtgccaggctttgatcgtcctcctgggccacctcccctagaggtacagagcaaactttccaaagaatgcattgatcatgccactcccatgctttaaaaaatctaattggttttaaaggatttctatcaatttaaataatcatatgcaagatgaattctgaatggtttgaaatacacatttgtttagtgtgttcatggatttttttttagccaaaataaattctaggaagccattagcaaaaataagcaaaaagggatacttttatcttcyccacagcttgtcatacacaaaattgcagttgcccaaattgttcatgtgtatgcatgagactggaaaatgttccactacaagtgttgaagtcaaatctcttaaaaattgcttaatggaactctcaaaagtcaaagatggccaggcgctgtggctcatgcctgtaatcccagcactttgggaggctgaggtgggaggatcacttgaggtcaggagttcgagaccagcctggccaacatggagaaaccctatctttactaaaaatacaaaaattagccaggtgtgggacacctgtagtcccag

SEQ ID NO: 184613 - DNA, 601 bp, Human
acagagcaaactttccaaagaatgcattgatcatgccactcccatgctttaaaaaatctaattggttttaaaggatttctatcaatttaaataatcatatgcaagatgaattctgaatggtttgaaatacacatttgtttagtgtgttcatggatttttttttagccaaaataaattctaggaagccattagcaaaaataagcaaaaagggatacttttatcttccccacagcttgtcatacacaaaattgcagttgcccaaattgttcatgtgtatgcatgagactggaaaatgttccamtacaagtgttgaagtcaaatctcttaaaaattgcttaatggaactctcaaaagtcaaagatggccaggcgctgtggctcatgcctgtaatcccagcactttgggaggctgaggtgggaggatcacttgaggtcaggagttcgagaccagcctggccaacatggagaaaccctatctttactaaaaatacaaaaattagccaggtgtgggacacctgtagtcccagctactcaggaaactgaggcaggagaattgcttgaaccggggaggcggaggttgcggtgagccgagatgtcgccat

SEQ ID NO: 184614 - DNA, 601 bp, Human
gaatggtttgaaatacacatttgtttagtgtgttcatggatttttttttagccaaaataaattctaggaagccattagcaaaaataagcaaaaagggatacttttatcttccccacagcttgtcatacacaaaattgcagttgcccaaattgttcatgtgtatgcatgagactggaaaatgttccactacaagtgttgaagtcaaatctcttaaaaattgcttaatggaactctcaaaagtcaaagatggccaggcgctgtggctcatgcctgtaatcccagcactttgggaggctgaggygggaggatcacttgaggtcaggagttcgagaccagcctggccaacatggagaaaccctatctttactaaaaatacaaaaattagccaggtgtgggacacctgtagtcccagctactcaggaaactgaggcaggagaattgcttgaaccggggaggcggaggttgcggtgagccgagatgtcgccatttcactccagcctgggtgacagagcgaaactctgtctcaaaagaaaaaaaaaaagtctaagatgatacctatgagacaggtgttttgttgttgttttgttgtttgacattcttt

SEQ ID NO: 184615 - DNA, 601 bp, Human
gacaggtgttttgttgttgttttgttgtttgacattcttttattatactcaagccattcctggcaaatagaacgtattaagctttaaattaatgtcagttattgttgttactgatgatattattattattatcatcattattattcctatagcatcccggaagcactcaggtcttcccgactcctttgagtctttgtttctttcagtcctcctgagtacaattctaccaccttcttctgaaaataacatttttatagtaactcttgaactccaagtgggtgctaaattcttaagccaaatmatatccatttgtgtggcatttaaagactccctccacctcccatagttcttccctttagataccctttccttctctctttactcagatcagcatctccatcattaaaagcacatggcactgtctcccatccttgctgttctacttgcctggaacctccctccctcccccaactaccgtggcagaataccagagagatttggaatgagacaaaccctcctatttactagctgcatgactgggcaaatgagttacaccctctgagcctcagattcctatcctgaaacatatgtataaatacct

SEQ ID NO: 184616 - DNA, 601 bp, Human
gaattccaatttatgatgtcaaagacatacatcagaatgtaagcctgttcaggacaggaccattgttttgttcaccactgtttccttaatgtctagaacattgcctggcacttagtaaatatttgttgagttaaaggttatctgtgtctttgtccatctgtctaccattaatctgttcactgtatgcaagcatggactatcttgctcactgtgatatccccagcgcctggcaggtgataagatcaataaatatttgttgaatgaataaatgactgaaataatctatccataagacacttaytgagcccctactgtgtgccaaggaatatgctggacctcaatgatgcagaattgactcagacactatcccagcctcaaggaatttgatcacctagaaaggattacatcaactctttctgggaacatttctaaaaactatcccaagttactcaatgttccccatcccagaagcgcgggaagtagatgagatgatcggggactattcagcaccaggttttgtcttggtgctgacaggtctgtgtccctagggttgtattccccctctgtggggtttgggtatgaaatgattgaactgatgttc

SEQ ID NO: 184617 - DNA, 601 bp, Human
ttaacatgatttctccaaagtgaaagggatgtttttttaaaagtcagtggagaaactacctttggctatttctttcattcatttcttcaatccttcagtattggtagagactggctgtgtggcaggccctgtgttaagtagtggcagtggggacccagaaaggaactcagtatggctctgctatggaggtgcccctcagcaggtgggagaagggagagcacacaaggtggatgtgtatgctaccagagcttggtcaggagtttgcggtcctggaatattcagtggcacctacaaacccctygcagaggccacagtggaaagcccagatgaggcctcttacatacaggttggggacaggttgggtgaaccaaaagaccaagaatcctgactttcctggacttattatctaacctctctaagcctcagctgccccagcttcctcagggggatgttgcaagagtcaactgagatgatgtcagtggatgatggaaggtactgtttactcagtcatccaataactcagacatttattaagcacctaccatgtgcgattacaactgttgctgttatgaattctgcatgagatgtctgtgcatggaca

SEQ ID NO: 184618 - DNA, 601 bp, Human
ataaatcatcattctctaaatgatggcctcattccatctcacctcccatccttccttaccatgctttatttttctttatagcatttatcatgacttgaaatagatatatttatacatttatatagtatagttttctctctatatatagatatatagctaactttccctactgctactctatgcttgtcaaatatctatatctatgtatacacctaccatgtgagtatacagaagcattatatatacgtaatgattttgttttgtctgtctcctctagaatgaaagctctatgaggactttytgttcattatgcatcccctacacccagaacaatgcctggcacagaataagccctcagatatttgttacatgttgtatgatttatatttacattacttgtcagggaccatgtgaatcacttttacgtatgtgaactcgtttaaccttcatgataataaccctatgaaactggtgttgtatccattttccattagcccatttactgagtagaaatgaacttattgaggtacacatggaaactagctgtatttttacttactttgaagaatcgccttcaaagttctccacccaactcttcctg

SEQ ID NO: 184619 - DNA, 601 bp, Human
cttactttgaagaatcgccttcaaagttctccacccaactcttcctgctctgatgatgatgtcttcagaggaaatcccacagcatctggccatgttcacccatcacatcagtcttggctgaataattacagctcattctcagctattaaaaagtgtagttcagtccaatttaaaacttcaatctcacatctaagtcagaccttcttcctccttgtggctcagaatttgctctgggaaagaggggtaggatcagctttttctccttccttttctggctcctccagggttggggttgggagayagtgggggaggaaaggcaacaagagtcatttgacaaactggtgctcactgggggcttctcctagctataagtgccttctgctatgactgtcacccaaatgctggggccaggggtcctgtcataggttttgggggagccactgtggatctctgtccacattagctgagagatgtgctctctagccaacctcctaccacctccactcacaggctgctttggcccctcaggtaactgaggagtccctctgtagctctgttattgtgttggaagcttctggccaactcactgcacaccgagtgt

SEQ ID NO: 184620 - DNA, 601 bp, Human
tgctctgggaaagaggggtaggatcagctttttctccttccttttctggctcctccagggttggggttgggagacagtgggggaggaaaggcaacaagagtcatttgacaaactggtgctcactgggggcttctcctagctataagtgccttctgctatgactgtcacccaaatgctggggccaggggtcctgtcataggttttgggggagccactgtggatctctgtccacattagctgagagatgtgctctctagccaacctcctaccacctccactcacaggctgctttggcccctcrggtaactgaggagtccctctgtagctctgttattgtgttggaagcttctggccaactcactgcacaccgagtgttacaccctgattcttagagatgcccagaggagccccaaaaagcagaactggcagataggacaggctgaactcaatgaagcataaacaaaaaatagctttgctttgttccaagtttgtctatggcccacttccttccctgacccctgattgttgcatggcagatttaatagcttttgggttattgattataagaacaagcatcttctcaataatttatactcttttt

SEQ ID NO: 184621 - DNA, 601 bp, Human
atattaagaatcattgtgtcttcttggagattgatacctttataattatataatgcccttctttatccttgataactttctttgctttgaagtatgctccatatgaaattaatatagttattcctgtttcttttgattagtattatcatagtatatttttctccatccatttacttttaatctacatggatctttatatttaaagtgggtttcttatagacaacatatagttggatcttgttttttgaactgcttaggcaatctttgtcttttaattgatgcatttagaccatgatcttcraagtaattattgataaaattggataatatttaccatatttgttactgttttctatttgttgcccttgttatttgttacgatttttgtcttccactcttctgctgccctttgcagttttaattgagcatttcatatcattccattttttctcctttattagcatatgttatactttaacataaaaaaaccttttaaatggccttcctataatttgcaatatatatttacaactaattcaagcccacttttaaataatgctatgccacttcacaagaagggcgagcaccttataatgagaaa

SEQ ID NO: 184622 - DNA, 601 bp, Human
ttgtaattgccccctagtccttggatgttctgttcggtttttcagtctttgttctcttcgctttttagtttttgaagtttctgttgatatctacacaagctcagagagtcttcagctgtgtctagtcacctgcaaatccatcaaagtcactcttaatttctgttacagtgtttttgatctttagcatttctttttggttctttcttaggatttctatctctctgctcacatggtccatctgttcttgcaggctgtctaatctatcaattagaacccttagcaaattgatcacagttgtttwaaattcctggtctgataattctgacatccttgccttgtctggttctgagccttgctgtttctttaaattgtgttttagcatgccttgtaattctttcttggtggccgaacatgatatgccaggtaaaaaaggaattgctgtaaatcacctttagtcatatggtggtaaggcgtgttgttggtgggggaagcaatctattgtcctgtgattaggtctcaatcctttagtaagcctatgcctctggactgtgaactttactacaagtgtttctccattttttccctcccctcttagatgtca

SEQ ID NO: 184623 - DNA, 601 bp, Human
tttgtgctctgccctttctagcagatggcttccagtttctatatcacctcatggtccaaaatgactgctagactccaaaaactatcttccaggaaagaagtagaaaaaaatggggtaagggaagaaaggtcaaagctcccagttcagtcagccctctttagactctttcccagagctcagcccagtgattttcccttacatctcattggctgcctttggctatcagggaggcaagaaaatgtggtccactctatcctggaataaaaactacggtttgagccaggtgcaatggtgcaggctyatagtcccagctactcaggcacgaggctgaggtgagaggatcacttgagctcctgagttcgagtccagcctgggcaacacagcgagagcccctcttaaaaaaattttttaaacttaaataataattaggatttatttaccttggactaaggatgaaggggaaaaaagaaaaaataattagggtttagtggggaaggagtaggcaactagccattttatccacataagggtgtttcacacatccatgcatccttgtatatgctacaactatgaaatggaactcaggatcctggaagagtat

SEQ ID NO: 184624 - DNA, 601 bp, Human
atcttccaggaaagaagtagaaaaaaatggggtaagggaagaaaggtcaaagctcccagttcagtcagccctctttagactctttcccagagctcagcccagtgattttcccttacatctcattggctgcctttggctatcagggaggcaagaaaatgtggtccactctatcctggaataaaaactacggtttgagccaggtgcaatggtgcaggctcatagtcccagctactcaggcacgaggctgaggtgagaggatcacttgagctcctgagttcgagtccagcctgggcaacacagygagagcccctcttaaaaaaattttttaaacttaaataataattaggatttatttaccttggactaaggatgaaggggaaaaaagaaaaaataattagggtttagtggggaaggagtaggcaactagccattttatccacataagggtgtttcacacatccatgcatccttgtatatgctacaactatgaaatggaactcaggatcctggaagagtataggttattctctcaaattatgagctcatgggaagtaacatgggtggtacaatgtgatcacttaagactgtggagggtgacatg

SEQ ID NO: 184625 - DNA, 601 bp, Human
gagtgtggaagagacaccagtaagaggtagagagactggagaaagggaagctgaggtgacagatgtgcttgtatgaattaaatttatttatatcctgcattttttcagtgaggacatgggtaattggcagtttgggttgtgggtggctcatccttgaagatttggctcctttctcctcgctgaccatccttgggcaatggggaaaaaagccaagtgtgttctggggacctgtgcttcatcagctgcacttacctgcattggagagaacagagacttcctcatttacacggtggccctcttmttctagtcccaccagtctgcccaccctcctcccatcctgacgtggggtcacttgcacacccctgaactgacacagcagaagatgagggcactcttgaggcatctttaggatccttcaaagatggtctttttccagttctcaaaggaaaaaaaaatacgtacatagacagactttccttctacttttaattcttgtatatatttttcttaatatttttgaatctgctgtggggcatccatgacagaatgtctgatttcacaccaggttttttctaggggtgtgtgtgtgtgtgtgtgtgtg

SEQ ID NO: 184626 - DNA, 601 bp, Human
ggacatctactgattccattgcattagaatttattttagatcacttcttgttgatggcaaatctttacctactgagggtgggtggaatttttggaaacaaacgcccgatgactaagattggagatcaaactgatcaagatcatattatttggggtcaaaattgaaggctgtattatgtagagtgatgagactgaatggccttcctgggtggctctgggggtgtctcttgaggcaacaccaagagaggcagtggggcagggggtgtcattcacaatgagaggacaccgtgctggctctggcrtgtgtgggcatgtgtcagccacagtaaagaagatgacaggtagaagaatcagattcctgtttcttccactggccagagactgtgaatggagacagccttgaatcaccctagatcccagttcctcatttgtaaagtgagatcatcatactctcttccagtgttgttttccttctttcttttcttttctttcttttgtttggagatggagtctcgctctgtcacccaggctggagtgcagtggcatgatcttggctcactgcaacttccgcctctcaggttcaagtgattctcctgcctcag

SEQ ID NO: 184627 - DNA, 601 bp, Human
gagatcaaactgatcaagatcatattatttggggtcaaaattgaaggctgtattatgtagagtgatgagactgaatggccttcctgggtggctctgggggtgtctcttgaggcaacaccaagagaggcagtggggcagggggtgtcattcacaatgagaggacaccgtgctggctctggcatgtgtgggcatgtgtcagccacagtaaagaagatgacaggtagaagaatcagattcctgtttcttccactggccagagactgtgaatggagacagccttgaatcaccctagatcccagtwcctcatttgtaaagtgagatcatcatactctcttccagtgttgttttccttctttcttttcttttctttcttttgtttggagatggagtctcgctctgtcacccaggctggagtgcagtggcatgatcttggctcactgcaacttccgcctctcaggttcaagtgattctcctgcctcagcctcctgagtagctgggactacaggtgcacgccaccacgcctgactagttttttgtattttagtagagacagggtttcactgtgttgcccaggcttgtctcaaactcctaagctcaggca

SEQ ID NO: 184628 - DNA, 601 bp, Human
atgttccttgggaaagcataatataccacaaaagcccaaaaactagattgaatgaggagcgtctgcaaatccatgaaggatggaagtatagagggctaactccgtcagtgaagagaaagggctagaaaataatgataactagaggacgagtcactagagaggcagagaggagtgttaatagatatggaccccctgctccggctcctccctggcagctggtcactcctggctcccctccagccagcgggctgtgaaagcctgttgaggttgagctcttgccctgcactcttgtcccacttcyggctggtgaagtcccaggaggcaagcctgggtacccagtctctagcctctctgatcctgctacgagcctgtgagataagctgagcgagtgttatgatccccactttatagatgaagaacttgatgctcaaatggaagaaagagcaaaaggtcttttgtgacttttcaatttagcacatttttataaagtgttaatgctgtcctatactttataaaagtgtgttttaagaacattgaaatgtgtctccccttggataaagcagctccacctttgagaaactatcacgaggaggaaatccca

SEQ ID NO: 184629 - DNA, 601 bp, Human
taacatccccacctccattttctttcttttttttttttccaagacagagtcttgctctgtcacccaggctggagtgcagcggtgtgatctcggctcactgcaacctctgcctcctgggttcaagcaattctcctgcctcagcctcctaagtagctgggattacaggcatgcaccaccacgccaaactaatttgcgtatttttagtagagacggggtttcaccatgttgtccaggctggtcttgaactcctgaccttagtgatctgcctgcctcaccctcccaaagtgttgggattataggyatgaaccaccgtgcctggcccccacctccattttctttattcccctcaccctacttttgtgttcccctctggagcacttacctgatagaagatacattgactttttcatttatttttggtcttctcacactagaatgtaagcttcttgaacagaggctgtttctgttttgctcagtgtgtttctcagtgcctagcaaaatgtccggcctgtagcatgagctcagtggatatctgctggtgaatgaatccctgctttgtaccattagccaacctattatggttattgaggctgcagcttgt

SEQ ID NO: 184630 - DNA, 601 bp, Human
agtggtcgtgatggggcatgacgggaagcagggccaatgagactatggcagcactccaggtgcaaaaccatggtcctgggatgcgtagagatgggaggatatgggtagaatcaggaatatgaagatagagggtagaacttggtcacaggttggaagtggcacatacaaggcaatcatggtttgggaaaggcgagctctggtgtggtcaggtaatggggaaaggctcacagagcagcagagtgcatgctgcgtggctggatgggctctgagggcacaggtagtgaggagggagagagagttkaaggtagaaggtgcagaggtatggacctgggaagcattcagggaatagtgcaacaccaagtagtctgacttggacagaacctcgagttcatggaaggaaatttagagaaaagatggaagcaaagagtggtgtctgagtttcaatcaaaagaacctctgctaagtcaggtgaccgtggagaattgccagaggcctctaggtagacaggtaatgatctgcatcattccttcagtaaacctacttggggacctcaattatgcaaataatgatttttgattagcattttattaagcaggagcat

SEQ ID NO: 184631 - DNA, 601 bp, Human
agaacctcgagttcatggaaggaaatttagagaaaagatggaagcaaagagtggtgtctgagtttcaatcaaaagaacctctgctaagtcaggtgaccgtggagaattgccagaggcctctaggtagacaggtaatgatctgcatcattccttcagtaaacctacttggggacctcaattatgcaaataatgatttttgattagcattttattaagcaggagcatttcactgccagatgatcacttgagtgggtgcagggaaatttcatccaggaggagacacggggctgtctgctgatgwcaccatcccctcagctgcttctcaccttccctagcctattgggtgcagggccctcagatcctgttcatagcagaggccaccagaacatctccaagagggtcaatgtgaggagaatagaagagaaatcttcactgaagagttgatgagaacgagaaatcatttcattcctcaaacacacccaatgtgtaaatgtaggaatatgacataaaagaaataaaggttactgttaaaggaaggaatgagaggcttcgagacattctcattcgtctagaagcagtaacattgcggtggtagagtgtt

SEQ ID NO: 184632 - DNA, 601 bp, Human
cttcagtaaacctacttggggacctcaattatgcaaataatgatttttgattagcattttattaagcaggagcatttcactgccagatgatcacttgagtgggtgcagggaaatttcatccaggaggagacacggggctgtctgctgatgacaccatcccctcagctgcttctcaccttccctagcctattgggtgcagggccctcagatcctgttcatagcagaggccaccagaacatctccaagagggtcaatgtgaggagaatagaagagaaatcttcactgaagagttgatgagaaygagaaatcatttcattcctcaaacacacccaatgtgtaaatgtaggaatatgacataaaagaaataaaggttactgttaaaggaaggaatgagaggcttcgagacattctcattcgtctagaagcagtaacattgcggtggtagagtgttaagttggactggatgcattcaaatcgcaggtctgcatctgagctgtgtggctttgtgcaggttgcttagcctctctaaacctcactttactcatctatactgagggaatatcagtggaacctggcgctggattgttgtgatgattaactg

SEQ ID NO: 184633 - DNA, 601 bp, Human
acataaaagaaataaaggttactgttaaaggaaggaatgagaggcttcgagacattctcattcgtctagaagcagtaacattgcggtggtagagtgttaagttggactggatgcattcaaatcgcaggtctgcatctgagctgtgtggctttgtgcaggttgcttagcctctctaaacctcactttactcatctatactgagggaatatcagtggaacctggcgctggattgttgtgatgattaactgagataatacatgtaaagtggttagcacagtgcctgagccaggactggaaccckggtgagcctgactccaaagcctgtgtgcctaatcactgtataccactgtttcccaattcactaggaaaacagagaaaggaggcagctaaggctgcatgggaagggtcacagggcaagtgggagaggcttggagaaagctaggagttccttggggtgagtggaaacagtgtggccttggcattccaggcacagggaacagcactgtggatgtgggagcaacataagcctggagctctggggagtggctggatttcaggctgggcagctgggtgggagtcgatcacagagggcctcatggac

SEQ ID NO: 184634 - DNA, 601 bp, Human
cgcaggtctgcatctgagctgtgtggctttgtgcaggttgcttagcctctctaaacctcactttactcatctatactgagggaatatcagtggaacctggcgctggattgttgtgatgattaactgagataatacatgtaaagtggttagcacagtgcctgagccaggactggaacccgggtgagcctgactccaaagcctgtgtgcctaatcactgtataccactgtttcccaattcactaggaaaacagagaaaggaggcagctaaggctgcatgggaagggtcacagggcaagtgggrgaggcttggagaaagctaggagttccttggggtgagtggaaacagtgtggccttggcattccaggcacagggaacagcactgtggatgtgggagcaacataagcctggagctctggggagtggctggatttcaggctgggcagctgggtgggagtcgatcacagagggcctcatggaccatcctgaggagcctggatttttattcagagtgggcagcaagaagacatccagcattttcaatgaggaagtgaaatgatcatattggcattttagaaagatcctgccgctgaggccgggtgt

SEQ ID NO: 184635 - DNA, 601 bp, Human
ggaatatcagtggaacctggcgctggattgttgtgatgattaactgagataatacatgtaaagtggttagcacagtgcctgagccaggactggaacccgggtgagcctgactccaaagcctgtgtgcctaatcactgtataccactgtttcccaattcactaggaaaacagagaaaggaggcagctaaggctgcatgggaagggtcacagggcaagtgggagaggcttggagaaagctaggagttccttggggtgagtggaaacagtgtggccttggcattccaggcacagggaacagcaytgtggatgtgggagcaacataagcctggagctctggggagtggctggatttcaggctgggcagctgggtgggagtcgatcacagagggcctcatggaccatcctgaggagcctggatttttattcagagtgggcagcaagaagacatccagcattttcaatgaggaagtgaaatgatcatattggcattttagaaagatcctgccgctgaggccgggtgtggtgcatgtacctgcagtcctagcttctctggaggctgaggcaggaggatctcttgagcccaggaattcaaggctgcagt

SEQ ID NO: 184636 - DNA, 601 bp, Human
tacatgtaaagtggttagcacagtgcctgagccaggactggaacccgggtgagcctgactccaaagcctgtgtgcctaatcactgtataccactgtttcccaattcactaggaaaacagagaaaggaggcagctaaggctgcatgggaagggtcacagggcaagtgggagaggcttggagaaagctaggagttccttggggtgagtggaaacagtgtggccttggcattccaggcacagggaacagcactgtggatgtgggagcaacataagcctggagctctggggagtggctggatttyaggctgggcagctgggtgggagtcgatcacagagggcctcatggaccatcctgaggagcctggatttttattcagagtgggcagcaagaagacatccagcattttcaatgaggaagtgaaatgatcatattggcattttagaaagatcctgccgctgaggccgggtgtggtgcatgtacctgcagtcctagcttctctggaggctgaggcaggaggatctcttgagcccaggaattcaaggctgcagtgagctaggatagcaccactactccagcctggtcaacagagtgagaccctgtc

SEQ ID NO: 184637 - DNA, 601 bp, Human
aagggcagaaagagagaaggggctagattcaggagacatcctgaaggcagaaccagtaggacctggggttgtgcagtgttaggaagagaggagtcagggaggactctcctgttctgtcttaggtaactcagtggagattgatgctggtcacacagatgttaaaactgcatgtattgatctatacattattcaaaaagaataagtaaaaaccatcaggaatgaagggagtcatagattaaattgatccgtgaattcccaggccccatgctatggcttgataattcctcaagatcacagtgcrtagaatcacaaacacactgattgtacacgttattgcctcacagaggtagaacaaatggctccagaaggccagtcatttcccaggggccttctggcacatctctagaacacagtcggcaacccctggtaccttcacctagggccaggcatcaagggcttggcctgtgttgctttatagatgttatgtaggataccatttggataaacacttagaaagatttcagaacttagcccagtctcttaaatcaagtaatcataagacttagcaaccaaacaaaacaatgctgctttcttcaattat

SEQ ID NO: 184638 - DNA, 601 bp, Human
ctggccaagtgcagtggctcacacctgtaatcccagcactttgagaggttgaggtgggtggatcacttgaggtcaggagttcgagaccagcctggccaacatggcgaaaccctgtctctactaaaaatacaattagccagtcgtgttggtgtgcacctgtagtcccagctacttggtaggctgaggcaggagaatcacttgaacccaggaggtggaggttgcagtgagctgagccatgccactgcactccagcctgggcaacagagtgggggctctgtctcagaaaaaaacaaaaaaaaaaaccaaaaaccacaatactttactgttgtgtccatttgtatcggagaaattttccagacctaaacataggaaaatttctgctttttctaagcaactagtatgcacttatattgatactgggactcttggaactctattgtattatcttctttgcttgggtggttaggaaacttagaacccacttttaaccaatgtgaaaaatcccctggctcaatttttatgcttcccttgttttctttctatcgctattagcatgtctatgtctgttcagtagtgtgcctttgtgaacagctgcttcaaa

SEQ ID NO: 184639 - DNA, 601 bp, Human
tggccaagtgcagtggctcacacctgtaatcccagcactttgagaggttgaggtgggtggatcacttgaggtcaggagttcgagaccagcctggccaacatggcgaaaccctgtctctactaaaaatacaattagccagtcgtgttggtgtgcacctgtagtcccagctacttggtaggctgaggcaggagaatcacttgaacccaggaggtggaggttgcagtgagctgagccatgccactgcactccagcctgggcaacagagtgggggctctgtctcagaaaaaaacaaaaaaaaaamccaaaaaccacaatactttactgttgtgtccatttgtatcggagaaattttccagacctaaacataggaaaatttctgctttttctaagcaactagtatgcacttatattgatactgggactcttggaactctattgtattatcttctttgcttgggtggttaggaaacttagaacccacttttaaccaatgtgaaaaatcccctggctcaatttttatgcttcccttgttttctttctatcgctattagcatgtctatgtctgttcagtagtgtgcctttgtgaacagctgcttcaaat

SEQ ID NO: 184640 - DNA, 601 bp, Human
acttgaggtcaggagttcgagaccagcctggccaacatggcgaaaccctgtctctactaaaaatacaattagccagtcgtgttggtgtgcacctgtagtcccagctacttggtaggctgaggcaggagaatcacttgaacccaggaggtggaggttgcagtgagctgagccatgccactgcactccagcctgggcaacagagtgggggctctgtctcagaaaaaaacaaaaaaaaaaaccaaaaaccacaatactttactgttgtgtccatttgtatcggagaaattttccagacctaaamataggaaaatttctgctttttctaagcaactagtatgcacttatattgatactgggactcttggaactctattgtattatcttctttgcttgggtggttaggaaacttagaacccacttttaaccaatgtgaaaaatcccctggctcaatttttatgcttcccttgttttctttctatcgctattagcatgtctatgtctgttcagtagtgtgcctttgtgaacagctgcttcaaatcctggctctgaagccattcatatgctgaaagtctgaagggcttggccacaggttaatataaat

SEQ ID NO: 184641 - DNA, 601 bp, Human
cattgataccattttagttgagatcaccaacacctagccctccaattaggggaagactacacaaccccttagtcctcaaatgccacaggaggaaattcaggcacagagaggttaaacagtatgtcccagttcaaacagctaacaaggtcacagtccatatttgttgagtgaatgagtaaatcaatcagtgagagtagtggtgtggataaaagaggggtgaatagatgaatagagattcatccccatccctagagaaagcactcaaggtttatgccctaccaacaagaaatcagcaacagcwtcttttctcatgaaggcttactctctctgaccatgtatgcctgctcagtgctgtaccaggagggaagggagtcttggttacactcaaaaaatccctggaagtaaaagggtcatcaggacaatcagtggtaataatgggtaacatttattaagtacttactaactgccaggcactactgccagctatttacatacattcactttttaaaatttcacaataactctagaggttattatcattcctattttacaaatggggaaactgagtcatgtggatactaaataacttgcccaagggcat

SEQ ID NO: 184642 - DNA, 601 bp, Human; identical to SEQ ID NO: 26247

SEQ ID NO: 184643 - DNA, 601 bp, Human; identical to SEQ ID NO: 26248

SEQ ID NO: 184644 - DNA, 601 bp, Human; identical to SEQ ID NO: 26249

SEQ ID NO: 184645 - DNA, 601 bp, Human; identical to SEQ ID NO: 26250

SEQ ID NO: 184646 - DNA, 601 bp, Human
tacaggtgggaggcttccgcgccttaatgcttcttgtgtttgtctttcccatttctcccactccagaattcagaaggagctggcggacatcactttagaccctccacctaattgcaggtgagttgcttttcggattttttccatttttaaaattcttctaacctttgtcttgggtttttctttttattatatactttttctttgattctttggctaatgcttgttatggcactaacatcacgtaacagctgaaatttattaacctgagtataatgttttgatgagcctctgacaagctcastactgttgagaagaagtaatggatttatttggagtggatttttacatatatgaaacaaaactaaagtaaatttaaaggtgtctccttgcctaatcatgggtctttgatatgccattaaagatgatgtaaaacctttcagatgcgaaggacattttggtttggaaaactgctttgctacagtaatctcttattcaatctctgctaagctaagagaacattagagttaaacactggatcttcaaacttactccatagcatatagattttttattagacttttggcagagcaattcaggaaac

SEQ ID NO: 184647 - DNA, 601 bp, Human
taattgcaggtgagttgcttttcggattttttccatttttaaaattcttctaacctttgtcttgggtttttctttttattatatactttttctttgattctttggctaatgcttgttatggcactaacatcacgtaacagctgaaatttattaacctgagtataatgttttgatgagcctctgacaagctcagtactgttgagaagaagtaatggatttatttggagtggatttttacatatatgaaacaaaactaaagtaaatttaaaggtgtctccttgcctaatcatgggtctttgayatgccattaaagatgatgtaaaacctttcagatgcgaaggacattttggtttggaaaactgctttgctacagtaatctcttattcaatctctgctaagctaagagaacattagagttaaacactggatcttcaaacttactccatagcatatagattttttattagacttttggcagagcaattcaggaaacaatttctggctttgataaaggttttcttttaaattgtagagttaaactttcatggggtgtttttttcacttgctttattcagactgtatacatatgtgtgtttcagtt

SEQ ID NO: 184648 - DNA, 601 bp, Human
ataatctctcaagatggttgagaagtggaaaaaccataagacttaggcctaactcattattttgatggtggtggttcacgtggaagcctgtagcttcccttggttgtttgtgtggaatccatgtacattccccaaggtggttctgtgctgtctagttattgctcctgcttggtattgtgtgtctcctatgtgtgtgttattaataacattgattaaaacatataatggctttcttgtgaataagcacagtcaaatctaaaattgtaaaccatttgaagattttcatgggattaagcatttaaaaaaaaaaaacagtgtaagtacacttcagtttcacatcgttttaactgagtttatgtgtgaaagatttatgctcctgaggcatgtggaacttttttatctttgggaaaccctcccaattaccccttcaaggtgaaacgtttgggaattacctgtggtcaggggatgcaccaaactgggtggctgttgggtgattggtgttacggagtcaaagctcaaaatactaaattttaagaaaaatctctgatttgagagaaaatacgaggcatcttcattttgcaagagaatgtatattacattg

SEQ ID NO: 184649 - DNA, 601 bp, Human
attgctcctgcttggtattgtgtgtctcctatgtgtgtgttattaataacattgattaaaacatataatggctttcttgtgaataagcacagtcaaatctaaaattgtaaaccatttgaagattttcatgggattaagcatttaaaaaaaaaaaacagtgtaagtacacttcagtttcacatcgttttaactgagtttatgtgtgaaagatttatgctcctgaggcatgtggaacttttttatctttgggaaaccctcccaattaccccttcaaggtgaaacgtttgggaattacctgtgrtcaggggatgcaccaaactgggtggctgttgggtgattggtgttacggagtcaaagctcaaaatactaaattttaagaaaaatctctgatttgagagaaaatacgaggcatcttcattttgcaagagaatgtatattacattgtcttttaacaataaagatgactttattttctgaagatattttccagtggggccgtttgagtaatgtgaattaaaatttttacttttggttggctaatggtgctgtcttaatgttatatagtagtcccaatattcagctctcttaaaagagttcggtt

SEQ ID NO: 184650 - DNA, 601 bp, Human
ttctgtgaatttacattgtgtttttctggcattccaatacctcctcgaattggtggtaatggtaatgagatgtcagttcagaagtcccaggctgctcatcatggttcacaatggaaagagatccttttcttgcaacagtggagtgttacatacctcgtccaggttcagcatgttttaaatggttgtttgggtataagaaataggttcagcagaagtcatcctttataaaaccctgtatcttatgtgctaaaaagtattcttccttttagcatctttcatttatctgatgttactaaatgcrttaaggatagaagtgtgacttaaacatctgaatgatgtttagtttcaccattgcagtgtgtatacctttatgcatgtaaaggcagtgttgaaaaattgtgacaaccaggagactggggtttcagcacgatcaaaacagcacccatactagggtcaggctgttgggaattagatcatcactggggcctttcctattagagaggaaagaaaccctatctggagatgaattgcctttcaaatgagcaggaagtcttgtggcggttgtgtttaccaaaagactatatctggattgtaaaactgt

SEQ ID NO: 184651 - DNA, 601 bp, Human
taccgtatgacccagtaattttactgctatctatgtaccctgaataattaaaaacagaggctcaaacagataacctgtatgtcagtattcatagcattattcatagtagccaaaaagtggaaaaaacccaagtgtctgtcaacagatgagtggataaacaaaatttggttaatctataaactggaatattcatctataaaaaggaatgaagttgtgatgcatggatacaacatggttgaaccttaatgttatactaagtgggctgggcgcagtggcttacgcttgtaatcccagcactttrggaggctgaggcaggcggatcacgaggtcaggagatcgacaccatcgtggcgaacacagtgaaaccccgtctctactaaaaatacaaaaaaattagccgggcatggtggcgggcacctgtagtcccagctactcaggaggctgaggcaggagaatggtgtgaacccaggaggcggagcttgctgtgagcagagatcgcaccactgcactccagcctgggcaacaaagcgaggctccatctcaaaaaaaaaggttatactaagtgaaataaactagaaccaaaaagacaaatagcgtatga

SEQ ID NO: 184652 - DNA, 601 bp, Human
ataacctgtatgtcagtattcatagcattattcatagtagccaaaaagtggaaaaaacccaagtgtctgtcaacagatgagtggataaacaaaatttggttaatctataaactggaatattcatctataaaaaggaatgaagttgtgatgcatggatacaacatggttgaaccttaatgttatactaagtgggctgggcgcagtggcttacgcttgtaatcccagcactttgggaggctgaggcaggcggatcacgaggtcaggagatcgacaccatcgtggcgaacacagtgaaaccccrtctctactaaaaatacaaaaaaattagccgggcatggtggcgggcacctgtagtcccagctactcaggaggctgaggcaggagaatggtgtgaacccaggaggcggagcttgctgtgagcagagatcgcaccactgcactccagcctgggcaacaaagcgaggctccatctcaaaaaaaaaggttatactaagtgaaataaactagaaccaaaaagacaaatagcgtatgattccacttacatgaaatacctagaataggcaaactcataaggacagacagtagattagaggttttcagg

SEQ ID NO: 184653 - DNA, 601 bp, Human
taaaaaggaatgaagttgtgatgcatggatacaacatggttgaaccttaatgttatactaagtgggctgggcgcagtggcttacgcttgtaatcccagcactttgggaggctgaggcaggcggatcacgaggtcaggagatcgacaccatcgtggcgaacacagtgaaaccccgtctctactaaaaatacaaaaaaattagccgggcatggtggcgggcacctgtagtcccagctactcaggaggctgaggcaggagaatggtgtgaacccaggaggcggagcttgctgtgagcagagatygcaccactgcactccagcctgggcaacaaagcgaggctccatctcaaaaaaaaaggttatactaagtgaaataaactagaaccaaaaagacaaatagcgtatgattccacttacatgaaatacctagaataggcaaactcataaggacagacagtagattagaggttttcagggactgaggggaggggagaatggggagttatttcttaatgaatacagtttctttttgaggtggtgaaagttttggaaataatggtgatggttgcgcaatattgtgaatgtaattaatgccactaaatt

SEQ ID NO: 184654 - DNA, 601 bp, Human
tcacaaactttgagggcctgttataaatgaaaaggcacaagctgggcatggtggctcacgcctgtaatcccagcactttgggaggccaaggcgggtagatcacctgaggtcagcagtttgagaccagactggccaactaaaaatacaaaaattagccgggcgtggtgacgcgcgcccgtaatcccagctacttgggaggctgaggcaggagaattgcttgaaccctggaggcagaggttgcagtgagccaagattacgccactgcactccagcctggttgacagagtgagactctgtctcaaaaaaaaaaaaaaaaaaaagaaaagaaaaggcactgccttcaaggagttcataatctagtcaagatgttaagacatgcacacacatattttgaatggtacttggaaatataaatattatttggaaaataataaaatgcagatatcatgttataaagtttcagaggagtgagagattactttgacttgggtttgagggattgtggctggagtacttagtgatctgggaaggcttcatggaagaggtgagaagtggggtggggaagaataagggatattcgtgatggaacagtgtaagccaa

SEQ ID NO: 184655 - DNA, 601 bp, Human
ctgttataaatgaaaaggcacaagctgggcatggtggctcacgcctgtaatcccagcactttgggaggccaaggcgggtagatcacctgaggtcagcagtttgagaccagactggccaactaaaaatacaaaaattagccgggcgtggtgacgcgcgcccgtaatcccagctacttgggaggctgaggcaggagaattgcttgaaccctggaggcagaggttgcagtgagccaagattacgccactgcactccagcctggttgacagagtgagactctgtctcaaaaaaaaaaaaaaaaagaagaaaagaaaaggcactgccttcaaggagttcataatctagtcaagatgttaagacatgcacacacatattttgaatggtacttggaaatataaatattatttggaaaataataaaatgcagatatcatgttataaagtttcagaggagtgagagattactttgacttgggtttgagggattgtggctggagtacttagtgatctgggaaggcttcatggaagaggtgagaagtggggtggggaagaataagggatattcgtgatggaacagtgtaagccaagacagcagagggaagac

SEQ ID NO: 184656 - DNA, 601 bp, Human
cttagtctacagagttacaaatggtaaccttattataaagttaccttatgttaacaagtgagcaagggtctaggggtgctaaatacagtgggttcctagagatggtcccccaagtcctaaagctattccagatagttggttatgttagagttgctggcacccgcctgagacatctgacacatcccatgtcaccagtgaagtgaaactgggtttcataataagcccattcttattcagcctcttttatgcagccatgctctaaagtgaaacaaaagacctagtaactggtgtcagaatatgyttctaatcctctgggaaacctcctcctttataggctaaaagctcatcaaagtccctgcttgagaaccgtaatccaggaactttgctgtatgctaatggctcttttcttgaaacatatacacagtgattatggattgctttgtagagtccatgccacattacatagatgatcaacctttggaaggccaagttgatgtcccatcccactcaggaaatcttacaaagccaaaggttttcacatacagaacatatttaagttgtcactgggttttgctacagtgacagcaaaccattggggcag

SEQ ID NO: 184657 - DNA, 601 bp, Human
agaatatgcttctaatcctctgggaaacctcctcctttataggctaaaagctcatcaaagtccctgcttgagaaccgtaatccaggaactttgctgtatgctaatggctcttttcttgaaacatatacacagtgattatggattgctttgtagagtccatgccacattacatagatgatcaacctttggaaggccaagttgatgtcccatcccactcaggaaatcttacaaagccaaaggttttcacatacagaacatatttaagttgtcactgggttttgctacagtgacagcaaaccaytggggcagtgtgttgttcactaatacttttaacagagtagttaaaaactgaattctgtctgctctccaaagtacatgctgacccaaatatgacaaagtgaatgcaaagccctcttatatagcattcaaaggcagatttgccacaggtgccacatctgacttgtctgtagtgatctgagtcattattaaattttaaatagtaatacaacggagtagtcttagtagagtctactagcattgaaatgatgatcattatccatactgccagtacattggccatttgtatttattaaaattgatc

SEQ ID NO: 184658 - DNA, 601 bp, Human
taatcctctgggaaacctcctcctttataggctaaaagctcatcaaagtccctgcttgagaaccgtaatccaggaactttgctgtatgctaatggctcttttcttgaaacatatacacagtgattatggattgctttgtagagtccatgccacattacatagatgatcaacctttggaaggccaagttgatgtcccatcccactcaggaaatcttacaaagccaaaggttttcacatacagaacatatttaagttgtcactgggttttgctacagtgacagcaaaccattggggcagtgtrttgttcactaatacttttaacagagtagttaaaaactgaattctgtctgctctccaaagtacatgctgacccaaatatgacaaagtgaatgcaaagccctcttatatagcattcaaaggcagatttgccacaggtgccacatctgacttgtctgtagtgatctgagtcattattaaattttaaatagtaatacaacggagtagtcttagtagagtctactagcattgaaatgatgatcattatccatactgccagtacattggccatttgtatttattaaaattgatcgatggaaaattg

SEQ ID NO: 184659 - DNA, 601 bp, Human
cattcaaaggcagatttgccacaggtgccacatctgacttgtctgtagtgatctgagtcattattaaattttaaatagtaatacaacggagtagtcttagtagagtctactagcattgaaatgatgatcattatccatactgccagtacattggccatttgtatttattaaaattgatcgatggaaaattggtgtgggatggacctctagtaaattctacagaaaaaggcattgaggcacatttccaaacagatgagagtaaatagagtaacttgggatgatcttacttggagaaaagttytagatgtgatgcagctcaaaaagtcagcattattatgaagcaatgttgtacatgtgacagcagcatgagtagatcagatcgtaatcatttaaaacattagagtgtctgctgtgtgctaggcattgttctgtaggtgactaaaacagacctggcctctggcttgtgaaacctgaattttagtagacagtgcaaacagcagctaagcaaaaggattagtacaagttgtaatggctagtaggaaagaaattgacagagtgcagtgatggagaataattggggagggtgtgagggttacctaga

SEQ ID NO: 184660 - DNA, 601 bp, Human
ggcctctggcttgtgaaacctgaattttagtagacagtgcaaacagcagctaagcaaaaggattagtacaagttgtaatggctagtaggaaagaaattgacagagtgcagtgatggagaataattggggagggtgtgagggttacctagagaagccttacaaagacatttggtcaaagacctaaaagataggaaaggaaatggccttgtgaaaagtaccagaagacatctgggacagagggaaggtaaaaacaggccctgaggcggggacaagtcaggtgatgctgattatgtaaaccgtrctaagtagagagtttggatttttctcaataatgctttaaaagtcttttcccaccctccctgctgcatggaaaatagctgggaggaagatgctagtggaagaagggagaccagaaaggagggtattgctctgtttcaagctagctggtgcaggtggctaggattaaggtagtggcagtggagatatggtagaacactgggacctgttgttggattgcatgtgagagatgagggacaggaacaaaaatgactccaagtttctgtgtttttttgcaattggctagatgatagtgatgttttac

SEQ ID NO: 184661 - DNA, 601 bp, Human
taattggagctctgagatacatacacatttgtaaaggagaccttaccaaacagaggctcttgggtgtcttgggaatgcctttctctctcctagaaaggaaaggcatcatgagaagagtgcccaggatgaagactcaggcatctggcatttagaagtgtacactaggaaaagccagcaaaggagacagaaggaaaatcaagagagtgtggtattagaaagcagtgagtggaaagttttgaggtagagtgatcaagtgggaaatggtgctgtgcagtagaaaaagatgaagaccagcaagtamccactagattttacctcaggtttgttggtgaccttcacgtgtcaaacctggtttagaggagagacaatggaaaaggaggaatgattttcaagaatgaaaatgtgtttgtattactcttcctagttaaaatatttcattgtatttatccagaaaagtgatctggtgttatctactttctacactttagggcagaatttcttaacacagtatatataattttgtggggaggatggggaaagggcccaccattttcagtggattctcaaaggagttttttttttctgatctcccctctttcct

SEQ ID NO: 184662 - DNA, 601 bp, Human
agacaagcaacaaataatatgtggaaccacaactgttttggctacgtaggaattttgctccacaagtaatttaaattgttcctactaccacttacaacctttcctcctctatgggggtacatctcaatttttaagttaatatattagaattggtgttataaaaatttatttcttagcagactttgctacaacacatttatcctaaataaaaggagattgttgactttgcagagaaaaagaccctaaaagaaaacatttgttttattacaagcacccaggaggattttttataaacatgaamgataactttcctctaacctaagtaaatatttcagaaccaacgtatgttaagtgattatagtaatgtgtgtgcagagactggcagtaaagttagcagcgtcatatactacttgctagtatatcacactgctttggcctttttctgagtaaccctctctctggaagtcttcagaatgcctaacttcatccttcagggagactggtagcccccgaaaagacatttattttttgtagcttggtattctgagatgttctcacatccaaagtaaacactgtcaagtgatttggaccagtcctaaag

SEQ ID NO: 184663 - DNA, 601 bp, Human
gaaaacagtaccaagaaattaaaatagagtaaaatggcttggtgagtgactgcgcaggttgggacattggttggtgccacattggggaaatgaccctgaatgatgacaaggacccaaccatgagaagggcattttaggctgaaggacagcagatagaaaggtgctgagtggggtaggccagtgtggctggacatagtgaatgagggtgagagtggtaggaaatgaggtaggcaggggtcagattttatttgaatttcagtagaaagccgtgggagagctttaaatggaggagtgaaatactaggtatttggagaatacctcacgtaaaatttcctactcatgaaaagagagaaggcaggtgcagtggggcatgcctatattccccgctgttaggagactgaggctggaggatcactcaaggctgggagtttgaagctgtggtgtgtactatgattgcacctgtgagtggccactgtgctccagcctgggcaacatagtgagatcctcatttaaaaaatagtattctgttcagtgttttgaaaaaattgtattaaaaaatagaggttatgcagatactctgtaaaacttttttggcattata

SEQ ID NO: 184664 - DNA, 601 bp, Human
agagaaggcaggtgcagtggggcatgcctatattccccgctgttaggagactgaggctggaggatcactcaaggctgggagtttgaagctgtggtgtgtactatgattgcacctgtgagtggccactgtgctccagcctgggcaacatagtgagatcctcatttaaaaaatagtattctgttcagtgttttgaaaaaattgtattaaaaaatagaggttatgcagatactctgtaaaacttttttggcattatatgcagttttactgacctttatgtaacagttctattatatctagatayctgtgtatctaacaaatttagacattttgcaaaaactgaagacatgttaccaaaaattggtgcctcaaccagtgaaaggaagtatagcattactcagctggtcttgacgtaaaggttggatgaagtgtgaatgtttgtaatgcatacataatatttaaagctaacagaaacaacttcttagttgtctttgtagtgtgcttgccttggttcctggctgttcacctgaagtgaagacagcctgagtctggcagtagggaagcatcaagagtttggcttcctcctccttcagagcaacaacag

SEQ ID NO: 184665 - DNA, 601 bp, Human
tattattattattattttgagacagggcctcaaaaaaaaaaaaaaaaaagagagggcctcgctttgttgcctaggctggaatgcaatggtgtgatcatagctcactgcagccttgaactcctggggtcaagcgatcctcccacctcagcctcctaagtagctgggacaacaggtgcactccacaaagtccagcttttttttttttttaatagagacaggatctcactatgttgcccaggctggtctggaactcctaagctcagatgatcctcctgcctcagcctcccaaagtgctgggatwacaggtgtgaatcaccacacccagacccagctgttttctaaatttttttggagaggtggggtcttgctgtgttgcctgggctagtctcaaactcctggtctcaagcagtccttctgcctcaacctcccaaagcacggggtttaccagtagcctgagcccccatacctgcccctctcctggaaaagtgctgaagtgggaaagtttacagatttagggagtccaaggaaaaggttgaggtcgagctaataagagaaggagaaaggaaagaggaactgagaaaggaaaggggtctagaagagc

SEQ ID NO: 184666 - DNA, 601 bp, Human
gtcttagtcaatatgtattataaatagatttagggttcacaaaggtcagcagccttcatctcttgccctacccccatcacacacaaaaataaaaatcacaaataataaaggattttaagagttataccagtcgggagtgggttcatttttttgtttttgtttttgtttgtttttgtttgtttttggcaagctgaagtcatctgttggatccaaaaatgcataaaaatcttcaggcttatagaaccaacagcatcaaaggaagagcagtgtgactcaatattggggtgggggcaggtttggkgttttggttgtgtagaagctccttatgagagaacagtgtgatgcttggagctatggagaatccagccactgctttttctctcttccttaccttattactcttcttgattcacctggatgtggaaactgtccctgtttaagagtggccttgtcaatgctctctgtgtatcatgtgtacagtagggaatgtgtcaagccagatgagtggtctcattgaaacatcagcaaatcagtatatcgtagaatttagatcccccttggaggtggtggtgatagctaacttctgttgcggtcttaactg

SEQ ID NO: 184667 - DNA, 601 bp, Human
cctaagtagctaggactacaggcgcgtgctaccacacccagctaagttttgtatttcttttttttttttctgtgagacagagtctcactctgttgcccaggctggaatgcagtggtgcgatctcagctcagtgcaacctctgccttccaggttcaagccattctcctgcctcagcctcccaaatgctggaattacaggtgcccgccactatgcctggataatttttgtattttttgtagaggcagggtttcaccatgttggccagactggtcttgaatgcctgactgagctcaggtgattcgcctgcctccgcctccgcctcccaaagtgctgaggttacagacatgagctaccatgcccagccaaatacttttttctaaaggaagaaaacttagtcatttatttagctttaataattggctttttgagtttgttcaatactttaagctctgtgagcatatggatcatgccagccatctagcacagggtttagaaaacagtaactgctcaaacttttgctgtgaatgaatgaaggagcaaatgaatgattttcctgaaagggaaataaaaacagaattcagtttctgatcattgtccaggg

SEQ ID NO: 184668 - DNA, 601 bp, Human
ctaagtagctaggactacaggcgcgtgctaccacacccagctaagttttgtatttcttttttttttttctgtgagacagagtctcactctgttgcccaggctggaatgcagtggtgcgatctcagctcagtgcaacctctgccttccaggttcaagccattctcctgcctcagcctcccaaatgctggaattacaggtgcccgccactatgcctggataatttttgtattttttgtagaggcagggtttcaccatgttggccagactggtcttgaatgcctgactgagctcaggtgattctcctgcctccgcctccgcctcccaaagtgctgaggttacagacatgagctaccatgcccagccaaatacttttttctaaaggaagaaaacttagtcatttatttagctttaataattggctttttgagtttgttcaatactttaagctctgtgagcatatggatcatgccagccatctagcacagggtttagaaaacagtaactgctcaaacttttgctgtgaatgaatgaaggagcaaatgaatgattttcctgaaagggaaataaaaacagaattcagtttctgatcattgtccaggga

SEQ ID NO: 184669 - DNA, 601 bp, Human
gtagctaggactacaggcgcgtgctaccacacccagctaagttttgtatttcttttttttttttctgtgagacagagtctcactctgttgcccaggctggaatgcagtggtgcgatctcagctcagtgcaacctctgccttccaggttcaagccattctcctgcctcagcctcccaaatgctggaattacaggtgcccgccactatgcctggataatttttgtattttttgtagaggcagggtttcaccatgttggccagactggtcttgaatgcctgactgagctcaggtgattcgcctccctccgcctccgcctcccaaagtgctgaggttacagacatgagctaccatgcccagccaaatacttttttctaaaggaagaaaacttagtcatttatttagctttaataattggctttttgagtttgttcaatactttaagctctgtgagcatatggatcatgccagccatctagcacagggtttagaaaacagtaactgctcaaacttttgctgtgaatgaatgaaggagcaaatgaatgattttcctgaaagggaaataaaaacagaattcagtttctgatcattgtccagggaatgg

SEQ ID NO: 184670 - DNA, 601 bp, Human
aaaacagtaactgctcaaacttttgctgtgaatgaatgaaggagcaaatgaatgattttcctgaaagggaaataaaaacagaattcagtttctgatcattgtccagggaatggcttggacacaaatagttgacctgttggaagagaatatacatttttaataaaggagaagggactgtgtttttcctggagggaggagacctgtaaagaaaaatatagaggtgtggggggctgggcgcagtggctcacgcctgtaatcccagcactttgggaggccgaggtgggcagatcacctgagctcrggagtttgagaccagcctggtcaccatggcaaaaccccatctctactaaaagtacaaaaattagccaggcgtggtggtgggcacctgtaatcccagctactcaggaggctgaggcaggagaatcgcttgaacccgggaggtggaggttgcagtcagccgagagagaatcgcttgaactcagtgggtagaggttgcagtgagctgagagagaatcgcttgaagccgggaggcgaaggttacagtgagccaagatcttgccactgcgctccagcctggacaacagagcgagactttgtctca

SEQ ID NO: 184671 - DNA, 601 bp, Human
tttttgtcccttttctcccatttttcctcagtctccatatatttgtctcttagcacttccttttattttccataacgtacctctcagtagagtataaaatggagatattttttatttttaaaatatgagttttgtgttgcttgttcctaaccttaaaaaatgattggtatatggtatgtgcctttcttgacagtgaactatttgatagtcatatatttaaaattaagaatttaatagaccttcccactagggaagcatttgtttcctaggcacctttggaaggtgctacattaatgaattwgttttattattttagataaattgtttttccctatttttagaatattaatagagtcaggttggaagatacaaataaacactgattcagaacgccacatgagagtctgaaagccatgtcatagcagtagttaaacagagtattaaatgcagatgaacaagatgtcggaaagcaatggtaatgttagcaaagctagagagaagataatttcttatattttacagcaaatgttgttgtctgtgtaaagaaaattataggcatgactgtgaagaaatgaggtttatttaagatgccaaaagtggc

SEQ ID NO: 184672 - DNA, 601 bp, Human
catatatttaaaattaagaatttaatagaccttcccactagggaagcatttgtttcctaggcacctttggaaggtgctacattaatgaattagttttattattttagataaattgtttttccctatttttagaatattaatagagtcaggttggaagatacaaataaacactgattcagaacgccacatgagagtctgaaagccatgtcatagcagtagttaaacagagtattaaatgcagatgaacaagatgtcggaaagcaatggtaatgttagcaaagctagagagaagataatttcktatattttacagcaaatgttgttgtctgtgtaaagaaaattataggcatgactgtgaagaaatgaggtttatttaagatgccaaaagtggctgggcgtgatggcttatgcctgtaatcccatcgctttgggaggccaaggcagaaggatttcttggggctagaagttcaagacaaacctgagcaacacagcgagaccctatctctacagaaaatttaggaaattagctgggcatggtggcatgtgcctgtagtcccagctactcgagaggctgaggtgggaggatcacttgagcccgaca

SEQ ID NO: 184673 - DNA, 601 bp, Human
gcataaaaagcaatgtgaggaatcactgctcaaattgataatgtttaaaatggagaataagagcatagaaaaaaaaatacgggactaattgtacaatattttaacatttttaggttttacatattgagttaacctgatcacctacttgaagcagtctagcattaactgttaaatgtttaatgaagtagttctcaaccttggctgctatctcagttacatgtaatgttttaaaaaaatgcaggccaggttgggtggctcatgcttgtaatctcagcactttgggaggttgaggcaggaggaktgcttgagcccaggagtttaagagcagcctgggcagtatagcaagatcctgtctacaaaaaatttaaaaattagctagatgtgctggtgcgcacctgtggtcctagctactcaggaggctgaggtgggaagatcacttgagcccaggaggtcgaggctaagtgagctaggatcatgccagtacactccagcctgagccacagaacaagacctgcctcaaaacaaaaaccagaacaaaaaacagtcacaccagggccccatcctattggaatcatctctaggggaggttcccacacctgca

SEQ ID NO: 184674 - DNA, 601 bp, Human
cttgcctgtgatcataaagctagaaagtttgggagccagaattaaaatacaggagtctcagtgctctgtttagatttaggacctgagccagggagtgtgttccaaacccagcactaatacttgagaagctctcaaaactgtaagtatccccaggatactggtgtctcaaaaagatagtaatgtgttaactgtaagctatttagtgatacatttgctttcttctgcagagaggagggactgaattttgggactgttgcctgcaccatcccagtccaacttgctatgtgtttttatttttagycattggctgattccaatttgaaattcagaggatttgtgatatattatgtgatatgttttaaaaattactagctccttgctgcattttataaagcgttggagatagtttttctttggttggctgattggttttggtgttttgttttttagaggactagcctacacctggtttgagtaagaaagttttgtttgagaagcagcgtttttaccaccttcaatcttttgaggaacttttggcatgtggaaaattaaatactacaaactttcaatagaaggtagacaggtaatatggagaactgag

SEQ ID NO: 184675 - DNA, 601 bp, Human
tagaggactagcctacacctggtttgagtaagaaagttttgtttgagaagcagcgtttttaccaccttcaatcttttgaggaacttttggcatgtggaaaattaaatactacaaactttcaatagaaggtagacaggtaatatggagaactgagaattagaaatcttgaccatgctgttgggaatttcccttttctttctgcttgtccactaatctgcattgcttattaaaacaggttgatacttttaaggctctgcaaagaagttcttttcattggttagtatctaataagtgatagctggtacaggactttaaaaatatataataggggtttattttctttatttttattatttattttatttttttttgagacaaggtcttgttctgttgcccaggctatagtgcagtggcacaattacagcctactgcagtctcagcctcccgggctcaagtaatcctcctacctcagcctcctaagtagctgggactataaacgtgagccaccacacctggttaatttttgaacttcttggtagaaaatgtttcgccatgttgcccaagctagtcttgaacttctgggctcaagtgatcctccctc

SEQ ID NO: 184676 - DNA, 601 bp, Human
tgttctctggtgattctttccctggcattgcgtagtgtcctctcatgcatgtgctaattcatgcttaggtaaatacttgacgggaccctctacagatctccggagttctgtctctgtgcagctctggtacttgtgaactctgaccacttaggttattccttcctgcaccacaggcgattgtaggtctcaatatatttagttttcctttctcagagatcactgccttgcactacctgatgtccagtgtatggaaactgctgttttatatattttgtcagtttttttgttgtttaagtggtasggcagatttagtatctgatataccatcttggttagaagctgaagtgactttacagcccatgatactttttgtaaataaagattagtcgttagaaaacaatactttcatgctgtttcagcttttatacatctataatgatattatttacttttagagatgcgggtgaactgtttgaaaagattgaaaagatataaagagttattggattctttacatcatgagcgaggaaaaaaattaagctcgtcttaaatggctatgtttcaattttatctgctataaatgggtaagagttagatttta

SEQ ID NO: 184677 - DNA, 601 bp, Human
ccccagtaaaggttgattcctttttctcctctttcctgcttgtttattttattctattttatcctcattttctacttctgccccaaaagcacccattctaatgcctttcactatattgtttgtgttcttgtaaaatgtatttagtgtttgtatttttaacttacataaatgatgcctaattctttcttacatttttctaagcacaatgttttaagctctctccctgttgctatgcaagcatctaattcattgcgttgaacagccacatagtattccaaggggtatactcattttatcttayagaagaccagatcgtttccagctctccatccccactaacagtgaacattctggtccgtaatcttttttggacctctgtaagaattaagcagaactgcaaggggatcatagggcttacttaaatttgatttgacttaagttgtaccagattgttccccagaatggctgtactcatctccatgcccaccagtagcagagcatgagaattcctgtgtcctcttaggtgcgttctgattttctaatttttgccaatcatactctacacttacatatggagaatatgttcatgaacatgtaggtc

SEQ ID NO: 184678 - DNA, 601 bp, Human
acatgtactttaaattttttttttttttttttttttttgagacagagtctcgctctgtcacccaggctggagtgcagtggtgcgatctcagctcactgcaagctccgtctcccaggttcatgccattctcttgcctcagcctcccgagtagctgggactacaggtgcccaccaccacactcggctaattttttctaatttttattagagacggggtttcaccgtgttagccaggatggtctcgatcttctgacctcgtgatccacccacctcggcctcccaaagtgctgggattacaggcmtgagccaccatgctcagccttaaaattgttatttggaaataatgcacgtgatagacaactcaaaacagtagaaagggatatatagaaaaagtaagttttcccatttccagccccaaaggcaatagctgttatcagtttcttgtgcatcctgtgtgaattactttagatatacttaatctataataatagattatacacccctttcccctacctccttttttaaataaacacaaatggtaacttgctgtaaacactgttctgtaccttggttttttaacttcagatatcttggactttccc

SEQ ID NO: 184679 - DNA, 601 bp, Human
ttgcccgttgcccagattggtcttgaattcctgggcccaagcagtttacctgcctcagcctcccaaagtgctgggattacaggcatgagccaccatgcccagcctattcctatattttcttctaagagtttcatacttttagtttttcgatttggatcagtaatccattttgagttaatttttgtgtgtggtgtgaagaagggttcagtttcatttttttgtttgtggctattcttttgttcccaacaccatttgataaaaaagactattctgtctccattgagctgatttggcactcttktcaaaaatcaatttacctgtaaatgtaagagtttatttctgggctcttaattaggttccattgatctttgtatctatccttttgctggtactacgatgtcttaatttttgtggcttcatagtaagttttgaaattgagaaggaagtcctctagcttcgttctttttaaagattgtttggctattctatgttccttgcatttccatatgaattttaggatccgcttgtcaatttctgtttttcattttgtttttttttaaacagtccagctggggtttttacagggtttatgttgaatctg

SEQ ID NO: 184680 - DNA, 601 bp, Human
tcttggtaatgagtgaattggtgaaaataactacatgtacacctgtagtcttgctttgtacaggttttgcatttggtagtctgccagtgctcaaaaattcctggtggtggtttttcagggataccacccagtgaccatctgtggtggtcatatgttatttgttcacccaacatccccctggggtaccaacactcctcattttataataattcgttttatccacatggttcaagtgggtctttttttaccctccagtggtgataggctgacccaagcccaggcccatcagaatgctttatcwtggtcaggcatggtggctcatgcctgtaatcccagcactttgggagaccgaggtgcatggatcacctgaggtcaggagtttgagaccagtctggccaacatggcgaaaccccacgtctactaaaaatagaaaaattaaccgattgtggtagtgcatgcctatagtcccagctactcgggaggctgaggcaggagaatcgcttgaacctgagaggcagaggttgcagtgagccaaaattgtgcctgggcaacagagagagactcagtctcaaaaaaaaaaaaaaaaaaaagctttatgcat

SEQ ID NO: 184681 - DNA, 601 bp, Human
ttatttgttcacccaacatccccctggggtaccaacactcctcattttataataattcgttttatccacatggttcaagtgggtctttttttaccctccagtggtgataggctgacccaagcccaggcccatcagaatgctttatcttggtcaggcatggtggctcatgcctgtaatcccagcactttgggagaccgaggtgcatggatcacctgaggtcaggagtttgagaccagtctggccaacatggcgaaaccccacgtctactaaaaatagaaaaattaaccgattgtggtagtgyatgcctatagtcccagctactcgggaggctgaggcaggagaatcgcttgaacctgagaggcagaggttgcagtgagccaaaattgtgcctgggcaacagagagagactcagtctcaaaaaaaaaaaaaaaaaaaagctttatgcatctacccacagtgattggttcagagagggtatttaacttaatctgaactgatgagagatataccaaagtatttgggagggatgtttttaaagcttacctcttttcctgagatatattatcttttccaagctatcctatgtggagagccagtctca

SEQ ID NO: 184682 - DNA, 601 bp, Human
tccatagaatacatttctgtgttctgtctgttcctttgaaaacatttttttagtttgtattgtactatatgtggtgcagtgtgcaatgaactatatgtccctggcatatagttatccctgaattatgtggtgaatctataatattaagctaatatgttatgcttgatttctggggaccaagtagatgatcatttggaaaaatataccaccattgtgcatggcagaggaacttcatttggtaaagaattgtgtcacatggttataggttgtaagatactatctttttcctttccgtcttatmtttcttattatttattttttgagacagagtcttgctctgtcacccaggttggcatgtagtggtgccatcacggcttactgcagcctcaaactcctgggctcaggcatttctcccacctcagccttccaagtagctggggctacaggcatgcaccaccacactcagctaatttttaaattttttgtagagacagggtttccctgtgttgcctaggctggtcttgaacttgcgacctcaagcaatcctcccaccttggcctcccaatagttttcatttttattgaaattatacactaacata

SEQ ID NO: 184683 - DNA, 601 bp, Human
ttcatttggtaaagaattgtgtcacatggttataggttgtaagatactatctttttcctttccgtcttatctttcttattatttattttttgagacagagtcttgctctgtcacccaggttggcatgtagtggtgccatcacggcttactgcagcctcaaactcctgggctcaggcatttctcccacctcagccttccaagtagctggggctacaggcatgcaccaccacactcagctaatttttaaattttttgtagagacagggtttccctgtgttgcctaggctggtcttgaacttgygacctcaagcaatcctcccaccttggcctcccaatagttttcatttttattgaaattatacactaacatagtttaaaggctttaatatttctttgtttgttaaaaaaaaaaaaaaactattcccagcattttgctctctagtggcaactacttgtacctccttgagccgagtactttgttgtttatatcctgtttttaggtatatactcatattactttatatttcagtttttaccaataactcttgattcatgacaatggatgatgacaacttagttctttcctacctagtcacactct

SEQ ID NO: 184684 - DNA, 601 bp, Human
ttgctctgtcacccaggttggcatgtagtggtgccatcacggcttactgcagcctcaaactcctgggctcaggcatttctcccacctcagccttccaagtagctggggctacaggcatgcaccaccacactcagctaatttttaaattttttgtagagacagggtttccctgtgttgcctaggctggtcttgaacttgcgacctcaagcaatcctcccaccttggcctcccaatagttttcatttttattgaaattatacactaacatagtttaaaggctttaatatttctttgtttgttaaaaaaaaaaaaaaactattcccagcattttgctctctagtggcaactacttgtacctccttgagccgagtactttgttgtttatatcctgtttttaggtatatactcatattactttatatttcagtttttaccaataactcttgattcatgacaatggatgatgacaacttagttctttcctacctagtcacactcttcctttatcctgttttgcttagatcaatgttgataaaatattcactgtttatattatgtgagcattattcacatgtggttacttttccttccttgcttgact

SEQ ID NO: 184685 - DNA, 601 bp, Human
ctataatttctgttttctgtagttggctatcttctagtttgttttgatttttgatttttatgttagaaaagaaccatgttcctcagttatctgttccttagttagaaaggtctttcctctgagtcgctcatattccccagaagagactgcctggagggcgaaggccggcctgtgttctgggagctgagtggagaaagaaaactggggtcttactgtcctgcatgcataagctctttttcagtacagcacctctgccctcatccatgttaatgaccactggtgcagagaccctctgtttcarcttcttctgaaaataaatttcagactgtcaggatttctctttctgtgtaacaaattactgcaaatttagcagcccaaaacaatacacacatttagtatctcacagttactgtgggtcaggaatccaggcatagcttagctgagccctctgctcagggtctctcttggctgtagtcaaggagtcagctggcctgtgtcctcatctgtagctcttacaaggtcacatagttgttgacagaattcagttccttgcagctatgggactgaggcccaggcaactcctagaggccgctcatagttc

SEQ ID NO: 184686 - DNA, 601 bp, Human
tagacagcaggaccaaggattcgcctgggtgaaagagttggcaatgagaaagcaaccagaccctcccctccaagcccagccctgtatttgacatgcagggcataacctcactcattcagtctctcagccctatgcaaatataaacagccttcctcttgtctctccaggccagccggggccaagaaagaagccagtgattcccccaagtgcagtaaatagctctcctcacctcctgaccctgttatttcctggtagttctgagttgtggatcctgcagtggagagggagggaacaaagaagytgcagaggcctcagcttcacagagcattgagcagtgggtgatattgtatcctcaggcaggggttgacctcacatttcagtgcaggtcattctaatgactgctggacctcccagtgccactgtgaactagaatggaatagagtgaagtggatctgaattcctggactgtgggaccaacctaacttctgagctggagaaagtaggtctcatgttctatacctgcttttttttagctctagggggaaaaaagaattgtgcatctttcttgttctctttgcagcttaggggcataacgtttgga

SEQ ID NO: 184687 - DNA, 601 bp, Human
tcattctaatgactgctggacctcccagtgccactgtgaactagaatggaatagagtgaagtggatctgaattcctggactgtgggaccaacctaacttctgagctggagaaagtaggtctcatgttctatacctgcttttttttagctctagggggaaaaaagaattgtgcatctttcttgttctctttgcagcttaggggcataacgtttggactgtaattgaactgatgcttgtttccccaaaatgtctttggttttcattaaggtgggggattctctgcatttttggagttgtcactttatcgaaattcctctccacactaagtactgtgtgtggtatgcttttattttcacctaattgatttctgcaaataaagtgatttaatttttggtattaagaaatttaaataacaccttttggcagatcacaagattttcttgttcttatttaatcctggcttccatccaaatgtgaaagagaaatgaaataataaggtaggaaaggcagaccagtaattgtgattaaacaacttttgtgttgagtccaaagacaggtaactttattttaagcttcatgggtgtagtaaaaatatatcacc

SEQ ID NO: 184688 - DNA, 601 bp, Human
gaagcttttatcataaggccaaaatctgtccttcaatgtgaccacagagccacaggagacccaaaccccttgtagtcactgatgattttcattgggctatagatgggaatggcagcagtcataaatatttcctatgaatgagtgttctagatattttttacccaaagatgtagcatatcagtgggtcactattgaaaacatgtttggaatgaagcaggaaaataagtcaaaagatctcccctcagttcctaagcaactttgttgtaaaaataactgtgaaaactgggcttaaatgaaacayacattcgaatgcctggagtaagaattattgatagcccagacttagtatcccccccacctttccaagtccttaaagcattggctttctactcagaaacgctgcttaccctagggtgaccatagttacttttattttttatttttatttatttatttatttttagatggagtctccctctgttgcttaggctggagtgcagtgacacgatctcgctcactgcaacccccacctcctgggttcaagctattctcctgcctcagcctcctgagtagctgggactacaggcgcccactaacacac

SEQ ID NO: 184689 - DNA, 601 bp, Human
agcaggaaaataagtcaaaagatctcccctcagttcctaagcaactttgttgtaaaaataactgtgaaaactgggcttaaatgaaacacacattcgaatgcctggagtaagaattattgatagcccagacttagtatcccccccacctttccaagtccttaaagcattggctttctactcagaaacgctgcttaccctagggtgaccatagttacttttattttttatttttatttatttatttatttttagatggagtctccctctgttgcttaggctggagtgcagtgacacgatctcrctcactgcaacccccacctcctgggttcaagctattctcctgcctcagcctcctgagtagctgggactacaggcgcccactaacacacccggctaatttttgaatttttattagagatggggtttcaccatattggccaggctggtctcgatctcctgaccttgtgatccgcctgcctcagcctcccaaagtgctgggattatagccatgagtcaccatgcctggccacttttactttctcttattactttactttctacattaataggtagattagattccatctcttctacctttatt

SEQ ID NO: 184690 - DNA, 601 bp, Human
accagaatcctaagggatgtgttggtgaggcactgacagcttctgctatagtttatcagtgagctcaggagttcaagtggcttctcttatttccaaaactataaaactgttcacttatattttcttcaagttcctatttaaaattctttttttattttatttttattttattttattgatcattcttgggtgtttctcgcagaggggtatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagggcacagggttgggggtaaggtcacagatcaacaggatcccaaggcagaagaatttttcttagtacagaacaaaatgaaaagtgtcccatgtctacctctttctacacagacacggcaaccatccgatttctcaatcttttcccc

SEQ ID NO: 184691 - DNA, 601 bp, Human
ggcagattagaattgttccaactcaggcttgtataattcctgcagaaaagacctattgttggatccacctttatcctgacttacctacatgtttaatcttatagaggaaaatggctttcaagacacaagggatactgatcttactttaattctaatcactgccgtacccccaacccctgcttctttcaggcacttggcattgaactagttttgtcattttacttgcttgccacctacccccacgactaccctgacaggccagaagggaaagtgcggttccttagctcactgtactaataastcctcattcagccatccctagttaagagtgaccccctaatgtccacattttttaggtctgctcttcttttgtcatccctaccagagtaacttaaccctttacttacaagttacttggaagtagttttcttttaaaaacagtgtcatctaatttttttcaatattggaatgtaaatttccagatgtgctggactgtccctagagcagcagcatatacagtaagacctacgattgaatgactaactgggcaagattgagcttttgtgatgttttaattattttacctaatatggaaacactg

SEQ ID NO: 184692 - DNA, 601 bp, Human
cacaaaaagttatgtcaaaaattccttcggaagtttatctactttatgctagaggaagacagtaggcaccatttcctcagtgttgttgttacaagacttttggagggctttgttagaaggccattaaatggccacactgttggagatcttaagtgcctgggatagtctccttcccatagttaggaagatataccccctatttagccccaccgtgttccagtataacttccttgatacagtggataccactaatgtgaattttttttgagacggagtctcgctctgtcgcccaggctggagygcagtggcgtgatctcatctcactgcagcctccgcctcccaggttcaagcgattctcctgcctcacccttctgagtagctgggattacaggcgctcgccaccacgcccagctaatttttgtgtttttagtagagacggggtttcactgtgttggccaggatggtctctatctctagacctcgtgatctgcccgctttggcctcccaaagtgctgggattacaggcgtgagccaactgtgcccagccaaatatgtgaattcttgtgtgtgggtactagtttttctggggagccctttaggt

SEQ ID NO: 184693 - DNA, 601 bp, Human
cttgagcccaggagttcaagaccagtctgggtaacctagcaagaccctgtctctaaaaaaaatttaaaaattagccaggtgtggtgatgcacgcctgtaatcctagcaactcaggaggctgagatggaaggatcacttgagccagctgtgattgagccactgcactccagcttgagcaacagagtgagacactgtctcaaagaaagaaacagttggtattcattgctcttaataatcctctgtagctggcttctcaaactttaatgtgcataagaatcatttgttaacatgcacattgatwgggtctgaggtggagtctgatgtctgcatttctaacaaactcccaggggatggatgccgatgttgcttgtccagaggcggcactttgaatatcagtctacagaacattcagggtatatgcaaattaacttttaataataacaacagcaaccatatatattgatccttttttggtgtaccaggcacagaaaaataaaataagactgggcactggagtctaacagctgggattcagattgaagctcttccctttactagcttaaccctgagcaaattttctctaaggcagggtttctcagcc

SEQ ID NO: 184694 - DNA, 601 bp, Human
gtgtaccaggcacagaaaaataaaataagactgggcactggagtctaacagctgggattcagattgaagctcttccctttactagcttaaccctgagcaaattttctctaaggcagggtttctcagccttggcactgttgacattgtaggctgagatcattctttgtgggggctgtctggtgcattgtaggatgtttagcaacatccctggcctctatccaccagatgccattagcacctccctcccgtttgtggcattcagaatgactgcaagcattgccaaacgtcagggggtggggtrggaggcaaaattacttccagttgagaaccactgctctaagactactgttgaaatatgggtgtttgggggggtttgtgatatgaatgatgtactttatgtaagtgacatagaagcttatcatgaagcttccacagacaaaaggagaataggcatgcagtagctaataagcagtccgtgccacatctggctttctgaggatgatgataaagcttattccaagtgccagttctttatttttacgaaacattagtcattgtactatgagataatatcaggaattacttgagatttttaaatagg

SEQ ID NO: 184695 - DNA, 601 bp, Human
cataacagatgagcagtgggtgggcaggccggccagctgagcgaagctccatctgtatttacagccactgcccatggcttgcattactgcctgagctccgcctcctgtcagctcagatcagcaatggcattaggttctcataggcacacgcaaaccctattgtgaactgctcatgtgagggatctaggttgcgtgctccttatgagaatctaatgcctgatgatctgctactgtcacccatcacccccacatgggactgtctagttgcaggaaaacaagctcgggggctccccactgattstacattatggtgagttgtataattatttcattctatatcacaatgtaatactaatagaaatagagtgcacaataaatacaatgcacttgaatcatcccaaaccatcccaccccccatctgtggaaaaattgtcttccacaaaagcagcccctggtgcagaaaaggttgtggactgctgctttagtccatctcctatgattgcacaggtaagctgcaaatgccaaggacttgatgagctcagttcaccccttgccaacaatgtatcagttcctgagagaatgagttcctgaagtcttgctg

SEQ ID NO: 184696 - DNA, 601 bp, Human
cggatgcctgtaatcccagctactcaggaggctgaggcaggagaattgcttgaacctgggaggcagaggttgcagtgagccaagatggcaccactgcactctagcctggatgacacaagcgaagctctgtcttaaaaataataataatggataaaattttttaaaaattagctgggcatggtggcatgtgcctttagtcccagctactagggaggctgaggtgggagaatcacttgagcccaggaagtcaaggctactgtgagctgagatcacattgtgctccagcctgggtgacacagcragactgtgactcgaaaaatatcctaaatttcactttgcttcaggatgttctttaaaagaaatcaataatgtcatttgaaaattgaaatgcagatttggtttctgaccattgaaatggaagagcagcagagtagtctgtaataagtctgtactgagaatgggaatggggaaagactcacaaaaacatgattttaaaacaaaaagaaaacatgaatgttactttgtggagttaccctggaagattttaagtcagtccagggaacacaacagattctagtaagactgtgctaatgacagtctt

SEQ ID NO: 184697 - DNA, 601 bp, Human
agttctccaagtccccactagattagctccacacagagcactgattggtgcatttacaaacctttagctagacacagaatgctgattggtacatttacaatcctccagctagacgtaaaagttctccaagtccccacttaactcaggagcccagttggctttgcctagtggatcctgtgccggggctgcgggcggagctgcccgccagtcccgcactgtgcgcccacactcctcaacccttgggcaggcgatgggaccgggagccgcggagcagggggtggtccccatcggggaggctcargccacgtgggagcccactgcaggggtggaggggaggctcgggcctggcaggctgcacgtctcaagccctgccccacggggaggcagctgaggcctggcgagaatttgagcctgttgctggcaggctggcactgctgggggaccaggcgcaccctctgcagctgctggctggggtgctaagcccctcactgcctggggccagtggcgccggccggctgctccgagtgcggggctgccaagtccacgcccacccggaactctcgctgttccatgagcactgcgcgcagccccagttcccacc

SEQ ID NO: 184698 - DNA, 601 bp, Human
tctaccccctaacccagtaccttcaaaggctccacctcctaataccgtcacattgaggattaggatttcaacataaaagtttcgaggggatgcaaacatgtaggcaggtaggcaaacttatgatgaccaagaaccggttctaacctcaggaaatgaagcaataatggtaatatcatttcactggagaagtttctgcctgtttccagagggagagggctgattaagagctctccctacattccaccttgtgaaaattgccatcagatatcgtgtaaaactatgaagtcatcttttttaaacrcaaagtatgacttcatggtgtagacaatgtttaaaaaatctctggccgggtgcgatggctcacacctataatcccagcactctgggaggccgaggcgggcggatcacctgaggtcgggagttcaagaccagcctgaccaacatggtgaaaccccatctatactaaaaatacaaaattagccaggcataatggcgcatgcctgtagtcccagttactcaggaggctgaggcaagagaatcgcttgaacccgggaggcggaggttgcattgagccgagatcgtgccattgcactccagcctg

SEQ ID NO: 184699 - DNA, 601 bp, Human
ccgggtgcgatggctcacacctataatcccagcactctgggaggccgaggcgggcggatcacctgaggtcgggagttcaagaccagcctgaccaacatggtgaaaccccatctatactaaaaatacaaaattagccaggcataatggcgcatgcctgtagtcccagttactcaggaggctgaggcaagagaatcgcttgaacccgggaggcggaggttgcattgagccgagatcgtgccattgcactccagcctgggcaacaagagcaaaactccgccttaaaaaacaaacaaaaaaaacmaaacaaacaaaaaaactctctctgtatctaaaacaaactttttggtggcttacacttataatcccagcactctgggaggctgaggtaggaggattgcttgagcccaggagttcaagaccagcctgggcaacatagagagacccccatctacacaaattaaatagaaaacattagccaggtatggtggtgcatgcctgtagtctcggctactcaggtggctaaggtgggaggatcacttgagcctagaagtcaaggctacagtgacccgagatcatgccactcactgcattccagcctggg

SEQ ID NO: 184700 - DNA, 601 bp, Human
aattacaggtaatttttactttgtgttttggtatatttcacaaataaaaattaagagacccaaataacaccagcttatgtgacttgtgttctgctgtggtccttgcccattactggctctgcatccatggacactcgattatataatagtaaattctgtgatgtaggtagacaggatgtctataggacctgatgtaacggtcagaaaaaagcagaaatagacttctcttcaaattttgttcagccttttgggtgtagtcattgtttgctaagtatgttgtttaattatctttatgtacccmttatgttgcacttcagtttttaagaggtatttatgattctcagtattttaaagcttactttgaggcagtgtagtactaccagctaacacaagaggtcagcaaacaattagctattcaaacttggaaatgttaatatttaaaagatttaaaattgctaaagatgaaattaggaagtactgaacttaccgtcagtggacataacattttaaatgaaattgacacagtccctgagatggtatcaatgaacactttctaatcaaatttattgtctatcttcttgacagctttaattaaaactgc

SEQ ID NO: 184701 - DNA, 601 bp, Human
tcctacataggataattttttaaaaacatgaactggcattttggtacaagcaattggtaaagtcggtaacaccaaaatagttttttgattaaaaacaagaaagttgaccatgctgtacggattctcttactgacagctacttccctacaggttttcgcatctccaatttctagcactgtcaaagagaaaaagattaggtgtaactacaaattagcaactatcaggaagagagaaagcccgcataagaggtaatacctagtcaccaacagtgaccattctagaccaaggttggttatccccrgatgactcgctggacaggctgtaaatggagtcctgagtctagtcagagtggtgctggtggctccacagaaaggaggaagagccaagaaagaaaatggctggataaacggaatctgcaaagtaaggtagggaatgggcacttttaggagctgagaagtgaactaggttaggcagtcaaaatggcttgatgtaagtcaagaattacaagctaagcttccttattcaagaggaaaacattgtctagagccgtaccaccctgaaagtgctcgatctcctcaaaagaaaacatcaaccacccaca

SEQ ID NO: 184702 - DNA, 601 bp, Human
aaaaacacacacacacaaaatagctgggcatgatggcaggtgcctgtaatcccagctactcgggaggctgaggcaggagaattgcttgaacctgggaggaggaggttgtagtcagccgagatcgtgccattgcactccagcctgggcaacagagcaagactccgtctcaaaaaaaaaaaaaacaaaaaaaaaacctcctcttccaataaataaggcattcagcaaatacggaacactacaaaacagaatgtttctctttaaaattcaagttccacaatacaatctgctaagttttggagayagtgcctcctccaagtaagtactgagggctgctggttttattccatgcttgtttcttaatggcagtgagttctgagaagcattaaaggtgggatgatgcaaagaacaccacatcattactttagaagctctggctgttctaaaaagttcaagtaaccctaaaattactaaaccagtttcttatctaacaataaaaaaaactaggtgcaaattgcaacttaaatacatcctatcagataaaatgcttgttctaatatacattaagccttgtcttctatatttttattcacttggggacctc

SEQ ID NO: 184703 - DNA, 601 bp, Human
ctcggctttgaaagccttctctacactctctgcagggctcacttaccacactgtgacttccactagagtacactgggcatctgatccctttctagattccttcaggaccacaatttattcatcttggtgttatttcaagtgcctagcatagcatctttcattcagtggactggtaaatgtttgttaatgagtcgctagtacatatatctgagcaaaaccagaaattcgcatttctggaaaaaaattccattccaatactgctaactcaacccagaaggttatcaaatctctttttcattcytttctcttcaaccagaaagaaaatactatctgaacactttcagacatttcttccccagcaaaccaaagcaagcaaatcaaggcttaaactttgtcgtctacattacttccttaacttgttcaaactgaaattgctgtcttttcacgctgtgcaacttcagaaaaggtaaaaaataaagaacagaagaatgcaataagatatgtactgacagcactacgtaatacctgctccaaagagggtttttacaccagtcaaaaattctaacagtttaaacaactgctcaacttggcacagcacagc

SEQ ID NO: 184704 - DNA, 601 bp, Human
ggttttacgtaagggattgctgttctcggctttgaaagccttctctacactctctgcagggctcacttaccacactgtgacttccactagagtacactgggcatctgatccctttctagattccttcaggaccacaatttattcatcttggtgttatttcaagtgcctagcatagcatctttcattcagtggactggtaaatgtttgttaatgagtcgctagtacatatatctgagcaaaaccagaaattcgcatttctggaaaaaaattccattccaatactgctaactcaacccagaargttatcaaatctctttttcattcctttctcttcaaccagaaagaaaatactatctgaacactttcagacatttcttccccagcaaaccaaagcaagcaaatcaaggcttaaactttgtcgtctacattacttccttaacttgttcaaactgaaattgctgtcttttcacgctgtgcaacttcagaaaaggtaaaaaataaagaacagaagaatgcaataagatatgtactgacagcactacgtaatacctgctccaaagagggtttttacaccagtcaaaaattctaacagtttaaacaa

SEQ ID NO: 184705 - DNA, 601 bp, Human
cgcctgtaatcccagcattttgggaggccgagacgggtggatcacttgaggtcaagagttcgagaccagcctgggcaacatggtgaaacctcatctctactaaaaatacaaaaattagctgggcgtggtggcgggcacctgtaatctcagctacttgggaagctgaggcagaacaatcgcttgaacctggggaggcagaggttacggtgagccgagttagggccactgcactccagcctgtgacagagcgaaactccatctcaaaaaacaaaaacaaacaaaaaaacttagccaggcgtcrtggtgggtgcctatagtcctagctactcaggaagctgaggtgaaagatcacttgagcccagggatttgaagttacgatgagctataatcacacaattatactccagcttgggtgacaaagtaagatcccgtctctaaaaaataataagtaaaaagttttttaaaatacacacaaccttggtgatcaggctttggctgcaactctggcccaggaggccagaaaaaaaaatacacacaaggcattcgcaaagaacagtgagcagataatagataaatctttagttttatgagagtgacaaga

SEQ ID NO: 184706 - DNA, 601 bp, Human
aactgtcagttttcttgattgttctgaggacctcagatccttcaactagtagccaaattcttgtctcccgaagatattttaaaaccaagggtagaatgatgaaattctaaacatgccccaatagacacactagccagactcatagtaactgaactcactgctgtttaatacgaaatagacaagtactgtaaaaagataaccagtgctctaccttcagcactctcgacaaacttaaaaatacaaaacttggccaggcacagtggctctcgcctgtaatcccagcattttgggaggccgagaygggtggatcacttgaggtcaagagttcgagaccagcctgggcaacatggtgaaacctcatctctactaaaaatacaaaaattagctgggcgtggtggcgggcacctgtaatctcagctacttgggaagctgaggcagaacaatcgcttgaacctggggaggcagaggttacggtgagccgagttagggccactgcactccagcctgtgacagagcgaaactccatctcaaaaaacaaaaacaaacaaaaaaacttagccaggcgtcgtggtgggtgcctatagtcctagctactcaggaa

SEQ ID NO: 184707 - DNA, 601 bp, Human
gtcaaaaataaaaaaataaccgaaacatttttctgctaccaaaattaaccacctaaaggcaatggacaagtagtatggtaacatactggagttctacagaaatattcaaccaggaaattacccagtgacattctgcagaatgcgctttttttttttcaagtgaagcgacatacaattacctagtgggaatgtggtttggaagtgagtgtcaccactgttaggtcaggtgctcgggaaagccttattaagtgttcttctctctttgaaagtagaattatgatgggaaactggttcaacttaragtactgtaacaactaggtttccttagaacaaagccatttacgaaggagccatataaatctacagtctcggctcactttgttaaactctactgaaaacaaggcagaaacttctaagccttgaaatgaatcaacaatcaacagctaaaaactgtcagttttcttgattgttctgaggacctcagatccttcaactagtagccaaattcttgtctcccgaagatattttaaaaccaagggtagaatgatgaaattctaaacatgccccaatagacacactagccagactcatagtaactgaa

SEQ ID NO: 184708 - DNA, 601 bp, Human
cggggcaacaaagggagactccatgtcaaaaataaaaaaataaccgaaacatttttctgctaccaaaattaaccacctaaaggcaatggacaagtagtatggtaacatactggagttctacagaaatattcaaccaggaaattacccagtgacattctgcagaatgcgctttttttttttcaagtgaagcgacatacaattacctagtgggaatgtggtttggaagtgagtgtcaccactgttaggtcaggtgctcgggaaagccttattaagtgttcttctctctttgaaagtagaattatgatgggaaactggttcaacttagagtactgtaacaactaggtttccttagaacaaagccatttacgaaggagccatataaatctacagtctcggctcactttgttaaactctactgaaaacaaggcagaaacttctaagccttgaaatgaatcaacaatcaacagctaaaaactgtcagttttcttgattgttctgaggacctcagatccttcaactagtagccaaattcttgtctcccgaagatattttaaaaccaagggtagaatgatgaaattctaaacatgccccaatagacaca

SEQ ID NO: 184709 - DNA, 601 bp, Human
aggtggaggttgcagtgagccgagatcacgccattgcactgcagccggggcaacaaagggagactccatgtcaaaaataaaaaaataaccgaaacatttttctgctaccaaaattaaccacctaaaggcaatggacaagtagtatggtaacatactggagttctacagaaatattcaaccaggaaattacccagtgacattctgcagaatgcgctttttttttttcaagtgaagcgacatacaattacctagtgggaatgtggtttggaagtgagtgtcaccactgttaggtcaggtgctygggaaagccttattaagtgttcttctctctttgaaagtagaattatgatgggaaactggttcaacttagagtactgtaacaactaggtttccttagaacaaagccatttacgaaggagccatataaatctacagtctcggctcactttgttaaactctactgaaaacaaggcagaaacttctaagccttgaaatgaatcaacaatcaacagctaaaaactgtcagttttcttgattgttctgaggacctcagatccttcaactagtagccaaattcttgtctcccgaagatattttaaaa

SEQ ID NO: 184710 - DNA, 601 bp, Human
ctagaataaactttgaaatgacctcgattccaagcctcactcctctcatggatatgactgacctaagttatttagctttactgagcctttattttctcatctgtaaaatgggtcaacagtacctaacctcaagagaatgttgtgaagactaaataactgataaggggtggtaaatgctcaataaatttattacagcaagcacttcaaagccccaaaataatttcaaaaacctttaagaatgaaacattaggcaaatgccagggccactctcagaaaactacacgctagttgtagtaattasctccaggcatgcccttcccgccccctgttattaaacagcatgatgtggcagatcaagcactaaactagcaggtagcaaatctgcattctagactcaatggtgtcattaactctgtgagtgaccttaggcatttacttagcatttctaaggctccagttcctttatctgaaaatgaagaggctgtacaactgctagggtcgtatccagcgctaacattctaagaacctctttattcggacacaaaagcaatgccacattatcaacctgatcagactttgcatagagtaactaaaattccat

SEQ ID NO: 184711 - DNA, 601 bp, Human
ctgtccatcccctaccctgaagggctaatgatcactcccctaggacatgacacctctttaaattagaggcacacatggggaccaggtgcagtggctcacacctgtacctgtaatcccagcactttgggaggccaaggcgggcagataacttgaggtcaggaatttgagaccagcctggccaacgtggtgaaaccccgtctctactaaaaaattaaaaattagctgggtctgctggcacacacctgtaatcccagctactcaggaggctgtggcgggagaatggcttgaaccggggaggtgsaggttgcagtgagctgagatcactgagtcactgcactccagcctgggcgacaagagcgagactctgtctcaaaaataagtaagtaaataaataaataaattataggtacacatgtatcttagttcttgttccctagattgtagacttccagaatgaactgtgggtggatgacttttttctctacttcagtagtctcaacaagttggcatgatgtattgtatagaataaatacacaatcaatttttactgaattactgtgttttcctttgattttcacactggttccttccagtcacatca

SEQ ID NO: 184712 - DNA, 601 bp, Human
gaaggccacacatctgaggttttggcaacacttcgggagccatggtagttactgtccttgatacgtatgccaacctcaacaccaacatcattcctgactcattttattttattttattttatttatttattttgagtcttgctctgttgccaggctggagtgcagtggtgcaatctcggctcactgcaacctccgactcctgggttcaagcgattcccctgcctcagcctcccgagtagctgggactacaggcgcgcgccaccacgcctgggtaattttttgtatttttagtagagatggsgtttcaccatgttggccaggatggtctcgatctcctgaccttgtgatccgcccgccttggcctcctaaagtgctgggattacaagcgtgagccactgcgcccagccagttttatgttatgtggattttgcttcaattttttaaaagagtgtacaatttttttttaaagctatgatcatgggtcaaaggacttgaatatggagaatcctacttggccagcatatcctcacagcatacgtcagtcaaggccacagacatcatggcaggtaaaaaaaaaaagctacgttttgattcaagttac

SEQ ID NO: 184713 - DNA, 601 bp, Human
aaaccccgtctctactaaaatacaagaattagccagggtgatgacaggtgcctataatcccagatactcaggaggctgagccaggagaatctggcaatcttgaacctgcgaggcggaggttgcagtgagccgagattgcaccactgcactccagcctgggcataacagtgagactctgtctcaaaaaaattaaataaaataaaaattagctgggtgtggtagcacatgtctgtagtgccagctacttgggaggctgaggtgggaggatcacttgaacccgggaggtggagggaggctgcartgaaccaagatcgcaccactgcactccaacctggaccacggtgtgagaccctgtctccaaaaaaaaggaaatgttttagaactacatagaattgctggttgtacaacacagtgtgaatgtactaaatgccactgaattgttcactttaaaatggctttatttatttgtttgttaattgtttatcaagacgaactattagcccacatattcatgtgtcgtagttcaggaacacgagtcagtgacaaacttctaggtaattcaacctgaagaaattctttatattccaagattactttaaac

SEQ ID NO: 184714 - DNA, 601 bp, Human
actctactaaaaacacaaaaatttgccgggcacggtgtcttgtgcctgtaatcccagctacttgggaggctgaggcaggaagctacccgggaggcagaggttgcagtgagctgagattgcaccatcgcactccagcctgggcaacaagagcgaaactccatcttaaaaaaaaaaaagccaggcacggtggctcatgcctataatcccagcactttgggaggccgaggcgggtggatcacaaggtcaggagatcgagaccatcctggctaacatggtgaaaccctgtctctactaaaaatayaaaaaattagccgggcttggtggcgggcacctgtaatcccagctactcgggaggccaaggcaggagaatggcatgaacccgggaggtggagctggcagtgagccgagatcgcaccactgcactccagcctgggtgacacgactctgtctcaaaaacagacagagcaggactctgtctcaaaaaaaaaaaaaaaaaaaaaagaggcaaaactaatagtataatttataataaaggaagattaatgacttgactgtggtacttggtacattaccacaaattttaaaacatgaagtgaagact

SEQ ID NO: 184715 - DNA, 601 bp, Human
acttctggaggtggaggcgggcggatcacctgaggtcaggagtttgagaccagtctgactaatatgaggaaaccccaactctactaaaaacacaaaaatttgccgggcacggtgtcttgtgcctgtaatcccagctacttgggaggctgaggcaggaagctacccgggaggcagaggttgcagtgagctgagattgcaccatcgcactccagcctgggcaacaagagcgaaactccatcttaaaaaaaaaaaagccaggcacggtggctcatgcctataatcccagcactttgggaggccraggcgggtggatcacaaggtcaggagatcgagaccatcctggctaacatggtgaaaccctgtctctactaaaaatacaaaaaattagccgggcttggtggcgggcacctgtaatcccagctactcgggaggccaaggcaggagaatggcatgaacccgggaggtggagctggcagtgagccgagatcgcaccactgcactccagcctgggtgacacgactctgtctcaaaaacagacagagcaggactctgtctcaaaaaaaaaaaaaaaaaaaaaagaggcaaaactaatagtataatt

SEQ ID NO: 184716 - DNA, 601 bp, Human
tcaaaaaaaaaagaggaaaaactaggctgggcatggtggctcacatctgtaatcccagcacttctggaggtggaggcgggcggatcacctgaggtcaggagtttgagaccagtctgactaatatgaggaaaccccaactctactaaaaacacaaaaatttgccgggcacggtgtcttgtgcctgtaatcccagctacttgggaggctgaggcaggaagctacccgggaggcagaggttgcagtgagctgagattgcaccatcgcactccagcctgggcaacaagagcgaaactccatcttaaaaaaaaaaaagccaggcacggtggctcatgcctataatcccagcactttgggaggccgaggcgggtggatcacaaggtcaggagatcgagaccatcctggctaacatggtgaaaccctgtctctactaaaaatacaaaaaattagccgggcttggtggcgggcacctgtaatcccagctactcgggaggccaaggcaggagaatggcatgaacccgggaggtggagctggcagtgagccgagatcgcaccactgcactccagcctgggtgacacgactctgtctcaaaaacagacagag

SEQ ID NO: 184717 - DNA, 601 bp, Human
ttaaggcaggaaaatgacgggtgtggtgggcttcctcaccactctcaagtgtatcactaactgtaacagcttttcaaaacaaaacagtacttacacctgaccacttagttcctggcaccaactattagatttacaatacagatggctcctcaacttacaatggattgtaagttgcaaatgggttgggcatggtggctcacacctgtagtcctaaacctctgggagtccaaggtgggaggatggcaagagtttgagaccagcctgggcaacatggcaaaaccccacctgtaccaaaaaaagmaaaacaaaaaacaaaaaacaaaaaactgtcgggaatggcggcatgcgcctgcagtcccagctgctccgggggctgagcctgggagggtcaaggttgcaatgagtcctgactacaccactgcactccagcctgggcgagagagtgacaccctgtctcaaaaaataaaaataaaaccgatatatttctaccctatcttcatacatacacagtaaacctttacttgttcattctactctggtcttattcatgactcacataacatccagattttactggctactaatgagcctgggcttagaa

SEQ ID NO: 184718 - DNA, 601 bp, Human
tatcaatatgtattgagtatcagccaggcacggtggctcacacctgtaatcccaacactttgggaggcggaagcggggggatcatttgagttcgggagttcaagaccaacccggccaacatggcaaaaccctgtctctactgaaaatacaaaacaattagctgggtgtggcatacacctgtaatcccagctactcgggaggccaaggcaggagaatcgcttgaacccgggaggtggaggttgcagtgagccaagatcacgtcactgcactccagcttggacaagaatgaaactccgtctcaaaaaaaaaaaaattaataaaaatgaatacatatatatatgtattgagtatctattatgggccagacaaggataaaagtactcacaaatccatattgtgtagggagtgggggatggagggggtagcaatttgctttaactaatttttattgagccctaagtgccgactgctagctcattcccaccaaaagccttaggaaacagatcctgtaatcactaccatctaacatacaggcacatcagaatcaactgcaggcatttccaagttatgcaagtgccatcttccccttcctcagatagtc

SEQ ID NO: 184719 - DNA, 601 bp, Human
tcatgcacagcaagtatgaaaaaataatgaatttgtaacctgtaaaatcattgcccggaaaggatcaatacctgtaagagtcaagagaaagtgttttgggcccaaccttcaatagcatcaaatgttgagtaaagtaatttcctgtccctgataggtaaaggacaaccaaattgttttctttttttttttaagtgacaggctcagactgtcacttaggaagatctttttcttgcagcttaaactacatgaactagagtgggcaagaccccacaggcaggaagacccacatcaccactgcaasaaagcatgccatggagacaaccaagcaatacaactaggaggggatgggggctacacctgacaggagttgggagaaagggagagtaaaaggtctaagatgaccccaagctgtgggatgagcaggacattaacaaacaggggggaaacgcatttgaacctggtttggaaggaggcagaaactgtacttcaacacaatacagattaacttttttttgcttttccattttcaagaaaagtttaaggataaggtaaggaaaaattactcagttttcagaggaagccaggtagtactgagagtatc

SEQ ID NO: 184720 - DNA, 601 bp, Human
caatcaataaccccagatcaatggcagctaactcaggccttcaagttagaagtctctgcttaacctacttttcaaaattctactaattacagccaattttgaaacattttcagtagtttcaatgtattcataaaaacatgcttattcttttgatttgctttataaaccttttcttcacagatactgtcaaagtaatttgcagctcagcacagatcaaattagagatgtgctcaacaaatacacatctacttcccgtgattctctctaggtaacccagcccaagaaagctgtgattagccctttttttttttttttttttttgagactgagtttcactcttgttgcccaggctggagttggagtgcaatggcacgatcttggcttaccgcaacctccatctccccggttcaagcgattctcctgcctcagcctcctgagtacctgggatcacaggtgcatgccaccatgcccggctaattttgtatttttagtagagatggggtttcgccacgttggtcaggctggttttgaactacgacctcaggtgttctgcccacctcggcctcccaaagtgctgggattacaggcttgagccaccgca

SEQ ID NO: 184721 - DNA, 601 bp, Human
gagagtgaaagagtttcatattactgtattaatatggtcagaaattttcttaccaataggttctgaaagttccatgctaacagctgaatttgaacctagacaagagattgaaatataatatatatttaccaaacagtatctagctttacacaccatatagacaacctaatgttttctcaagtagactttcaaagagtacatcattaccttcacacaatgactgttcctcttgagaggattccacaggtgctgtttaacagaaagaagttctattaaaaattgatacttatccatccatttyacttatcttttaatatgcagtaaaaacagaagttcaataacacgacacaagcctcaatcaataaccccagatcaatggcagctaactcaggccttcaagttagaagtctctgcttaacctacttttcaaaattctactaattacagccaattttgaaacattttcagtagtttcaatgtattcataaaaacatgcttattcttttgatttgctttataaaccttttcttcacagatactgtcaaagtaatttgcagctcagcacagatcaaattagagatgtgctcaacaaatacacatc

SEQ ID NO: 184722 - DNA, 601 bp, Human
ttcctgcttcacacaaaattatctggtaaggtcaatcccattaaaattaacaagttaactgaggttcacataaaaaagggcacattttctaagatactgatatataatactatgctgaactaccatcaatggtcaatagactaattatatgttacgtacaatatactgaagtttttcttccagcatctatgccgttacagaattattcatttgcctaaacttcaggaaaaaagtacttgcaattttttgccagctaaaaaaaatcagcaagttaaaaatcaagacattttcaattaatttscttcagtttcactaaacatctccaggtagctaaaaaggatgttctatgttttatgtatccagtaactttaattgctatgagagcagcttacctacgtgcccaatgaatactacatttacatgctctttcttaggagcacctggcggtgcaaccacagacttaggttttgggatttcctcttcctcctccatcatttcatgggcactttcctctggcggccttccatctcccaaggaaccaccccctggctctgcttcacttatttcttctttgtgctcccatgattcttctggagacatt

SEQ ID NO: 184723 - DNA, 601 bp, Human
ctgggttcaagcaattctcctgcctcagcctccggagtagctgggattacaggctcatgccaccacacctggctaatttttgtatttttagtagagacggggtttcaccatgttggccaggctggtcttgaactcctgacctcgtgatgtgcccgccttggcctcccaaagtgctgggattacaggcgccagccacagtgcccagccgctcctttacactttcaaaagagttcttgctactaaaagaaggggtacagtgtttcatatctggggggaaggcagagatagctgaaatgaaagwcacataattctgtattttttttctcacaattctggggataggccagataattagagaatatctgagtaaattaaataaatttgttcttttgttttttgctaaaccagcaacctggcaagcatccagaagttactccaaattattgatttcctgcttcacacaaaattatctggtaaggtcaatcccattaaaattaacaagttaactgaggttcacataaaaaagggcacattttctaagatactgatatataatactatgctgaactaccatcaatggtcaatagactaattatatgtt

SEQ ID NO: 184724 - DNA, 601 bp, Human
agaagtttccaagagcaaaagcagctgaagaactgtgaactagattcaggtgcttttcctttcacttacagcaaatgaggtatgtgctcctttacacctttttttccccacgagacggaatcttgctccgttgcccagagctggagtgcagtggtgcgatctcacctcactgcaacctccaccttctgggttcaagcaattctcctgcctcagcctccggagtagctgggattacaggctcatgccaccacacctggctaatttttgtatttttagtagagacggggtttcaccatgttgrccaggctggtcttgaactcctgacctcgtgatgtgcccgccttggcctcccaaagtgctgggattacaggcgccagccacagtgcccagccgctcctttacactttcaaaagagttcttgctactaaaagaaggggtacagtgtttcatatctggggggaaggcagagatagctgaaatgaaagacacataattctgtattttttttctcacaattctggggataggccagataattagagaatatctgagtaaattaaataaatttgttcttttgttttttgctaaaccagcaacctgg

SEQ ID NO: 184725 - DNA, 601 bp, Human
tgagaccctatctcaaaaaaaaaaaaaaaaaaaaaaaaaaaaaaaaaaaatttaactaggcaagatgatggcaagccctctaggtcctctgatgacacagttcaaagaaatgggtctaatttagagaagcaattaaaaatttaggactttttagttatcaagatttgtcaatactaaaatgcattactaaaggccagccacggtcatttcatacctaggaaatttctataatacgatcaaaaaattatcttagcattttagctagtctacctgtcttttattaaatccatatacatttaargagctgatgaatgaggaaaaaacagttcccccattcaccagattcaagagctggttgtcattattcccatgtatgttatatgcaaaggagaccaagtttcccataatctagagttctgtgttcattttttatttttaaaaaatgtaaaaagctttcagaaacacatttaacactagtaataatcacattacaaaaactactacttttaaaaaaattaaagtagagacagagtctcattgtcttgcccaggctggtttcaaactccagacctcaagtccagtgatcctcccaccttagcct

SEQ ID NO: 184726 - DNA, 601 bp, Human
acctgtatgccagcactttgggaggcagtagaggtgggcagaccacttgaccccaagaggtcaagaccagcctgggcaatatgatgaaacaccacctctacaaaaaaacacaaaaattagccaggcttggttgcatgcacctgtgatcccacctgcttgggaggctgaggtggaaggattgcttgagtccaggaggtcgaggctgcagtgagccaaaatcatgccactgcactccagccttggtgacagaatgagaccctatctcaaaaaaaaaaaaaaaaaaaaaaaaaaaaaaaaaaawtttaactaggcaagatgatggcaagccctctaggtcctctgatgacacagttcaaagaaatgggtctaatttagagaagcaattaaaaatttaggactttttagttatcaagatttgtcaatactaaaatgcattactaaaggccagccacggtcatttcatacctaggaaatttctataatacgatcaaaaaattatcttagcattttagctagtctacctgtcttttattaaatccatatacatttaaggagctgatgaatgaggaaaaaacagttcccccattcaccagattcaaga

SEQ ID NO: 184727 - DNA, 601 bp, Human
aatgactatggttataagatgtcaacatcagggcaggatgaatgaagggaacttcccgtactgtttttgcaaccattccgtaaatctaaaattatttcagaatatagtaggttttgttttttgtttttgtttgttttttttaagtaaatataaggtgggcatggtggtgcaagcgtgtagtcccagctacttgggaggctgaggtaggaggatcagttgagcacaggaatttgaagctatagtgcgctatcatcctcccccctataaatagccactaccctccggcctgggcaacacagcragaccctgtctcttaaaataaatatagttttatttttattttttatagaaatgagggtctcactatattgtcctggctcttcttgaagcctgggctcaaatgatccttccgccttggcctcccaaaatgctaggattacagatatgagccaccatgcccagccaagtaaatttaaaaataaaataacaagtaaatgtaaatgtaggtactatagaaaagaaaaaaaaattgcaacaatgttgtctaggcaagtaagtcttattacttgtcaaaatgagataataatttcaaaatagttcg

SEQ ID NO: 184728 - DNA, 601 bp, Human
tacttgggaggctgaggcaggagaatcatttgaacccaggaggcggaggttgcagtgagccaagatcacaccactgcactgcactccagcctgggcgatagagattctgtctcaaaaaaaaaaaaaaaaaaaaaaaaaagaaaagaaaagggaaaacaataaccttatagtggacaatcttgacagatgacaccttaaccaagtaatcatgactaatttcaccagtaataaggaagttttgatgaatgactatggttataagatgtcaacatcagggcaggatgaatgaagggaacttccygtactgtttttgcaaccattccgtaaatctaaaattatttcagaatatagtaggttttgttttttgtttttgtttgttttttttaagtaaatataaggtgggcatggtggtgcaagcgtgtagtcccagctacttgggaggctgaggtaggaggatcagttgagcacaggaatttgaagctatagtgcgctatcatcctcccccctataaatagccactaccctccggcctgggcaacacagcgagaccctgtctcttaaaataaatatagttttatttttattttttatagaaatgagg

SEQ ID NO: 184729 - DNA, 601 bp, Human
ttttttttttttttttttttttttggagatgggagtcttgctctggccaggttggagtgcagtggcaccatctcggctcactgcaacctctgcttcccaggttccagctattctcctgcctcagcctcccaagtagctgggattacaggtgcccaccaccacgcccggctactttttgtatatatattttttgagatggagtttagctcttgttgcccaggctggagtgcagcagcaccatctcggctcaccgcaacctccgcctcccaggttcaagtgattctcctgcctcagccccccsagtagctgggattagagcatgcgccaccatgcccagctaattttgtatttttagtagagacagggtttctccatgttggtcaggctggtctcgaactcctgacctcaggtgatccgcctgcctcggcctcccaaagcgctgggattacaggcgtgagacactgtgcccggccatttttgtagttttagtagagacagggtttcaccatattggccagggtggtctcgaactcctgacctcaggtgtgatctgcctgccttgcctcccaaagtgctgagattacaggcttgagtcaccgcg

SEQ ID NO: 184730 - DNA, 601 bp, Human
catatttgggacaaaactcttgtggccaggggcatctagaattgtgaaatgcttcttttcggtttcaaaataggcacgacccacttctactgttttacccttgtctcgttcttcctgatttgtgtctaaggcccaagacaagtacctgaaataatttttaaaaaaagaacaatattcctaagaacatcagagtttttaggatattcttcaccattaaagatataatggatgacacacaacacctaaatcacgaacaagattggtgaaatgaaaattgagccgggtgcggtggctcacatckgtaatctgagcactttgggaggccaaggcggcggatcacaaggtcaggggttcgacaccagcctgaccaacatggtgaagccctgtctctaccgaaaatacaaaaattagctgggtgtggaggagcccacctgtagtacttaggagactgaggcaggagaatcgcttgaacctgggaggaggaggttgcagcgagccaagaccgtgccattgcactccagcctgggcgacagagcaaggctccgtctcaaaagaaaacaaagaaattgaaagaatagggctgggcgcagtggctcacgcc

SEQ ID NO: 184731 - DNA, 601 bp, Human
ttcctggctgagattacctaattccaagaaaggaaacagtttactccttcgccttcaggcatacccttatggcagtaaaacatctttcctttcagttatatcacgagttttttttttttttttttgcaagaaaatagaagcaaacgagttatgacgtacctgcttttgaatgtcacaaatcaaacaatgtctagatgcttccaatcccccacattcccaaaatctagtatacctgcatattttaaaattccaacatttactttctagctattgtaactacaaaggaaaaaaaattgtgatmtactaccagtacattgtgaaaagcgcaaaatgactgaagaccgtatgaaacagatggtttcctattcattttttacccatggtgcctaacggtgggcttggcatttaatggagactaagttctgacatggtaatagataatagcaacaggagagaaaaggtgaaacgtattttcagaagtaaatcaaattttgaagatttcttgaagagagattagtatgatgaaaactgtgaccgtgtacatcattatatttcactgcaacctgaatttgagcttttagaagataaattcaaatttaaa

SEQ ID NO: 184732 - DNA, 601 bp, Human
ataacaaaaccatccttaatcccactaacataaaataccagacatctacgctcacctctcattgctccaatttactgttggatcatccatcttattaattagcacaattaggtgttttacacctgctgtctttgccaacattgcatgttctcttgtctgtcctcctttttcaaatccagtttcaaactctcctttcctggctgagattacctaattccaagaaaggaaacagtttactccttcgccttcaggcatacccttatggcagtaaaacatctttcctttcagttatatcacgagttttttttttttttttttgcaagaaaatagaagcaaacgagttatgacgtacctgcttttgaatgtcacaaatcaaacaatgtctagatgcttccaatcccccacattcccaaaatctagtatacctgcatattttaaaattccaacatttactttctagctattgtaactacaaaggaaaaaaaattgtgatctactaccagtacattgtgaaaagcgcaaaatgactgaagaccgtatgaaacagatggtttcctattcattttttacccatggtgcctaacggtgggcttggcattta

SEQ ID NO: 184733 - DNA, 601 bp, Human
ctcagtataaggcttcctcataaacttattaaaatttagagaaatattttatagcaaatagcctacatgtaataaattgactatattactttttatggacttttccagctatgaaaccaagattctataaaataatttcccctttaaacatacagtattggctgcgtgcagtggctcatgcctataatcccagcactttgggaggccgaaaggcaggtgcatctcttgagcccaggagttcgacaccagcctgggcaacatggtgaatctgtctctactaaaaatacaaaaatcagccggstgcggtggcatgtgcctacagtccctacgacttgggaggctgaggtgggaggatctcttgagctgggaggcagaggttgcagtgagccgagatcatgccactgcactccagcctggttaacagagtgaaaacctgtttcaaaaaaacaaaccaaaaaaaagaaacacggagttcaagaataaactcgtatttatggtcatttgattttcaaagagggagccaaatcaattcaatgaaaaaagaatagtcttttcaacaaattgtgtgtaaacaattaatatacaaaaacaaaacaaacct

SEQ ID NO: 184734 - DNA, 601 bp, Human
aaaaaaaaaaaaaagaaggccaggtacggtggctcacgcctgtaatcccagcaccttgggggaggccgaggcaggtggatcacaaggtcaggagatcgagaccatcctggctgacacagtgaaaccccgtctctactaaaaatacaaaaaattagctgggcgtggtggcgggagcctgtagtcctagctactcaggaggctgaggcaggagaatcacttgaaccaaggaggcagagcttgcagtgagctgagatcgcgccactgcactccagcctgggggacagagtgcaagattctgtcaaaaaaaaaacaagaaagaaaagaaaagaaaaaaagttttcaaaactagaaacaaaatgcacaacaatgatttcccctcccaggaaacccaatttctttaacattttgggtaccttgtacttatccacaattggcagcctgattggtccatcaactgatctattgaagttcggcaaattatccagatatggaataaacggtaatccactgagaacataacaacaaagccattaaaggaagtcaacataaatatcaaaatgttaagttacatgactataaacagcttctaataatattttca

SEQ ID NO: 184735 - DNA, 601 bp, Human
ctagcctgggtgacagagtgagactccgtctcaaaaaaaaaaaaaaaaagaaggccaggtacggtggctcacgcctgtaatcccagcaccttgggggaggccgaggcaggtggatcacaaggtcaggagatcgagaccatcctggctgacacagtgaaaccccgtctctactaaaaatacaaaaaattagctgggcgtggtggcgggagcctgtagtcctagctactcaggaggctgaggcaggagaatcacttgaaccaaggaggcagagcttgcagtgagctgagatcgcgccactgcrctccagcctgggggacagagtgcaagattctgtcaaaaaaaaaacaagaaagaaaagaaaagaaaaaaagttttcaaaactagaaacaaaatgcacaacaatgatttcccctcccaggaaacccaatttctttaacattttgggtaccttgtacttatccacaattggcagcctgattggtccatcaactgatctattgaagttcggcaaattatccagatatggaataaacggtaatccactgagaacataacaacaaagccattaaaggaagtcaacataaatatcaaaatgttaagt

SEQ ID NO: 184736 - DNA, 601 bp, Human
acaattagctggatgcggtggcacacgcctgtagtcccagctactcaggaggctgaggctggagaatctcttgaacctgggaggcagaggttgcagtgagctgacatcacaccactgcactctagcctgggtgacagagtgagactccgtctcaaaaaaaaaaaaaaaaagaaggccaggtacggtggctcacgcctgtaatcccagcaccttgggggaggccgaggcaggtggatcacaaggtcaggagatcgagaccatcctggctgacacagtgaaaccccgtctctactaaaaatayaaaaaattagctgggcgtggtggcgggagcctgtagtcctagctactcaggaggctgaggcaggagaatcacttgaaccaaggaggcagagcttgcagtgagctgagatcgcgccactgcactccagcctgggggacagagtgcaagattctgtcaaaaaaaaaacaagaaagaaaagaaaagaaaaaaagttttcaaaactagaaacaaaatgcacaacaatgatttcccctcccaggaaacccaatttctttaacattttgggtaccttgtacttatccacaattggcagcctgattg

SEQ ID NO: 184737 - DNA, 601 bp, Human
acagcagcaacaactaactaagaactcaacctgagaattattttcactcatatgttagcctccaagttgcaaagataataggaaaaagtaggctttaaaatgtaaacattttagaagatactatatattctcatctccaatgcacaaggcatcaagaaaccagataatacaatttgtaaggtgccaattatgtctaaatattacatttgataatggattctttttctaatttactctgcctggagttagcatggtaaataaattctcactgaaatctagcaaaatctccatctgaaggtamtgatgactcaagtctgtggtcctgcataagcaacatctttggagctgttagagaagccctgcctcaggttatctgcaaatctcagcaactgaacagtcaaaaatgacacaaaggaggccaggcatgatggctcacgcccgtaatcctagcactttgggaggccaagatgggaggattgtttgaggccaggagttagagactagtctggtcaacatagtgagaccccatctcaatttttatttaaaaaaaaaaaaaattagccaggcagagtggcacaagcctatagtcccagctacttgg

SEQ ID NO: 184738 - DNA, 601 bp, Human
cacctcaaacttcgaaagtgctaggtgttagccaccatgcctggctcatctccataatttttgggacaactctacagacaaaactgagtaagtaagggctgggtgtggtggctcaagcctgtaatcccagcactttgggaggcccaggcgggcaaatcacgaggttaggagttcgagaccagcctggccaacaaggtgaaaccctgtctctactaaaaccacaaaaattagccagatatggtgatgcatgcctgtaatcccagctacccgggaggcggaggttgcagtgagccaagaatgygccactgcactccagcctggcgacagggtgagactccatctcaaaacaacaacagcagcaacaactaactaagaactcaacctgagaattattttcactcatatgttagcctccaagttgcaaagataataggaaaaagtaggctttaaaatgtaaacattttagaagatactatatattctcatctccaatgcacaaggcatcaagaaaccagataatacaatttgtaaggtgccaattatgtctaaatattacatttgataatggattctttttctaatttactctgcctggagttag

SEQ ID NO: 184739 - DNA, 601 bp, Human
ggtcaggagttcaaggccagcctagccaagatggtgaaaccctgtctcgactaaaaatacaaaaattagccaggcgtggtggcaggcacctgtaatcccagctactcgggaggctgaggcagagaactgcttgaaccctggaggtggaggttgcagtgagctgagatggcgccactgtactccagcctgggccacagaaggagactccgtctcaaaaaaaaaagaaagaaacaagagtttagaagtcactcacctaaaaaacaatctgtatcggctgggcgcagtggctcacgcctgtaaycccagcactttgggaggccaaggcaggtggatcacgaggtcagaagttcaagaccagcctggccaacacggtgaaatcctgtctccattaaaaatacaaaaatgagctgggcatggtggcacgttcctgtaatcccagctacttgggaggctgaggcagaagcattgcttgaaccgggacctgggaggtggaggtcgcagtgagccgagatcacaccactgcactccagcctgggctacagagcgagactccgtctcaaaaaaaaaaaaaaaaacaaaacaaaaaacaaaaaacaatctg

SEQ ID NO: 184740 - DNA, 601 bp, Human
atcgcttgaacccaggaggcagaggatgcagtgagccgagatcgtgccactatactccagcctgggcaataagagcgaaactccatctccaaaaaataaaaaataataataataataataaaaaaaaaggccgggcacagtggctcacacctgtaatcccagcactttgggaggccaaggtgggtggatcacaaggtcaggagttcaaggccagcctagccaagatggtgaaaccctgtctcgactaaaaatacaaaaattagccaggcgtggtggcaggcacctgtaatcccagctactygggaggctgaggcagagaactgcttgaaccctggaggtggaggttgcagtgagctgagatggcgccactgtactccagcctgggccacagaaggagactccgtctcaaaaaaaaaagaaagaaacaagagtttagaagtcactcacctaaaaaacaatctgtatcggctgggcgcagtggctcacgcctgtaaccccagcactttgggaggccaaggcaggtggatcacgaggtcagaagttcaagaccagcctggccaacacggtgaaatcctgtctccattaaaaatacaaaaatgag

SEQ ID NO: 184741 - DNA, 601 bp, Human
ggccaggtgcagtggctcacgcctcagcattttgggaggccgaggcgggtgatcacctgagatcaggagtttgagaccagcctggccaacatggtgaaaccctgtctctactaaaaatacaaaagaaaaaaaacaattagcttggcgtggtggcaggcacctgtaatcccagctactcaggaggcttgggcaggagaatcgcttgaacccaggaggcagaggatgcagtgagccgagatcgtgccactatactccagcctgggcaataagagcgaaactccatctccaaaaaataaaaaawaataataataataataaaaaaaaaggccgggcacagtggctcacacctgtaatcccagcactttgggaggccaaggtgggtggatcacaaggtcaggagttcaaggccagcctagccaagatggtgaaaccctgtctcgactaaaaatacaaaaattagccaggcgtggtggcaggcacctgtaatcccagctactcgggaggctgaggcagagaactgcttgaaccctggaggtggaggttgcagtgagctgagatggcgccactgtactccagcctgggccacagaaggagactccgt

SEQ ID NO: 184742 - DNA, 601 bp, Human
aaatagttatggagcctccagttctgatgccagtattgctcctcagtactgccagtgctggctgtggcagcaaggtgaagcaaaagaacaagtgacctgagaggagatacacgggaaatttaccatcagtgacatttactacatcaataatgctatgcaggccaggtgcagtggctcacgcctcagcattttgggaggccgaggcgggtgatcacctgagatcaggagtttgagaccagcctggccaacatggtgaaaccctgtctctactaaaaatacaaaagaaaaaaaacaattagcytggcgtggtggcaggcacctgtaatcccagctactcaggaggcttgggcaggagaatcgcttgaacccaggaggcagaggatgcagtgagccgagatcgtgccactatactccagcctgggcaataagagcgaaactccatctccaaaaaataaaaaataataataataataataaaaaaaaaggccgggcacagtggctcacacctgtaatcccagcactttgggaggccaaggtgggtggatcacaaggtcaggagttcaaggccagcctagccaagatggtgaaaccctgtctcgac

SEQ ID NO: 184743 - DNA, 601 bp, Human
taaaagtctatcaactatttaatgaatacatcatttccttttggtgtaatgaaatggtctggaattagatagtgatgatggctgcatagcattgttatttttttattttgagacagagttttgctcttgttgcccaggctggagtgcagtggtgcgatcttggctcactgcaacctctgcctcctgggttcaagccattctcctgcctcagcctcccaagtagctgggattacaggcacccaccaccatgcctggctaattttttgtatttttagtagagacgaggtttcaccatgttggmcaggctggtctcaaactcctgacctcaggtgatccacccaccttggcctcccaaagtgctcagattacaggcgtgagccactgtgcccggcctaaactctttgtttctaacaaaatagtccacggagctgggtagtccacatgcctttagccccgctacttggaaggctgaggcatgaggactgcttgagcccaggtgttttaaggctgcagtgagctatgatcacactaccgcactgtagcctgagtgacacagcgagaccctgtctttaaaaaaaaaaaaaaaaaaagtttttaatgt

SEQ ID NO: 184744 - DNA, 601 bp, Human
gaattcaatgttctcaagcgccatataaatcccaagaattagtgttaccatctcactaggacatcaacttaagtgatttttgtgttagaggtgataggtttgtcttactaattttgttcacaggatgggtcaggctgcttgacctcaaagcatgaatttcagtatcttatcctgtatttatcttcttggcaagtccctggtcaactttcaaaatacggcaggctggctgggcgcagtggttcacgcctgtaatctcagcactttgggaggccgaggcggcaggggggccggggggatcacytgaggccaggagttcaggaccagcctggacaacatggtgaaaccctgtctctactaaaaatacaaaacaatcagccaggcgtggtggtgggcgcctaaatcccagctactcaggaggctgaggcaggacaatcgcttgaatcccggaggtggaggttgcagtgagccaagatcgcgccactgcactccagcctgggtgacagagcaagaccccatctccaaacaaaacaaaagacagcaggccaactttcttatctgggaagactttccttatattccccaaggaactaagctaattttt

SEQ ID NO: 184745 - DNA, 601 bp, Human
agatttggcattactactaaagcacgtggtcaattctgttcaatacattcaactcataaaacactcatacgaataagaatgtgaatcgaagttttctgtgaacctgttgcaatgtgtactgtactgagatgatgaagatgaccaaagctaggtatcctggatatactactagacgtcagtttaaaagctcttaccctcatctcttaaggtgaaacgacccatctgagggaagtctttaaaggtctcaaggcagatggttcctgctgtccttaagcgagcaatgcatacttgatcttgtttsacaaaacggggtcgggtcttacttttttctcctgattttttgtctaccaagcagattaaggcctaaccaagaaaagagtatgagaaaatcagaataatgccaaataaaataatctttaagaacaggtgtagaaataaaagtgcatcactgttgctgattagaaattatgaagataaaacagtattaaaacagaaataaaccaattatcttaaactcactgttatttccacctcctcaatacaggtatgaatatgcagcaccgcattatagcctgggcagatgatggatttgtgctctata

SEQ ID NO: 184746 - DNA, 601 bp, Human
ggtggagcttgcagtgagccaagatggtgccactgcactccagcctgggtgacagatcgagactccatctcaaaaaaaggaaaggaaagggaagaggaaagggaaagggaaagggaaaggaaaaggacaggaatattaaaagctcataaggaaacgtttcataacaatcattttgtttttatgccaaagaacttcatgaccccaagatgggaatgttagttgttctgcgtcacccagaggtaggcagaaatggatgcacacaaaaggtcacaaagattagacctctgaaaaattaggtgtaaaaaaaaaaatcaatctctatgttccttttaatcgctagacatattacaaaggattacatcatagaaatatcttagtaaacaaaatagccctccaaatccactactcacaaaacatcaaaattaagattcttcacgtagagcattactagatttggcattactactaaagcacgtggtcaattctgttcaatacattcaactcataaaacactcatacgaataagaatgtgaatcgaagttttctgtgaacctgttgcaatgtgtactgtactgagatgatgaagatgaccaaagctagg

SEQ ID NO: 184747 - DNA, 601 bp, Human
agcacagttcctgacactttgtagatacaaagtagtttttgctaaatggaattggaatgaacatgtgaaatgactattctgtatttcaatggaactataaagttttatgtaaagtcttctatagtcttaaaatggttatctaagttagaaatattaacagctgggccgggcacggtggctcacgcctgtaatcccagcactttgggaggccaaggcgggcggatcacgaggtcaggagatcaagaccatcctggctaacgtggtgaaaccccgtctctacaaaaatacaaaaaattagccrggcatggtggcagcacctatagtcccagctactcgggaggctgaggcaggagaatggcgtgaacctgggaggtggagcttgcagtgagccaagatggtgccactgcactccagcctgggtgacagatcgagactccatctcaaaaaaaggaaaggaaagggaagaggaaagggaaagggaaagggaaaggaaaaggacaggaatattaaaagctcataaggaaacgtttcataacaatcattttgtttttatgccaaagaacttcatgaccccaagatgggaatgttagttgttctgcgt

SEQ ID NO: 184748 - DNA, 601 bp, Human
tagcacagttcctgacactttgtagatacaaagtagtttttgctaaatggaattggaatgaacatgtgaaatgactattctgtatttcaatggaactataaagttttatgtaaagtcttctatagtcttaaaatggttatctaagttagaaatattaacagctgggccgggcacggtggctcacgcctgtaatcccagcactttgggaggccaaggcgggcggatcacgaggtcaggagatcaagaccatcctggctaacgtggtgaaaccccgtctctacaaaaatacaaaaaattagcygggcatggtggcagcacctatagtcccagctactcgggaggctgaggcaggagaatggcgtgaacctgggaggtggagcttgcagtgagccaagatggtgccactgcactccagcctgggtgacagatcgagactccatctcaaaaaaaggaaaggaaagggaagaggaaagggaaagggaaagggaaaggaaaaggacaggaatattaaaagctcataaggaaacgtttcataacaatcattttgtttttatgccaaagaacttcatgaccccaagatgggaatgttagttgttctgcg

SEQ ID NO: 184749 - DNA, 601 bp, Human
tcattgaattacatacttaaaacaggtcaatttcatattatggaaattgtatctcaataaagctgctaaaaaaaaaaatcccaaaacctatccttaagtaactgtgaaaaggcacagcaatcaccactgactacagtgcagtgaacacgtccttctggtagtaatcctgtggactgaaaggatacaaaacccattgggtcttgtggaaaacctaaaagccaagttagcttttttttttttttttttttttttttttttaaagccaagttagcttttaggaaaaaataattctagggttaaraattcctgctacattaattgcttttcttctgtcttcctgattttatcaggttctgagtggtaaactaaaactatcattttgttatattaataagataaacccaataaccagttttactatcaaccagaagagttctgggcctttaaagtaaaataaacactgtctttataaaatttcatccaatgtaaagttcaggaactgtattcatcaccagggcttagcacagttcctgacactttgtagatacaaagtagtttttgctaaatggaattggaatgaacatgtgaaatgactattctg

SEQ ID NO: 184750 - DNA, 601 bp, Human
tttttaggtgttctaaatgttctaatattagtatatggtgatggttgtacaattctgtaaacatactaaaattcattgaattacatacttaaaacaggtcaatttcatattatggaaattgtatctcaataaagctgctaaaaaaaaaaatcccaaaacctatccttaagtaactgtgaaaaggcacagcaatcaccactgactacagtgcagtgaacacgtccttctggtagtaatcctgtggactgaaaggatacaaaacccattgggtcttgtggaaaacctaaaagccaagttagcttttttttttttttttttttttttttttttaaagccaagttagcttttaggaaaaaataattctagggttaagaattcctgctacattaattgcttttcttctgtcttcctgattttatcaggttctgagtggtaaactaaaactatcattttgttatattaataagataaacccaataaccagttttactatcaaccagaagagttctgggcctttaaagtaaaataaacactgtctttataaaatttcatccaatgtaaagttcaggaactgtattcatcaccagggcttagcacagtt

SEQ ID NO: 184751 - DNA, 601 bp, Human
gtagttgttctttttactagtcattagatatcaaggtaatttgatgctgggcttttattgaaagctcttctttattatgccattcataaaaactcctctgatttcttccctttttcttttttgtcaatagatatatttttttcttttaacttttactttgggttcagaggtacacatacaggtttgttacatagggaaacttgtgtcacaggggtttggtgtacagattgctttgtcacccaggtactaagcatagtacctgacaggcatttttttctgatcctttccctcctcccacccmccaccctcaagtaggccctagtatctgttgttgccgtctttgtgtccatgagttctcgttatttagctcccagttataagtgagaacaggtggtattgggtttcctgttcctgtgttagtttgctaaggacaatggcctccagctccatccatgttgctgcaaagtacatgatttcatatgctgtggtgtacatgtactatccagtctactacagatgggtatttaggttgattccatgtctttgctattgtaaattgtgctgcagtgaaaatacacatgcactgagtctttacagtaga

SEQ ID NO: 184752 - DNA, 601 bp, Human
ccagaaagatcacatacacatgtactcactaataaaatctataataaatgtacatgagtgtcctttcaagatatctttcttggccaggcggagtggctcaggcctgttatcccagcactgtggaaggccgaggcagacagatcacttgaggtcaggagttcgagaccagcctggcaaacatggtgaaaccccgtctctatcaaaaaatacaaactttagtcgggggtggtggcaggcgcctgtagtcccagctactcaggaggctgaagtgggagaatcgcttgaacctgaaagatagagkttcagtgagtgaaggttgcagtgagcagagattgcaccactgcactccagtctgggtgacagagtgagagcctgtctcagagaaaaagaagatatctttcttaaaatatgtgtgtaacaatttttataaaacaaatcactcttttggtgttttgttaattaaagaatattgatttataaagtaaaagtttcatttattttaaaaatgtgaactattgctctaatctatctgtttagtaaactggcaaattgagtagtaatttctgttaacataggcaaacatctacatatgggattgttt

SEQ ID NO: 184753 - DNA, 601 bp, Human
ttcatatacatgatggtgaatgaactatacagagacaaatggatatatatgtataaagacacacatacatggtataactacaatcttccagaaagatcacatacacatgtactcactaataaaatctataataaatgtacatgagtgtcctttcaagatatctttcttggccaggcggagtggctcaggcctgttatcccagcactgtggaaggccgaggcagacagatcacttgaggtcaggagttcgagaccagcctggcaaacatggtgaaaccccgtctctatcaaaaaatacaaamtttagtcgggggtggtggcaggcgcctgtagtcccagctactcaggaggctgaagtgggagaatcgcttgaacctgaaagatagagtttcagtgagtgaaggttgcagtgagcagagattgcaccactgcactccagtctgggtgacagagtgagagcctgtctcagagaaaaagaagatatctttcttaaaatatgtgtgtaacaatttttataaaacaaatcactcttttggtgttttgttaattaaagaatattgatttataaagtaaaagtttcatttattttaaaaatgtgaact

SEQ ID NO: 184754 - DNA, 601 bp, Human
catgtaggcagaaatctaccatcataccaatgtaagaagactatgcgtgaggagggaggttgcttttttgaggaaatgcaatgatcctgatgagacgcagggaagggggctgtgttcacagattctaaaagaattatttataaagattagccatgtccaacctgctttcctcaatatgtcagaggtagatgctggcttttgtctgaaagtcatgaagacagggagaggctgctgctgctgggctgtggagacaggggaggagagacgtggtggagctgagaggagtgaagcatccccatcrcgtgtggtggagacacgggtttctagggatggagacgagagggcacaggaggtgcctgggcttgacctatcctgcaagcactactccaattgagctaaaaagcctcggaaaaacagttatgagaagactttacagaagagatgagtaacaagataagacattatcacaggatgtgagtcagtatcaagggggaaaacaagaactattccaaacatggacataagaaaagcaaagggaaagaggcaagaaaaaaatgctgccttcatagaacctgcaaggcgtattagggaggaatttcaa

SEQ ID NO: 184755 - DNA, 601 bp, Human
acccatcatttgaaaaacactaacaatattaaaaccaacttaaagaatgttgcatttaaaaccaacttaaatacttttaaaacatgtattcttttacctggaatagtctttgtttgtgagtcagttagtaatgcaatgctgatttattttctttataacctttgtctccggcccaacctttgtctcttctgtttctctaccctttacaaacaccctcttttaaaaatctctgttcattgtttttcttttgtattctcctgttttattaattctatttctgacacatttaacatactgactscatacagagactggtagataaccccactctctcagatctacgcatactagtgtttggttaagtttctgaatgctcctttttgcaatatgcttgtacaacaagaattttctttacttgtttgagggaagttactgtgaaggttttatttctaatgatgtgttgtaataaaatggtatcctagtgcagtcgtgaaaaataagtaaccccgattcattctcttgctgaaagtagagaggaaaacattcagagttccatctctttatatgtttaattgaatcaacctaaatgaccatcaatggt

SEQ ID NO: 184756 - DNA, 601 bp, Human
tatcttctaagataggtgtcaacaaactatagctcacaagccaaatgttgcccatagactgttttagtatggcctgtgagctaagaatggtttttatatttttaaagagttgtaaaaaaaatatgcttcagagaccatacatgatttgaaaagcctaaaacaaatttactctcttgctctttaaagaaaaaggttactaaccatttttgaaagtcagtggctttaaaacttttaaacttttggaccataagctgcagaaagaaatacattatacacccaaaccaacaccgggtcagtcagactatctatctatctatctatctatctatctatctatctatctatctacaactgatataaaagtttccaaaattagtagcccttattaccacttacattgtaccctttctttcttttcccttccctttcctatcctatgccattctttttttttttaaatgctggtcacaacttaccaaattattttaatacacaattactaaagaggctcaacccatcatttgaaaaacactaacaatattaaaaccaacttaaagaatgttgcatttaaaaccaacttaaatacttttaaaacatgtat

SEQ ID NO: 184757 - DNA, 601 bp, Human
gatacagaaagaaaaggggaaagtgaatggggaaataaaaagtggaatgcagaggataggaaagaagaaatgagtgaaagctatgagaaacagaaaaatgctaaccccaattatttaggctccacacgttctgctagcatgtttaatgacagaataaaaaaaggttggccgggagcggtggctcaagcctgtaatcccagcactttgggaagccgaggtgggcagatcacctgaggtcaggagttcaagaccagcctggccaatgtggtgaaaccccgtctctactaaaaatacaaaaatmcaaaaaaaaaaaaaaaaaagccaggcatggtggtgggcacttgtaatcccagctatttgggaggctgaggcaggagaattgcttaaagctgggaggcagaggttgcagtgagccgagactgcaccattgcactccagcctgggcaacaagaacaaaaccccatctcaaaaaaaaaaaaaaaaaaggttaagacagtttctgataatagcaaaaagttagcacttcctaatttggacatgctaaataataaatcccagatctatttttaatttaaactgatttaattttaagggcctatta

SEQ ID NO: 184758 - DNA, 601 bp, Human
ggggaaaagatacagaaagaaaaggggaaagtgaatggggaaataaaaagtggaatgcagaggataggaaagaagaaatgagtgaaagctatgagaaacagaaaaatgctaaccccaattatttaggctccacacgttctgctagcatgtttaatgacagaataaaaaaaggttggccgggagcggtggctcaagcctgtaatcccagcactttgggaagccgaggtgggcagatcacctgaggtcaggagttcaagaccagcctggccaatgtggtgaaaccccgtctctactaaaaatmcaaaaatacaaaaaaaaaaaaaaaaaagccaggcatggtggtgggcacttgtaatcccagctatttgggaggctgaggcaggagaattgcttaaagctgggaggcagaggttgcagtgagccgagactgcaccattgcactccagcctgggcaacaagaacaaaaccccatctcaaaaaaaaaaaaaaaaaaggttaagacagtttctgataatagcaaaaagttagcacttcctaatttggacatgctaaataataaatcccagatctatttttaatttaaactgatttaattttaagg

SEQ ID NO: 184759 - DNA, 601 bp, Human
actagcttggctcacaaagcctctgcatcccagctgcaactagcagttccagcttaatcccccatccggctatgctaacactcagatgtgatgaaccaccctaccgtgcctgacaaagtctttggcactgctgtttacatctactacacctagaaagttcttctttcccttttaaaaatgtttgtccatcctaaatgccccacatccttcatgttgtgtggagctccccaactggaccttttccattgggaaagcccaatgctttccctcttgccattaaatcggggcattgtttctgcakgcaactgacacttctgcagattttataagctccttcaacttaagaatcatggcttttatttatgtacatcctcatatgattagccaaatgccctgcacatagaaaacattcaataaatacatattgattgaaacctaaaacagtgaggtgctgattaaatattataagcaaaaatttactagtattagtacagattgctacgcaaggctggaaaaatgtactaaaatagaatcttgagggaaaatggaaaagatgccatttcattgagagaaacatagagaaagttactgcccattcaat

SEQ ID NO: 184760 - DNA, 601 bp, Human
cacaagcttctaaggttgagatacacaaaattgcgtgtggggatttggctgccataagtatgatgcagcttatctcacctcttagcatagcaagtgcagaactgtggaaagccctgagatgctgatttctttgagttgtgaacagtctgcctctgaagattggcttttattattttaaatgatggcattgcagatcagaaggccaaagaaataggagaagttcaacttggttattaatcagatacataaaatattctattttttcttaagaaacagccatcataagagatgtttgccatasgttggctataaggcagagacagttcctaaattcctctcagaatatctgcacaatcagatagaagaaaataaaacattcattttaataaaccttgtggacctctgggacctgttaatgcaaaaaacaaatattatgtttcaacctcatactttgcaaagctagtgtgtggctttcagaaactaaattatttatgtgaagccatatttatgtgcatataaaatgtcaatttggagtgatccgagtgttaaaaaatttatgaacaaagtaataatatggtggaatgagattaaggaagagcaa

SEQ ID NO: 184761 - DNA, 601 bp, Human
acaatattattttatttttctcctctactgttcagttctatttttggtatttgaatattttagaattcagcactgaataatggttacaaaaaaaaaaaagcctttcactaaaagatataatacaaagggtaaaacccaaaatttcaacctaaatagtagaacattacacctgacattcttcatcatgacccatttattttaagcagatgaaattctgcttcttaggcttaagacattattactcatgaagagtagtagttgcaaattaggaacttggcctgaatcctacagttttctactyacctgcataactaatggatttttgaaataatagagatattaacactaatggaatacattactactctccatttattaatacctgacatttcttctatactgtcttttctcattgaaataattctaaaggaaatagggtagagactttgtctttttagcttaaagacaaatgaccaatgaggaagcaattaaagatagaaagttcatttgtatgtggtttataattatttacctacacctatagccacaataaacagttaattagtgacaagattcctgtgataataaagcaatgcattct

SEQ ID NO: 184762 - DNA, 601 bp, Human
gctaaataaatatatgtctccccatatttgttcttctccatttttatttttcaaaaatttaaaaattgtttttgtgtgtgtgagagagggtctccctctgtcacccaggctggactgcagtggcatgatctcagctcactgcaacctctgccttccaggctccagcaattctcccacctcagctgccagaaaagctgggacaacagatgcatgccaccacactcagctaatttttgtagagagggggtttcactgcgttgccgaagatggtcttgaattcctgggctcaagcaatcctccygcttcagcctcccaaattgctgggattacaggtgtgagtcactgcacctggcctcttctccattcttaaatatatatcgatgctgttatgatttatagacacaaatttatttaacagttacactgaagttttagttcattgtgtgtagttgattattgcattttttaaaatgcagcgtagctggaccaagcttgtccaacccacagcctgtgggccacatgcggcccgggatggctttgaatgtggcccaacacgaattcacaaactttcttaaacattgtaatttttttttgcaacttt

SEQ ID NO: 184763 - DNA, 601 bp, Human
agatttcccagaggcctcctacttcccaggactttgaagctttgtcatgcacaggaattactgggagttgtccctgaatccacacatacacccagtactaggtgtatgctaaataaatatatgtctccccatatttgttcttctccatttttatttttcaaaaatttaaaaattgtttttgtgtgtgtgagagagggtctccctctgtcacccaggctggactgcagtggcatgatctcagctcactgcaacctctgccttccaggctccagcaattctcccacctcagctgccagaaaasctgggacaacagatgcatgccaccacactcagctaatttttgtagagagggggtttcactgcgttgccgaagatggtcttgaattcctgggctcaagcaatcctcctgcttcagcctcccaaattgctgggattacaggtgtgagtcactgcacctggcctcttctccattcttaaatatatatcgatgctgttatgatttatagacacaaatttatttaacagttacactgaagttttagttcattgtgtgtagttgattattgcattttttaaaatgcagcgtagctggaccaagctt

SEQ ID NO: 184764 - DNA, 601 bp, Human
tctagttcatcggcaaatgctgtcagctcgaccctcaaaatatattcacaacctgcagagtcaccatttgccaccctggtctgctctgaagaatgatccttggaaaatgtaagtcagccctcgcctacccttcgctcaagaccatccgatgacttcctatctcactcagggtcaaaatcttacagtggtctgcaagacctcacataacccaccccagcccacctctctgattttgttcttatcatcctctcctagcccacttcactacagccgtattcctggaacacacccaacccctctrcctcatggcctttcatacttgctattccttctgtcggaaacaccctctctcagtttcttatcctcattcttctctttctttcgatgtcagctgaaaactaacctcatgagagatgtattctccgatgagcctttacaaaatagtaactcttctcctatgctcttcctcccggatcatgctcaactattctccgtgataattatcaccacctgaaatgtgtttgactctctatttgtatacacagttcccatccttaccctccaactagttaattgcacttcatctgttttattcaccaca

SEQ ID NO: 184765 - DNA, 601 bp, Human
gaatctccatctcaaaaaaaaaaaaaaaaaaaagaaaaagaaaagaaaagaaattcaggttaatttgaaaaagaaaaagaaaaatgttaatggtggacatttctaagtgaagggctacagattatttgtgtttgttttctacttctcacagtcctgtttttaccttttgtaggggaaatattgttttatatttgtaaagacaggttaaatataatctgtagttacagaactttataattgcaaaaatgagactattgttttataaactaattttttactgattatgttctagatatcttgycacagcaatatagtgggatatcattatttttaataacttcatagtaaaatggtataaaagaatcatttgtttaataaattcctattagtaaggatttctgttatttctaattttatttgaattattagaagccatatcaaaataaattaccttattggattatggctttagtttgaatacccggaaatagtttttctggatcaaagattgcatactttaaaaaagacttattggtgttgtacaaatttatcctccctggggtagcatgtatgagcacaccacaaaaaccaccccaaacct

SEQ ID NO: 184766 - DNA, 601 bp, Human
cggctcactgcaaactctgcctcctgggtttaagcgattctcctgcctcagcctcccgagtagctaggattacaggcgcacgctaccacgcccagctaatttcttatttttagtagagacagggttggccaggctggtctcgaactcctgacctcaggtgatccacccgcctcggcctcccaaagtgctaggactacaggtgggagccaccacacctggccttttttaaaaaaagttctattatttgatctacagtctgaaatgtcttatttcttatatacacatacctccaattgcacaygatgcaaaataactgatttaggcacttcatttatataatcacattccctaggatccatgtctgcattatataagtccctactgatggtccctactgatgatatgtagcagtagcagactgctggactttacttaaacaattcttctgatgcccatattgatgacttcaaacaaaaggcaatgccaaaggtggcccatcctacttctgtccccacatgatctcaagatatttgagctgtagttggtaaaggaagcagattgggtaacactggaccagactaggatttcaagctccacctct

SEQ ID NO: 184767 - DNA, 601 bp, Human
ggctggactgcagtggtgtagtctcggctcactgcaaactctgcctcctgggtttaagcgattctcctgcctcagcctcccgagtagctaggattacaggcgcacgctaccacgcccagctaatttcttatttttagtagagacagggttggccaggctggtctcgaactcctgacctcaggtgatccacccgcctcggcctcccaaagtgctaggactacaggtgggagccaccacacctggccttttttaaaaaaagttctattatttgatctacagtctgaaatgtcttatttcttawatacacatacctccaattgcacacgatgcaaaataactgatttaggcacttcatttatataatcacattccctaggatccatgtctgcattatataagtccctactgatggtccctactgatgatatgtagcagtagcagactgctggactttacttaaacaattcttctgatgcccatattgatgacttcaaacaaaaggcaatgccaaaggtggcccatcctacttctgtccccacatgatctcaagatatttgagctgtagttggtaaaggaagcagattgggtaacactggaccag

SEQ ID NO: 184768 - DNA, 601 bp, Human
caagcagcttatctttttttttttgagatggactcttactctgtcacccaggctggactgcagtggtgtagtctcggctcactgcaaactctgcctcctgggtttaagcgattctcctgcctcagcctcccgagtagctaggattacaggcgcacgctaccacgcccagctaatttcttatttttagtagagacagggttggccaggctggtctcgaactcctgacctcaggtgatccacccgcctcggcctcccaaagtgctaggactacaggtgggagccaccacacctggcctttttwaaaaaaagttctattatttgatctacagtctgaaatgtcttatttcttatatacacatacctccaattgcacacgatgcaaaataactgatttaggcacttcatttatataatcacattccctaggatccatgtctgcattatataagtccctactgatggtccctactgatgatatgtagcagtagcagactgctggactttacttaaacaattcttctgatgcccatattgatgacttcaaacaaaaggcaatgccaaaggtggcccatcctacttctgtccccacatgatctcaaga

SEQ ID NO: 184769 - DNA, 601 bp, Human
gagtcctttggtgatctcaattagtgccctggcccatcagtcatgacacagttcctatggttctttggagactttgtgacactaaactatctttaactttttcctctgtcccaaattttcagttagttcctagtcgtgatgtccctttgtctctttcctcaaaaatacctcctatttgttccttctcttcatttctagtttaggacttaattatatgtcagaattactgtaatagcctcttcacttgtccccttgctctcattatctctctagtctaataagttcttcatgtgtataaacrtttggtctcaaggtatttgtttggaaagatggaaacagataagaatgcataaaacaagagattctctgtcaaataagcttgggaaatgcgcacatcatattccttcttggtggttttataatacactgtagcataaaaaaggtgctaaggagtcctgtattaaagaattctgcaaaaccttatctgtccatggaaatctttgtggaatagttatcagcatctcacaggtaaattcagtttggaaaactctctcctccattaatcttcattgaacattcctgcatcatgcttcttgcccaa

SEQ ID NO: 184770 - DNA, 601 bp, Human
ttatgatttgttagcgtgaaaatgcatgttattatatttagctggatatttccagcagcactgcctagcgacacttttatatacccattttatatatccattatcatgctgcaaaatttatattaccaagaactagatgtactacaggagctacctgagtcctttggtgatctcaattagtgccctggcccatcagtcatgacacagttcctatggttctttggagactttgtgacactaaactatctttaactttttcctctgtcccaaattttcagttagttcctagtcgtgatgtccytttgtctctttcctcaaaaatacctcctatttgttccttctcttcatttctagtttaggacttaattatatgtcagaattactgtaatagcctcttcacttgtccccttgctctcattatctctctagtctaataagttcttcatgtgtataaacatttggtctcaaggtatttgtttggaaagatggaaacagataagaatgcataaaacaagagattctctgtcaaataagcttgggaaatgcgcacatcatattccttcttggtggttttataatacactgtagcataaaaaaggtg

SEQ ID NO: 184771 - DNA, 601 bp, Human
tgaatgtatatgagataatgcacaaagggttagcacagtgccaagcacacagcaaatgccctgttcatatcagctcttctagccaagacccacagtaacactcacaaacgtgttagtccatgaaggcctggcccatacatggaaaacaactcccatggtaaataacttccatggaaatggacaaggtggattccttttacccccacctgctcactttatttttcacctatctactttattctctcacaccattctgggatacaaaacattttgctgtcctttcagatctaacagatccttkggaatatcctttggacatttattccaagcgtgaaaacaattttttttcagtggtataatttggatgttatttatactttcttgaaaattttctttttttttccttcctctctccctctctcctttttccctttcctcctttctcattctttcttccttcctttctttgttcctccctcccttccttctttccttcttttcccataagtaggactgaagacattattccagtagagttatttccatataggcaggaattctcagcatgactgtccaaggaatggtttctactatgagcttt

SEQ ID NO: 184772 - DNA, 601 bp, Human
tagttaccgttattttaacctctcaaagtctcagtttcctcatctgtagaaacaggctgcacaggagtttagcttacagactgctgaatgtatatgagataatgcacaaagggttagcacagtgccaagcacacagcaaatgccctgttcatatcagctcttctagccaagacccacagtaacactcacaaacgtgttagtccatgaaggcctggcccatacatggaaaacaactcccatggtaaataacttccatggaaatggacaaggtggattccttttacccccacctgctcacttyatttttcacctatctactttattctctcacaccattctgggatacaaaacattttgctgtcctttcagatctaacagatccttgggaatatcctttggacatttattccaagcgtgaaaacaattttttttcagtggtataatttggatgttatttatactttcttgaaaattttctttttttttccttcctctctccctctctcctttttccctttcctcctttctcattctttcttccttcctttctttgttcctccctcccttccttctttccttcttttcccataagtaggactga

SEQ ID NO: 184773 - DNA, 601 bp, Human
atatacaaagcgatccaatacataatcagttctatgtctgctgtatataaaaggcctggaaaaattcttgttcaaatcaataactttaaaattgcaactatacggccattaaatccaaaactcacacttactaaaaatcgctgactgtgccatcctcagtagtgttatttctttatccaatatgaggtatttattacaaaatatcgccaatcaaagcattaaaaaaattatcagatgaatatgtgcaacaaaatttcaaaatttaattgtcaacatgaatatattaaatatcatagaagakaactcataaggaaaatttagataaatattatccacactggaaaaatatcatgattttacatcatctccaaggagctgcattattattcatcaggtagaaaaaacaaaggttgaagaaatagaagttttaattcttagtccactcaaattaatgtttaattttgttactaaggaacatagcactgaaaatgcaggctactttgagaagattctcatgctatcctgatgtaattctatacaactctggaggcaacgtatacaattgcagattacactggaaagaagggaacctccaggattt

SEQ ID NO: 184774 - DNA, 601 bp, Human
tcagacaatcaaaatctcattggcaaccaaaccatgtttctttttctgaattcatattataaagaagcttagcatgcctcagcagctgtaaacacagactggctacatgtcatgtcctttacttctccttttttggaagagtcggatgaatgctgactgcttatcttgactagaggagtgtcaaccaggtctatgtcccaactatgtatacctacatggcgttactgacatcatttaatactattgtcacattaaaaagaaaagctgattattttattttttattttttttatttttttgrgatggagtctcacttttgtcaccaaggcttgagtgcaatggcatgatctcggctcactgcaaccttcgcctcccaggttcaagtgattctcctgcctcagcctcccaagtagttgggattacaggtgcccgccaccatgcccggctaatttttttgtatttttagtagagacggggtttcaccatgttggccaggctggtctcgagctgctgacctcaggtgatccacccgccttggccccctcaaagtgctgggattacaggcatgagccaccgtgcccggccagaaaagctgatgtta

SEQ ID NO: 184775 - DNA, 601 bp, Human
cttacaggaagacacggtgcagaaagtcttttgagaatgtgattccccttagggcatcagacaatcaaaatctcattggcaaccaaaccatgtttctttttctgaattcatattataaagaagcttagcatgcctcagcagctgtaaacacagactggctacatgtcatgtcctttacttctccttttttggaagagtcggatgaatgctgactgcttatcttgactagaggagtgtcaaccaggtctatgtcccaactatgtatacctacatggcgttactgacatcatttaatactatygtcacattaaaaagaaaagctgattattttattttttattttttttatttttttgagatggagtctcacttttgtcaccaaggcttgagtgcaatggcatgatctcggctcactgcaaccttcgcctcccaggttcaagtgattctcctgcctcagcctcccaagtagttgggattacaggtgcccgccaccatgcccggctaatttttttgtatttttagtagagacggggtttcaccatgttggccaggctggtctcgagctgctgacctcaggtgatccacccgccttggccccctc

SEQ ID NO: 184776 - DNA, 601 bp, Human
ttcatataatatatattatatataatatatattcatataatatatattcatataatatatattatatataatatatattctatataatatatattatatataatatatattcatataatatatattatatataatacctattcatataatatatattatataaatatataaacatatattcatacatatatctttcatatatatgaaaagatttattatgaggaattggctcaggtaattatggaggctgagaagttatatttacataatttctctctctctctctctctctctctctctmtatatatatatatatctcctattggttctgtttcttgagggaaccctgactaatacaatgtctttaaaggaatttgtccatctatctgggctaatttgttggcatacaactgttcatagtattctacactccattttatttccgtaaagtcagtagtaatgtcccctcttagtttctgattttggtactttgaatcttctctatttgttacttagtcagtccacctaaagtttgtcaactttgttgatcttttcaaaaagctaacttttggtttcactaattttctctatttttttctat

SEQ ID NO: 184777 - DNA, 601 bp, Human
cacatgaactttcagattagcttgtcaattttttcaaaaaggtagttggggttttggtagggattgtgttgaatgtataggtaaatttggagagtactgccatcttaacaatgctaagtctttcaatccattaacacagagtatttatttatttatatcttccttaatctctttcaaggttttattattttcagcgtaggtatcttccactacctttattaaatttattcctaaatatttaattcttttgatgctattttaaatcgaattgttttcttaatttcattttcagtttactcaytgctagagtataaaagtgaattgatttttgtatactcatcttgtatcttgaaacactgctagactaatttattatctgtaatagtatgtgtgaatttcttagaatttcctgcatacaagatcatgtcatctataaaaagaggtagttttactcttcctgttcctttccctttaaaaaatgtatatttttcttgctcaactgttgtggctaaaacctccagtacgatgttgacaaaagtgaactttctcatctcatcactgatcatagaggggaaagctttcagtctttcaccattaagta

SEQ ID NO: 184778 - DNA, 601 bp, Human
attatctatttttatatgtttgcttgtgcttttggtgtaaaatccaagaagccattgtcacaatgatttatgcctattattttcttccgggaaatgtatagttttagtttttacatttaggcctttgatccatattgagtgaatttttgtatatggtatgaggtaggggttcaacttcttttttttttttttttttttttttttttttttttttttgcaagtggatatctagtttttctagcaccatttgctgaaaagactattctttctccattgaattgttttggcaccaccttgctgraatttaattgaccataatcataagaattatttttagattctcgactctattcagttgacctgtaagtctaactttatgtcagtagcacactattattgtgggtttactgcaagttttgaaatcacgtatgtgacacctccaatttgttcttattcaagattgttttggcaatgctaaatgccttgaaatttcacatgaactttcagattagcttgtcaattttttcaaaaaggtagttggggttttggtagggattgtgttgaatgtataggtaaatttggagagtactgccatcttaac

SEQ ID NO: 184779 - DNA, 601 bp, Human
tgaaaagatatccatcttgactcataattataggaatgcaaataaaaatgacgttgagaaaccatttgttatctataagattggcaaaaaataaaaagtacgacaacatattctgttagtgagaatgggttgaagacagactctctcatatattggtgatgaaaatgcaaattcatacaaattttttgaagggtcatttagcaatatctaacaaagctacctatgtgtttacctcctgactcagcaatcccactctagaaatttatgctaaatatataccttcaacaaataagaatatatrtatatatattaatatatacacagttacccattgtatgtagttccgttagaagcatataatggttgttgaagacaatctaattgcccattcataacacagtgattgaataaacgcaaatccacatatggaagactatgcagtgttacgagaaatgaagatctctgtgaattaatagggagtgatttccaggatattctgttaaatggaaaaggcaaggtgaacaagagaatatgcagtatatttttttgtgaaagagatcaggagaaataagaaaatatacaactatctgagcatttttcc

SEQ ID NO: 184780 - DNA, 601 bp, Human
ctgtatcaaaacatcgtatgtaccccatgaatatatacacctattctgtacctataacaatttcaacaactgggttagaaaggatgtaagagaagaggatggcttcagaaatgttttagttatggtgttactgtctgtttcaaatgcaaaggatgcttaggaggaatagcagcaaacatttttgcatggggtaagtcaactggcaaggaatacaattatagaccatatactgtacttaccaataataacagtgttatcatcagcaattaacaacttgctgtggacatagataagctcagtkactaggtttccttcgagctctgcatgtgttctaagaccacagaatgatatgtaatttatccactgattaccaactgcaaatttaaaaagaaattattaaaattaatatgaccaagctcaataaacgtacattaaatcttattgtttctcaaaacatactacttagactgttcagaatagattgtatattatatgtatatgttttctatttcagaattcatccaggatttatttttgatatctgaatttcatattgtcagtctgaatggctttctctctctctctctctctctctctatat

SEQ ID NO: 184781 - DNA, 601 bp, Human
cagtttttacttcaaggcttctgaaatcttggtgaagaaatatgtggctttgtttatttttccatttcagcaaacatcaatagtttttatttcttactgtcattgtcaaatttaattccaaagtattctgagatttgcttttgaagagcaagtcagagtagctcaggagaaataaatgaaatcttgagtattagggcaaatgggggaataaataaactcctaaagagcttttatccctataggccaggagataaaagaacagtattttttaaatgtgctatacaaatattaaaagtgtgtrtgtgtgtgtgtgtgtgtgtgtgtgtgtgtgtgtgtgtatctcaccatactgtggtttacacagtttctggctatagacgaggagataaaggaacaatattattttaatgtgctatacaaatattaaaagtgtgtgtgcgtgtgtgtgtgtgtgtgtgtatgtatctcaccacactgtggtttacacagtttctggcttcagaactatgtttcttttctattcaaatcatgttccagataagacagttttattcttctcagatatgagatatgttttcttttctcagtggagaatagaaag

SEQ ID NO: 184782 - DNA, 601 bp, Human
atctgtcagtttttacttcaaggcttctgaaatcttggtgaagaaatatgtggctttgtttatttttccatttcagcaaacatcaatagtttttatttcttactgtcattgtcaaatttaattccaaagtattctgagatttgcttttgaagagcaagtcagagtagctcaggagaaataaatgaaatcttgagtattagggcaaatgggggaataaataaactcctaaagagcttttatccctataggccaggagataaaagaacagtattttttaaatgtgctatacaaatattaaaagtgtgtatgtgtgtgtgtgtgtgtgtgtgtgtgtgtgtgtgtgtatctcaccatactgtggtttacacagtttctggctatagacgaggagataaaggaacaatattattttaatgtgctatacaaatattaaaagtgtgtgtgcgtgtgtgtgtgtgtgtgtgtatgtatctcaccacactgtggtttacacagtttctggcttcagaactatgtttcttttctattcaaatcatgttccagataagacagttttattcttctcagatatgagatatgttttcttttctcagtggagaat

SEQ ID NO: 184783 - DNA, 601 bp, Human
ttaatgatttacaagctgctctacaaatgttaattattactggcattattatcagatccttgttaactctacaataactgcaccggagaatgctgccataggaaccgaccatttgatggaatgtagcatttgtttaaagaagcctcctctctggcttaatcgccccatgtgtgaactgtaggagctcaaagattgaagatcccatattgctactttaggacttttactgtgcccctggagccagcagaggccgctgtcaggcgggggctgctggattgaactgacatcactgctttgtttmgggtcaggagaacctgggatgtgagccagcctggaaagccccctccgcacacacattctcccacgcgcccccattcctctcccaccacagtgggccccgacactcccgaggtgaggaatacatttccagcattctgagctggaattattagacagagggtgtcgttcttgtattttaagggccaacatggaattacccagataactgactctccaccacattaaataagtgtgttggctgctatttaataggcatgtgaggaaagaaatgagaaaattttagatgaatgaataaattaga

SEQ ID NO: 184784 - DNA, 601 bp, Human
attttagaattagaattcctgggtcagagaatattcaaattactgcaagaaaggctgtaccaaaacatacactattaagcatgaatattttcccagttttctccaacattatcaactcacgaaaaagttcaagtctgtagatattaaaggacactcattttagttttagtctgcactttttccactgtataaaaatttttttaaaatggatctggcaccataggctttctaggattcttgacttttataacctcaaagttctgtttccacttcaaataatgtgcctccttcagactacacragaataactttttttaaaaaaagatttaagagatgtttgcacatagacattggctgctaattgagacccaaagcacaattttactgcatcaaatgtgaatgacagtacaaatgatgacagtaagtcaattattataatacctttgatttgggccagatttaagaagctgaaaattgagcagaaagagtttttctgtaactttgcttttaaattagagcaagagataagccaatgtgtccaccaaactatcaggtaagggcttgtttgtagaaaaagtatttaaataagtctaaaataggc

SEQ ID NO: 184785 - DNA, 601 bp, Human
tcccacatacttgataggctgaaataataccaagaagacctgtgctatttggaaagagcaataggaaaattggccttgtaaggctttggtttttatattaagtgaaatggagagtgtagacatcagtgcagaggagtgacagaatctgacttacatattaaaatacggctgctgtattgagaacacactctggggggcaagggttgaaacagggagcccatttaggagctactcccataatccaggtgaggtatgatggtggcttgggcctgggtggcagtggagatgaagatagagccarcaggttttactgatagagtgaatgtagggtgtgtcaaaaagtgaggcatcaaagatgactacaaggtttttgtcttgagcaactataataatgtacagctgtagtcgcctttagctgagatagggaattctgtgggtagagctggtttgtgggagatcaggaattcgattttgagcctgttgagacatctattaaagatgcaagtggcagtgctgagtaggcagtagataaatggaactggggtttgggagagaaggcttgtttagagatataaatctgagaattgtcctcatgcacatg

SEQ ID NO: 184786 - DNA, 601 bp, Human
aattctcaagcaaacaagacaagttttagaagtgatatttgaaaattataataacccttgtacttagagaaggctttaggattaaaaagcacttccaccttaatcctgtgtggtaggcgggacagatgattctcattctgtagataggaaactaaagtctcgaggcacactagtaatggagttagaactcaaactgagggcaaagcccttttcccacatacttgataggctgaaataataccaagaagacctgtgctatttggaaagagcaataggaaaattggccttgtaaggctttggyttttatattaagtgaaatggagagtgtagacatcagtgcagaggagtgacagaatctgacttacatattaaaatacggctgctgtattgagaacacactctggggggcaagggttgaaacagggagcccatttaggagctactcccataatccaggtgaggtatgatggtggcttgggcctgggtggcagtggagatgaagatagagccaacaggttttactgatagagtgaatgtagggtgtgtcaaaaagtgaggcatcaaagatgactacaaggtttttgtcttgagcaactataat

SEQ ID NO: 184787 - DNA, 601 bp, Human
tgttaacttattatggtggcgggcgcctgcagtcccagccactcgggaggctgaggcaggagaatggcgtgaacccaagaggcggagcttgcggtgagcagagatcgcaccactgcaatccagcctgggcaacagagcgagactttctctcaaaaacaaaacaaaacaaaaaaagtggcctaatagtgaagagtagcacttgcttcttgaaagtttagaaatgaaaacaagtatgttggtctttgcaatggatttcattttttatttttattgatatatcataattgtgcatatttatggrggacatatgatcttttgatacatgcacacaatgtgtgatgatcaaattagggtaattaggatatccgttaccgcaaacatttatcatttatttgtggtgggaacattccaaacattctagctgttttttctagctatacagtaaattatattggtaactatagccaccctattgtgcaattgaacagtggatcttattccttctatctaactgtatttgtgtactcattaaccaacctctcttaatccttctttccccctacccttctcagcctctggtaaccaccatccattctaccca

SEQ ID NO: 184788 - DNA, 601 bp, Human
gatctatttgttctacagggcaactgaattctaatatttctttgttgattgtctgtttgtataatctgtccaatgctgaatgacaggtcttgaagtctccagcaattattgtgttaggctctatttatttctttagctctaataatttttgccttatatatctgggtgctccagcggttgttgcatatatcttcttcacccccttcttaacttttggagttaattcatgtcgctgctacaattaaacttgataagaatcacctattgtgccagaattttcaatgctgtggctgctcaatgkttgcctttggccaactgtatggcaaaaagtctaagtgctaaagtaattatttctccttaggtttccgtcagattactatataagtaaagataatttttgctccacctttcccctttatctttttccccagtatatttgtaacaatccctactgcaaacatttgaactctggcaaaatgggtgtcttactcccaggagttaataagcataagaatccatttgggccctgttgctctagtggataaattttgtcctagcatcaaggttgttctttttaaaatagcattatggctttccacat

SEQ ID NO: 184789 - DNA, 601 bp, Human
ttggagttgaagtcagaggagagatcaaataaagccagtggtaaactttataaactctaaaatcctatacaagtttaaagtggtggtggtatgactggcactattttcgtccatataacattcccgagttctttcatccttgtaatgtgtggccccaactgactgttgacgcatgaagataagtctgtggattcctgtttttatgctttgactctgagctaaattgggtgaaagctggattcccctaactttctttaagataaaaaaaaatcttagatttcttctgtagttatttgccccyaaatgagatttttcatatcttgtggttcctaattgggtcactgaatcagtgctcgttagaacaatatgttgatatgtaaaagtaaggcaaatatgttcacaagttggtggtctgtggctcttgaaggagagaagtcagaaaagccaggttggattgaccttggaaaatgttcatgtagaaatagatttaaatattattttagcagcagcctgtcagtaaaagctttgttcattcttaatctcttaggaaaacaaaagcttccgccaataagaatggcacatttcatcagacgcatgtcta

SEQ ID NO: 184790 - DNA, 601 bp, Human
ttgaataccttgcccaaggtcttatagtcaataattttagagccaggatccgtatccaggattttatagtttcattgttcgactaagacaggaagaagtcagctactgttaatgctggtaaacaaaaagtttgaatttaaactggtaagtcagaagtgcacagaaattacagttgtttgcttttatactttcctcatttggcaggcccatcttaactgcctagatatttttaaatgtcctgttgaggaagtttgtgtttttttctaggtcatcattcaacagattattttgtctttcattratttactattaatatttacctctactctctaggctctttacatagtctagaatagtctgtttttcacaggctatctcgagcaagttgcaaaaacatacatagtctctttattggccctttctaaattcttcaaattggattttaaaaagtagattccaattacaaataggttgcatcaatatagaaataccttgacttgctcattttctcaaagtaataaggcaaatgttaaaaaaaatcatttctgcattatgcattaataaaatacagatgatgaaatggttttcctcattttctttt

SEQ ID NO: 184791 - DNA, 601 bp, Human
ggcatacagaggacaatcagacatggaaaagtgctcaacatcactgatcaccagagaaatgtaaatcaaaactgcaatgatatatcatctcaccccagttaaaatggcttatctagaaagacaggcaatagaaaattctggtgaggatgtggaggaaagggaacccccatacactgttggtgggaatgtacattagtactaccagtatggagaaatgtttgtaggttcctctaaaaactgaaaatagagataacacatgattcagcaattctactgctggatatataccccaaagaaaggraatcagtatatcaaagaggtattctgcactgccatgtttgttgtagcattcacaataggtaagatttggaagcaatctaagtgtccatcgacagatgaatgaaatgtaaagaaaatgtggtacatatgcacagtggaggactattcagtcataaaaatgagatcctgtcatttgcaacagcatggatagaactggagatcattatattaagtgaaataaatcaggcgcaataaggcaaatgccatgtgttctcatttatttgtggaatctaaaattcaaaacaattaaactcatggccat

SEQ ID NO: 184792 - DNA, 601 bp, Human
gatttcttctaggatctttatagtttgaggtcttacatctaaatatttaattcaccttgagttaaattttgtacttcatgaaaggaaggggcccagattcaatcttctgcatatgggtagccagttatcccagaaacatttattgaataggaagttctttccaattgtttatttttctcaactttgtcaaagatcagatgactgtaggtgtgcagctttatttctgggttctctattttttttttatcttagtcagtgagtctgttttagtaccagtaccatgctggtttgattattgtarccttatagtgcagtttgaagtcagataatgcgacgcttctggctttgttgtttttgcttaggatttctagggctatttgggcaatattttagtttcgtatgaattttagcatagtttttttctagttctgcgaagaatgttatttgtagtttgatagcaataacattgaatctgtagatttctttaggcagtgcggtcattttaacaatacttttcttccaaatcattagcatataaagtttttccatttgtttgtgttgtctttgatttcttttggaactgttttgtagtttttgttat

SEQ ID NO: 184793 - DNA, 601 bp, Human
gatgaatcatagggagaggctctctgcctctctcatgtactttaatcacttttattttttctcacctttatcagctgtatgccatcacaggggctttgctgacattcttctcccaaggatctgggatgtccctcacaattctggtggattcccattttccttcttgaattaaagctcacagagtttatctatatgcactatgttgttatttccaagtgcctgaggcatgctcaaatacgctgtcttgggaaaacaaaacaaaacaaaacaaaaaaaacaaaaaatcttaactatctttatygctcttcctctgacacctagaacaagtgtcaagaaaagtctcagctcaataaatagttgttaaatgagtgcttgattgaataattcttaattcttaatctttcccaaccaatggaccagtaaatctcattagttattttaataatgtctcttagagagtaaatttcctctgcatttttacaacttataacttccacttgacccttgttctttcagacctagattaaacaataatttcttaactacagtctattttcaacctatcttgcatacttctattatactaattttcctcactgtt

SEQ ID NO: 184794 - DNA, 601 bp, Human
agagttaaaaaaatactgctttaagttataccatagcttctaatcttaaatttgtgatatttgtaaaaaatcctgctgatttttaatgaagactgcataattaaagaaacctcctaagacttttcacaagtcaaaggacacccagctctctaatcattatcataaactaaattgggcaatctgagacgttttatgaaaattactcgtattttaatggattttatgcaatatcatttaaaatatattttggatttcagttctagacttgaatgctggaaaatgtattagacaaaaatatttrttagaataactgcttaaaatatgtttttaactgttaaaggaattttatattttaatactatagttttctgtttattagtttaaagccactctttttttttcattggcttgactagctcgcttccgcttttcaatttttaggatgaaaaatttcctaattgtttaacaaattactgttttttttttatttatgacttaattctttaatttcctcttgtataatatggtggtaaagatcatgggttctaaaattgtgctgtttagtttgaatctctgttctaccattttctagctgtgttct

SEQ ID NO: 184795 - DNA, 601 bp, Human
tgtggacccaccatcagtgacagatgtttaacagttattttcccagaccagcctagagagggtgaccagggaaatgcagtatttttgtgtgtgaaagtaacttgatcaagacttatttaccaactgagtgtgcagccttgaagaggcattgatgtaaacagattttagattgttaagcaacatttattaatatacattgctttgtggagattcttacaacttctttcttaagttttttttttttttttttgatatggagtctcgctctgttgccaggctggagtgcagtggcacgatctcrgctcactgcaacccttgcctctgggttcaagcgattctcctgcctcagcctccccagtagctgggactacagacgtgcgccaccacacctggctaatttttgtatttttagtaaagacggggttttatcatgttggccaggaggttctcaatctcctgacctcatggtccgcccccctcagcctcccaaagtgctgggattacaggcgtgagccaccacacccagccacaaattcttttaaaaagcaaaattgcaatcatcctatgtttgtggaaggccatttacactcttttaccctga

SEQ ID NO: 184796 - DNA, 601 bp, Human
taagaaacattttattgaattgtgcagatacagttttcttatgtttgatcccaaagtccagttcttcatttacataccttcactattatactgccctaggaagactttcctatattatggttgatgcattattctgtcattcattagttttaatagcttgaggggagggattttctctcaactctatatatctctagtttcttatgtatatttaaaatactagctaccaatccttgagtacttattatcatttattaatttgtttattctctacatatttatagaatacccgctatgggtcacagatatgatagcaggcactagataacatgatcagccatgagagagcttataattaacaatctagcttattttttgacaggcagtgcaataggcacattgcatctgttatatataattttctgtgcaacgattctgagaggtaggtattatgactctcaactaatagatgaggaatttgagactcagagaagttaatcaagttgctcagtcacacagataaatggaggatttgagattcaaatgcaagtcagtcaggttctgtattagttttctatgctgtgtaacaaatactaagtat

SEQ ID NO: 184797 - DNA, 601 bp, Human
tcaaattaagtcagagacaatcctttatagcaaaaagtgccttctctgcatccacttaattcctattagggcagaaagatgtgcataaccaaatgcataaactatgtgtttagcaggtaggtagagtgacttccccatcaagctgcccatgggagcaaatttctcattgacctatgcacagataagtgcttagcaattttaaagccttcattattccagctgtcctgcatggttctacatcgacagtaagcatcttagttcatggtaatctccttggcagcacttattgtctttgtgtgaragcaaatgatagagtcatccattcaagttaattaagagcatctgcattgcaaaactggtcactaaattgctcgccaaatttgaggcttttttcctgccaacacaaattaattttttaagtagcagcattttcaggagagaccaaataaagaaagcaacaataaagttgcctgtctagtgagatgtccccaaactatcaactttaaacatacctttgccttttatagtagttcttcacacaaactgccttaatcaaaatgcgtgtctcttgctctgtcattttatgttttgctcttagcaa

SEQ ID NO: 184798 - DNA, 601 bp, Human
aaaacagaacctctttaaggcataaatcacacaggacctataaaacaaaaatacaagcttgaaagcaaaagcaaaaaacaacaatgaaaaaatctagagtacacaggcaacaaagagcacaatgaatgcaatggtacctcacatttccatgctatcattgaatgtaaatggcttaaatgcttcacttgaaagatacagaactgcagaatggataagaactcgccaaccaactatctgctgccttcaggagactcacctaacacataaggaggcacataaagtaaaggggtggaaaaaggtrtttcatgcatatggacaccaaatgagagtggggcaactattcttataacagacaaaacaaactttaaagcaacagtggtaaaagagacaaagagggacattatataatggtgaaagaccttatccaacaggaaaatatcacaatcttaaacatatatgcacctaacactggagctttcaaatttataaaacaattactaatagacccaagaaatgagatagacagcaacacaataatagtgggggaattcaatatcccactgacagcactagacaggtcatcaacacagaaagtcaacaa

SEQ ID NO: 184799 - DNA, 601 bp, Human
tctttaaggcataaatcacacaggacctataaaacaaaaatacaagcttgaaagcaaaagcaaaaaacaacaatgaaaaaatctagagtacacaggcaacaaagagcacaatgaatgcaatggtacctcacatttccatgctatcattgaatgtaaatggcttaaatgcttcacttgaaagatacagaactgcagaatggataagaactcgccaaccaactatctgctgccttcaggagactcacctaacacataaggaggcacataaagtaaaggggtggaaaaaggtatttcatgcatrtggacaccaaatgagagtggggcaactattcttataacagacaaaacaaactttaaagcaacagtggtaaaagagacaaagagggacattatataatggtgaaagaccttatccaacaggaaaatatcacaatcttaaacatatatgcacctaacactggagctttcaaatttataaaacaattactaatagacccaagaaatgagatagacagcaacacaataatagtgggggaattcaatatcccactgacagcactagacaggtcatcaacacagaaagtcaacaaagaaacaatgg

SEQ ID NO: 184800 - DNA, 601 bp, Human
actcatggagatagagaatagaaagatggttaccagaggttgagaaaggtagtgggtgattgagaagtgggtttggttaatggcacaaaaaacagaaacaatgagtaagatctagtatttgataccaaaacatgaagactacggtcaaaaataaattaattgtatactttaagataactaataatataataattatgttgtttataatacaaacaatacatattggagttatggataccccgtttacccagatgtgattattatccattgcatgcctgtatcaaaacatgtcatatacccmataaatatatatacctactatgtacatacaaaaattcaaaataaaaaaaagaacaaaatactggctatggagcaatgttaggtccttagaggaaaaaggatttcatgttaggtcatttttgcattattatacaactgcttctccaactatgtatgctatgtttttgaggggtcttagtataaattattttttgagttatgtgtagaaattcttgaaagcttgttctataaaatgaagcaagatgcatactgtgactttaacatattcattttgacatctaaacactgttaaagcttcaaa

SEQ ID NO: 184801 - DNA, 601 bp, Human
tttagatggctctggcttttgagggcaaagtgagtggaaaaaataatggaggactggagtccgaacagaattttaatttatgttttcagtagtaataaagccttctctagattaataactgggaaagcactttgaaaagcatcaagcattatgcaaatgtgaggtattattcttttggaatttgcatagctgagagtggaattcacgtttgatgttctatgatgatgaaattacttcttggaaattggctctgaaacccagcctcagtcccagtgctgtttttctttttaactggtttaattttttttttgaacttttttatctcattgtagcttaccttggattgaaactggccacatgtaaaaccaagagcaaatggtagctccttccctacccccagcccccaataatccatctcaatgtgtttttatgctccgggaagcccgaagcacagtgtctgacatgcagaaagtgcttagtcgatgtcagccactataattaaccatctatcatctatgtaacctaaaagaaaataagtctttagtggtttaggtttatttttaatttcttactaatgtgcttattcatattaatctcatca

SEQ ID NO: 184802 - DNA, 601 bp, Human
ctaagcaacagccaccagcttgaatgaggcaaggcccccttcctgcttcattgtcttgaaaggatatgtgtggaagagacaggggtgcttttcctccagtgagaggattcacaggcaaggaaagatggaggtgtagagacacttgcaggagaaactggcagggggagtggattaaacattgcagcacattagtctttgctttaagtgttacatgtgccatccagccaggtgagatggcagcagagaacctaaaccctgagaaggtgaaatcaaatgggctgggcgcggtggctcatgcctrtaatcccagcactttgggaggccaaggcagacagatcacttgaggtcagaagttcgagaccagcctggccaacatggtgaaactccatctctactaaaaatacaaaaattagctgggcatggcagcaggtgtctgtaatcccagctacttgggaggctgaggcaggagaatcgcttcaacctgggaggcacaggctgcagtgatctgagatcatgccacttccctccagcctgggtgacaaagaaagactctgtttcaaacaaaacaaaacaaaacaaaacagaaggatgggaggatgga

SEQ ID NO: 184803 - DNA, 601 bp, Human
cccacagaccctctgaaggaagcggattgctcctgtagggcccagaagacaccccaaatactgtgagtgccccaactgcggaagtgggaaagggagaccctcctctcccaacacactcccccaatttgagtgggagaaatattcaatgaaatagatagcttaaagaaaaaacaatagaaaattcaggaaactttggacacacttttagaaatgtgaaatgctctggaaagtctcagcaatagaacaagtagaagaaggaaattcagagctcaaagacaaggtctttgaattaactgaatcyaacaaagacaaagaaaaaaaataaaaaaatatgaacaaagcctccaagaagtctgggattatgttaaatgaccaaacctaagaataattggtgttcctgaggaagaagagaattctaaaagcttgcaaaacatatttgggggaataatcaaggaaaagttccccagtctagctagagacctagacatccaaatacaagaagcacaaagaacacgtgggaaattcatcgcaaaaagatctttgcctaggcacattgtcatcaggttatccagagttgagacaaaggaaagaatcttaagag

SEQ ID NO: 184804 - DNA, 601 bp, Human
atatgcacctaaaactggagcttccaaatttacaaaacaattaaaataggcctaagaaatgtggtagacagcaacacaataatagtggcagatttcaatattccaccgacagcaccagacaggttagcaagacagaaagtcagcaaagaaacaatggatttaaactataccttggaacaaatggacctaacagatatatacagaacatttcatccaataaccgcagaatacacattctattcaacatcatatggaactttctccaagatcgaccatatgataggccataaaacaagcctcwataaatttaagaaaattgaaattgtatcaagcactctctcagaccacaacagaataaaactggaaatcatctccaaaaggaactttcaaaaccatgcaaacacatggaaattgttaaataacctgcttctgaatgagcattgggtaaaaaacaaaatcaagatggaaattaaaaaattcttctaactgaatgacaataatgacaaaacctatcaaaacctctgggatatagctaaggcagtgctaagaggaaagttcatagccctaaacacctacatcaaaaagtctgaaagagcacaaa

SEQ ID NO: 184805 - DNA, 601 bp, Human
tcaggaagcattagataccctgaacagaccaatacaagcagtgagattgaaatggtaattaaaaaattaccaacaaaaaaaagtccaggaccataaggattcacagcagaatttaccagacattcaaagaagaattggtaccaatacttttgacactattccacaagacagagaaagaaggaaccctccctaactcattctatgaagccagtatcaccccaataccaaaactaggaaaggacacaaccaaaaaagaaaactacagaccaatatccttgatgaacatagatactaaaattctttttttttttttttttctgagacagagtcttgctctgtcgcccaggctggagtgcagtggcgcgatctcggctcactgcaagctctgcctcccgggttcatgccattctcctgcctcagcctccggagtagctggcactacaggtgcccgccaccacgctggctaattttttgtattttttttagtagagatggggtttcaccatgttagccaggattatcttgatctcctgacctcgtggtccacccacctcggcctcccaaagtgctgggatttcaggcgtgagccaacacgcctggc

SEQ ID NO: 184806 - DNA, 601 bp, Human
acttttgacactattccacaagacagagaaagaaggaaccctccctaactcattctatgaagccagtatcaccccaataccaaaactaggaaaggacacaaccaaaaaagaaaactacagaccaatatccttgatgaacatagatactaaaattctttttttttttttttttctgagacagagtcttgctctgtcgcccaggctggagtgcagtggcgcgatctcggctcactgcaagctctgcctcccgggttcatgccattctcctgcctcagcctccggagtagctggcactacaggygcccgccaccacgctggctaattttttgtattttttttagtagagatggggtttcaccatgttagccaggattatcttgatctcctgacctcgtggtccacccacctcggcctcccaaagtgctgggatttcaggcgtgagccaacacgcctggccaatactaaaattcttaatgaaatactagctaaccaaatccaacaacatatcaaaaagataatccaccatgatcaagttggtttcataacagagatgaagggatggtttaacatacaaaagtcaataaatgtgatacgccacata

SEQ ID NO: 184807 - DNA, 601 bp, Human
tctcttggccttcacagttccatacagatctaaattctcttgcccatgtgacccactccctttcctgaaagcttgctgtgttttcagtttgtgtcaatttgccatgcactgttccagttgttgaagatggactgtttttgtatcctttcttatcctgtagagcagacaccatgccatgtacttaatgcacacttattaattattaggtgtatgcgtgaatttggaaaaaagacaaaaaaaatctttcatttaaaaagacactgttttaaactaggcacagtacactttgatcgttttcccraaaccgcgttggacaccatttttccatgatgatcatttgatttaaaccgaccagtgtgtggctgagctctgtgaactggggcatcaggggatcagggctgcaccaccagggctggagatggagctggggatagagactgtattagctggaagtacatggagcacatgctaagacgattaacacacaagataacacattttaaaaactaattttttcccatataaaatggtttaaaattcttacttctggaggagatttgatggacaagaaatgagttgtacgagttgaacgttgctcgag

SEQ ID NO: 184808 - DNA, 601 bp, Human
ttgaagatggactgtttttgtatcctttcttatcctgtagagcagacaccatgccatgtacttaatgcacacttattaattattaggtgtatgcgtgaatttggaaaaaagacaaaaaaaatctttcatttaaaaagacactgttttaaactaggcacagtacactttgatcgttttcccgaaaccgcgttggacaccatttttccatgatgatcatttgatttaaaccgaccagtgtgtggctgagctctgtgaactggggcatcaggggatcagggctgcaccaccagggctggagatggagctggggatagagactgtattagctggaagtacatggagcacatgctaagacgattaacacacaagataacacattttaaaaactaattttttcccatataaaatggtttaaaattcttacttctggaggagatttgatggacaagaaatgagttgtacgagttgaacgttgctcgaggcaaccgtaagtcctagcgtatttaatctttcaagcaacacctaaggactggcagctgggttcctgtggggaggataaagattgctttattctttaagatccagtgtaaagaaatagccc

SEQ ID NO: 184809 - DNA, 601 bp, Human
agttgaacgttgctcgaggcaaccgtaagtcctagcgtatttaatctttcaagcaacacctaaggactggcagctgggttcctgtggggaggataaagattgctttattctttaagatccagtgtaaagaaatagcccagatagcaatagtggatttctttctgggatggggttgtgggtgatttcttttcccttcttttagtctttctgcatcttttgtatttctttaatgagtgtgaatatttagcaaaaaagagaaattttactaaaaagagtgggaaactgctcccttctagtggtraaggggaaagcagtttcatgctttaggcgtgaggtttcaggactgtagtctaattatttcttccagtggagtagaatgtctgaaaggatttggagtaacagggctgatgaagcggcaaggaaggtgagtagctatctaggcaagtatgtgaacacagcctggaagggcttgtagtaccaagctgctcttaaagctcaggtaccaagacccagaggtacataatcaattcgacatcaaaaataggaattcaggctgggtgtggtggcttatgcccaaaatcccagggctttgggagggcaa

SEQ ID NO: 184810 - DNA, 601 bp, Human
aagatccagtgtaaagaaatagcccagatagcaatagtggatttctttctgggatggggttgtgggtgatttcttttcccttcttttagtctttctgcatcttttgtatttctttaatgagtgtgaatatttagcaaaaaagagaaattttactaaaaagagtgggaaactgctcccttctagtggtgaaggggaaagcagtttcatgctttaggcgtgaggtttcaggactgtagtctaattatttcttccagtggagtagaatgtctgaaaggatttggagtaacagggctgatgaagyggcaaggaaggtgagtagctatctaggcaagtatgtgaacacagcctggaagggcttgtagtaccaagctgctcttaaagctcaggtaccaagacccagaggtacataatcaattcgacatcaaaaataggaattcaggctgggtgtggtggcttatgcccaaaatcccagggctttgggagggcaaagtgggaggatcacttgagcccaggagtttgagaccagcctgggcaacaaagagagaccctgcttctaccaaaaaaaaaaaaaaaaaaacaaatcaaaaattagccaggtgtg

SEQ ID NO: 184811 - DNA, 601 bp, Human
tttcttccagtggagtagaatgtctgaaaggatttggagtaacagggctgatgaagcggcaaggaaggtgagtagctatctaggcaagtatgtgaacacagcctggaagggcttgtagtaccaagctgctcttaaagctcaggtaccaagacccagaggtacataatcaattcgacatcaaaaataggaattcaggctgggtgtggtggcttatgcccaaaatcccagggctttgggagggcaaagtgggaggatcacttgagcccaggagtttgagaccagcctgggcaacaaagagagwccctgcttctaccaaaaaaaaaaaaaaaaaaacaaatcaaaaattagccaggtgtggtggtgcgagtctgtaatctcagctacttgggaggctgaggtcggaggatctcttgagcccaggaggttgaggatacaatgagctgtgattgcaccactacactcgcactccagcctgggtgacagggcaagatcctgtctgtagtcccagctacttgggaggctgaggcaggagaatcacttgaacccgggaggcagaggttgcaatgagccgagatcacaccactgcactccagcctgggca

SEQ ID NO: 184812 - DNA, 601 bp, Human
tttggagtaacagggctgatgaagcggcaaggaaggtgagtagctatctaggcaagtatgtgaacacagcctggaagggcttgtagtaccaagctgctcttaaagctcaggtaccaagacccagaggtacataatcaattcgacatcaaaaataggaattcaggctgggtgtggtggcttatgcccaaaatcccagggctttgggagggcaaagtgggaggatcacttgagcccaggagtttgagaccagcctgggcaacaaagagagaccctgcttctaccaaaaaaaaaaaaaaaaaamcaaatcaaaaattagccaggtgtggtggtgcgagtctgtaatctcagctacttgggaggctgaggtcggaggatctcttgagcccaggaggttgaggatacaatgagctgtgattgcaccactacactcgcactccagcctgggtgacagggcaagatcctgtctgtagtcccagctacttgggaggctgaggcaggagaatcacttgaacccgggaggcagaggttgcaatgagccgagatcacaccactgcactccagcctgggcaacaagagtgaaactctgtctcaaaaaaaaaaa

SEQ ID NO: 184813 - DNA, 601 bp, Human
gggtgacagggcaagatcctgtctgtagtcccagctacttgggaggctgaggcaggagaatcacttgaacccgggaggcagaggttgcaatgagccgagatcacaccactgcactccagcctgggcaacaagagtgaaactctgtctcaaaaaaaaaaaaaaaaaagagatttcagatagagagtgagttagtgttctgatcaagtctcattctaagaccagtttaaattgaaatgtgattggtgattattaagatttaagactatcacagattattaagacttaagtttaccactatgcstggaagttcctttcccagagagtttcttctacatgtaagaactggactctaattctagacccacatctactccagactatatttagaaggcaccattgggatggaatatgggagccaagatgagaaatctgaagaggaagaagccatgtaggtattccctggcacaatgggaggtgagctccggaaaaggcatcccgcctccagcatgtggggactgaagatcaatttgcccaccatttcccaacttcggttcctaaaagtgtttaggaaattaagtctaaatcaagcccttcttggaga

SEQ ID NO: 184814 - DNA, 601 bp, Human
agacccacatctactccagactatatttagaaggcaccattgggatggaatatgggagccaagatgagaaatctgaagaggaagaagccatgtaggtattccctggcacaatgggaggtgagctccggaaaaggcatcccgcctccagcatgtggggactgaagatcaatttgcccaccatttcccaacttcggttcctaaaagtgtttaggaaattaagtctaaatcaagcccttcttggagattcatagaatatcaaaggccctgaaaggttctttaataaagaaacctgttcagcttyatttaacccagtgttttcgcagcgtctttgctaaagtactgctgcatatggccgtggtgggttgggcaactagacccgctgagatggtcccttgaaaacggcggtcggatgcattggtagctgcacaaccagtggaaatggaggggccacaaaacggaggaataagacattcaaattgcccctttgcaagctctgaggttccagggttgacgtattgtttccttcagggcacagaaaatatggagtctagcgaacagaagcagggcccatgcgtaggggtggtccaggtttacaccaaag

SEQ ID NO: 184815 - DNA, 601 bp, Human
ccagtgttttcgcagcgtctttgctaaagtactgctgcatatggccgtggtgggttgggcaactagacccgctgagatggtcccttgaaaacggcggtcggatgcattggtagctgcacaaccagtggaaatggaggggccacaaaacggaggaataagacattcaaattgcccctttgcaagctctgaggttccagggttgacgtattgtttccttcagggcacagaaaatatggagtctagcgaacagaagcagggcccatgcgtaggggtggtccaggtttacaccaaagaaaatgartactactcacagctgtctggcaaggtggcaagagagcgcctcggaggtcgtgagtgtccctcaccatccataggaatgccacaaaagcccttgctgccaggcatgagcagctggtacagaaggccaccgagtgccttcccgatctggactccgtgacttctatgcccactggcgctcttgcatgggtcagtctgtgctgccgctcaggaaaagcaagtcaggtgccataccagcgacccaatggcggctgctgcttcttctgcctgggcacctcatcatccccagcagtagttcctaggt

SEQ ID NO: 184816 - DNA, 601 bp, Human
gagcgcctcggaggtcgtgagtgtccctcaccatccataggaatgccacaaaagcccttgctgccaggcatgagcagctggtacagaaggccaccgagtgccttcccgatctggactccgtgacttctatgcccactggcgctcttgcatgggtcagtctgtgctgccgctcaggaaaagcaagtcaggtgccataccagcgacccaatggcggctgctgcttcttctgcctgggcacctcatcatccccagcagtagttcctaggtgtgagcgtggcaaggagcccagaaatacagaagsagcgtttaggggcctcacggtagcttcatgcctgactcttttctctcctcttccggcctggcctctaggcctttctggatcgccagccagtcagactctacttcgagaagcagaaggtcttgggctgggtcttgaaatgcagggaagaattgacttggcagaggagaggaaagagaaaatttcaggtggggaagtaccccaggcaaagacaacattagtgtttgtaacatttgctggaacaaaacattaggagtgtgaataatggacacagtttagaaatacattttaaaggcatggata

SEQ ID NO: 184817 - DNA, 601 bp, Human
accccaggcaaagacaacattagtgtttgtaacatttgctggaacaaaacattaggagtgtgaataatggacacagtttagaaatacattttaaaggcatggataattttcagtgcctccaagcatctagagagggatacatctatttcccttttttttttttttatctttttgtatttttgtctaggatatgatgggtacttcgatttaataactcagtgatgagcttggagataaaattgagcctgctgtgaaaactaggtctgtggcttccttgaggaccatttctacagaatattattttttttgttttctctctcttaaatggttatacacaatatccctatccttctcctcactttattgattttccagaatgagagtacgaggtatgactataaagtaacgtgactgattattttagcatacactccaatacttatacagccaaatgaattttatgaccttcggaggcattttcctgataggctaaacccttactgcagatatgccactatcagaaaacacattcttagcactttttgtgggaatggcacttggtgcttagatgtggtcctttgaaagccctcaacgcaacaca

SEQ ID NO: 184818 - DNA, 601 bp, Human
cctccaagcatctagagagggatacatctatttcccttttttttttttttatctttttgtatttttgtctaggatatgatgggtacttcgatttaataactcagtgatgagcttggagataaaattgagcctgctgtgaaaactaggtctgtggcttccttgaggaccatttctacagaatattattttttttgttttctctctcttaaatggttatacacaatatccctatccttctcctcactttattgattttccagaatgagagtacgaggtatgactataaagtaacgtgactgaytattttagcatacactccaatacttatacagccaaatgaattttatgaccttcggaggcattttcctgataggctaaacccttactgcagatatgccactatcagaaaacacattcttagcactttttgtgggaatggcacttggtgcttagatgtggtcctttgaaagccctcaacgcaacacatctttgtggagaatagattgattttttttaaaaaacagtccatattttggcaaatagatgattaaacagagtaatattatttgcaattttaaaaatgtgattataaaacaataca

SEQ ID NO: 184819 - DNA, 601 bp, Human
ttatttatttatttatttatttatttagagatggagtctcactctgtcatccaggctggagtgcagtggcatagtctcagctcactgcaacctccgcctcccgggttcaagtgattctcctgcctcagcctcctgagtagctggggctacaggtgcgtgccaccacacccagctaatttttgtatctttagtagaggtggggtttcatcatgttggccagtctggtctcgaactcctgacctcaggtgatccgcccacctcggcctcacaaagtgctgggattacaggcatgagccacagygcccggcccactttattttatagcttatgcatgtgacctatcttcttggcttgactgtaagtccctaagaggagggcccacatcttaagccagtgagtgccctctacatagtagctgctcagtaaatgctaatgatcatgattatgcctctggtaaccgagatagcagcactgtttccaaatgattactgtgacaatgtgtgtgtgtgtgtgcatgcctgtgtatggaagagggtagaatcagtctccccctaattgcacactagtggtagtgtgttcttagcacctggcagaatgcctt

SEQ ID NO: 184820 - DNA, 601 bp, Human
ctgtttccaaatgattactgtgacaatgtgtgtgtgtgtgtgcatgcctgtgtatggaagagggtagaatcagtctccccctaattgcacactagtggtagtgtgttcttagcacctggcagaatgccttgcacaaggcttattgaaaagggaaataaatcttgattcatgcaatcgtcgaatgctgaaggttttctaggctgtgagctggttctacctcattggtgtgctatggataacattcccatgaattcagatagatagaggaattgccccatttgaaattgaagagcaagactgyaaaaggaggggatgatggaatgcaggacccagccacttagaatacgtggtacatgggggtatatagagcactcaaagtctgagtggggtatcctgacaccagactaggggacaggaggcatccaacccccagcagaggcattgaagaacagacactttctccttcactgttctattgagcacaaatccccacagtttgaagcaatggtatctcaactcttccctaccatccactgttgatgtgatttttccccatagatcctatgttctgttgtcccagcaacaatgtatatttaagtaa

SEQ ID NO: 184821 - DNA, 601 bp, Human
tgttcctggcctggctcctgaagccccctctgacctggtcccctgcccctctgcaggtttaactcccctcgcttctcacctggtgcctggctcccaggtgctcacagctcctcccacacaccatgcagttcagtgccaatttctttccttctacttgcatgtccttcccccttcatttgggtgagaacttctccaggagcctcttctgcatctcctaggttcttgccccaatgtacctggtaccttccctctctctcatcacttacctggctccccaagggcaggattggtccttcctcakctttagctgagcactcagcattgtgccaggggcactcaacacacttctgttgagtaataggcacgcagttacttgttgaaccaaactgcgttagaagagatgatctataggattttgtgtggcatatgcattgttctttgccgctatgggtatcatcatagagaatttccattaatttctggccgtgtgccactgcaaccagctttcaccctgacttgtcatataacaaaatatcattaaattgaactctagtttttttttttttttttttagacagggtcttactctgttgcccaggct

SEQ ID NO: 184822 - DNA, 601 bp, Human
tctcatcacttacctggctccccaagggcaggattggtccttcctcatctttagctgagcactcagcattgtgccaggggcactcaacacacttctgttgagtaataggcacgcagttacttgttgaaccaaactgcgttagaagagatgatctataggattttgtgtggcatatgcattgttctttgccgctatgggtatcatcatagagaatttccattaatttctggccgtgtgccactgcaaccagctttcaccctgacttgtcatataacaaaatatcattaaattgaactctagtttttttttttttttttttagacagggtcttactctgttgcccaggctggagtacagtggcacaatcacagctcactgcagcctcaacctccccaggctcggggaattctcccaccccagccccatgagtagctgggactacaagcgagcactaccaccccaggctattttttgtatttttttgtagagacggggtttctccatgttgcccaggctgggaactctggatcttaataaaatatttttttctttagaagtcaggctaggctgggctgtgggttgaagttcatctctgtgctat

SEQ ID NO: 184823 - DNA, 601 bp, Human
ctttgcttcattggttgacatttgccttgcccttggacttgagaacttgaagtatcaatgaggcatagcacatcagtaaataagccccgctaagccatactctattctcgcctgttgaccagatcttttgtttcctgctcactctcatccaagcccttacccacatcattttcaatgatggtgtcactgcaaatgtttctttgcaggttcaattctctcctatcataaaacaaacaactgagccagccaactaaccaaccaaccaaccaaccaaccaatcaaccaaccaactcactaaccrcctcttctttgactccaccccaggcaccactccacttatccttctcttcccagcctagtgacttgaaagaggactttgtatttgctcactttctcacctcctatttacccccgacccctgcaataaggtctctgttccattctctactgaaacggctttcttcaaggccaccattaagtctctagtacctaaactgaattaacagtttctaatccttctctttctttggcactttgcaatatttgttgtttgtttgtttgtttgttttgaaataggatcttgctctgtcacccatgctga

SEQ ID NO: 184824 - DNA, 601 bp, Human
aaaaaaaacaacaggccaggcatgatggcttacacctataattcttttgggaggctcactttgggaggctgaggtaggaggatcacttgagcacaggaattctcgagaccagcctgggcaatataggaagtctccgtctctacagaaaatacaacaattagccaggtgcggtgacatgcatctgtggtcccagctactcaagaggctggggtgagaggatcagttgagcccaggatgtggatgttgtagtgagccaagatcgcaccactgcacttccaacagcaaagaccctgttcccccmaaaaaaacacaaaaaacaaaaaacaacaaaaaaaaaacaacccaccaaaaaacagaaacaacagatagtgatgcagaattttcccactgagacactgacatggtgggtcatggtgatcttgcttatgaagtgataacctagcttcaagagtgttgaagcagggtccagagctcagtgtaggggccaggttggtcctgggccgaacctggggacgtacctaggaatttctagccaaataagcaatagagggaagggtctgactgatgacggagcatgagcacactctaggaagggcaaaga

SEQ ID NO: 184825 - DNA, 601 bp, Human
agaggatcagttgagcccaggatgtggatgttgtagtgagccaagatcgcaccactgcacttccaacagcaaagaccctgttcccccaaaaaaaacacaaaaaacaaaaaacaacaaaaaaaaaacaacccaccaaaaaacagaaacaacagatagtgatgcagaattttcccactgagacactgacatggtgggtcatggtgatcttgcttatgaagtgataacctagcttcaagagtgttgaagcagggtccagagctcagtgtaggggccaggttggtcctgggccgaacctggggaygtacctaggaatttctagccaaataagcaatagagggaagggtctgactgatgacggagcatgagcacactctaggaagggcaaagaattgatctgggggatgggatggggcggggccctaagatttcaactccaccctggaaaagcaggacttaggggaggcatgtctgaagttcagaagaccaggggaaacctgaatgcagaaagcgcagcttgttcaccatgtcctgaaatacagcaaccaggggacactcttgtagattgtgagctgtattgcttaggacaaattcattgttctat

SEQ ID NO: 184826 - DNA, 601 bp, Human
caaattcatgtccattaaaacctctgaatgtgacctgatttggaaatagggtctttacagcggtaatcaagttaagatgaggtcctactggatgacggtggtccctaatccagtgactggcatccttataagaagagtgaaatttggatgctgagatggacagagggaggacgacatgtagatatagtcacacaggcgagaacactgtgatgaccaaggcggagattagagggatgcatctacaagccaaagaccatggattgccagcaactaccaggagatggacagaggcaaggaaggrgctcccttcgtgtcttcagagggagcatggccctgctgatgtcttgacctcagaattctgaactccagaatgatgagaggataatttctgttgttttaagccacccggtttgtggcaatttgttagagaagccctgggtaactagtctggtctccttgctcccgttggtcttactgagccaaagcatcccattggccttactgagccaaagcatcccattgcatcatgtttgttactgtaaccctcaaatctttttcttgacctaactcttagcaagtttagccactggcctttgatcat

SEQ ID NO: 184827 - DNA, 601 bp, Human
gggaggacgacatgtagatatagtcacacaggcgagaacactgtgatgaccaaggcggagattagagggatgcatctacaagccaaagaccatggattgccagcaactaccaggagatggacagaggcaaggaaggagctcccttcgtgtcttcagagggagcatggccctgctgatgtcttgacctcagaattctgaactccagaatgatgagaggataatttctgttgttttaagccacccggtttgtggcaatttgttagagaagccctgggtaactagtctggtctccttgctcccrttggtcttactgagccaaagcatcccattggccttactgagccaaagcatcccattgcatcatgtttgttactgtaaccctcaaatctttttcttgacctaactcttagcaagtttagccactggcctttgatcatctcttagctgcaataatcttcacttgacagacaagccagaggcctggctggaggctcaggcccttcattcagacagctcaggaggcctggactgtggctgggccagttcctgtggccgggctctaagtctcagtttccccatctgtataatgcacacaacaggg

SEQ ID NO: 184828 - DNA, 601 bp, Human
tggtagagattacaggacatgatgtttataaagtgtgtttataattttattttgtgggtcagtacaatgcctgacccatagcaagtgcttaataataaatgttagctattattaaacatacagttttctgaaatctttaaatccatttttatccaccccagggtgaagtttccctgatttttcttttccagtaaaagcatggcagatcctatctactctcttagtgatgcacaatgacatctgggctagtgcctgacacagagtaggcactaaatatatttttatggaataaagaatggamcaactacattgtttcaatatctaatcaaaggaggaaatagcttacagattttatgaggcttagtaaccagcttgatacactcaaggtgaaactttggaaaaggatgtaatttcaccacatttgttcacaatagggcacaggtgatgtggtagacagcctccaagagggccctctggatccttgccctggaattcacacccttgcatagctccctcccccattgtaccagggtcagttagcatgaccagtggaatacagcagaggtgatggtgttatcacttccaagattagattattgga

SEQ ID NO: 184829 - DNA, 601 bp, Human
agctcatgtgtgggaagcactcagccgggctcctggctcacaggaagcatcctgtaactgtttccttttattacgcaggatccagaggcaggggcagccccagctgacccctctgggctctaatttaactatctgttggggttcaccggaggcagatgtccctctttcaccacaagtctcaggggttctttaaggacttcataaaaacaaaggattaactgcagatgactaagcccacatgatggaaacagaatcaggtacagtaaataatgaacgtagacaggattagattcctacaaayaatacattgtgttctcctgctcttcattggcaatcatccccagtagggaatcagtggaactctttgagtggccaaggaaaacatctccatgtgcccaggatagcctgggtgggctcctggaggaggcaacccttgagcagaaagccgaagagcaatctggcctttgcaaatggagaaagagtggatgcatcagcagagaggagagtgggctgggacaagggtgagagaaggaagcaagcacctaggcccaaaatttaagaaggccctcactctcagggttgtacaagagcaggggtggca

SEQ ID NO: 184830 - DNA, 601 bp, Human
agcctcccaagtaggtgggtctacaggcacacaccaccacacctggcaatttttaaaaattttttttgtagaggtggggtcttgctatgttgcccaggctggtctcgaactcttggcctcaagcaattctcctgccttggccccccaaaacactgggattatgggtgtgagctaccacgcctggccttgggctgaattttcttgggggtgggatgggcattttaaagcactcttgagaaagtagaacacactccattttaaggcagtttctttgcagtgcttcttcgtacacatcaacccyatgctcactctgccccatggcctccaggtgacccatctgttccaaggcagcagcctttccagtgccttcacctgctatggtgccacaacatggctctcgtttattgtgccagctttgacacctctgttctcagtttaatgatttttctggggatgggtccttcttggagggtcctgctttgtttttgtttttttccagattaactttgggggacataataagtggagaccatttatcgttttttaaggctcaacaaatatccaatagtcagacagaagagtgatcaaaatagaaagcatg

SEQ ID NO: 184831 - DNA, 601 bp, Human
gttccaaggcagcagcctttccagtgccttcacctgctatggtgccacaacatggctctcgtttattgtgccagctttgacacctctgttctcagtttaatgatttttctggggatgggtccttcttggagggtcctgctttgtttttgtttttttccagattaactttgggggacataataagtggagaccatttatcgttttttaaggctcaacaaatatccaatagtcagacagaagagtgatcaaaatagaaagcatgtatttaaactgggactgacaggtgacaggggatgcctcwtagccacaatgatcataatgtaaatgcttaattaactgtttgtcagtagccattgaatgtctgtctggtccactaggctgtaagtgccacagagcaagggcatgtaggcatggtccctgcagcatcctggtacccggaactcagcactcccccagcaccatgcttggtatctgctctctggccatggttttgaactatcagctgagcccaagcaaccttgcagaccacattttgattatgtcttcctcggaccatccttgagagtcacgtcttcttggcagtgtcccatagactgtgaat

SEQ ID NO: 184832 - DNA, 601 bp, Human
aactgggactgacaggtgacaggggatgcctcttagccacaatgatcataatgtaaatgcttaattaactgtttgtcagtagccattgaatgtctgtctggtccactaggctgtaagtgccacagagcaagggcatgtaggcatggtccctgcagcatcctggtacccggaactcagcactcccccagcaccatgcttggtatctgctctctggccatggttttgaactatcagctgagcccaagcaaccttgcagaccacattttgattatgtcttcctcggaccatccttgagagtcaygtcttcttggcagtgtcccatagactgtgaatggtgagtgagatcactttagaaggtacacggactttaaaaatctttcattataaagcatttatttattttttaatttttaattttaattttttattttgagaaggagttttgctctcgttgcccaggctggagtgcaatggcgtgatcttggctcaccacaacctccccctcctgggttcaagtgactcacctgcctcagcctcctgagtagctgggattacaggcatgcgccagaattaaccatgcccggttaattttgtattttta

SEQ ID NO: 184833 - DNA, 601 bp, Human
ggacaacagaggaagactctgtctcaaaaacaacaacaacaaaactaaagaatatgtattcttggctgtttcagtggtagggctaccaaagcctggttcagtgctgcccaaggcagaggctgggtactgggtgagctctcggctggccttcccccaccccaccccctgcaactgtaccatgtactgttcagttctgtagaaacaggaagctcagggtaactcacagtccccaccccagacacttcttcttttcaggcacacttcaaaataaaatcaggatctacatacactataagttggygtggtagctgaatattggccccctaaaatgtcgatgtcctagcctctggaacttgtgaatgcaaccttagatggcagaactgattttgaagatgtgattaagttgaagatcatgaaaggggttaagtattctggattgtttgggtgggccctaaatgtaatcatgaggtccttataaaaaggacacaggagttgtcagagcgagagaaggcagtgtgaggactggaagcagaactggaaggttatgaccatgacccagggagacaagaaggggacaccccctgccatctccagaaggaac

SEQ ID NO: 184834 - DNA, 601 bp, Human
ggttttaactctgactcaattgcttagcagcaccttgggtacattatttacctctctaagcttttatttcctaatcagtaatataagaatggtatttatttctatccttatgtgattgttggagggcttgtacaagacagtatataaaaagtactaagcatagtgcctgagacacaggaaactaaaaactattgtaaattataataatagtaatgattgtgtaactcttgtatgtcaatatacatgtataatatatttttcttgtgcagtgacaaagttattgtcaggctaatgactgcartgactatgtctttgtggtacctacattattggtgaaagaactgaacaccagccagatatttatgtatttattgagtagtcttctattttttttccagaggggtaaagattataagcggttccttaggcaacaaattataatggctgtcattcactaaatcttgtatatagggtgggacagaattgaaaaaacaataggaaggtcttgtaactccaacatatctgttctcctgaggtttgcatgtgtacatcttatagcacattgatattcagaagtttcctattggaatgcaactatcag

SEQ ID NO: 184835 - DNA, 601 bp, Human
tactcacactaatgaagaggagtgttggtatgactaatccttggcgttcacgtgtggctcttgagtgtggtttgtaatcacacttgaacatggacctaaatgtgacgtactgggaattcattcaaacctattaatggagccatacggtggaaatcttaggataacttgggatagaggacatcctgccttcccgttctgccctggttctcccttgtgaccactttaaaaatcgactcatttggccaggtgtggtggcttatgcctttaatcccagcactttgggaggccaaggcaggaggaycgcttgaggccaggagttaagaccaacctggacaatatagggagaccctgtctctacaaagaatctgaaatactagttgggagtggtggcacatacctgtagtcccagctacttgggaagctgaggcaggagaatcacttgagcccaggagttttaggctgcagtgagcctccactgcactccagcctgggtgacagaaataaataaagaaataaatagcacattgctcagaataatgcaaaccagcacttaagctgtgtttcctttccctgaatatttgagtatttttattttaagtac

SEQ ID NO: 184836 - DNA, 601 bp, Human
gcctgggtgacagaaataaataaagaaataaatagcacattgctcagaataatgcaaaccagcacttaagctgtgtttcctttccctgaatatttgagtatttttattttaagtactccttattgactgcaggtgggaaagatcaaagagtatagcaaatactctgtcctttgaaaaagagtgattcttatagcagtaatagtttgagtttcaatacacacagaaagctagattgtactgatagtctccatgtttttccttgcccttaaattgtgatttggctgatctctgcgtgatgctwaacaaccagtttgactcattaattttgctgaactaactgaacttttgacctaattggctgctggttagggatcagagccatatgtgcaggtttttctaagccagttctgactttagctgtgttatccctctgttcctataaactgttgaaataccatagtaattccaatgttttgacagccacactgcacttctcagactgccgctttctcctgggaagtggcacagaaatctgtcggaccacgcttcctgatttttggttaagaaaatatgcttcccatatggttgcgggccgagaaaa

SEQ ID NO: 184837 - DNA, 601 bp, Human
tctattgctttttaaaggttctcattccagctctttctttcaaacagtctcattctgcagctgagttggcaatgacttggagactgtctcatatgcctctgagacacagcactgactcagaatgacagtgccttcaccagaatcagaaaaagtcctgactgagtttgaattctaggaaccacttttcttgagtgtttcttgtacagatatccaaagtagagcctttgggtatttaaaaataatttgtaaatgccaaattaagagtttaaagggcactgtatgaactagttgtgtgtgtgtaagagagagagagagagagagaaggagagagagagagagaatgacagagaaaaagagagagagagaaaaggagagagaaagagacagagaaagagatagaaagagatagagagagatagaagagggggagagagagagagagaggagagagagaggtggagcgaattggtttccttgacaacaggatatccaatcaactttttcctccaactttaactgagttaacacaatttatccttttcatttcaagaaaacctaaatcatagagaatgatttcaaatgaggttatagagatcaagat

SEQ ID NO: 184838 - DNA, 601 bp, Human
tgcatattaaagaaagtagccttttatatgccttaaatagtttctcctctttatcattgtctttgactttgcttatcatatatttcttccaatcagaaaacatttgtttttgtgttgttgactttaattgattttaacagtgtctacattttgcatcttactcagaaaggttttctccaccaaggatattttttcataaactttcatttttctagtttctttaaattttatttttaaaatatagaatgtttgatatatcaggaatttatttggaagatggagttagggacacacccttttyccccccctccaggagggtagagttccatctggaaattcatccttttccaaatgatttgaaatgtcacttttatcatttattaattcctaggtgtatttctgatttctctattctgttgtactgcttaatcacaagccagggctgcactgaatatcctcgtttggatgtcacgtttgtagcttcttgtacctagctgcagtagggtgttctaagaacatctttgtaagtatcaaagcctgaagcaatctatctcccagggaaccttaggtcccatactgaaaaaaaaaatcaatttagcaa

SEQ ID NO: 184839 - DNA, 601 bp, Human
aaagaaagtagccttttatatgccttaaatagtttctcctctttatcattgtctttgactttgcttatcatatatttcttccaatcagaaaacatttgtttttgtgttgttgactttaattgattttaacagtgtctacattttgcatcttactcagaaaggttttctccaccaaggatattttttcataaactttcatttttctagtttctttaaattttatttttaaaatatagaatgtttgatatatcaggaatttatttggaagatggagttagggacacaccctttttcccccccyccaggagggtagagttccatctggaaattcatccttttccaaatgatttgaaatgtcacttttatcatttattaattcctaggtgtatttctgatttctctattctgttgtactgcttaatcacaagccagggctgcactgaatatcctcgtttggatgtcacgtttgtagcttcttgtacctagctgcagtagggtgttctaagaacatctttgtaagtatcaaagcctgaagcaatctatctcccagggaaccttaggtcccatactgaaaaaaaaaatcaatttagcaaataaataa

SEQ ID NO: 184840 - DNA, 601 bp, Human
atctcgttataccaaatagtgtattgctacaaagcttccatgctttcttatgatttaagaccaccttctttcccagtcttgatccaaagacccttctgaagtttacctaattttctggacttctaacttcttctttcagcccatttattttataccagttcatttccccccatcctctttctataacagcatatgggtgatggttgctgcatattttaatgactactgctatctaagtctttgtgacccaccctcataaagatcaagaacctgtattaattccctcttctttgggtagaarcatccaacagggcatgatagcttacagtagaaatctgcagttaaaatcccagcttcaactttctttctctctactgcttgttaccttaatggatttaggccaatcacttcccctctccagctttagttctcttagatgtaaaatgtgggatttggactaggtcggtgattttgacactgtttaatcatgaacctcagtaaataatatattaaccacattgttatctaatacacacacatacatttgaaataaaagttttacagaagaacaccttattcacagtataagaaccactttgat

SEQ ID NO: 184841 - DNA, 601 bp, Human
ttttgacactgtttaatcatgaacctcagtaaataatatattaaccacattgttatctaatacacacacatacatttgaaataaaagttttacagaagaacaccttattcacagtataagaaccactttgatctattctattgtattgtattctatctgtaaaaaataaaacatttacaagttggtcacagcccattaaattgatttcatgaccactagtgagtcaaaatcagcaatttgagaagcaaagggccagatgatatctgaagtcctttccagttgtaaactggatgactacaarccaatgagacagcccctatcagtgtgcatcagaaaattgttagaggccattgtgtttgcctctttgtggtttaagattctgagaaacctctgtcaaagtcagtaaaagcccaccgttcacagctgaaaccgaactccagtggaagcacttctcctgcagagaccagctcccgcacctgactgtgggcccaggctgggcacctcccacccagtagcaccttcttgttctttaaaatcacaagttcaactattattgaaattatttccaagccttaactcggaatcatgctaagaagctaac

SEQ ID NO: 184842 - DNA, 601 bp, Human
aatcagcaatttgagaagcaaagggccagatgatatctgaagtcctttccagttgtaaactggatgactacaagccaatgagacagcccctatcagtgtgcatcagaaaattgttagaggccattgtgtttgcctctttgtggtttaagattctgagaaacctctgtcaaagtcagtaaaagcccaccgttcacagctgaaaccgaactccagtggaagcacttctcctgcagagaccagctcccgcacctgactgtgggcccaggctgggcacctcccacccagtagcaccttcttgttytttaaaatcacaagttcaactattattgaaattatttccaagccttaactcggaatcatgctaagaagctaacacaaatatattaattgaccatttaagacatctctctgtaagatttttgcattgggtgtaaatatctaagtaattcatgtggatatcttctcccaggtaggtgtggccagctgattacttattcccagggagctggagcagcaggaaggaatggcctggaaactggaaataatcccatttgccggggtaagctagctgtggaaaactgaccaggctgtgggtaccgag

SEQ ID NO: 184843 - DNA, 601 bp, Human
aactccagtggaagcacttctcctgcagagaccagctcccgcacctgactgtgggcccaggctgggcacctcccacccagtagcaccttcttgttctttaaaatcacaagttcaactattattgaaattatttccaagccttaactcggaatcatgctaagaagctaacacaaatatattaattgaccatttaagacatctctctgtaagatttttgcattgggtgtaaatatctaagtaattcatgtggatatcttctcccaggtaggtgtggccagctgattacttattcccagggagytggagcagcaggaaggaatggcctggaaactggaaataatcccatttgccggggtaagctagctgtggaaaactgaccaggctgtgggtaccgagagagcagcttcctgctaaacttcctgctgtgggtgaagggcagcgtttaaagagtaagatggtgctccccattccagcaaacactggccacagtggacagtccaggagagagctgtgcaccaggaaggtgtcagctggacagtagtcaagcgtccagtaaagcagcgatgaggaggctgtcagtggacaccagggccccactagt

SEQ ID NO: 184844 - DNA, 601 bp, Human
cagtagtcaagcgtccagtaaagcagcgatgaggaggctgtcagtggacaccagggccccactagtgggtggttcaggaacctgagaagcccccggccctgagaaaggagtctaggtagtacagcagggtctcagcggtgagggctctgaggatgaaccaggaattgacattcagttctaagattcacagcatcatgtgaggcccaggaccagaagccagacctaatctccgatatcagtcagggtggacaggtccatcatggttggaacagatccatgctggagaggcaccgagtctcaygatgtgtggctggaggttgttcctgcttctggggccagggctgggcctgcagatgagggacagagcacctggctagaaaggagagaggactgcagcggctggagcgtcagccacagatttttaattttgctttccttgatattcacatccaaaatctaccatggagaactgtatatcacgttcaaggtggaagggaactaactcattcctcattagtaactatcaaatatggcatcagtaccttctttatcctgtaagtgacagctctgcacagatgtgttcccaatcgatagaatgtct

SEQ ID NO: 184845 - DNA, 601 bp, Human
aaagaagaaagacaagccatctttgatttcaaaatttaaaagaaattattactaaatttgaagaagcaatgagttcccaattcacttagagcttaaagttcctctttcatcactattttgtgagcagaggaactttttccaaacaagttcttagaaatccttgcttgattaaaaaccagttctaaatcttgttactcacatagggcaaaaggtaaaggaatctaaatgtctaaaaccaaattaactccagatactagtgtgaactttcaagcaaaaaaagtcacacaccaccgcatacacstttgaaattctactaaattttgaatgtttgacgttagcctttaaactggaacatattcttctttcttccttaggatctttaaatcttttaaagtttgggttgtttactatgcattctaattactcctgatcactcttatgtgtaacatttctatagctatgcacacaaagtaattccttagcaaggccccaccaagttttatgatgcctgcttgcctagggcagataatataaacttaactacgaaaataagttctttgattattcttcgtatctcaagaccgtgctcctaacaacctct

SEQ ID NO: 184846 - DNA, 601 bp, Human
ctacgaaaataagttctttgattattcttcgtatctcaagaccgtgctcctaacaacctctcctccatctcaccctcaagctgcaagaattttgcaacccactctatgaagtttttccaccctgagtaaggctgtcagtttattggcctatttataaaggtctgactctctgacatgttctccaggctccccacattaaccactaaggaggcactctttgcagatgaatttttttttttttttttttttttttggcctcggcttaaagaggaacctattaacctttgcccggaatctatgsctggtgaatggcttgtcatagcatgttagtttgatgaggcaattgtggtcttttttgttaaaacaccccccagcacctcttgatactacttggcctactggagatgtgggcatccaggattgaatcaaaactactgcacttcacaacagagctactgcaggaaggaaatccaggtactccctggcttgtgccacctccatcttttccgtggctaatgtaatgcctagtgcatattcaccacaaagaggcaactgttgaatggctcttccatttgcctttgaagattgcttgtaactcttc

SEQ ID NO: 184847 - DNA, 601 bp, Human
tgttaaaacaccccccagcacctcttgatactacttggcctactggagatgtgggcatccaggattgaatcaaaactactgcacttcacaacagagctactgcaggaaggaaatccaggtactccctggcttgtgccacctccatcttttccgtggctaatgtaatgcctagtgcatattcaccacaaagaggcaactgttgaatggctcttccatttgcctttgaagattgcttgtaactcttcaagttcacttcttcatctcactgccagaccacagcttgagactgatgattgacatkgccactaggttcttcccaaagactccagcctaaagattgttagctgcttcccccaaaggcttagccttctctgctagagttttggttctttggagcatcccatgagcaagaagcctcagctctttgtcctcctctgtgtaggagcccacaaggatgctttatctccaatctggaatggacacttagcatcctgagttctgccctgctcaaaatccatacctgttcatgagtaccagggcttcagggcccgagaacccacagctaacacccataggagaaaggtttcatatgagtaggtgg

SEQ ID NO: 184848 - DNA, 601 bp, Human
caactgttgaatggctcttccatttgcctttgaagattgcttgtaactcttcaagttcacttcttcatctcactgccagaccacagcttgagactgatgattgacatggccactaggttcttcccaaagactccagcctaaagattgttagctgcttcccccaaaggcttagccttctctgctagagttttggttctttggagcatcccatgagcaagaagcctcagctctttgtcctcctctgtgtaggagcccacaaggatgctttatctccaatctggaatggacacttagcatcctkagttctgccctgctcaaaatccatacctgttcatgagtaccagggcttcagggcccgagaacccacagctaacacccataggagaaaggtttcatatgagtaggtgggatgggttttcatgcctctacaacctggccagcaggaggaacactgtgacccatggtttcagaattgatggtctcccacttctcggttagatctaggtattgagaataacctgaaggacatttggctggaggacattatttttattgtgttaaaatatgcatcacacaaaatgtactctcctatttttcattg

SEQ ID NO: 184849 - DNA, 601 bp, Human
attaaacattaactctcccttccctcctcccccaggccctgacaaccaccattttaccttctgtctctacaaatttgactactctaagtacctcaataaagtggaatcatatggtatttttccttttgtaactggtttatttcacttaatataatatcctcaaggttaatccatgttgtagcacatgggagaactactgcctttttaaggctgagtaatattccattgtaagcctattctgccttttgtttattcgtttgtttgtagatggcggagtgtgttacttccagcattgagctamtgtgaataatgttacttgaatatggatgtggaaatacctctttgagaccctgcttttagttcttttgggtatatatgcagaggtggaattgccagatcacagagtaaatctatttttagctctttgaagaccgtcatactgttttccatagtgaccataccatttcacctttggaggacatcttatagcaatgctttgttgtccccttttcaccacgattatgtggccattacttcttgttttcaaaccttgagagtgagctcaggttaaatttacacttccctttgtgccctggatccc

SEQ ID NO: 184850 - DNA, 601 bp, Human
atcacagggcatacactcctgcttcatgactgttcatgacatattgaattcccctcttgtaccccacagtctctgcactgagtgtgtgctcattgggaaaggttagctcacattatacctatccaaaaaaggagaggtggcaggtggcctgtggagaagagtgtatccaggcacatatgcatgggagaaagttcagaggttttggctgagatagaaagaagaagagtagaggccaaatgtgtgctaggaaaatgtgatgtttggggcacaagtagagaggacaaccttggcagtggcagaygagagagaacctcaggactggtgctaaggaggtgggttatttaaagaaagttgtgcaggtatagagtggagaaggggtgcagggggaggatggaattgagttaaaaaaaaaaactagcaaaaaacattctgatagcacaggtgagagagataagagtgatttagattatcagaaatggaaggaaaagaaggagaattttatagagaaagtgtcctgtagtggccgggtgtggtgactcgtgcctgtaattctagcacattgggaggccgaggtggggagattgcttgagcccaggagttt

SEQ ID NO: 184851 - DNA, 601 bp, Human
tagctcacattatacctatccaaaaaaggagaggtggcaggtggcctgtggagaagagtgtatccaggcacatatgcatgggagaaagttcagaggttttggctgagatagaaagaagaagagtagaggccaaatgtgtgctaggaaaatgtgatgtttggggcacaagtagagaggacaaccttggcagtggcagatgagagagaacctcaggactggtgctaaggaggtgggttatttaaagaaagttgtgcaggtatagagtggagaaggggtgcagggggaggatggaattgagttaaaaaaaaaaactagcaaaaaacattctgatagcacaggtgagagagataagagtgatttagattatcagaaatggaaggaaaagaaggagaattttatagagaaagtgtcctgtagtggccgggtgtggtgactcgtgcctgtaattctagcacattgggaggccgaggtggggagattgcttgagcccaggagtttgagacagcctgggcaatatagtgaaaccacatctctacaaaaaataccaaaattagctgggtgtggtggcatgtgcgcctgttgtcccaagtactttggaggc

SEQ ID NO: 184852 - DNA, 601 bp, Human
ccatagactgggtggcttatgaataacagaaatttatttctcatagttgtggggactgggaagtccaagatcaaggaaccaacagattcattgtctggtgagggctcactttctggttcatagatggtgccttctcactgcaccctcccgtggtggaagaggtgaaagagctccctagggcctcctttataagagcactaatcctgttcaagagggctctgccctcatgacccatttgtcccccaaagaccccaccttctaatactgtcatctgggggtttaagatttcaacatatgaatytgttggggggatggatacaaacattcagaccatggcagagctgctaaggagacattgggtgcaaggtgacttaggaatgaagcactcagaggatcaggaagctgcattaggaaggagagaggaatgggagctccagggtaggcctggaatccggaatctccacctcccaccctccaacaatcgaatggggtgtttcccgcagtgtgtccttgagaccatcgtttccactgacagtaataattgttacatggggaatagcaaaaggaacacaggtctcttcagtgtagaaagactccgaac

SEQ ID NO: 184853 - DNA, 601 bp, Human
gcattttactcctaaagaattccccataaaagacaaccattaatagaaatagtttacttcaccattgtgaattatcaacattacaaccagtaattactaattacctccattttgagttgatgttttgggggatgtttttatcctgcagtgctatggagaggctgggaacgcactgctgcctgtgttgcttgtttatttatttccttttattcccagtgttctctcattccccttcccatccccaatagtcaaccattccaattgtgtttaatgtgtttttttttcacatgttcttgcaaaytgtgcattatcatttcgtggatattatccttagtttatgccaatagtactgccgtagatctcattctattccttagttttttcatttagcactgtgctttcaaggtccagcacagagttcccattgagtctgctgcttcccatggctgcctgacatgccacggatgcctgtacctacttcacctgtccactgtcccaggaggagatacccagtggccctcagcaagcaaccctgcagtgggcatccttttatgggacctctacggacctgtgggagaactctatgggctatccatcttgc

SEQ ID NO: 184854 - DNA, 601 bp, Human
ctggtagaatgcaaacttcacgagggtagggacttgctctcttgtttgtgctgctatttccagtgcctagaatggtgactgacacataatagatgctcagtaaatatctgttgcgtgaacagaagaatcatctctaagtacatgtctttcatgtcagatttgtctccaaggaaacttcaaacaggaaggtcttgctatttggctaatttgggtaatggtactattttactggagacaaataaaaggaattagggggagagtctcatattaaaatagagggttggataaggggagtttatamtctttccccatcagtggcttttatgctctatcaattcagtagttagcccatcaaagtaaaaaattgaattacactgtgtaaggccaccttgggatccaaaagataaaagagaagataagggacatgttctcctgatacactagctgggctccactcacccaagtcattaattggagtcttattgggctactgcctcatatcctactcccgaagagctgatacctcccataacctcattcttagggtcagctggccgtaccagaaagagcactggattaggagccagatctgggttctggt

SEQ ID NO: 184855 - DNA, 601 bp, Human
atctctaagtacatgtctttcatgtcagatttgtctccaaggaaacttcaaacaggaaggtcttgctatttggctaatttgggtaatggtactattttactggagacaaataaaaggaattagggggagagtctcatattaaaatagagggttggataaggggagtttatactctttccccatcagtggcttttatgctctatcaattcagtagttagcccatcaaagtaaaaaattgaattacactgtgtaaggccaccttgggatccaaaagataaaagagaagataagggacatgttytcctgatacactagctgggctccactcacccaagtcattaattggagtcttattgggctactgcctcatatcctactcccgaagagctgatacctcccataacctcattcttagggtcagctggccgtaccagaaagagcactggattaggagccagatctgggttctggtcttagctcagctatccctactgatgggactagaatgaatgagtcatttatcattttcttccctttaaaaaatacttgaggccaggctcagtggctcaccgctgtaatcccagcactttgggaggccgag

SEQ ID NO: 184856 - DNA, 601 bp, Human
ggtactattttactggagacaaataaaaggaattagggggagagtctcatattaaaatagagggttggataaggggagtttatactctttccccatcagtggcttttatgctctatcaattcagtagttagcccatcaaagtaaaaaattgaattacactgtgtaaggccaccttgggatccaaaagataaaagagaagataagggacatgttctcctgatacactagctgggctccactcacccaagtcattaattggagtcttattgggctactgcctcatatcctactcccgaagagytgatacctcccataacctcattcttagggtcagctggccgtaccagaaagagcactggattaggagccagatctgggttctggtcttagctcagctatccctactgatgggactagaatgaatgagtcatttatcattttcttccctttaaaaaatacttgaggccaggctcagtggctcaccgctgtaatcccagcactttgggaggccgaggcgggtggatcatgaggtcaggagttcgagaccagcctgaccaacatggcgaaaccccgtctgtactaaaaaaatacaaaaattagc

SEQ ID NO: 184857 - DNA, 601 bp, Human
cactcacccaagtcattaattggagtcttattgggctactgcctcatatcctactcccgaagagctgatacctcccataacctcattcttagggtcagctggccgtaccagaaagagcactggattaggagccagatctgggttctggtcttagctcagctatccctactgatgggactagaatgaatgagtcatttatcattttcttccctttaaaaaatacttgaggccaggctcagtggctcaccgctgtaatcccagcactttgggaggccgaggcgggtggatcatgaggtcaggmgttcgagaccagcctgaccaacatggcgaaaccccgtctgtactaaaaaaatacaaaaattagcctagtatggtgccgcgcacctgtaatcccagctactcaggaggctgaggcaggagaatagcttgaacctgggaggcggaggttgcagtgagctgagatcatgccactgcactccagcctgggcgacagagtgagactctgtctcagaaacaaaacaaacaacaacaacaacaacaaaacaaaacaaacaaaaaaacttgagcacctacctatctcacaggtctgacatgagactca

SEQ ID NO: 184858 - DNA, 601 bp, Human
taggacaaaatgccacctctctgtgttcctactcagcccggccactggatgtgggctttaccaggaagggggtgaccccagtgacatggatctcagcagctgaggctggccctgaaggagctaacagctggaggctccctgctgaccacagtctcggctgctggacagcaagtccttcccagaagggggatctggacgacatgtcttgatgtcatcacatcatgggaactctagttcaaatgaagtttttggcagaatcaccaggttgaagtgggaggtgatctgagggttctgtatgctsagcttccccacagaggactctttgccccgctagacctgagactggctggggccagccacaaaggcaggcccatggctgatggagccaacagggcacctctgcagggggcacctctccagggtggtaggagtgaaatagagcaggccccaagttttagaaaatgaccaggggctgggtgaattttggaagcaagataaatgtggataaagagaaaaaaggattctgaggtttcaagtctggcttcagagttgaaagctccttctgccaggaggagtaatagggaagccaagaggataaaat

SEQ ID NO: 184859 - DNA, 601 bp, Human
ggggtgaccccagtgacatggatctcagcagctgaggctggccctgaaggagctaacagctggaggctccctgctgaccacagtctcggctgctggacagcaagtccttcccagaagggggatctggacgacatgtcttgatgtcatcacatcatgggaactctagttcaaatgaagtttttggcagaatcaccaggttgaagtgggaggtgatctgagggttctgtatgctgagcttccccacagaggactctttgccccgctagacctgagactggctggggccagccacaaaggcagscccatggctgatggagccaacagggcacctctgcagggggcacctctccagggtggtaggagtgaaatagagcaggccccaagttttagaaaatgaccaggggctgggtgaattttggaagcaagataaatgtggataaagagaaaaaaggattctgaggtttcaagtctggcttcagagttgaaagctccttctgccaggaggagtaatagggaagccaagaggataaaatgatttcccagtcctggaaaggcagcttaaaaccatccttccacttgctcttaagggtgaggcgctctg

SEQ ID NO: 184860 - DNA, 601 bp, Human
ttgcttcaaatgatggagaaccactagagatttatagggaatagaacgacacagtcagcttctgttttacaaaggtgattggccttggcgggagggttggtttggagacagagagcttcactgggagctcctcagtggtccaggcgagagagacagggcctgaagccagttggcattagacgttggagctggaatacagcacactgcgttgacatcatggaattcccactgcatgcttaacaccataatgaacactagacatcaaagataagaagacaagatgtgtttccaccactcacaracgagcagaaagacagtcaggaaaaaaattacaattactagagaaccactaggagtcaaccaggcaagaaaagaggagccgttccaggcaaggcagggggaacagcatgtgcaaaggcatgggagtgagagatcatggagggtttcagtcggtatgatcaggattggctcttggcggtggggtggggagggggaccgggggcaggcaggcggggggaataaggaggcacaaggccaaagaacaaggcagggagcagggtgtgaaggacatcatgtgccacatgctaaagacttggcaaac

SEQ ID NO: 184861 - DNA, 601 bp, Human
atgggcagatgttgcctgaccctgctcagagtgacagacaggagccctgggaaagcaactccagactccatggcctatgactgtgtcactggctcctcaagaaaactctccctggtagctgagtctgctctgtcattcagctgactcaagcctcttgctctaatgacagacgggagagctgacccaaaagggaaagacactccatgagccaagcagggacagagccccaggactctggggaccctgctttctccatggcaccctgtggaccatccagccccggaggagcgcctgtgagtcraatgcccaggtactcccagcactggacttctccttaactttctctgaactttctggaagttgagcatctcagacactcacaactgtgatctgcagtagcgtctacccctttcctcactgagcctcctgccgcttccacatggacattccatggcaaaggtcagacttgagggtaggacagcagctaccctgttagcatcctcagcctgctgggaaataaaactgtcacggagacaagaagttctcagatgcttggcatttagcagttgtcagaggagctgaaagccctcatcagttctac

SEQ ID NO: 184862 - DNA, 601 bp, Human
agttctcagatgcttggcatttagcagttgtcagaggagctgaaagccctcatcagttctacctgaaaatcagaagtttcccaacgtgcatggcttttttttttttttttttttttttttttttttgagacagagtcttgctcttgtcacccaggctggaaagcaatggcgcaatttttgtacttttagtagagacggggtttcgccatgttggccaggctggtctcaaaatcctgacctcaggtgatccgcaagtgctgggattacaggcgtgagccactacgcccggcctgtgcatgcstttctgttccttctgctgatgtggggggtgttgggctcctgtcaggggcctcctgatgccccgttggggcacttcctcgctcagcttcctcgtccctgacaaagtggcagcagcagggtgtggcccatggaaggtgaccatgaccagcattttcattaaactttactgttcggacaaactattctcatctgacctcataacggtctctttaatcataggaacagtttcaagaaggttgatttgctcaaggtgatacagctgttaaattacaggacaaagccttgagcccaagttcctaag

SEQ ID NO: 184863 - DNA, 601 bp, Human
ctttgtcagatatatagattgtgaagattttctcctactctgcgggttgtctgttgactctgttgactgttccttttaccgtacaaaagctctttactttaattaggtcccagctatttatctttgtttttgttgcatttgcttttgggttcttggtcacgaaatccttgtctaaaccaatgtctagaaaggtttttctaatattatcttctagaatttttatagtttcaggtcttaggtttaagtctttaatccatcttgagtgaatttttgtatgagagatgaagatccagtttattcycctacatgtggctagccaattatcccagcatcgtttattgaaagggtgtcctttccctacttcatgtttttgtttgctttgtcgaagatcagttggttgtaagtatttgagtttatttctgggttctctattctcttccattggtctatatgcctgtttttataccagtatcatgctgttttggtagctatggccttatagtatagtttgaaatcagatagtgagatacctccagatttgttctttttgcttagtcttgctttggctatgcaggctcttttttggttccatatgcatttt

SEQ ID NO: 184864 - DNA, 601 bp, Human
ctaagtatttttatttttttgcagctattgtaaaaggggttgagttcttgatttgattctctgcttggtcattgttggtgtatagaagagctactgattggtgtacattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcc

SEQ ID NO: 184865 - DNA, 601 bp, Human
tatttttatttttttgcagctattgtaaaaggggttgagttcttgatttgattctctgcttggtcattgttggtgtatagaagagctactgattggtgtacattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcctttat

SEQ ID NO: 184866 - DNA, 601 bp, Human
tttttatttttttgcagctattgtaaaaggggttgagttcttgatttgattctctgcttggtcattgttggtgtatagaagagctactgattggtgtacattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcctttatta

SEQ ID NO: 184867 - DNA, 601 bp, Human
ttatttttttgcagctattgtaaaaggggttgagttcttgatttgattctctgcttggtcattgttggtgtatagaagagctactgattggtgtacattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcctttattacat

SEQ ID NO: 184868 - DNA, 601 bp, Human
tttttttgcagctattgtaaaaggggttgagttcttgatttgattctctgcttggtcattgttggtgtatagaagagctactgattggtgtacattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcctttattacattaa

SEQ ID NO: 184869 - DNA, 601 bp, Human
cagctattgtaaaaggggttgagttcttgatttgattctctgcttggtcattgttggtgtatagaagagctactgattggtgtacattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcctttattacattaaggtatgtc

SEQ ID NO: 184870 - DNA, 601 bp, Human
gctattgtaaaaggggttgagttcttgatttgattctctgcttggtcattgttggtgtatagaagagctactgattggtgtacattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcctttattacattaaggtatgtccc

SEQ ID NO: 184871 - DNA, 601 bp, Human
cattaatcttgtatctggaaactttgctgaattttttttatcagttccaggacctttctggaggagtccttagggttttcaaggtaaacgattgtattgtcagcagtgacagtttgacttcctctttagcgatacggatgctctcctttctttcttccttccttccttcattccctccctccctacctttctttctctttctctctttctctctttctctctttctttctttctttctttctttctttctttctttctttctttctttctttctttctttctttctttctctctctctctctctctttctctttctccctctctctctctctctctttctttctcttgtctgattgttctggctaggacttccagtactatgttgaagaggagtggtgggagtgggcatccttgtcttgttccagttccgagagggaatgctttcagcttttccccattcagtattatgttggctgtgtgtttgttatagatggcctttattacattaaggtatgtcccttgtatgccgattttgctgagagttttaatcataaggggatgctagattttgttgaatactttttctgcatctattgagatt

SEQ ID NO: 184872 - DNA, 601 bp, Human
gaaaaacctacccttcctgcattgaattgcttttgtatctttgtcaaaattatcagttgagcatatatatgtgggtctacttctgggttctctattttgtcccattgatctatgtgtttgtctttctgccaataccacacagtcttgacgactacagccaagttttgggatctcgtagactgattcctcccactttattcttttttcaaaattgatttagttattttaagttctttgcctttccatataagttttggaataagtttgtctacacctacaaatattcttgctgagactttgrttggaattgcattaaactgatatgccagttttgggagaattgatatttttacattgtggagtcttccaatccatgaacatgatatgtttctccacttagttcttcttttatttctttcatcaacattgtaaatggcaatgtgctttcatttggtttacacatgttcattgttagcatgtagaaatgctattgacttttttttgtatgttgatctggaatcctgcaaccttgctgaactcacttattagttctaagattgtttttaaattttttagtagtttctctgtagatatcatgtca

SEQ ID NO: 184873 - DNA, 601 bp, Human
ttttatatagtgctagatttgatttgttgaagatttttgtgtttaaggtcatgagagatactggtctatacttttcttgtagtatctttggctggttttggtatcagagtaaacctgtcctcataaattgagttgtgaagtgttccctcctcttttatcttctggaagatattgtaaaattagtgttaattcttcttttaatatttggtagaattcttcattgagaattctacattagagaattgtactctctaagtacattgagtaccacatcatagggtggtgtaatttttgcttcaamcatcaagtatgatttaagagactccaaggtatcctggcctggagatgtgtttttcaggaaattttaaattatgaattcaaataaaaaatatgaataattaaattttgaaatttaattaaaattattagtagttttgtggttgtaagattattcagattgcccacttcatcttgattgagctttaatagtttgtaattttcatagaattggtcaatttctttctagtttttaaatatattagtctaaagttgtttgtagtagacccttatccttttagtagctgcagtgtttgtagtgata

SEQ ID NO: 184874 - DNA, 601 bp, Human
tggaccttttagcctccttacttttaaaatataattgtcttaagtatatcttctaagtgcattgagtaccacatcatatggtggtgaaatttttgcttcaaccatcaagaatgatttaagagactcctgagaaggatagtctattatttttatccatttcattgtcctttcctttctgaagttccaaactttcttctgttatcatctccctttcctttctgtttggagaacatccttcagccattctttaagggtaaatatgtgagtgacaaaatctcttagttttccttcatcagagaaygccattatttccacttttctcctgaaggatactttcaccaaatagatgacttgtgattgacagctatttcctttcagcacttgaaaaatgtgccacttccttctggcttccatggttcctgataaaaaaaacctgctgtcctttgaactggtgttccctatagataatacattatttctctctggctgttttcaagatgtttttctttcttttttagttttcagaagtttaactatgaggtatcttggcatggatttccttgggttcatctgagttgagattcactcagcttcttgaata

SEQ ID NO: 184875 - DNA, 601 bp, Human
acgctgtctcaaaaaaattaaataaataaataaaagaaataaagaatgaaaaaatggcagatatcagtgctaaccattttccaaaaatagggagataggcattctagcagagaagaccagtaacctttacgttgattcttggaaaaagtctaaagtgaattaataaacatgtttgtgagaactcagagaatcaccttgccaaccatttttggggggttccaattagacctcacttttcattcttttagggaagtacgtattcattcttttgttgattatgtggcaaactttttcatacctrccatatgccaggcactgtgtaggtgctgactgtaaagagacagtgtccctcgaggaactctcggtttagtgagggaggcagacaaggaaagggaccagcacaatgcagtgtggtgagtgctcctgaggtggggagcccaggccaccaggatgcagacagaggaaagcttattgggtgtgaggtgcttggggctgagtcttaaagaaattagagaaagtccccctgcctgtgttccgaactaggtgagccatccagagtgtgtccttgtcatcgcaagagcttatgagatgagtacaatta

SEQ ID NO: 184876 - DNA, 601 bp, Human
gacctcacttttcattcttttagggaagtacgtattcattcttttgttgattatgtggcaaactttttcatacctaccatatgccaggcactgtgtaggtgctgactgtaaagagacagtgtccctcgaggaactctcggtttagtgagggaggcagacaaggaaagggaccagcacaatgcagtgtggtgagtgctcctgaggtggggagcccaggccaccaggatgcagacagaggaaagcttattgggtgtgaggtgcttggggctgagtcttaaagaaattagagaaagtccccctscctgtgttccgaactaggtgagccatccagagtgtgtccttgtcatcgcaagagcttatgagatgagtacaattatcatctctattttatagacaaagaaactaaggttcagagaggctaaatgatcaaccctggtaacatggcttaacacgaggaagagcagggattcatgtgccatctctcaacttaagtctagagctctttttactgccaaagctgtgacagctgcctcagtgacatttcaggatgtcaaggttgagtggagtaattggccactcacccaaaatttgctcatcttct

SEQ ID NO: 184877 - DNA, 601 bp, Human
tcccattttccctcttctaagccatagctcagtagtatggtgaaatgtctttgattttagtttaaagaaatgaaatcagattccagatttgctacctcttattagttgtgtggccttcagacaatcctttaacctcctgattctcaatttcctcctgtgtaaaatacattagactagctaatccctaaggtctgtttggtgcccagttcacgtgaccgttggcagccacagggagccacggagtcccaccagcgtcccatagagccacttggagcttcaggtacaaggaacaagcccctcktaggccccctcaggaaaatttattctcgcagccaagcatgtcaagtgcaatatcaggaacacccttgtccttcttgaacactgcttctggccagaaactctgctgagatctgttggagagtttcctgcaaagataagagttaacaagcccccagattcccttccccgctcaggaggggccctcactgtcagctttggggctgatagaagcacagttccaagcgcctggcttcctcctcctccccagtggataaaatgctggaactccgtcaggcaggactgccataattagaagaggccc

SEQ ID NO: 184878 - DNA, 601 bp, Human
ctgcttctggccagaaactctgctgagatctgttggagagtttcctgcaaagataagagttaacaagcccccagattcccttccccgctcaggaggggccctcactgtcagctttggggctgatagaagcacagttccaagcgcctggcttcctcctcctccccagtggataaaatgctggaactccgtcaggcaggactgccataattagaagaggcccctttccagcagctgaagctgactaggcagatagagcccaaatttgtttttagccaccacatgcccctgagctgacccctcragctgtggacacatctcacaacctcacccggaggccattctctcaggccagtcacactctcccacagagagagcgaagatgatgtcaaatctatggccaccttctaccagcagagggaatgaatgaaaactgacatgtagaagagtaagaccactactgttttcatttttggtattttttttttacattttaatttttttatactctatttttagtaaaagggacacctttactatttcaaaccaccaaaatataagccctatttggttcaaatctttgtacagccagatagcaatagat

SEQ ID NO: 184879 - DNA, 601 bp, Human
ggagggtcagagactgtggtcttgacacattctgtgtggggttcatccacatcttcctaaatgcccaaggcatggctatttgaagcagagcaagtaaagacaacgaggggtccctctgctgggttttctgtccccctctggctgccagcactaatctagcctttgaagaggggcagaaggggcaaagttaaaccacactttcctctcttacctgttgtcacccctctaatgacttttcactttctctgctcaccttctccttcctgcctcttttagaaatgggaaacaaagggcccatagrccctaaaaggggccaccctttgaaggaggagacatgaccacaaatgtcaccctttgatatcctaatgggatccatgttaaaaaaggaagtttttaacctggtctcagaggacacttgcaagagatgccaaggaaggcagtgtgatcatcccaagtcaagcagcctaacgtgagcctgtgagagagaaactgcaatccacccgcaacgtgtggtcatcaaagggcggcaaccccagttaccagcttgagattaaaaacccaaattaaaacagggccaaaggattcctgtcagctcttaaca

SEQ ID NO: 184880 - DNA, 601 bp, Human
aatgaaggttcccagatctttttaatgcgactttttgcaggtcaggttgcttccatcacatgcactgaacaaccaaattttaaacctaaatatgaaaccttgtagttacatctgttgattttcgtcttgttagtgttcatccagcattcaagtctgtcgaaattaaatgtttattattccttagtatttttttaaattgaagtcacttccatacacaaaccttgagtgtaaagctcaatgtattattgtctatgtattcccctatgtgacaccacccagatcaagacacaaacatttccarcactccagagggttccctcatgcctcttctcagtcaacccatccctaccatccagaggaaaccactcctctgacatcaatttgtatagatttctcttttcctgctgttgaacttcatgtaaatgtaaacttacagtatgtatccttttgttctggcatcttttgctcaacataatgtctgtaagagtcatccataccacgtatttagattaatatagccaggtgtggtggctcagtcctgtaattttgcactttgggaggctgaggcaggaagattgcttgagcccaggagttcgagact

SEQ ID NO: 184881 - DNA, 601 bp, Human
tcatccagcattcaagtctgtcgaaattaaatgtttattattccttagtatttttttaaattgaagtcacttccatacacaaaccttgagtgtaaagctcaatgtattattgtctatgtattcccctatgtgacaccacccagatcaagacacaaacatttccaacactccagagggttccctcatgcctcttctcagtcaacccatccctaccatccagaggaaaccactcctctgacatcaatttgtatagatttctcttttcctgctgttgaacttcatgtaaatgtaaacttacagyatgtatccttttgttctggcatcttttgctcaacataatgtctgtaagagtcatccataccacgtatttagattaatatagccaggtgtggtggctcagtcctgtaattttgcactttgggaggctgaggcaggaagattgcttgagcccaggagttcgagactggcctgggcaacaaagtgagacccctgtctctacaaaaaaaaatttttaaattagccaggccccgtggtgtgtgcctgtggtcccaggtactcaggagactgagggaagaggatgccttgagcccaggaatttgag

SEQ ID NO: 184882 - DNA, 601 bp, Human
ctgggtagtagtggtatctcaccacagttttaatttgtatttatctggtgaccatgtcattgagaactttttctttttctttttttttttttttccccgagatggagttttgctcttgttgcccaggctggagtgcaatggtgtgatctcagctcactacaacctctgcctcctgggttcaagcgattctcctgcctcagcctcccgtgaagctgggattacggacatgtgccaccatgcccggctaatttttgtatttttagcagagacggagtttctgcatgttggtcaggttggtctygaattcctgacctcaggtgatctgcccaccttcacctcccaaagtgctgggattataggcgtgagccaccgcgcccagccgagaactttttcatatgctctctggccatttgaatagtctcctttttaacaacgtgcctgttgagtctttgccccctcccccacttttattttaaggtgtttgactttttctgattgacttgtttttctttgcatgttctgccttgagtcttttgtcagataaatgtgttgtgaatatcttctcccagtccatggtttgtgtgttattttcttaataata

SEQ ID NO: 184883 - DNA, 601 bp, Human
ttttgggaaggccaaggtgggggaattgtttgaggccaggagtttgagaccagcctgggtaacaaaccaagacccagtctctactaaacaaatatatatatatataattagccaggcatggtggcgcatgcctgtagtcccagctactcagaaggctgaggtaagaaaattgcttaagcccaggaggcgtaggttgtagtgagccatgattctgccactgcacttcagcttgagcaacagagcgagaccctgtccgagagagagagagagacgcaagagagagaaacagagagagatggcrgtataaattctcgtggttattctagttcttttggttccatatatctgtttacaggaatcagcttgtcaatttttaaaatgtttaatttttgtgagtatatagtaggtgtatacatttatggggtatatgaaatattttgatacatgcatgtatcatgcatgcatgatacatgcatgcaatgtataataatcacatcagggtaaatggggaatccaccatctcaagcatttttcctttctttgtgttacaaacaatccaattataatcatttatttttttgccctgtcttatggtgctgat

SEQ ID NO: 184884 - DNA, 601 bp, Human
atgttttgtttcccacatctatagatctgtccctatgtgggggaaagaaaagaatgagtaaacattacttctcagtgaacttgttcctaaggatcacttttttaaaaaatcttttttaaatgggagtaagctgttatctgcacaaagcccttggggtgaagtccagtcaacagggcttcccttaggagatgttctctaaactgtgttcatgaaagtgaataagagttagcaggcaaaggagaaagggggttggagagggatctagagtttcagagaaagagaaaaacagctcacgagaagkaccacaccctagagagatgacatggtcaagggtctaacggaataatgcgacatcatctcaacactatgtgccaaggactgtcctgaaagctgtgtcataaataaagttttggtgccgcaaaagaaatagcactcaaatataaaattttctttttaattctcagcaaggcaagttacttctatagaagggtgcgcccttacagatggagcaatggtgagcgcacacttggacaagggaggggaaggggttcttatccctgacgcacgtggcccctgctgttctgtcgttcccctattggct

SEQ ID NO: 184885 - DNA, 601 bp, Human
agcatctctagtcctttctgaatttgtaagtagtctttggacttttgttatcaaacatcagagtttattcttgaaataaaagtttgtttccccttggaattctgaggctttctcctttagaaccttggcagcctaagtccctctctacctgtgtctttaagtatggtcaatattcaaaagctttggatggcgttgtcttcgtttatgcggatattaggttgcctcagtcaacaatgcttgaaaatggctttaaaatgagcatcatatcatgaagccatatttgtatttaaattaaaattgtttttttttttggtctatgtcataccagggataatatagagcaacagagaaccagggaaaatgtgattcatgcatctccaagtcaggaaaaagagactattggaatcatagccagcgacaaacaagttattgggatttatagaaaaggatggctgagcattcctggaaaaacaactgactttttgttgttgttgctgttgttagggaagattttgtctgcttaactggccagagttttcactccatcccccgaagaattgacgttttaaaaagcacaactgtagatttagattttcacagt

SEQ ID NO: 184886 - DNA, 601 bp, Human
ctttctgaatttgtaagtagtctttggacttttgttatcaaacatcagagtttattcttgaaataaaagtttgtttccccttggaattctgaggctttctcctttagaaccttggcagcctaagtccctctctacctgtgtctttaagtatggtcaatattcaaaagctttggatggcgttgtcttcgtttatgcggatattaggttgcctcagtcaacaatgcttgaaaatggctttaaaatgagcatcatatcatgaagccatatttgtatttaaattaaaattgtttttttttttggyctatgtcataccagggataatatagagcaacagagaaccagggaaaatgtgattcatgcatctccaagtcaggaaaaagagactattggaatcatagccagcgacaaacaagttattgggatttatagaaaaggatggctgagcattcctggaaaaacaactgactttttgttgttgttgctgttgttagggaagattttgtctgcttaactggccagagttttcactccatcccccgaagaattgacgttttaaaaagcacaactgtagatttagattttcacagtcttttgctagatt

SEQ ID NO: 184887 - DNA, 601 bp, Human
aaaaggatttgaaatatggaggaccgaaaaggccccatagtcaaataatttggtgaaatattacaaactatattcttcaagattcaccatgtacctgagcatatgaaaggcttgagaaaggcctgcagtaaagaaacctgcttaactttgtttattctgggctcaaataggttttcaaaaggagagaacgtgggttgttaacttcctggttggctactgagagaaatgagtctcttgagcaattatcctttgcaggtagcttccatgaagaacccagtttttgagtgcctctagcagagamtaagcttcaaacctcattaaccatggatccaatccaatatggcagcttgtatgttctccattctcaaagcccaatataaatgatgggctttcttcattcacccagataactaagagctgatggtaccccattgagcagatatgggagacaatgaatcttcatagatgagtgcctaaggatatatgtgtcactcaagagtaaatgaaccaatcatgttgctatgcatagggactcagttaaagaaaagtcagataaaatgggaggctggtatctcgcacagcactgatccggctctctgcc

SEQ ID NO: 184888 - DNA, 601 bp, Human
cagtttagtttggcctttaaattttcactgtaaactctccagatggtcacatatgggggcttctaaggcagaacacgcttcccaataacattagagcaagcagccttctctaggaggcatccatttccagcagtctatttttaatatttgcttttatttcttaatcctcctgaacaataaaaatgaacgtcattataaccaagtgtggctgtagtcatcaatacttcagagtccaaaaatacattggccttgcctgaccagttgcccattttctggaatagctgggtatttatctagcagygagagaccattatcctgagacacagtcgtgttccaccgacacctgatctactaattaaaatcactatcatgatggactgtttaaattctggtttaaatgttccttttgcatttgcatttaaaagaaaacacactcctcatcatgggcaccccagcctgggttataatttggctttcctttgccagaattataatgtcactctgacttgccgctggttaaatctaaaagagcatctaaatgtgcctcacagcttggctgttgcttggcaacgccagcagccacctcctcattggggtgact

SEQ ID NO: 184889 - DNA, 601 bp, Human
aggctgagtccagagggactgagggctgaggccagagggatcaaggtgtcttggagtagtagtcaaatggctggcctgatctgtggtctcatctgaaggcttgactgggggaagatctgcttctaagcctcatcacacggttattagcaggattcaattcgtaatggactttggaagataagaatcttgtactgtgtccttcagtcagtggggatctacaaatgtttcagcaaagcattactgaaataacaagtatttttggaagatctggccaggcatggtggctcatgcctgtaatccmagaacttcaagaggccaaggtgggaggatcgtttgaacccaggagttcaagaccaacttgggcaacatagggagaccccgtttctacaaaacattaaaaaaattagccagctgtggttgtgtgtgtctgtagtcccagatattaatacttgaggggctgaaatgggaggatggtttgagcccaggagggcaaggatgcagtgagctgtaatcatgccactgcactccagcctgggtgacagaatgagatcctgtctcaaaagaaaagaaaagaggccaggaagctctttcaaagaacttt

SEQ ID NO: 184890 - DNA, 601 bp, Human
gagtagtagtcaaatggctggcctgatctgtggtctcatctgaaggcttgactgggggaagatctgcttctaagcctcatcacacggttattagcaggattcaattcgtaatggactttggaagataagaatcttgtactgtgtccttcagtcagtggggatctacaaatgtttcagcaaagcattactgaaataacaagtatttttggaagatctggccaggcatggtggctcatgcctgtaatccaagaacttcaagaggccaaggtgggaggatcgtttgaacccaggagttcaagaycaacttgggcaacatagggagaccccgtttctacaaaacattaaaaaaattagccagctgtggttgtgtgtgtctgtagtcccagatattaatacttgaggggctgaaatgggaggatggtttgagcccaggagggcaaggatgcagtgagctgtaatcatgccactgcactccagcctgggtgacagaatgagatcctgtctcaaaagaaaagaaaagaggccaggaagctctttcaaagaactttctttagtacacctgggtgtcaggcactatcaaagtcctaagactacaaagatg

SEQ ID NO: 184891 - DNA, 601 bp, Human
atcgtttgaacccaggagttcaagaccaacttgggcaacatagggagaccccgtttctacaaaacattaaaaaaattagccagctgtggttgtgtgtgtctgtagtcccagatattaatacttgaggggctgaaatgggaggatggtttgagcccaggagggcaaggatgcagtgagctgtaatcatgccactgcactccagcctgggtgacagaatgagatcctgtctcaaaagaaaagaaaagaggccaggaagctctttcaaagaactttctttagtacacctgggtgtcaggcactrtcaaagtcctaagactacaaagatgcttaggctatagtcttttttctcaagaaggaagatgacaaccatattccaggtgacaagtagcaacacctgaactaggaggtgactgaggagataaatatgaaagaacagatgaaagaaaggaagcaatgttaacatgatgaggcaagaacagatggctccaatggggagttgtccctgaggaacaagaaaagagaagagaatgattccagtagtccaaaccagcctgggaggatggatccctccagaggacaactaccatgtttacaccactcc

SEQ ID NO: 184892 - DNA, 601 bp, Human
ttcaaagaactttctttagtacacctgggtgtcaggcactatcaaagtcctaagactacaaagatgcttaggctatagtcttttttctcaagaaggaagatgacaaccatattccaggtgacaagtagcaacacctgaactaggaggtgactgaggagataaatatgaaagaacagatgaaagaaaggaagcaatgttaacatgatgaggcaagaacagatggctccaatggggagttgtccctgaggaacaagaaaagagaagagaatgattccagtagtccaaaccagcctgggaggayggatccctccagaggacaactaccatgtttacaccactccctgccttctgtgccaagtgttttgcatattttgtttctaatctttgtcacgactcttcaagggaggtattattttcatttttgcagatgaggaactagactcagtgaggttaggcaatgtacccaagatcacacagctataaagtgccaggggaaggaaacctactaatttgcagtgcctttgagtatttgctatgcttggggcaagtattctccaacaaggtcggaatcttacactcaaggaaggaaactcagtgatga

SEQ ID NO: 184893 - DNA, 601 bp, Human
agtcctaagactacaaagatgcttaggctatagtcttttttctcaagaaggaagatgacaaccatattccaggtgacaagtagcaacacctgaactaggaggtgactgaggagataaatatgaaagaacagatgaaagaaaggaagcaatgttaacatgatgaggcaagaacagatggctccaatggggagttgtccctgaggaacaagaaaagagaagagaatgattccagtagtccaaaccagcctgggaggatggatccctccagaggacaactaccatgtttacaccactccctgcyttctgtgccaagtgttttgcatattttgtttctaatctttgtcacgactcttcaagggaggtattattttcatttttgcagatgaggaactagactcagtgaggttaggcaatgtacccaagatcacacagctataaagtgccaggggaaggaaacctactaatttgcagtgcctttgagtatttgctatgcttggggcaagtattctccaacaaggtcggaatcttacactcaaggaaggaaactcagtgatgagattctgtgagtcacccaaaaggagaggagaagaagacctttgag

SEQ ID NO: 184894 - DNA, 601 bp, Human
aaaaaaaaactggtgcccatcaatgacagactggataaagaaaatgtggtacatatatggcatggaatactatgcagccataaaaagggactagattatgtcctttgcagggacatggatggagctggaggccattatcctcagctaactaacacaggaacagaaaaccgaacaccacatgttctcacttacaagtgggagctgaacaatgagaacacatgcgcataaggaggagaacaacacacactgaggcctgttgggggaggggggaggaagagcatcaggataaatagctaatgcytaatacctaggtgatgggttgataggtgcggcaaaccaccatggcatatatttacctatgtaacaaacctgcatgtcctgcacatgtatcccaaaacttaaaataaaataaaattttaaaaaactgggtactttaattacataagaatctccaggttatgcagaaccttccttccttggggaatttgcttcccagggtggggatggtgatttcccctgaatggttaccactggttgccagacagctgctcagcctcacactcggcatcacctgtgtagggacaaccaatgtgagaggcga

SEQ ID NO: 184895 - DNA, 601 bp, Human
ttttaaaaaactgggtactttaattacataagaatctccaggttatgcagaaccttccttccttggggaatttgcttcccagggtggggatggtgatttcccctgaatggttaccactggttgccagacagctgctcagcctcacactcggcatcacctgtgtagggacaaccaatgtgagaggcgagaggaacaaaatgggaaactttctcccctagcttggctactgcactgcaaccccggtcttagcttgggctgtcataaccaaacaccattgagtgtgtggcttaaacaacagactttttttttttttgagatggagtcttgctctgtcacccaggctggagtgcagtggcgtgatcttggctcactgcaacctccacctcccaagttcaagtgattctctggcctcagcctcccgagtagctgggattgctggcacgggccaccacacctggctaatttttgtatttttagtagagagggggtttcaccatgttgaccaggctagtcttaaactcctgacatcaagtgatccacctgccttggcctcccaaagtgctgagattacaggagtgagccactgtgccaggcccagaca

SEQ ID NO: 184896 - DNA, 601 bp, Human
tagcttggctactgcactgcaaccccggtcttagcttgggctgtcataaccaaacaccattgagtgtgtggcttaaacaacagactttttttttttttgagatggagtcttgctctgtcacccaggctggagtgcagtggcgtgatcttggctcactgcaacctccacctcccaagttcaagtgattctctggcctcagcctcccgagtagctgggattgctggcacgggccaccacacctggctaatttttgtatttttagtagagagggggtttcaccatgttgaccaggctagtcttraactcctgacatcaagtgatccacctgccttggcctcccaaagtgctgagattacaggagtgagccactgtgccaggcccagacatgtattttctcacagttttggaggctgggtgccagcgttgttggtttccagggaggcctctctttctggtttgtgggtagccgccatcttgctctgtgcccacaagacctgttctttgtgcatgagagagagagagagggagagagaataagcatgagtgctctggtgtctcttcttataaggacaccaatcctattggatcagggccccatcct

SEQ ID NO: 184897 - DNA, 601 bp, Human
gaagacccgatggtgggcagctggcctgggctctctttcacactgtccaggaatatgtttggattcagaatgggtggccccctctttatacacagggcatgcctctgaagagttgtgtgtaaatcacattttatgttccatctcttttgttatgttaagaaagcttcaagctagatatctaaaaagacttcctttcaaacagtacatatatatatgtagatagatagacagattttcttttaccatgttactattcctctgaagtaaatttaaaaggtatttaggtttatgggattttatkaaactaggattcagttgtaccactaaacttattaagataatcgaaggaagatagccagtaaagctagttataaaaatgtggcttagactgtactgacttttccaatgttaagggtagactgagacttcttggaagttggggcctagagaccattttaagtgacccattggcacacccttttgtactgatggattattaaatcgatggtttgtgagaatttagaaaagcatacagtagtcatgaagcatcaacacagagatactaagaataaatcaggatagtcatacttatttttctttt

SEQ ID NO: 184898 - DNA, 601 bp, Human
aaaaaaaaaaaaattagccaggcatggtggcacacacctgtaatcccagctacttgggaggctgaagcaggagaatcacttgaacctgggaggcagaggttgcagtgagccgagatcacaccactgcactccagcctgggcaacaaagcaagactctgtctaaaaacaaaaaaaaagaaagaaagaaagaagaaggaaagaaagaggaaagaaagaaggaaggaaggaaggaaagaaggaaggaaggaaggaaagaaagagagagagaaagaaagagagaaagaaggaaagaaagaaaaagaaagaaagaaagaaagaaagaaagaaagaaagaaagaaagaaagaaagaaagaaagaaagaaagaaagaaagagaaaggaaggaaggagggaaggaaggaaggatgggaacagttgtctaggagaagatggggagcagataggtacttgctgtctgagtgtcgggtgcactgtcatgaagaagagaacagaaatgaaaccagcaaaagattgttagacgaagtcagattttgcctcagtacaacaacataccttctgagaagcagattaactttataacttttcccagtgcctcaagact

SEQ ID NO: 184899 - DNA, 601 bp, Human
gcaacagccagtacccttgtcagcagctgcagtggcagctcttgggagcaattcaggaggtcatgctgggaacaattatccactggaaagaaaattcaaatgaccagaaagtttgtaaaaagtaaatcagcttctaccacttgctaaggcttgaaacagcctgtaatcctttctctcttaatgaagtacaaagaccttcaggtctcatccccaggacctgaaacattaatttatgagggtgaccttgacctcttgagggccagatggaagtgcagactcgattaattgcacagatgtttaytgagtgcttactatgtgccaggaatggtgaggagtaccgagagggagtgagacatcacccctgctctcagaagcagcagtgcggcggggagggcaggactccaaaacggctccgattccaggcccgcgtttgcttcccgggaacaggcgtctaatggccctggtttattatcacccccttttcaatgccacttttgtttttctctttcaagtatcatttccatccataatggtcccactggcccggattttgcccaataagaaccgagacgaactgaatggcttttttaacaaactcatt

SEQ ID NO: 184900 - DNA, 601 bp, Human
ttgggagcaattcaggaggtcatgctgggaacaattatccactggaaagaaaattcaaatgaccagaaagtttgtaaaaagtaaatcagcttctaccacttgctaaggcttgaaacagcctgtaatcctttctctcttaatgaagtacaaagaccttcaggtctcatccccaggacctgaaacattaatttatgagggtgaccttgacctcttgagggccagatggaagtgcagactcgattaattgcacagatgtttattgagtgcttactatgtgccaggaatggtgaggagtaccgagagggagtgagacatcacccctgctctcagaagcagcagtgcggcggggagggcaggactccaaaacggctccgattccaggcccgcgtttgcttcccgggaacaggcgtctaatggccctggtttattatcacccccttttcaatgccacttttgtttttctctttcaagtatcatttccatccataatggtcccactggcccggattttgcccaataagaaccgagacgaactgaatggcttttttaacaaactcattaggaatgtgattgccttgcgggaccagcaagctgccgaaga

SEQ ID NO: 184901 - DNA, 601 bp, Human
aagtgctcatgttaggccaggcacagtggctcatgccagtggctcatcccagcactttgggaggccgaggtgggtggatcacctgaggtcaggagttcaagaccagcctgaccaacacagtaaaactccatctctactaaaactacaaaattagctgggtgtggtggcacatgcctgtaatcccagctactcgggaggctgaggcaggagaatcacttgaagcagggaggcggaggttgcagtgagcaaagattgtgccattgccctccagcctgggcaataagaaagaaactccgtctcaaaaaaaaaaaggaccacatgttattatggggctgtacagactgttgcaaagcactgagaccccttggtcaaataaacacattacagcaggtcaaatttttgagtttagtgtgcataaaagtatataggaagactgcttagaatgcactttccagggtcctgacctcaggggttccgattccataagtctgggctgggacccaggaacccgcattttattttattttattttttgagatggagtctcgctctatcatccaggctggagtgcagtggcacaatcttggctcacagcaaactc

SEQ ID NO: 184902 - DNA, 601 bp, Human
tgggcacactcccttctcaggcacatctcccctaggggtctcaagccagctgtgtaaccagtgttttgaacagtctcaactcagtgaggtaccaacttgaaaccatttggtgttttttgtttcatttttttcccttaaatgtgctctgatgaatctcctttccctgtccgtgatgatactttggacagatctcaatgatttctggtcattttggggggcattaaaaagtccaggccagtctggcccagatgaaaacttcaggctcaaatccaatcagtgcccttctgttctcttagctcargctgacctgtggcctgaggatgccgccctgcgggaggagaggtctgttttttcccctccttctacccctcccccacccctgctgggcccctttctcctccaggagtggggcctgtgaacggatccccaaatcctgcctacctggagctgccctcagtgccttccctgcggggcttctgacgtggggtagatgcaagacgtattcggagggctcccaggtctgaagtcctcactgcataattccctgccagggagacaggctccagctcctgccaccagctcctgccccaaggctgcttga

SEQ ID NO: 184903 - DNA, 601 bp, Human
atgtctctgatgccatttctttggtggcctaggacagaatctgagctatttccactagaggaataggagcttcagcagggggccttggaaatgtatccaaggtacccacctcctgtccttctttctggaagcatctggccctgggaagtagcatcccgaccactaatatcagggcactaatatcaggcaaagggaggaaaagttgcatcctgaccactaatatcagaaaggcccctcctcccagcccgtgaagaggggcctctctgggtgtgtacctggaaccctatcttggaagttaagwtttgtggtcactgctaccaacacaccaactcccaggacacaggatactagggacttctgtgccccatcagtggacaagtcacaagttcccaaagcagggtgaccaatcgatctggatcaggtggcagggcctcggatcttaactgtccatttcattgttatgcacacaaacttatcttagagatccggccatctgcctgttcccgtcctggggatacctgcgggaaggcaggctgtgcctcccagaggtcatctgggctgcaaatgggtgccaagaccttcctctgcccctactcaggac

SEQ ID NO: 184904 - DNA, 601 bp, Human
aatttaaagacttcttgtccccaaaaaaccttttcgtcactaggcttaaaattttccattgggaggccctggctttgttttgacacatgatccgttattaacacaccactcattttgggaggggaatatcatcaagtcccagccaggatgtaaaccccacgactaggaagcctcgtccgctgggtaccttggtaggtcccagggccgagcacagtgcctggcacgtgagaaataggtgttgagaaaagttatttcactcttccttttctaactggaaaccaactccaagcacagatttgasgggggacgagcagggaggcacagtagataaagcctgtgagttactgcgcccagcgagaaaggggtcggtggagtcaaagagagaaggcactgcgtggggagatggaggcaggttgaaggcaacacttggagtccctatagtcctacaattgcagtgcaattgcccagaagatatcatgctaagaaaaggagggagcctcagccctcggcctccgaggagacctctggggacatctagggcagcttcccatccaggacagatatctgaaagatcatgaggctgggcttgaatcctgctgac

SEQ ID NO: 184905 - DNA, 601 bp, Human
cccttccttagtttttctgtctgtaaaatggggatagtaacattgtgtagctcataaggttgtcaccaagattaaacgagttaagaatacacgtgcaatgtttgaacagcgccagcattacgtacatatagctactctcattcgcctttctgtgactcagtttccttatctgtaaaagaaaaaggttggactagacctcttctccactgttattgatgatgatgatgataaatgaatgtttctgtgccagatcctaaactaaacaaaagttaacttgatactcacaatggctgtatgaagygggagttatcaccatccccatttcatcagtggggaaagaaaggctggattagtcagggatctccagaggaaccgaactaataggacagagacagaaagacattcattttcaggaattggctcatgtaatttatggagtttggcaagtgtgaagtctgcagggcaggctggcagtttggacaaccaggcaggagtcaatgcaacagtctagacacagaattctttcttcgccagaaaacctcagtttttgctcttacggccttcaaccgattggatgaggcacgcccatattattgaggat

SEQ ID NO: 184906 - DNA, 601 bp, Human
gattttaagtgttaaccatatctaccgaagaccttcccagcaaccctgggattcatgtttgattaaataactgcacactatagcctagcaaagttgacacaaaagactaaccaagctaaataacttgagaacataagataataccctaggacagggcctaggtcggattggcactcacgtttcccgactccttagtctgtattcttttcaaccttgtctctaatattccatgattccatggttctgatgccattcctcagcgctctgctgttcttgcctgaccaagtggatcaatggtggctctggcatttctataaaggggatttcagggctgcctgctggggagggaggcttgaagctgtgtctgcactgcatcttcacagcactgagaaaatgccagtcattcaggaggacagggcagccctgtcctcgccacagtgcccgcatcttcattggttcacctttgcaggtatcatctgtgacctgtcatccaggctctgagccctgaggataataagtttccctcgaaggtcctgggtttgttggagctttttctccctcttgccatgtccttttcacggtccatcctctgagtttgtga

SEQ ID NO: 184907 - DNA, 601 bp, Human
ctaatattccatgattccatggttctgatgccattcctcagcgctctgctgttcttgcctgaccaagtggatcaatggtggctctggcatttctataaaggggatttcagggctgcctgctggggagggaggcttgaagctgtgtctgcactgcatcttcacagcactgagaaaatgccagtcattcaggaggacagggcagccctgtcctcgccacagtgcccgcatcttcattggttcacctttgcaggtatcatctgtgacctgtcatccaggctctgagccctgaggataataagtytccctcgaaggtcctgggtttgttggagctttttctccctcttgccatgtccttttcacggtccatcctctgagtttgtgaattatctttcttcgtggcccatgtggcacaagatgaagagtgcatgggcagcttctcccctgacatccctacctccctgacgcttaacccacatagggaagaacattcctgaaacagagacgtcacccagggttgctttctgccacagcaggcactctgcttcgtgcctttctcacttccatttgtaaatgatcttgtctccttccttgtagaaagctt

SEQ ID NO: 184908 - DNA, 601 bp, Human
agggttataaaatagacgccagccttcttgtaggtagaatctgacttcagacagcaaaagactctaaaacagcttaaattcctgtatatgccttctcctgtgcatgccaccggtcagaccaaaggccacacgccaatcaaggcccaagatcagccaggggtgtttccatgtcctcaagaacttttacaaactgtagctgattgggttccgcccctggagattcgatttagtgggtctggagtgaggcctgggcttcttagaagccccagcggattctaaaatgcagccaggaggaagaacsttgccagaatcccatgaggcacagatgcaaatgtgcatagtgacattgggttgcattatcaatggcaggactgactttataaacctccacatccttactggagctgctgtttgctttttagaaaagtccctcatcagattatcaggaagtcgtgggttttccgtgatcatgctgtggtcagatccagcccaaccagagagccaaaaacaaaacaaacatacaaaacaaacaaacaaacaaacaaaacccaaatccctggcaagccccacgaaatgactgctctgataacattcagcagac

SEQ ID NO: 184909 - DNA, 601 bp, Human
gagattcgatttagtgggtctggagtgaggcctgggcttcttagaagccccagcggattctaaaatgcagccaggaggaagaacgttgccagaatcccatgaggcacagatgcaaatgtgcatagtgacattgggttgcattatcaatggcaggactgactttataaacctccacatccttactggagctgctgtttgctttttagaaaagtccctcatcagattatcaggaagtcgtgggttttccgtgatcatgctgtggtcagatccagcccaaccagagagccaaaaacaaaacaarcatacaaaacaaacaaacaaacaaacaaaacccaaatccctggcaagccccacgaaatgactgctctgataacattcagcagacaagcctgtttgaaatcatctcagaatcataccagacccaaacccaagaggtcatctggtctatgcatcgactctaggagggtgtattagtccgttttcacgctgctgataaagacacacccgagactgggcaatttacaaaagaaagaggtttcatggacttacagttccacatggctggggaggcctgacaatcatggtggaaggcaaagaggag

SEQ ID NO: 184910 - DNA, 601 bp, Human
actcactatcacgagaacagcacgggaaagactcgcccccatgattcaattaccgcccaccagtttcctcccacaacacaagggaattgtgggagttaaaattcaagacgaggtttgggtgaggacacagccaaaccatatcagagggtgaggggctatttctccatgttacagacaaggcacgtgaagcctagggacgttccatcacaggcccacaccttgtctcagaattaagaggaaatgcttctggctgccaggggtggggtggggtaggatgcagagcctctccctccaccaccayctccatccttttccctttctctgaaaatctcatttgatgattccccagcctggctgcaaattaaagatttgtagacctgaaagatgctaccgatggttatcagcaccaccaccaccatcgtaacagtaaacatttatggagcgccataattattcataataatttttatgtgttaaacaaatctgacctagctctataaagaaataggccctgttaaccaaaaatattggataaattaaaagtctcctagaagcatctgatgaaaggatctcaagttccataacacacggaccattcagt

SEQ ID NO: 184911 - DNA, 601 bp, Human
acccactggcacaccgctaggaattctgttttcttaccaccaccggagccaggtctctgtcacggtgatgagaagttcccaaagtcatttctcctctctagggtgtcccctctctgtctgctgccactaaatccctaacgacattagagcgaataaatggcatttttaacttcagctttaagcaacaaagaaatactattaagtcaagatgtgtccatctttaccataaaaaaaaacaaaaaacttgcttcaataaccaataaacagatcaaacaacagaaaaataaatagcaaaagactkcagggctcgatggctcacacctgtaatcccagcactttgggaggcggaggtgggtggatcacctgaggtcaggagtttgagaccagcctgaccaatacggtgaaacccgcctctactaaaaatacaaaaattagccaggcttggtggcgtgagcctgtagtcccagctactcaggaggctgagataggagaattgcttgaacccaggaagcagaggttgcagtgagccaagattatgccactgcactccccattctgggcaacagagcaagattccatctcaaaataataataataataa

SEQ ID NO: 184912 - DNA, 601 bp, Human
cagggcagaggggtgctgttttatggagaaaggcacttactgctgggaccttgatatctttagactgtgggggaggctggctctcctaggaacactaacagagtcaaagagatcagacaagagaggtgccagtgcaaagggggaaactgaggcaggcagcatgcctgggctttcttgacagtaccaggggtattatagccctgttttccagattttttggactacaatctcatcataagaaatataatttataattcaacccagaacacacatcccttataaatggaacaaaaagttttakgaaacatgtcaccttctatgtacaatctgctcgacatcctgttctagttgatttcatttctttaaatgccactcttaaccccctaaattgaattcatggattgaattcatggtcccctaaaggatcacagcccacatgttgaaaaacactgggttagagggtcacagttcaggaaaatgaacgaggaggttttttaaaatctactttacaaacgaggaaatgtatcgggttccttaagagcctttccaggaaaatttttgctcatttgtggccaaactcgaaataaaacttaggtccccc

SEQ ID NO: 184913 - DNA, 601 bp, Human
atcataagaaatataatttataattcaacccagaacacacatcccttataaatggaacaaaaagttttaggaaacatgtcaccttctatgtacaatctgctcgacatcctgttctagttgatttcatttctttaaatgccactcttaaccccctaaattgaattcatggattgaattcatggtcccctaaaggatcacagcccacatgttgaaaaacactgggttagagggtcacagttcaggaaaatgaacgaggaggttttttaaaatctactttacaaacgaggaaatgtatcgggtyccttaagagcctttccaggaaaatttttgctcatttgtggccaaactcgaaataaaacttaggtcccccaactcccaaccctgcgttttctggtttccttccaccactctttctagtatccattttcctggtctccaagttgtaatacacattctgggatccacatttacttgttttattttacataattatattacttgtatactatttccttatacttcatattcttctcaaatttccatgttttatatcatttctgatgcaaactgattacatcattgcttatggcacattcttgac

SEQ ID NO: 184914 - DNA, 601 bp, Human
acatcccttataaatggaacaaaaagttttaggaaacatgtcaccttctatgtacaatctgctcgacatcctgttctagttgatttcatttctttaaatgccactcttaaccccctaaattgaattcatggattgaattcatggtcccctaaaggatcacagcccacatgttgaaaaacactgggttagagggtcacagttcaggaaaatgaacgaggaggttttttaaaatctactttacaaacgaggaaatgtatcgggttccttaagagcctttccaggaaaatttttgctcatttgyggccaaactcgaaataaaacttaggtcccccaactcccaaccctgcgttttctggtttccttccaccactctttctagtatccattttcctggtctccaagttgtaatacacattctgggatccacatttacttgttttattttacataattatattacttgtatactatttccttatacttcatattcttctcaaatttccatgttttatatcatttctgatgcaaactgattacatcattgcttatggcacattcttgactgatatcaacattttaaaccaaattgtcttggtacgca

SEQ ID NO: 184915 - DNA, 601 bp, Human
tccgcacacatttttttttctagttgtcataaacaaatttcaaagaaagccattttcccagagccctttcttgtgactctaccacagttcatcctggtttgcagaatccaaactcagggcttccttccaatatttttattagttcagtagtcgatcagtttgcacagagaagtggattggagctccccttcccttggagctgccagtggagaaagtctcctccaaccctcaggctcagcaccactcagggccagtgagatgcacaaacagcatcttgcaggtaccacaatgccttcatcasttgtatcttccccgaccctgtgatgaagtaggatgaagatggctgagggtatggacgttgggcccacctccctggcttaaagctgctggaccccttacccggccatgtggccctggggcatgacacagttccccctaagcctcgcttcttcactgtttaaaggggataataatagcatctgctctgttagactgagggctggttaagtggaataacatacttagcacatagcctggtacccacttattttttttattttgctactttgtttcaaatcttcaaatcttcctattattcctt

SEQ ID NO: 184916 - DNA, 601 bp, Human
ccaaccctcaggctcagcaccactcagggccagtgagatgcacaaacagcatcttgcaggtaccacaatgccttcatcacttgtatcttccccgaccctgtgatgaagtaggatgaagatggctgagggtatggacgttgggcccacctccctggcttaaagctgctggaccccttacccggccatgtggccctggggcatgacacagttccccctaagcctcgcttcttcactgtttaaaggggataataatagcatctgctctgttagactgagggctggttaagtggaataacatacktagcacatagcctggtacccacttattttttttattttgctactttgtttcaaatcttcaaatcttcctattattccttttttacagagccatgtcagaaaccttagattcacgtcccttccatgtgtcccttccacatgtccctccttgacctgccacaatgcctctgctccacccagagcctcagcacctgcgttctgccccctcagtaaccagggtccctcacctgccactcctgggttgctctctccttttgaactagaaatttttctaccctcctgcccctccagccaaaattac

SEQ ID NO: 184917 - DNA, 601 bp, Human
ttccttttttacagagccatgtcagaaaccttagattcacgtcccttccatgtgtcccttccacatgtccctccttgacctgccacaatgcctctgctccacccagagcctcagcacctgcgttctgccccctcagtaaccagggtccctcacctgccactcctgggttgctctctccttttgaactagaaatttttctaccctcctgcccctccagccaaaattacctttttgatgtcccatttccccaggacactattttgtcctagggatcaaaaataaaaaaataagaaagaaagaragagagagagagagagagagagagaaagaaagaaagggaagggggaaagaaagaagaaaagaagaagaaagaaagaagaaagaaaaagaaagaggaaggaaggaaaagaaagaaagaaagaagaaaaagaaaagaaagaaagaaagcaggaaagaaagaaagaaaagaaagaaagaaagggaagggggaaagaaagaaaagaagaagaaagaaagaggaaggaaggaaggaaaagaaagaaagaagaaagagaaagaaagaaaagaaagaaagcagcaaagaaagaaaggaaagaaagaa

SEQ ID NO: 184918 - DNA, 601 bp, Human
aaagaaagaaagaaagggaagggggaaagaaagaaaagaagaagaaagaaagaggaaggaaggaaggaaaagaaagaaagaagaaagagaaagaaagaaaagaaagaaagcagcaaagaaagaaaggaaagaaagaaagaaggaaagaaagaaagaaagaaaagaaaagaaagaaagaaagaaaagatcaaattaccaggatctgaggacctgggaggatttcagaaatcgctggtcagtcccagcaactaaggctcaaatgccctccccaggattctgctggagatcattctgccagtcrctccaggagcgaggggctcacctcttcctaaggcaggactttccacgaggctagaccagaccagtgtcctccaattaattcatttccctgtgtcttccatccatggtttcaaactctgggaccccaaagcacagtggccctttacaaagttgaaggctatgtccctctggcttctgcagcttttcctgatgtggcagggtttcaggtcccctgcccatccaccccccacccctctagcctgactgtctgtgtccctctagagggtgacatgccttgaatggcagcgaaccctggtgtggg

SEQ ID NO: 184919 - DNA, 601 bp, Human
taaaaaattaactccttcaagtaatctagagtttggtgaccaatttcttattttaccctcctcacatcttcaaaactcagcactggtgatttcacgtctgttgatgggattcatctgtccccctccactagactggaagctccccatagggtgagacccactatagcatcccccaatgtccagcacggaactggagcatcacaggtgccctgaggaatgaatgggtggacggcgcttacagactcgggtgccacttcctcttgtccagctccatgccctcccccatagtgtgtggaccatygggggcctagaactgaggtcctggttggtagcacccaggagcctgttcccaacatggccccatggcagggcctggtctccaggtgtggcatgaggtgctacatgagcattctgtgagcatcttcagggagaaaacaaagtgttggccaggcccaccggaacagcggcccacctaaacaggctggcgggcggaggagtgccacagaatggacatggggaggccttacaaggtctgtagtagcagaggtagtgaatgtttgttgagttctctctatgcgctagtgttattctaagtgaggtc

SEQ ID NO: 184920 - DNA, 601 bp, Human
ggtctctgtcacagagtttctcgtgcttggctgcagcctggagccaccttggggagcttgatgcctggggctccccacggattccagtgtcatcggcctgggcatttggcatttgggatattcacaagctccttggtgactccagggtgcagccgaggttgagaaccattgggaatagaaaagcaagaggaagctgttctcacctgccctttccacaccagagccccagggtcccggggagactaaagctggggtctatttctattcccccaaccaagacgggagcttcacatccccacayactgagaggccagaatgggtcagaccagagtgagtgtgctctggctaagactggccgacagctctgttcccctggggtggggactggacgtggccctttggtttaactgcattttactctttccagcctgtctggccattattcttgcaggagcacgcaggactaaagtccccttcctcagcaccacgcatgtcccatctcaccctgtgtcttccaacttcacttgccataaatcagttgtcaggacccccgaccctaaaacagtcacctaatgataaatcatgtttaattctaatggaa

SEQ ID NO: 184921 - DNA, 601 bp, Human
gggctccccacggattccagtgtcatcggcctgggcatttggcatttgggatattcacaagctccttggtgactccagggtgcagccgaggttgagaaccattgggaatagaaaagcaagaggaagctgttctcacctgccctttccacaccagagccccagggtcccggggagactaaagctggggtctatttctattcccccaaccaagacgggagcttcacatccccacacactgagaggccagaatgggtcagaccagagtgagtgtgctctggctaagactggccgacagctctgytcccctggggtggggactggacgtggccctttggtttaactgcattttactctttccagcctgtctggccattattcttgcaggagcacgcaggactaaagtccccttcctcagcaccacgcatgtcccatctcaccctgtgtcttccaacttcacttgccataaatcagttgtcaggacccccgaccctaaaacagtcacctaatgataaatcatgtttaattctaatggaaccctcccgccaagactactcatcagagaggaagctaattcgcagggatatgaagagctttctaaaat

SEQ ID NO: 184922 - DNA, 601 bp, Human
aaccctcccgccaagactactcatcagagaggaagctaattcgcagggatatgaagagctttctaaaattagttccagacgttttttgtcttaaatctgtattatggctgccctatttttaatttactttttgaaaaaccacattgggacactaagtaatctgggggcccaaaagactttgggggccacgggaacctcccaggccctagggggcagtagcaccaccatgcagatcaccagttccacaaaagaacggaactccaccagtacctagtgttattagtataagttttgggaaagrtccttcttttcttagctcattagaaaaacaatcacagcatcctatggactgggccaaagtgggcagacattgcagtccagcccaaagaggcctgtcccagcaggacgccaggggacagggtcagaaagaggcagcccacaagctgagcacagctgcagaggttttagcttgcttactacatttgaattaattgccaaacttttaaactcaggggaattccgcaaaaatctaggtaccagcttttcttgaagacaacggaagctcaggccaccctgaggccatcacctctggcagtcacct

SEQ ID NO: 184923 - DNA, 601 bp, Human
ccaccatgcagatcaccagttccacaaaagaacggaactccaccagtacctagtgttattagtataagttttgggaaaggtccttcttttcttagctcattagaaaaacaatcacagcatcctatggactgggccaaagtgggcagacattgcagtccagcccaaagaggcctgtcccagcaggacgccaggggacagggtcagaaagaggcagcccacaagctgagcacagctgcagaggttttagcttgcttactacatttgaattaattgccaaacttttaaactcaggggaattccrcaaaaatctaggtaccagcttttcttgaagacaacggaagctcaggccaccctgaggccatcacctctggcagtcacctgccaagcacgtggctccagcttagcccgagcgcctccacctgccccgtcaaggcccagatgcagtggcccttacccatcacacttgcgctgttctgaccacagactcacagtcatggtcccacctggccccatggacatttgggtttgcatcatcatctaatgacacagtgaagctccttggcctaccagctccctttgtgttcaccttgaccagccccca

SEQ ID NO: 184924 - DNA, 601 bp, Human
gcctcagctgcctggcccctccaaagcctcctttgaccatcagcccagcttgcatggatgcccgggacacatacagcactttcttggtcttggtttacaaagtagtctgccccagtggtcccaccacacctccaatcaactccagaccccagccagccacttgaaaatctgtagtccaggccagagggcaaaaggcacagtcgaggacaaggagcaggcatcccgtgtggcgggagcaggaacactcttgctcagggtgctgtgcgatgggccattggtaggtagtcccagctggtctggygtgtgaggggagaggcaggttcacccagctgtctgtgcctgggcagggcaactcccgaagtgggctgagggagagctctccgtgatctctaaggagggaggcagcgcattgcagggttagcaaacctttagaagatcctcccggtgttcttcctcccgctcctgccctgcccatagcagaaatcaacaacacgtgggcactgagctcttttccagaaactttccaaagagacccatgggtctggccaagaccctcaggggttgccctcattggcctggggacagtttttgagcgactgct

SEQ ID NO: 184925 - DNA, 601 bp, Human
cagcccagcttgcatggatgcccgggacacatacagcactttcttggtcttggtttacaaagtagtctgccccagtggtcccaccacacctccaatcaactccagaccccagccagccacttgaaaatctgtagtccaggccagagggcaaaaggcacagtcgaggacaaggagcaggcatcccgtgtggcgggagcaggaacactcttgctcagggtgctgtgcgatgggccattggtaggtagtcccagctggtctggtgtgtgaggggagaggcaggttcacccagctgtctgtgccygggcagggcaactcccgaagtgggctgagggagagctctccgtgatctctaaggagggaggcagcgcattgcagggttagcaaacctttagaagatcctcccggtgttcttcctcccgctcctgccctgcccatagcagaaatcaacaacacgtgggcactgagctcttttccagaaactttccaaagagacccatgggtctggccaagaccctcaggggttgccctcattggcctggggacagtttttgagcgactgctctttgagaagaagtcagcatcagagggagtcagagaagag

SEQ ID NO: 184926 - DNA, 601 bp, Human
gtaagcaagctaggttggggagctgctacccccaaatcagactgcaaagacaggcaagggtcatggccacttccgtgggcccagtgccagacagctccacagaggctcagagagggctgaagggccaagcctaaggaaaacaacaaggctgaaactccccatgtctaacgacatcgtgagcgtggctgcagagctcccacatggcttcctcctccttcccaaggggctgccccaccgctttgccctcactagccagagcaatctaccttgttcactttgcccaagacacagggaggacccytgtggtctttgcaggggcttcacccagttgagctgggaagagacctcacagcatcctccccatctccctggcccgggtttagaatactgaagacacatagtcctgtcctccgtggcctacgcagatccttcctgttcctgagatctctggccccatgcgggcccatctctgcattcctagcttggtggatgccctgcctatctggcttctacctttgattgttcccttggtcactccgatgccatggtcctatagcaatcagggtgctgagtgagtccctgcctgtcctgccttataagg

SEQ ID NO: 184927 - DNA, 601 bp, Human
attttttttgagatgaagttttgctcttgttgcccaggctggagtgcaatggcgtgatctgggctcactgcaacctctgcctcccaggttcaggtggttctcctgcctcagcctcccgcgtagctgggattacaggcacctgccaccacacttggctaattttttgtatttttagtagagatggggtttcgccatgttggccaggctggtctcaaactcctgacctcaagtgatctgcctgccttggcctcccaaagtgctgggattacaggcgtgagccattgtgcccagctgctcttcyctttttactgtcctatgactggtctcccaatgccagctgagagtgttggtctgatctcttttcttctaagctggccacacaaatggacctcagttactcagtagcccttaaaatctggtaccagtcaccatttaggcctctggacatcatccttgggcaaaggaggctttttttttaagcttgggcctagccctccccacttatatcctggactgtgaaaatggaccgagtgggcaatagggaattcaggatgagctggaaaaaaagaaaaaaaaaactcctgctgcaataaattacatc

SEQ ID NO: 184928 - DNA, 601 bp, Human
cctcagatgagacatttttataaacatccaggcaggcagcctctgaagactcctgggctttacaaacacatctcgtattctatagtcagctgagaccatgctttgagcatgggcggtaagaggagcaggaagcaggaggggcggggaggggtctggcaccagctttctaaatttaacatgcagttgcttttaggccagtggataaaaaataaattccagtgcttaaagctcttatctttgtttaccatttccccaaacagctagtgacctgctctctgactcctacagcaaatcatcaacragatgcacacgaagatgagggatgggaaatgcaggaggggtgtgcggagggcaagttgatggctctccgccttcccgtcacgtttatttggcctggcagagtgaccaggatctgctaaggtcatgaggctgtccctgggtgggtgggggcgtggccatgctgcatcagaccagtccagaggtggagggcaccttggggtctctcgtgtggctctcctgttgatgagggacctatgaatatcccacagcgaccttttcagatgctccataacctcgtgtgaaaagccccggtggacctggg

SEQ ID NO: 184929 - DNA, 601 bp, Human
ttaacatgcagttgcttttaggccagtggataaaaaataaattccagtgcttaaagctcttatctttgtttaccatttccccaaacagctagtgacctgctctctgactcctacagcaaatcatcaacgagatgcacacgaagatgagggatgggaaatgcaggaggggtgtgcggagggcaagttgatggctctccgccttcccgtcacgtttatttggcctggcagagtgaccaggatctgctaaggtcatgaggctgtccctgggtgggtgggggcgtggccatgctgcatcagaccrgtccagaggtggagggcaccttggggtctctcgtgtggctctcctgttgatgagggacctatgaatatcccacagcgaccttttcagatgctccataacctcgtgtgaaaagccccggtggacctgggcttgcctattgcattgtgaagttgtagtcctttgaaaatcctgccccacgtggagtcagaatctttctttctgggactgatgccatggggcctggctccacccccacaactgcatggcacagcactgccttttccttggccatgggctcgccctgcagatgggtgatgatgc

SEQ ID NO: 184930 - DNA, 601 bp, Human
cgtggccatgctgcatcagaccagtccagaggtggagggcaccttggggtctctcgtgtggctctcctgttgatgagggacctatgaatatcccacagcgaccttttcagatgctccataacctcgtgtgaaaagccccggtggacctgggcttgcctattgcattgtgaagttgtagtcctttgaaaatcctgccccacgtggagtcagaatctttctttctgggactgatgccatggggcctggctccacccccacaactgcatggcacagcactgccttttccttggccatgggctcrccctgcagatgggtgatgatgcgctcctgcctcccttcagtttgttctgttctcccaaattctttcagtgtgcctggtagaagcagtctgccagtctcccctcgctccctctcattcatcccctctctaactactcatcctgcgaccccactgacttggttttggccttgtccctgccacagttgacaaatataatggcgcgtcttcttcttcattattatcattattattactggcaatcatagtccactctgcctcaaactcctaggttcaagtgatccttccacctcggcctcccga

SEQ ID NO: 184931 - DNA, 601 bp, Human
tttcagatgctccataacctcgtgtgaaaagccccggtggacctgggcttgcctattgcattgtgaagttgtagtcctttgaaaatcctgccccacgtggagtcagaatctttctttctgggactgatgccatggggcctggctccacccccacaactgcatggcacagcactgccttttccttggccatgggctcgccctgcagatgggtgatgatgcgctcctgcctcccttcagtttgttctgttctcccaaattctttcagtgtgcctggtagaagcagtctgccagtctcccctcrctccctctcattcatcccctctctaactactcatcctgcgaccccactgacttggttttggccttgtccctgccacagttgacaaatataatggcgcgtcttcttcttcattattatcattattattactggcaatcatagtccactctgcctcaaactcctaggttcaagtgatccttccacctcggcctcccgagtagctgggattacaggtgcacaccaccatgtctggcattttttttttttttttagagatggggtttcactatgttgtccaggctggtctcgatctcctggcct

SEQ ID NO: 184932 - DNA, 601 bp, Human
gttgtccaggctggtctcgatctcctggcctcaagcaatcctgccacctcagcctcccaaagtgctgggattacaggcgtgagccaccgtgccagccatcaatggtctctcttagtcttgaatctcccaggcactgtccaggagatctgagatgttttccagggtcccttactttccagttgccctgccaccttcccctgggaagcattaaggttcaatgcttggctctgtgcttgtttttcttacccctatcccagaggactcatccccgtctgtgcgacaccatctccccacttctacrccaagctgctcacggtctcacccaggtggggtggtggagggggcctccagcaaaatcctgcaaaagctgatctccttcccctggaagatgctgccccacccatgtggtcctctttctgtgtttctctcagccacttaggaatgaaaccagggaatccctttcatctctcttcattccctgacccgttaaatcccaacaccctcacctcccctggtagagcttcctttatgacagtgattctgaaatccaggctgcatgtgataatcccttgggggacttctaaaacaataccaattcctg

SEQ ID NO: 184933 - DNA, 601 bp, Human
tgcagttagagtaaatagaagaaactaggatgtcaacaggctgcttttcaactgattcactgttaaaattttaggcagtgtgaacaacctgtctgtcaaactgtttgcaatatctactaaagctgaacatacacatccctcatgacccggcagtgccatgcccagatgtacacccaacagaaacctgtactctgttcaccaaaagccataaacaagaatgttcataaggctttattcataatggcccccaacctgggaacaactcaaatgtccattgacaaggaaaaggatggataaatcsgggcagctcacccaatggagcaccaaatcatgaggatgaacacaccacaacacacaacatgggtgactgtcacagacatgaaactgagcaaaagaaggcagaccgaaaagcctgcatggaaatatttcatttataggaagttcaagacaaagaggcaaaagtaatctctcgtgttagaagtcaagacagtggttactactgaggggcatgtgaccgggagaggccacgggtgtgcttccaagtgctggaaggttctgtcttggtctaagtgctggttacacaggaatgcttacagtgtga

SEQ ID NO: 184934 - DNA, 601 bp, Human
gtttgtgtgcgcacgcagcctggtttatgttttttcattacatctctgcacctaatcccttaatggcctgggcctcagagtacaaaaacacctggaaaaatctctgtgtttttatgagacgggttctgtccccttctaaagcaggtataaatagatgccatgtacactctcttaattactttttctcgagtatggatgaatttcaacatctaaatctgccaaattattgaagctagcacagagaactttctgggcattggccagggaagccagcaatgtggatggaaagatttatcacccsctctcataaccaaacctccatcgtatctccctgcaagccttgaaactgctcactggacccactcagacaacagagctatgggatctagaaggtgaaatgtcagagctcagagaacctcagctccctcccaaccttgccataagaactcagggctggccgggcgccatggcttacgcctataatcccagcactttgggaggccgaggtgggtgaatcacctgaggtcaggagttcaagaccagcctggccaacatggtaaaaccccgtctctataaaaatacaataactacgtgggcatgg

SEQ ID NO: 184935 - DNA, 601 bp, Human
gaagccagcaatgtggatggaaagatttatcaccccctctcataaccaaacctccatcgtatctccctgcaagccttgaaactgctcactggacccactcagacaacagagctatgggatctagaaggtgaaatgtcagagctcagagaacctcagctccctcccaaccttgccataagaactcagggctggccgggcgccatggcttacgcctataatcccagcactttgggaggccgaggtgggtgaatcacctgaggtcaggagttcaagaccagcctggccaacatggtaaaacccygtctctataaaaatacaataactacgtgggcatggtggtgagcgcctgtaattccagctacttgggaggctgacgcatgagactcgcttgaacccgggaggtggaggttgcagtgagccgagattgtaccattgcactccagcctgggggatagagcaagactctgtctccaaaaaaccagttgcaagggtgaggggctttgcctctggtttatggtcagaagggcaaagcgaaggtcaccccattttccacggcttggtttcatattatagtcccacggtccctggagaatcagagtga

SEQ ID NO: 184936 - DNA, 601 bp, Human
tcgcttgagcccaggagttcaaggctgcagtgagctatgacagcaccactgcactgtagcctgggccacagagcaagaaaataaacaaacacatattggtttctagatcctaaactatatgatggaaagactaagagaccaagaatcttaggaataaaattagaagttactgcccattgaaaatcaactacatatgaaaaagtctcccccaaaatgaagaaactctggtttgagaatgtaaatcactaggtaaagattctgtttattttctttatttccatgtttcccaatatttaatttkcaaccctctaagagcagttattttataaaataagtcccagctgaaatgaatttgataggattttagaatttctttctcccttaacacatcctattagcctagttcaatagagagagcagagcgcctcatgttgaaataagctttcccgccactgaatgtgttcaaacagaaatatcacctgcttaggaggtactttccagttgccaaagacttccaccttcatcttcttgttcactctactctgcaagatgggtgggacagcattacagacgaggggtcctgtagatactgtcctgacga

SEQ ID NO: 184937 - DNA, 601 bp, Human
ctagttcaatagagagagcagagcgcctcatgttgaaataagctttcccgccactgaatgtgttcaaacagaaatatcacctgcttaggaggtactttccagttgccaaagacttccaccttcatcttcttgttcactctactctgcaagatgggtgggacagcattacagacgaggggtcctgtagatactgtcctgacgactggcccaaggccatggctaagggttacagacccggaacagaaccctgccctttgcctcccttgtgggacccaaagccaggccaaggtcaaggggaggsgctgcagggggggcttcctcattgggtgtggacagcaaaggttgattttgagatttccccccagctctaattctcagtaatttggcctttgaaacaggaggcagagagaaccctgggggatggcttttcatgttatcttttggaaacatagaagcttcaggtgcttcctggcttgaaataagagaatattctgctcagtcccccacatttttgagacactccaggcccagcagacccacagcaccctcactagctgttggtaacgttggtgcctggatgtactgacagaggaccaggtgt

SEQ ID NO: 184938 - DNA, 601 bp, Human
gtctctctgtcctttgcttctgctttgttgtatacatctgattcatttcttctttcttgaggccaactgctgttttctgctcattaatccacaaggccgaatgtggccaacaatgggtctccacttccctgtgttcaatcgccacctgctggagaaaaacttttttctttgtcccagatcgaaatttccagactggcccctttgggccagtcaatcttggcctgcagggctggctacaggatctgtgaggcccagtgagaaataaaagcgtggtagcctttattcccaaagcagggggacrtgtccatcgtggtactcagcgagcttctttgtttcttctgcagtctctttttcgacttgtcatggtgctttttattttccatttactgttgttctaagtaaagaaaactcaatgttaaattattagcaagcattttaccattcatctttatatcaaacaatgccagttttaaatgtaaatttcagagcgtttaacttatatgcagaaccactgaaattacacaattggtgtttgtgacttgttggccagaagagacaaacacaaaccaaactcataaagattggaagcaggaagacaagt

SEQ ID NO: 184939 - DNA, 601 bp, Human
tacccaggaccctgtgaagtgtggacagcaacagtggccataggtcagggcagaaagggggaagccaggtggagagcacaggcagctgagagctggtcgtgggaggcagccacaggtggagccatgcataagccaggcttccaaagcacagattcaaagataaagttacgtccgggtgcagtggctcacgcctgtaactccagcactttggaaggccgaggcaggcggatcacttgaggtcagaagttggagaccaacctggccaacatggtgaaaccccatctctactaaaaatacaaargttagccaggcatggtggcagatgcctgtaatcccagctatttgagaggctgaagcaggagaatcacttgaacccgggaggtggaggatgcagtgagccgagatcacaccactgcactccagcttgggcgacagaaaaagactctgtctcaaaaaaaaaataaataaataaaagataaagttatgaagactctcaagacagcgccacagaggattaacccccgcacagagcccttttcattggtcacttgctcagccagctgccccagtggcctgtgatgggagtgggaagtgtggggtt

SEQ ID NO: 184940 - DNA, 601 bp, Human
attcaaagataaagttacgtccgggtgcagtggctcacgcctgtaactccagcactttggaaggccgaggcaggcggatcacttgaggtcagaagttggagaccaacctggccaacatggtgaaaccccatctctactaaaaatacaaaagttagccaggcatggtggcagatgcctgtaatcccagctatttgagaggctgaagcaggagaatcacttgaacccgggaggtggaggatgcagtgagccgagatcacaccactgcactccagcttgggcgacagaaaaagactctgtctcaaaaaaaaaataaataaataaaagataaagttatgaagactctcaagacagcgccacagaggattaacccccgcacagagcccttttcattggtcacttgctcagccagctgccccagtggcctgtgatgggagtgggaagtgtggggttgggtgataaccttctaaagttagaaccgttcccagaaatgcagacgggagagctttgggaaaaccatccaaaccttgttattttttatgacaaagtaggaatgccaccctggccctctaaattcataaacagtcacagacatgggattaaa

SEQ ID NO: 184941 - DNA, 601 bp, Human
ctgcaacgtggcttataggcatcattaaacagctgcaatatgttgaatggctatgtcatcatagattagctacgatactggctatggacttcaagactccatgtgtcctggcccctgcccttccacccctctgacccgagatgcagttctaacaggttcccgggtgatgctgctgctgctgacccttgcccatcccggagctcactttgagagctggctgagatcccaggcagggtggccagtggctgctccagggctgtgaagggctccccctgcagacggaggaactaggcctcccagygcctgtaactggaacgttggcggcttgagaatggacttgccctgaaggccggcctcctgctgctctgggaaaaagagggaacagaagaaagcaatccgccaccttggggactcctcctggattagcattatctaggtgaagaaagtgagaccatcacctaccaaccagataactcattccacctctgtgggcaaactggcagagcagcaaataagcttccttaatcccagtgcgcccacaccctgctcaagagctcatgggcacgtgttcatcttcaggccaaagatggggagccaggga

SEQ ID NO: 184942 - DNA, 601 bp, Human
gtggatgatttgagggtatctcaaaacgatatttcaacacaaaagcattacaaagaatgcaattgtagacattgtccaaatgttcaagtccagaagcaaatacagaaaattccggtggcgtgattcgaactgcattgtcctcaagcacacaaggttttgggtctcagtgtggaagcaggccagtcactcaggggctctgtgccccctctccccatgccagcattaagacctgatgtgcagcccttccctgatctcctttggagcctcttgcaaactgtcatccaattctttcttttattcttttttttttttttttttgagatggagtcttgctctgttgcccaggctggagggcaatggtgtgatcttggctcactgaaacttctgcctcttgggttcaagagatcctcctgtctcagcctcccaagtaactgggattacaggtgcccgccactatgcctggctaattttttgtatttttagtagagacggggtttcaccacgttggccaggctggtctcaaactcctgacctcaggtgatctgcctgccttggcctcccaaagtgctgggattacaggcgtgagccaccaatcccagcc

SEQ ID NO: 184943 - DNA, 601 bp, Human
acattgtccaaatgttcaagtccagaagcaaatacagaaaattccggtggcgtgattcgaactgcattgtcctcaagcacacaaggttttgggtctcagtgtggaagcaggccagtcactcaggggctctgtgccccctctccccatgccagcattaagacctgatgtgcagcccttccctgatctcctttggagcctcttgcaaactgtcatccaattctttcttttattcttttttttttttttttttgagatggagtcttgctctgttgcccaggctggagggcaatggtgtgatctyggctcactgaaacttctgcctcttgggttcaagagatcctcctgtctcagcctcccaagtaactgggattacaggtgcccgccactatgcctggctaattttttgtatttttagtagagacggggtttcaccacgttggccaggctggtctcaaactcctgacctcaggtgatctgcctgccttggcctcccaaagtgctgggattacaggcgtgagccaccaatcccagccttatttttttcataattgatatccagctttcttccaaggggattgtgggaagctggtgtacatgttaa

SEQ ID NO: 184944 - DNA, 601 bp, Human
ctggtgtacatgttaaaatgaagttcaagataaagcattcagggatcaaatagaacaaaggccatttaaaggaaagaaggccttacagggccccagagctggctggtagctggggtccagctgtggcttggtgaccagggctcctggccaagagggagagcagccaagccaaacaggtgtgttctccagcaagaggacagcacagaaactgatcaatggacacagtacttcctggacctaaactcagccacgaatccatcagacaagaccttattagctgtcatgttgaataacaaagggrttaggctcttcaacatgaaaatgcggtggccgattctccactgacccgttataaacagcagagcagaaaaggaagttggtgcaggtggaccaggaagctggtgatctcacctgaggaccagacagaaactagagaacctgggtgaagtagttagaattcatctaacaggtctagagggcacgtcagaagaccatcttggccctggccttggcatactgcgtgatcgtgagcctcatgctgctccgtgcctctccttcctacgggttaaatggggacacacacctgcttggctggccctgc

SEQ ID NO: 184945 - DNA, 601 bp, Human
aaaaacagtcccggccgggtgtagtggttcacacctgtaattccagcactttgggaggcaaggagggaagatcacttgagttcaggagttcaagaccagcctgaccaacatgatgaaactctgactctactaaaaatacaaaaattagccgggcatggtggcagaaacctgtaatcccagctacaagggaggctaaggcaggagaattgcttgaatctgggaggcggaggttgcagtgagccaagatagtgccactgcactccaccctgggcggcagagcgagactctgtctcaaaaaaarcaaacaaacaaacaaaaaaaacagtcccctaaacaatgaagaataaaaaaaaaagaaaaaaaaaggccccctgccattctccatcccaatcccatcccctagagaagagaaagatagaaatttaagtattcttctagaaatgttatgttcatatacaagcatatatagtctaccctttaaaagtaaagcataaatgagattgtgccattgcccttgggtaaaatgaacaatctgatcaaatattttcctctctgggagaagaagctatcggtagagacatagacaacagggaacagattt

SEQ ID NO: 184946 - DNA, 601 bp, Human
accctatagtcacaaaagtagttgggaagggggtgggctgagaggtgcagggaggtgataaagagaagctggggctgtaattctgccctcgtcctaaaaggctctatctcatcctttaaaatcccaaatcacctgtaaccagaactttttttttttttgttttgagacggagtctcgctctgtcgctcaggtgtacagtggtgcgatctcagctcactgcaacctcctcctcccgggttcaagcgattctcgtgcctcagcctcctgagtagcagggactacaggcgcacgacaccatgcytggctaatttgggtatttttagtagagacggggtttcaccatgttggccaggctggtctccagctcctgacctcaggtgatccacacacctctgcctcccaaagtgctgggattacaggcatgagccaccacacacccggccatgaccagaactcttgagagcgtgtgctcaacactcgaagtccaaaagtctacccaagttcaggaagagagcggttcttcacctctccacctcgaattttgtttctagaatgttgcatgtaggtctgaagagtgacagcacgtttgtttaacaggaac

SEQ ID NO: 184947 - DNA, 601 bp, Human
tttgaaattgggcaagatgagtgagctgagatcgcgccactgcactccagcctgggcaacagagcgagactccatctcaaaaaaaaaaaaaaagaaattggggcaagatgtatgacataacaatttaggaatgagtgaatacaggtaggtgagttgaagggagttctgacaggtaagactgttgtctggcaagtgaactgtttgctcacgcaagcaaaccattgtcctgataggaaagtggtttgctcagacaaattagtttgcattaatttcctgaagccaacagtgaagctgtttcttsgttcagaggtttatcttcctcggcaagaattttctggagcagagaggaagtcactgacacaggtggtctcgatgctcactccaagagttgagttgtgtggctccaggtagactcatttcccagggtcacctgctgggccataatcaacaaggtacaagcttaagagagccatgccgggatttcaagttgcaaggaagagagattcaatggtgctttcttgagtcacgggtgttggttgtaagaaactggtggggtaaggaagctagaactctcccaggaaccaggaacggctctcactgg

SEQ ID NO: 184948 - DNA, 601 bp, Human
cgcatccccgcaggcgctgtgctagagatggccgtgggtgccctgcaccatgaccctgagcactggccaagcccggagaccttcaaccctgaaaggtgagtactgccccttttaaaaagctctgaagggatgtgagtgtgtgggatagaaatttaccagtggaggcagcagccgggaggcacagacttagcaaaattgtccccaaatagtcaaaagttatggcaattcagatagatgtttgcaagacataatttccaaaggaaataattataccattttttagccacgcgtggtggctcaygcctgtaatcccagcactttgggaggccaaggtgggcggatcacaaggtcaggagatggagaccatcctggctaacacggtgaaaccccatctctactaaaaatacaaaaacttagctgggcgtggtggcgggcacctgtagtcccagctacttgggaggctgaggcaggagaatggcgtgaacccaggaggcggagcttgcagtgagccgagatggtgccactacactccagcctgggtgacagagcaagactctgtctaaaaaaaaataaataaattaaataaaaataaataaataaa

SEQ ID NO: 184949 - DNA, 601 bp, Human
tgccctgcaccatgaccctgagcactggccaagcccggagaccttcaaccctgaaaggtgagtactgccccttttaaaaagctctgaagggatgtgagtgtgtgggatagaaatttaccagtggaggcagcagccgggaggcacagacttagcaaaattgtccccaaatagtcaaaagttatggcaattcagatagatgtttgcaagacataatttccaaaggaaataattataccattttttagccacgcgtggtggctcatgcctgtaatcccagcactttgggaggccaaggtgggcrgatcacaaggtcaggagatggagaccatcctggctaacacggtgaaaccccatctctactaaaaatacaaaaacttagctgggcgtggtggcgggcacctgtagtcccagctacttgggaggctgaggcaggagaatggcgtgaacccaggaggcggagcttgcagtgagccgagatggtgccactacactccagcctgggtgacagagcaagactctgtctaaaaaaaaataaataaattaaataaaaataaataaataaataaataattataccattttttcaaggtccaaactgaat

SEQ ID NO: 184950 - DNA, 601 bp, Human
agcactggccaagcccggagaccttcaaccctgaaaggtgagtactgccccttttaaaaagctctgaagggatgtgagtgtgtgggatagaaatttaccagtggaggcagcagccgggaggcacagacttagcaaaattgtccccaaatagtcaaaagttatggcaattcagatagatgtttgcaagacataatttccaaaggaaataattataccattttttagccacgcgtggtggctcatgcctgtaatcccagcactttgggaggccaaggtgggcggatcacaaggtcaggagatsgagaccatcctggctaacacggtgaaaccccatctctactaaaaatacaaaaacttagctgggcgtggtggcgggcacctgtagtcccagctacttgggaggctgaggcaggagaatggcgtgaacccaggaggcggagcttgcagtgagccgagatggtgccactacactccagcctgggtgacagagcaagactctgtctaaaaaaaaataaataaattaaataaaaataaataaataaataaataattataccattttttcaaggtccaaactgaatccagagatttagcatttcag

SEQ ID NO: 184951 - DNA, 601 bp, Human
ccaagcccggagaccttcaaccctgaaaggtgagtactgccccttttaaaaagctctgaagggatgtgagtgtgtgggatagaaatttaccagtggaggcagcagccgggaggcacagacttagcaaaattgtccccaaatagtcaaaagttatggcaattcagatagatgtttgcaagacataatttccaaaggaaataattataccattttttagccacgcgtggtggctcatgcctgtaatcccagcactttgggaggccaaggtgggcggatcacaaggtcaggagatggagaccaycctggctaacacggtgaaaccccatctctactaaaaatacaaaaacttagctgggcgtggtggcgggcacctgtagtcccagctacttgggaggctgaggcaggagaatggcgtgaacccaggaggcggagcttgcagtgagccgagatggtgccactacactccagcctgggtgacagagcaagactctgtctaaaaaaaaataaataaattaaataaaaataaataaataaataaataattataccattttttcaaggtccaaactgaatccagagatttagcatttcagcagccctg

SEQ ID NO: 184952 - DNA, 601 bp, Human
gaaaggtgagtactgccccttttaaaaagctctgaagggatgtgagtgtgtgggatagaaatttaccagtggaggcagcagccgggaggcacagacttagcaaaattgtccccaaatagtcaaaagttatggcaattcagatagatgtttgcaagacataatttccaaaggaaataattataccattttttagccacgcgtggtggctcatgcctgtaatcccagcactttgggaggccaaggtgggcggatcacaaggtcaggagatggagaccatcctggctaacacggtgaaaccccrtctctactaaaaatacaaaaacttagctgggcgtggtggcgggcacctgtagtcccagctacttgggaggctgaggcaggagaatggcgtgaacccaggaggcggagcttgcagtgagccgagatggtgccactacactccagcctgggtgacagagcaagactctgtctaaaaaaaaataaataaattaaataaaaataaataaataaataaataattataccattttttcaaggtccaaactgaatccagagatttagcatttcagcagccctgcatgcaaggaacaaggcaatttca

SEQ ID NO: 184953 - DNA, 601 bp, Human
gtcagggagcttatatcccctgctttcacactcacagcaaccctgcagagtaggagtgactattcccattctttagatgaggaatcaaagctcagagaggttaaataacttgcctaaggccacacagcaggactgcaggcttcgtgatggcagggacccagtctgtcatattcattgttggactttccagcatctagcttaatgccaggcgcatgacaggtgctcactcattcattcaacaaacattaatgagcaaatggataagcagccagagatgagagaaacgggggtcctcacccakatcctgcccactcccaagctctccctccttcctgacatctggctacgtctctgcacagcgttagctattccctgcctatcctgaccactgctgtcccctgcacctatcctcatgcttgtcctgccacccggaacccactgttcagctgcagacctggacaggcaggcataggaaggcataaggacacagttgacagatagcaacaattctagattgagacaggcagtgcctctgacagagaacctgggaccagctgctggtcctggaggaataatgagcttggatgggggacatagagtc

SEQ ID NO: 184954 - DNA, 601 bp, Human
tattcccattctttagatgaggaatcaaagctcagagaggttaaataacttgcctaaggccacacagcaggactgcaggcttcgtgatggcagggacccagtctgtcatattcattgttggactttccagcatctagcttaatgccaggcgcatgacaggtgctcactcattcattcaacaaacattaatgagcaaatggataagcagccagagatgagagaaacgggggtcctcacccagatcctgcccactcccaagctctccctccttcctgacatctggctacgtctctgcacagcrttagctattccctgcctatcctgaccactgctgtcccctgcacctatcctcatgcttgtcctgccacccggaacccactgttcagctgcagacctggacaggcaggcataggaaggcataaggacacagttgacagatagcaacaattctagattgagacaggcagtgcctctgacagagaacctgggaccagctgctggtcctggaggaataatgagcttggatgggggacatagagtctgagatactgaaagtgaacgcatccacatactctgggctggagacagggaggggcagatc

SEQ ID NO: 184955 - DNA, 601 bp, Human
cgtgtgcggggcttgtctcacttccccacgatctcaacatacagtacagcagccagaccagtctcccaaaacgctgcttatgcctggcactccccggcttaagaaccagccaggagtcaagggctccccgttcttccttgtctgctcagacaagtgctggggcctgcagctttttcagatgcctttgagggctatggctcccacaggagacacgtacagccccaagcactaagaccctggtgactctttgctgtcacattagccactggctcatcattttactcagctccagaggaaaccsaactcctcgagtaattctttggtttttcttcaaagtccccagtccaccactggctctgccttttaagctggacataggaaagctttctggatgtcagtgaggccagaccacagcacacatgagcaggaacagcatgaagctgctttccccagagcccctgggccagagggcattgctcagttactggccagaactggagagtgagatggggaggatcagcagggacggctggagtcactgaaagataggtttggggctttgctctctgctttcttcttgtgtgaccttggacaacggact

SEQ ID NO: 184956 - DNA, 601 bp, Human; identical to SEQ ID NO: 184801

SEQ ID NO: 184957 - DNA, 601 bp, Human; identical to SEQ ID NO: 184802

SEQ ID NO: 184958 - DNA, 601 bp, Human; identical to SEQ ID NO: 184803

SEQ ID NO: 184959 - DNA, 601 bp, Human; identical to SEQ ID NO: 184804

SEQ ID NO: 184960 - DNA, 601 bp, Human; identical to SEQ ID NO: 184805

SEQ ID NO: 184961 - DNA, 601 bp, Human; identical to SEQ ID NO: 184806

SEQ ID NO: 184962 - DNA, 601 bp, Human; identical to SEQ ID NO: 184807

SEQ ID NO: 184963 - DNA, 601 bp, Human; identical to SEQ ID NO: 184808

SEQ ID NO: 184964 - DNA, 601 bp, Human; identical to SEQ ID NO: 184809

SEQ ID NO: 184965 - DNA, 601 bp, Human; identical to SEQ ID NO: 184810

SEQ ID NO: 184966 - DNA, 601 bp, Human; identical to SEQ ID NO: 184811

SEQ ID NO: 184967 - DNA, 601 bp, Human; identical to SEQ ID NO: 184812

SEQ ID NO: 184968 - DNA, 601 bp, Human; identical to SEQ ID NO: 184813

SEQ ID NO: 184969 - DNA, 601 bp, Human; identical to SEQ ID NO: 184814

SEQ ID NO: 184970 - DNA, 601 bp, Human; identical to SEQ ID NO: 184815

SEQ ID NO: 184971 - DNA, 601 bp, Human; identical to SEQ ID NO: 184816

SEQ ID NO: 184972 - DNA, 601 bp, Human; identical to SEQ ID NO: 184817

SEQ ID NO: 184973 - DNA, 601 bp, Human; identical to SEQ ID NO: 184818

SEQ ID NO: 184974 - DNA, 601 bp, Human; identical to SEQ ID NO: 184819

SEQ ID NO: 184975 - DNA, 601 bp, Human; identical to SEQ ID NO: 184820

SEQ ID NO: 184976 - DNA, 601 bp, Human; identical to SEQ ID NO: 184821

SEQ ID NO: 184977 - DNA, 601 bp, Human; identical to SEQ ID NO: 184822

SEQ ID NO: 184978 - DNA, 601 bp, Human; identical to SEQ ID NO: 184823

SEQ ID NO: 184979 - DNA, 601 bp, Human; identical to SEQ ID NO: 184824

SEQ ID NO: 184980 - DNA, 601 bp, Human; identical to SEQ ID NO: 184825

SEQ ID NO: 184981 - DNA, 601 bp, Human; identical to SEQ ID NO: 184826

SEQ ID NO: 184982 - DNA, 601 bp, Human; identical to SEQ ID NO: 184827

SEQ ID NO: 184983 - DNA, 601 bp, Human; identical to SEQ ID NO: 184828

SEQ ID NO: 184984 - DNA, 601 bp, Human; identical to SEQ ID NO: 184829

SEQ ID NO: 184985 - DNA, 601 bp, Human; identical to SEQ ID NO: 184830

SEQ ID NO: 184986 - DNA, 601 bp, Human; identical to SEQ ID NO: 184831

SEQ ID NO: 184987 - DNA, 601 bp, Human; identical to SEQ ID NO: 184832

SEQ ID NO: 184988 - DNA, 601 bp, Human; identical to SEQ ID NO: 184833

SEQ ID NO: 184989 - DNA, 601 bp, Human; identical to SEQ ID NO: 184834

SEQ ID NO: 184990 - DNA, 601 bp, Human; identical to SEQ ID NO: 184835

SEQ ID NO: 184991 - DNA, 601 bp, Human; identical to SEQ ID NO: 184836

SEQ ID NO: 184992 - DNA, 601 bp, Human; identical to SEQ ID NO: 184837

SEQ ID NO: 184993 - DNA, 601 bp, Human; identical to SEQ ID NO: 184838

SEQ ID NO: 184994 - DNA, 601 bp, Human; identical to SEQ ID NO: 184839

SEQ ID NO: 184995 - DNA, 601 bp, Human; identical to SEQ ID NO: 184840

SEQ ID NO: 184996 - DNA, 601 bp, Human; identical to SEQ ID NO: 184841

SEQ ID NO: 184997 - DNA, 601 bp, Human; identical to SEQ ID NO: 184842

SEQ ID NO: 184998 - DNA, 601 bp, Human; identical to SEQ ID NO: 184843

SEQ ID NO: 184999 - DNA, 601 bp, Human; identical to SEQ ID NO: 184844

SEQ ID NO: 185000 - DNA, 601 bp, Human; identical to SEQ ID NO: 184845

SEQ ID NO: 185001 - DNA, 601 bp, Human; identical to SEQ ID NO: 184846

SEQ ID NO: 185002 - DNA, 601 bp, Human; identical to SEQ ID NO: 184847

SEQ ID NO: 185003 - DNA, 601 bp, Human; identical to SEQ ID NO: 184848

SEQ ID NO: 185004 - DNA, 601 bp, Human; identical to SEQ ID NO: 184849

SEQ ID NO: 185005 - DNA, 601 bp, Human; identical to SEQ ID NO: 184850

SEQ ID NO: 185006 - DNA, 601 bp, Human; identical to SEQ ID NO: 184851

SEQ ID NO: 185007 - DNA, 601 bp, Human; identical to SEQ ID NO: 184852

SEQ ID NO: 185008 - DNA, 601 bp, Human; identical to SEQ ID NO: 184853

SEQ ID NO: 185009 - DNA, 601 bp, Human; identical to SEQ ID NO: 184854

SEQ ID NO: 185010 - DNA, 601 bp, Human; identical to SEQ ID NO: 184855

SEQ ID NO: 185011 - DNA, 601 bp, Human; identical to SEQ ID NO: 184856

SEQ ID NO: 185012 - DNA, 601 bp, Human; identical to SEQ ID NO: 184857

SEQ ID NO: 185013 - DNA, 601 bp, Human; identical to SEQ ID NO: 184858

SEQ ID NO: 185014 - DNA, 601 bp, Human; identical to SEQ ID NO: 184859

SEQ ID NO: 185015 - DNA, 601 bp, Human; identical to SEQ ID NO: 184860

SEQ ID NO: 185016 - DNA, 601 bp, Human; identical to SEQ ID NO: 184861

SEQ ID NO: 185017 - DNA, 601 bp, Human; identical to SEQ ID NO: 184862

SEQ ID NO: 185018 - DNA, 601 bp, Human; identical to SEQ ID NO: 184863

SEQ ID NO: 185019 - DNA, 601 bp, Human; identical to SEQ ID NO: 184864

SEQ ID NO: 185020 - DNA, 601 bp, Human; identical to SEQ ID NO: 184865

SEQ ID NO: 185021 - DNA, 601 bp, Human; identical to SEQ ID NO: 184866

SEQ ID NO: 185022 - DNA, 601 bp, Human; identical to SEQ ID NO: 184867

SEQ ID NO: 185023 - DNA, 601 bp, Human; identical to SEQ ID NO: 184868

SEQ ID NO: 185024 - DNA, 601 bp, Human; identical to SEQ ID NO: 184869

SEQ ID NO: 185025 - DNA, 601 bp, Human; identical to SEQ ID NO: 184870

SEQ ID NO: 185026 - DNA, 601 bp, Human; identical to SEQ ID NO: 184871

SEQ ID NO: 185027 - DNA, 601 bp, Human; identical to SEQ ID NO: 184872

SEQ ID NO: 185028 - DNA, 601 bp, Human; identical to SEQ ID NO: 184873

SEQ ID NO: 185029 - DNA, 601 bp, Human; identical to SEQ ID NO: 184874

SEQ ID NO: 185030 - DNA, 601 bp, Human; identical to SEQ ID NO: 184875

SEQ ID NO: 185031 - DNA, 601 bp, Human; identical to SEQ ID NO: 184876

SEQ ID NO: 185032 - DNA, 601 bp, Human; identical to SEQ ID NO: 184877

SEQ ID NO: 185033 - DNA, 601 bp, Human; identical to SEQ ID NO: 184878

SEQ ID NO: 185034 - DNA, 601 bp, Human; identical to SEQ ID NO: 184879

SEQ ID NO: 185035 - DNA, 601 bp, Human; identical to SEQ ID NO: 184880

SEQ ID NO: 185036 - DNA, 601 bp, Human; identical to SEQ ID NO: 184881

SEQ ID NO: 185037 - DNA, 601 bp, Human; identical to SEQ ID NO: 184882

SEQ ID NO: 185038 - DNA, 601 bp, Human; identical to SEQ ID NO: 184883

SEQ ID NO: 185039 - DNA, 601 bp, Human; identical to SEQ ID NO: 184884

SEQ ID NO: 185040 - DNA, 601 bp, Human; identical to SEQ ID NO: 184885

SEQ ID NO: 185041 - DNA, 601 bp, Human; identical to SEQ ID NO: 184886

SEQ ID NO: 185042 - DNA, 601 bp, Human; identical to SEQ ID NO: 184887

SEQ ID NO: 185043 - DNA, 601 bp, Human; identical to SEQ ID NO: 184888

SEQ ID NO: 185044 - DNA, 601 bp, Human; identical to SEQ ID NO: 184889

SEQ ID NO: 185045 - DNA, 601 bp, Human; identical to SEQ ID NO: 184890

SEQ ID NO: 185046 - DNA, 601 bp, Human; identical to SEQ ID NO: 184891

SEQ ID NO: 185047 - DNA, 601 bp, Human; identical to SEQ ID NO: 184892

SEQ ID NO: 185048 - DNA, 601 bp, Human; identical to SEQ ID NO: 184893

SEQ ID NO: 185049 - DNA, 601 bp, Human; identical to SEQ ID NO: 184894

SEQ ID NO: 185050 - DNA, 601 bp, Human; identical to SEQ ID NO: 184895

SEQ ID NO: 185051 - DNA, 601 bp, Human; identical to SEQ ID NO: 184896

SEQ ID NO: 185052 - DNA, 601 bp, Human; identical to SEQ ID NO: 184897

SEQ ID NO: 185053 - DNA, 601 bp, Human; identical to SEQ ID NO: 184898

SEQ ID NO: 185054 - DNA, 601 bp, Human; identical to SEQ ID NO: 184899

SEQ ID NO: 185055 - DNA, 601 bp, Human; identical to SEQ ID NO: 184900

SEQ ID NO: 185056 - DNA, 601 bp, Human; identical to SEQ ID NO: 184901

SEQ ID NO: 185057 - DNA, 601 bp, Human; identical to SEQ ID NO: 184902

SEQ ID NO: 185058 - DNA, 601 bp, Human; identical to SEQ ID NO: 184903

SEQ ID NO: 185059 - DNA, 601 bp, Human; identical to SEQ ID NO: 184904

SEQ ID NO: 185060 - DNA, 601 bp, Human; identical to SEQ ID NO: 184905

SEQ ID NO: 185061 - DNA, 601 bp, Human; identical to SEQ ID NO: 184906

SEQ ID NO: 185062 - DNA, 601 bp, Human; identical to SEQ ID NO: 184907

SEQ ID NO: 185063 - DNA, 601 bp, Human; identical to SEQ ID NO: 184908

SEQ ID NO: 185064 - DNA, 601 bp, Human; identical to SEQ ID NO: 184909

SEQ ID NO: 185065 - DNA, 601 bp, Human; identical to SEQ ID NO: 184910

SEQ ID NO: 185066 - DNA, 601 bp, Human; identical to SEQ ID NO: 184911

SEQ ID NO: 185067 - DNA, 601 bp, Human; identical to SEQ ID NO: 184912

SEQ ID NO: 185068 - DNA, 601 bp, Human; identical to SEQ ID NO: 184913

SEQ ID NO: 185069 - DNA, 601 bp, Human; identical to SEQ ID NO: 184914

SEQ ID NO: 185070 - DNA, 601 bp, Human; identical to SEQ ID NO: 184915

SEQ ID NO: 185071 - DNA, 601 bp, Human; identical to SEQ ID NO: 184916

SEQ ID NO: 185072 - DNA, 601 bp, Human; identical to SEQ ID NO: 184917

SEQ ID NO: 185073 - DNA, 601 bp, Human; identical to SEQ ID NO: 184918

SEQ ID NO: 185074 - DNA, 601 bp, Human; identical to SEQ ID NO: 184919

SEQ ID NO: 185075 - DNA, 601 bp, Human; identical to SEQ ID NO: 184920

SEQ ID NO: 185076 - DNA, 601 bp, Human; identical to SEQ ID NO: 184921

SEQ ID NO: 185077 - DNA, 601 bp, Human; identical to SEQ ID NO: 184922

SEQ ID NO: 185078 - DNA, 601 bp, Human; identical to SEQ ID NO: 184923

SEQ ID NO: 185079 - DNA, 601 bp, Human; identical to SEQ ID NO: 184924

SEQ ID NO: 185080 - DNA, 601 bp, Human; identical to SEQ ID NO: 184925

SEQ ID NO: 185081 - DNA, 601 bp, Human; identical to SEQ ID NO: 184926

SEQ ID NO: 185082 - DNA, 601 bp, Human; identical to SEQ ID NO: 184927

SEQ ID NO: 185083 - DNA, 601 bp, Human; identical to SEQ ID NO: 184928

SEQ ID NO: 185084 - DNA, 601 bp, Human; identical to SEQ ID NO: 184929

SEQ ID NO: 185085 - DNA, 601 bp, Human; identical to SEQ ID NO: 184930

SEQ ID NO: 185086 - DNA, 601 bp, Human; identical to SEQ ID NO: 184931

SEQ ID NO: 185087 - DNA, 601 bp, Human; identical to SEQ ID NO: 184932

SEQ ID NO: 185088 - DNA, 601 bp, Human; identical to SEQ ID NO: 184933

SEQ ID NO: 185089 - DNA, 601 bp, Human; identical to SEQ ID NO: 184934

SEQ ID NO: 185090 - DNA, 601 bp, Human; identical to SEQ ID NO: 184935

SEQ ID NO: 185091 - DNA, 601 bp, Human; identical to SEQ ID NO: 184936

SEQ ID NO: 185092 - DNA, 601 bp, Human; identical to SEQ ID NO: 184937

SEQ ID NO: 185093 - DNA, 601 bp, Human; identical to SEQ ID NO: 184938

SEQ ID NO: 185094 - DNA, 601 bp, Human; identical to SEQ ID NO: 184939

SEQ ID NO: 185095 - DNA, 601 bp, Human; identical to SEQ ID NO: 184940

SEQ ID NO: 185096 - DNA, 601 bp, Human; identical to SEQ ID NO: 184941

SEQ ID NO: 185097 - DNA, 601 bp, Human; identical to SEQ ID NO: 184942

SEQ ID NO: 185098 - DNA, 601 bp, Human; identical to SEQ ID NO: 184943

SEQ ID NO: 185099 - DNA, 601 bp, Human; identical to SEQ ID NO: 184944

SEQ ID NO: 185100 - DNA, 601 bp, Human; identical to SEQ ID NO: 184945

SEQ ID NO: 185101 - DNA, 601 bp, Human; identical to SEQ ID NO: 184946

SEQ ID NO: 185102 - DNA, 601 bp, Human; identical to SEQ ID NO: 184947

SEQ ID NO: 185103 - DNA, 601 bp, Human; identical to SEQ ID NO: 184948

SEQ ID NO: 185104 - DNA, 601 bp, Human; identical to SEQ ID NO: 184949

SEQ ID NO: 185105 - DNA, 601 bp, Human; identical to SEQ ID NO: 184950

SEQ ID NO: 185106 - DNA, 601 bp, Human; identical to SEQ ID NO: 184951

SEQ ID NO: 185107 - DNA, 601 bp, Human; identical to SEQ ID NO: 184952

SEQ ID NO: 185108 - DNA, 601 bp, Human; identical to SEQ ID NO: 184953

SEQ ID NO: 185109 - DNA, 601 bp, Human; identical to SEQ ID NO: 184954

SEQ ID NO: 185110 - DNA, 601 bp, Human; identical to SEQ ID NO: 184955

SEQ ID NO: 185111 - DNA, 601 bp, Human
agtctcagtagtagaaaccgcaataacagtacctggcatttactaagcattcagcaaggggcacctgcgaggtagttaataaccaacatcttgtttagtcttgttgacctcccattgaaccgcctctcttgggaggtgggggatgtgcttagggttaccccatgtaagcggtggggtggggatttgaagggacggtccagattccatgacattcaacaagttatttgactagataaaacagccaattcaaacagcagaggtccacaatcggttagtattaaataaacgtatctgctatgcytatgttttagttttagaaattttcaaataattatcagcaatatgacttaaaaaaaaaaaaaaaaaaaaacaggccgaggcgggcggatcacttgagggtcaggagtttgagaccagcctcaccaacatggtgaaactccgtctccaccaaaaaaatacaaaaaaaaaaaaaaaaaacaaattagctgggcatggtggcttgcgcctgtaatcccagctacttgggagactaaggcacgagaatcgcttgaacccgggaggcagaggttgcaggagcagagatcgcgccattgcactccag

SEQ ID NO: 185112 - DNA, 601 bp, Human
agtattaaaaaataactgtgcttgttcaaatgctcataactaattaaaaaaaaaaaacagactgaaaactcaaggccacagacttttaagcctaatactccctcacagagtctcagtagtagaaaccgcaataacagtacctggcatttactaagcattcagcaaggggcacctgcgaggtagttaataaccaacatcttgtttagtcttgttgacctcccattgaaccgcctctcttgggaggtgggggatgtgcttagggttaccccatgtaagcggtggggtggggatttgaagggasggtccagattccatgacattcaacaagttatttgactagataaaacagccaattcaaacagcagaggtccacaatcggttagtattaaataaacgtatctgctatgcttatgttttagttttagaaattttcaaataattatcagcaatatgacttaaaaaaaaaaaaaaaaaaaaacaggccgaggcgggcggatcacttgagggtcaggagtttgagaccagcctcaccaacatggtgaaactccgtctccaccaaaaaaatacaaaaaaaaaaaaaaaaaacaaattagctgggcat

SEQ ID NO: 185113 - DNA, 601 bp, Human
gctgtagtcaacatcaatactaaacatagtattaaaaaataactgtgcttgttcaaatgctcataactaattaaaaaaaaaaaacagactgaaaactcaaggccacagacttttaagcctaatactccctcacagagtctcagtagtagaaaccgcaataacagtacctggcatttactaagcattcagcaaggggcacctgcgaggtagttaataaccaacatcttgtttagtcttgttgacctcccattgaaccgcctctcttgggaggtgggggatgtgcttagggttaccccatgtragcggtggggtggggatttgaagggacggtccagattccatgacattcaacaagttatttgactagataaaacagccaattcaaacagcagaggtccacaatcggttagtattaaataaacgtatctgctatgcttatgttttagttttagaaattttcaaataattatcagcaatatgacttaaaaaaaaaaaaaaaaaaaaacaggccgaggcgggcggatcacttgagggtcaggagtttgagaccagcctcaccaacatggtgaaactccgtctccaccaaaaaaatacaaaaaaa

SEQ ID NO: 185114 - DNA, 601 bp, Human
tggctaatttttttgtatttttagtagagacagggtttcaccatattggccagactggtctcgaactcctgacttcaggcaatccgcctgccttggcctcccaaagttctgggattacaggcatgagccatcgcgcccgggtgatgctgtcttacctaggaaaagctgagagaaaatcttggggcaaaggtccactaagtgaaagttaaaaggtggggcagcagtaaggtggaggaaaaaaaaattatagaccccatgctcagaaaggactatcttagaataaaagagtatcaaccctatrtaatatttcttggccaatctcaattaaattgctattcaggaaatctagaattttctaacatgctttgcaaattatttctgactttttttctttttttttcaagacagagccttgctcttgtcgcccaggctggagtgcagtgacacaatctcagctcactgcaacttccgccttccgggttcaagtgattctcctgcctcagcatcctgagtagctgggattacaggcgcccaccaccacgcccggctaatttttgtacttttagtagagacagggttttgccatgttggccaggctggt

SEQ ID NO: 185115 - DNA, 601 bp, Human
ttcctgatgctcctcccacttagcccaactccaaacttttactgtaactatcatttgaaattaaaacacacacacacacacacattatgtataatttttttggcttatcaagaaaaaaaaccacattatgtataaaatcatcaacaaagatcagagccatatactacacctacatttggaggccagtgcagaattcaaatacctttaccacaggtcaaaaatatgaaaccccatgccttgagaggaaaacacacaaaacagctgaaaagcttaaacaaattcatggttcacgccaccaccrttcaacagaagtaaagaataaatgtaaagaatgttcctgtaaggatgatgtcacggaaggcatttttcacattcagctaagaaactcctggacagtaatgtatgtccaagtcagacattgggctagacaggccactagcccaatctggactccactttgtataaagagtgaaacagagagggcttcaagtcattcgttcccattcctttaatcaaccaacaccaaaacaacactattaaaatagttgtggccgggcgcagtggctcgggcctgtaattccatcactttgggaggccaaag

SEQ ID NO: 185116 - DNA, 601 bp, Human
gactgaccaacacagcgaaactgcatctctattaaaaatacaaaaaattagctgagtgtggtggcaggcgcctgtaatcccagctactcaggaggctgaggcagaagtatcgcttgaggccacggggtagaggttgcagtgagctgagatcgcatcactgcactccagcctgagcaacagagcgagactctctgactcaaaaaacaaaaaaaagtatgtagatcttaaggacaaggcagtagaatttagtaactgtcaaatatatattcctacttattgaataaattaaagacctcgcatraaggtcctcgatttacactgacaaacaaggtatggggattctgtaacggtaggccttatatataactgcgttaactatgcagataaaatctgtccagaaaaatacaccactagagtagtgcagtgctaaataaacacaaaacccaatctaaaattatgatgttctactaccaatatctgacttcacaatcaatgtaaagaaagctagccataagccaggcacggtggctcatgcctgtaatcctagcactttaggagggcaaggtgggcggactgtctgaccttaggagttcaagaccag

SEQ ID NO: 185117 - DNA, 601 bp, Human
gccaagagaactttttacttactttttgaggagagtagggtaaactttagtgttacttcctgaaatctataaaccaaaacttaaaagcacaatcaacaaatctagaaacgctaggaatttcctcacgttaaaaaaataaaagatccaagaagctcaaaaaataacaactttctgcactgccttcttttaaagacacgttgatctcaggacagaaaagccaaactcttccaatgacaattacaattgcaaaccaaaatacagagcatatattgctgtctaaaagtgagtagatcttggccasgcgcagtggctcttccctgtaatcccagcaagaggccaaggcgggtggatcacttcaggccaggagttcgagaccagactgaccaacacagcgaaactgcatctctattaaaaatacaaaaaattagctgagtgtggtggcaggcgcctgtaatcccagctactcaggaggctgaggcagaagtatcgcttgaggccacggggtagaggttgcagtgagctgagatcgcatcactgcactccagcctgagcaacagagcgagactctctgactcaaaaaacaaaaaaaagtatgtagatc

SEQ ID NO: 185118 - DNA, 601 bp, Human
gccctgtcctgtagaaataaccacaatgaaagcaaataacttatgttgctattatgttcttcatttttccattaagagaactttaagacggagtcttggctctgtcttccaggctggagcccaatggtgcaatcctggcttaccacaacctctgcctgctgggttcgaacaattctcctgcctcagcctcccaagtagctgggactacacgtaagcaccaccacatccagctaatttttttttgttgttgtattttcagtagagacagggttttgccatgttggccagactggtctcgaaytcctgacctcaggagatccaccccatcggcctcccaaagtgctggggttacaggcgtgagccaccacgcccagccaagagaactttttacttactttttgaggagagtagggtaaactttagtgttacttcctgaaatctataaaccaaaacttaaaagcacaatcaacaaatctagaaacgctaggaatttcctcacgttaaaaaaataaaagatccaagaagctcaaaaaataacaactttctgcactgccttcttttaaagacacgttgatctcaggacagaaaagccaaactcttc

SEQ ID NO: 185119 - DNA, 601 bp, Human
ggcctttccctcatgaagaatggaagccgtatttggccacaagtcttgactgatactgctggagaatttctggtagttactacttctttggaatttctaactttatataattaactgctcagttcaacctcttttcaatcatcgagcaatgtcatcactctaggaaacgaacatgagtcggctggaagaaagttcatgccatttctacattggatttccccctagctcatgatgctacaattttttttaacctatctgtgcttcccctgccctgtcctgtagaaataaccacaatgaaagyaaataacttatgttgctattatgttcttcatttttccattaagagaactttaagacggagtcttggctctgtcttccaggctggagcccaatggtgcaatcctggcttaccacaacctctgcctgctgggttcgaacaattctcctgcctcagcctcccaagtagctgggactacacgtaagcaccaccacatccagctaatttttttttgttgttgtattttcagtagagacagggttttgccatgttggccagactggtctcgaattcctgacctcaggagatccaccccatcggcct

SEQ ID NO: 185120 - DNA, 601 bp, Human
gaatgcaatcatcacatgaaattatgcgtgtgataactgtcattattaaagcagctctggaaatgtacagcaaaagagctaacatttctagagctgaaaaaaatatttttaggccaggcatggtggctcatgcctgtaatcctagcactttgggaggctgaggtgggtggatcgcttgagcccaggagttcaagaccagctgggccaacatggagaaacccgttctctactaaaaatacaaaaattaggtgggtgtggcggtgtgcagcagtagtctcagctacttggggggctgaggcasgaggatcacttgaacccaggagggaggtcaaggctgcagtgaaacaagattgcaccagtgcatccagtctgagggacaaagtgagaccctgtctcaaaaaaataaatttttttaaattaaaaaataaaagcctggtgcagtggcttaggcctgtaatcccagcacaggaggctataatcccagcacaggggcctgaggtgggaggatcgctgagcccaggagttcaagaccagcctgggcaacatagggagaccttgtttccacaaaaaattcaaaaataagtggtggctcttgcctgta

SEQ ID NO: 185121 - DNA, 601 bp, Human
acatacttagcattaaagaaaatgttttctataaccctttatcaccacatacacattggtaccctgaaatttaaagtaaacaaactagaatttctcagaaagatagagtcaggagccatcacattctgtttaggtacccggtgttagcattaatagtcaagaaacagttgtcacctagctacaagactcaagagaaacaagattttaaaacttcacgtctcttctgtgaacatctgtagagcctctcatcaagaatcttaagtttgatcctgaagatattttctttttttcttttttttcttttttttttttttttgagaccgagtctcgtgctgtcgccccagctggagtgcagtgcagaggcaccatcttggctcactgcaacctctgcctcccaggttcaagcgattctcctgcctcagcctcccaagtagctgggattacagctgtccaccaccacgcctggataatttttttgtatttttagtagagatgggttttcgccatgttggccaggctggtctcgaactcctgacctcaagtgatccgcccacctggacctcccaaagtgctgggattacaggctggagccaccacaccc

SEQ ID NO: 185122 - DNA, 601 bp, Human
tgggattacaggcacccgccaccacacctggctaattttttgtatttttagtagagatggggtttcatcacgttgaccatgctggtctcgaactcctgaccctcagttgatccacccgcctcagtctcccaaagtgctgagatcaccacccccagccctattttttaaaagcctaatataccttataattaggtttcagtgaatgtttaagaaaaaattagtatctgttcatatgaggattaaagatggctttacagcaaaacaaatggtcaaagaaatgtgaaacccgtaacacaaacargttaattcccaatttaagatacttacacagtagggatatattctccaggaaatgcattggttgtgtaactgatcagtaggcaagttttacctacagctctaaagagaaagagaaaaaaggttgcttagtcaacatgaatgtaatcttagctttcactattaagttaaaataatttctagagaaaaaaaatcaaggcatatacatcacatacttagcattaaagaaaatgttttctataaccctttatcaccacatacacattggtaccctgaaatttaaagtaaacaaactagaatttct

SEQ ID NO: 185123 - DNA, 601 bp, Human
cctacacctcaatgcggacatgtaaccaactgatgacttatcagaaaaggccaattaaaacgtaatggaatctttccctttccagttcccagaaagccagtgtatctgaaactcgtgcactgacaaggactgtttctgatcagacttttggtcagagttcttgtgtccaactatggttttctttaacatcatccagtctctgtacctcacagacagttaaagtttgctttctggatgtctaaaaatcaactagcaaagttgtgaaaagtttatattaccctaagtttctttttttttttttttttgagatggagtttcgctctcattgcccaggctggagtgcagtggcgtgatcttggctcactgcaacctccgcctccacggttcgagtgattctcctgcctcagcctcccaagtatgtgggattacaggcacccgccaccacacctggctaattttttgtatttttagtagagatggggtttcatcacgttgaccatgctggtctcgaactcctgaccctcagttgatccacccgcctcagtctcccaaagtgctgagatcaccacccccagccctattttttaaaagcctaatatac

SEQ ID NO: 185124 - DNA, 601 bp, Human
tcgcatcacagcactccatcctgggcaagagagagagactaactccaaaaaaaaaaaaaaaaaaggaaaacaacaacaacaacaacaaaaacatgggtacgacacttcagagagcacctgggtgtgtgttgtgcctgaggaggtgaacacaggtggggaggaggcgacacctccccagcctgcacagggaggactcacagcagctgcaggatggtgcattatgaggctcagctacgtgcgctcccgggtaacccatcaccagagcagcactttcctgtctccacccaattctgctgcctayagggagtaagcaattcaatagccaattccaccctcccattcccccttcaacacacacacccaagtttcaattccaaagccctacacctcaatgcggacatgtaaccaactgatgacttatcagaaaaggccaattaaaacgtaatggaatctttccctttccagttcccagaaagccagtgtatctgaaactcgtgcactgacaaggactgtttctgatcagacttttggtcagagttcttgtgtccaactatggttttctttaacatcatccagtctctgtacctcacagacagttaaa

SEQ ID NO: 185125 - DNA, 601 bp, Human
acctcagtgatccgcccagctcagcctccccaagtgctgggattacaggcgtgagcaaacttttttaattaaaaaaaaaaaaaattcaaaagattttaaccacatctgtgattggaaatgaaaacggttagataacttcaacccacgttaatggcagtgtgtactaagaggccacttaagtcaaggccagcaaagtgacagctttatagacagcaatttggtagttatctaccaaaaaataattttttaattttttttttttttgggagacagagtctcactctgttacccaggctgaagwgcagtggcacaatcttggctcactgcaacctctgcttcccgggttcaagcaattctcatgcctcagcctcctgagtagctgggactacaggagtgcaccaccacacccggctaactactgtatttttagcagaggtgggggttttaacatgttggccaggttggtctcgaactcctgacctcaagtgatccttccgtcttggcctcccaaagtgctgggattacaggcgtgagcaatcacgcccagctgtatctaccaaaatttaaaacatccattgtcttttgatttggcacgattttg

SEQ ID NO: 185126 - DNA, 601 bp, Human
tagtagagacagggtttcaccatcttggccaagttggtctcaaactccttacctcagtgatccgcccagctcagcctccccaagtgctgggattacaggcgtgagcaaacttttttaattaaaaaaaaaaaaaattcaaaagattttaaccacatctgtgattggaaatgaaaacggttagataacttcaacccacgttaatggcagtgtgtactaagaggccacttaagtcaaggccagcaaagtgacagctttatagacagcaatttggtagttatctaccaaaaaataattttttaattttttttttttttgggagacagagtctcactctgttacccaggctgaagtgcagtggcacaatcttggctcactgcaacctctgcttcccgggttcaagcaattctcatgcctcagcctcctgagtagctgggactacaggagtgcaccaccacacccggctaactactgtatttttagcagaggtgggggttttaacatgttggccaggttggtctcgaactcctgacctcaagtgatccttccgtcttggcctcccaaagtgctgggattacaggcgtgagcaatcacgcccagctgt

SEQ ID NO: 185127 - DNA, 601 bp, Human
aaagaagaagaagaaagaaaaggtgtgatggtgatggacatgttaattatatttccataagaaaaaaattattggataaatagtattgtgactttttttccccataagggaaaaagaatcaggtccttgcctcattctataccaaaaataagtcctaaatgaattaaagataaaaattttagccacaaaaatcctagaaaaaaatactagagcatacttttgcattatttaagtaggaaaggcctttctaagtacaacatacaattctgagggagaggtggtattatcattattattattwttttttttttgagacagaatctcactgtcacccaggctggagtgcagtggtgcgatctcggctcactgcaacctccacctcctgggttcaagtgattctcctgcctcagcctcctgaggagctgggattacaggtgcacgccaccatgcccggttaatttttgtatttttagtagagatggggtttcaccatgttgatcaggctggtcttgatctcctgacctcataatgcgcccacctcagcttcccaaagtgctggaattacaggtgtgagccaccgtgcccgggtaaggtggtatta

SEQ ID NO: 185128 - DNA, 601 bp, Human
aaaaaagaagaagaagaaagaaaaggtgtgatggtgatggacatgttaattatatttccataagaaaaaaattattggataaatagtattgtgactttttttccccataagggaaaaagaatcaggtccttgcctcattctataccaaaaataagtcctaaatgaattaaagataaaaattttagccacaaaaatcctagaaaaaaatactagagcatacttttgcattatttaagtaggaaaggcctttctaagtacaacatacaattctgagggagaggtggtattatcattattattwttattttttttttgagacagaatctcactgtcacccaggctggagtgcagtggtgcgatctcggctcactgcaacctccacctcctgggttcaagtgattctcctgcctcagcctcctgaggagctgggattacaggtgcacgccaccatgcccggttaatttttgtatttttagtagagatggggtttcaccatgttgatcaggctggtcttgatctcctgacctcataatgcgcccacctcagcttcccaaagtgctggaattacaggtgtgagccaccgtgcccgggtaaggtggta

SEQ ID NO: 185129 - DNA, 601 bp, Human
aagacacattaaaagtcagctgcaatccttactgtttgcggataggatagggggcgtaatctgtcataatcttcttgtccagctgtatcccataagcccagattcaccggttttccatctaccataacattggcagaataattgtcaaagctgtagaatggaatgaaaatggttagtcacaggtgtagaagctaagtcactgtcccagccatcctagagaaggtgtgccaagaaaaaggctggggacgggcctggaggctgccacaccagcaaatgtccctgcaggcacaaggaggaaggmggcacgggcaaaacttgcgggaaacaaaccaaacccaacccaaaacttaagagaaatgaaagaaacaaacaacaagctatttaagtgaaacaaatcaccgtcagaaataaaaacattttactttaaacaaagtttaagacttttatccccagaagaaataagggtacaattagccccgctttcaaatcctacttgttgggtttttcatgtacttatgttgctcattttcagcaagagagctagctggccactagagctaccctctgcagggtttccagaaggcctgagtgtagagcagtc

SEQ ID NO: 185130 - DNA, 601 bp, Human
gcaaacctgccttcaaactaattggtgttaaaaactggtttgcaaaaacaaaaagtagctctttcatacggttattctaaagctaaatggaagactgtaaaatgcccaacaatggaacagctggtaacgctcaaaacacaaaacccctgggcttgcatctagggggatgtttacatggaaccaatcccaccctgtttgctatttactcaatacccaaatgatggcaatataagcaagtccataggtaacatgcactaattaagcgctcgagaattatatactctaaaagacacattaaaartcagctgcaatccttactgtttgcggataggatagggggcgtaatctgtcataatcttcttgtccagctgtatcccataagcccagattcaccggttttccatctaccataacattggcagaataattgtcaaagctgtagaatggaatgaaaatggttagtcacaggtgtagaagctaagtcactgtcccagccatcctagagaaggtgtgccaagaaaaaggctggggacgggcctggaggctgccacaccagcaaatgtccctgcaggcacaaggaggaaggcggcacgggcaaaac

SEQ ID NO: 185131 - DNA, 601 bp, Human
tgatacagaagcaaaagtaaacttttttttctgattagacacagtggatacattttacaaaaccaaaacttcaatctacattgaataaatttaggttctattgtatggttcacaaaatccatacaaattatgtattttgtgggaaaaaatgtattaaacctgtgagattagttactaacttggtttaaagaaacctgaatcttaactgcctaatttgattctgtggtacaaaaatgtcacacagcaaacctgccttcaaactaattggtgttaaaaactggtttgcaaaaacaaaaagtasctctttcatacggttattctaaagctaaatggaagactgtaaaatgcccaacaatggaacagctggtaacgctcaaaacacaaaacccctgggcttgcatctagggggatgtttacatggaaccaatcccaccctgtttgctatttactcaatacccaaatgatggcaatataagcaagtccataggtaacatgcactaattaagcgctcgagaattatatactctaaaagacacattaaaagtcagctgcaatccttactgtttgcggataggatagggggcgtaatctgtcataatct

SEQ ID NO: 185132 - DNA, 601 bp, Human
aggaaacaggcaaagactggagagaggatgaagcctgcctgaagtcacagagctaggacatgcacacaggttatcaacccaaggaatctcaagcatatttaacttttgcttccaaagatacttttaaaaatgaagaacaaacatgtaacaagataagcaaatgatacacaagtaaaaccgctgcttaaagaaaagtaacttttaacgacaacaatgtcttctaagtacccattttcaccagctactgctctaattagctttggtaaataaatcacttagttgtctgatacagaagcaaaastaaacttttttttctgattagacacagtggatacattttacaaaaccaaaacttcaatctacattgaataaatttaggttctattgtatggttcacaaaatccatacaaattatgtattttgtgggaaaaaatgtattaaacctgtgagattagttactaacttggtttaaagaaacctgaatcttaactgcctaatttgattctgtggtacaaaaatgtcacacagcaaacctgccttcaaactaattggtgttaaaaactggtttgcaaaaacaaaaagtagctctttcatacggtta

SEQ ID NO: 185133 - DNA, 601 bp, Human
ttctcagaatgacaccacacccttccacatgtgtccagtgggctgaagtctcctactctaccagccagtatgtttttaaatccatttacaatctgaattattaaacatccactgggtatagaagagtttcctaagatactgaagaatttgaattgtctggggattatagactgatttttaatacagcagacttaaccactaagttatttcacccatattaccccctacaacgaagtactggttgaatcaatcacaggctgcctcatcatcaatcagggctcaaagccagcctttctctagratgtcttcctgacctcaacccaaccccaaccccaatccctccggccaacccaggtgtgctgagcaccacacaacttccactcatttgggcacaacgtggaaagcagcactctttaggccgacccacccgcacactgaggaacaggagaattctgacagcggctggccccacagtgtgtgctatgtgcccaggactgttatgcgtgcgtgacacgtactcatctcaccctacaaggaaacaggcaaagactggagagaggatgaagcctgcctgaagtcacagagctaggacatgcacaca

SEQ ID NO: 185134 - DNA, 601 bp, Human
ttttgaaactcaaaactgccaagctgaacaccacagtttttctttttatctaccatcacaggagtctagcccaccactttaaaacctttagcactggccaggcgtagtggctcacgcctgtaatcccagcactttgggaggcagaggcaggcggatcacctgaggtcaggagttggagaccagcctgaccaaagtggagaaacccccgtctctactaaaaatacaaaatttgtaatcccagcacttggggaggccaaggcgggcggatcacaagctcaggagatcaagaccatcctggctwacatggtgaaaccccgtctctactaaaaatataaaaaattagtcaggtgtggtggcgggcgcctgtagtcccagctacttgggaggctgaggcaggagaatggcgtgaacccaggaggtgaagcttgcagtgagccaagatcgcaccattgcactccagcctgggcgacagagcaagactccgtctcaaaaaaaataaaatacaaaacaaaattagccaggcatggtagcacatgcctgtagtcccagctacttgagagactagggcgggaaagtcacttgaacctgggaagcggaggtt

SEQ ID NO: 185135 - DNA, 601 bp, Human
tagtgacaaatccaagatcatcatacaaaccacaaaaatcaccaaatatctcctgctcccggccagtaagagtgagggccgaattcccacagcccccaggtgcgtgtttccctcgcggcgaagagtaacaactctagttctgcggaaccacatgtgtgtgcctggtgctctctggctgcacttgtaacagccaacctcacaaaagctgaggccttttgaaactcaaaactgccaagctgaacaccacagtttttctttttatctaccatcacaggagtctagcccaccactttaaaacctytagcactggccaggcgtagtggctcacgcctgtaatcccagcactttgggaggcagaggcaggcggatcacctgaggtcaggagttggagaccagcctgaccaaagtggagaaacccccgtctctactaaaaatacaaaatttgtaatcccagcacttggggaggccaaggcgggcggatcacaagctcaggagatcaagaccatcctggcttacatggtgaaaccccgtctctactaaaaatataaaaaattagtcaggtgtggtggcgggcgcctgtagtcccagctacttgggaggc

SEQ ID NO: 185136 - DNA, 601 bp, Human
cacgcctgtaatcctgtaaaagggtcaggcagccctgacgtatgagaaccagcctggcactcgcagcttcgccctggtggaggtgttactattgaatagaataatctcgcagaacactaacatcagagaaggtcacctgtgtgactgtgctgaaataggaccaaaagtaagtaaactttaaaaaaaacaactcataatcgtttctaagtagtgacaaatccaagatcatcatacaaaccacaaaaatcaccaaatatctcctgctcccggccagtaagagtgagggccgaattcccacagyccccaggtgcgtgtttccctcgcggcgaagagtaacaactctagttctgcggaaccacatgtgtgtgcctggtgctctctggctgcacttgtaacagccaacctcacaaaagctgaggccttttgaaactcaaaactgccaagctgaacaccacagtttttctttttatctaccatcacaggagtctagcccaccactttaaaacctttagcactggccaggcgtagtggctcacgcctgtaatcccagcactttgggaggcagaggcaggcggatcacctgaggtcaggagttggagac

SEQ ID NO: 185137 - DNA, 601 bp, Human
gaattttaaaacacacagacattctggccaggcgcagtggctcacgcctgtaatcctgtaaaagggtcaggcagccctgacgtatgagaaccagcctggcactcgcagcttcgccctggtggaggtgttactattgaatagaataatctcgcagaacactaacatcagagaaggtcacctgtgtgactgtgctgaaataggaccaaaagtaagtaaactttaaaaaaaacaactcataatcgtttctaagtagtgacaaatccaagatcatcatacaaaccacaaaaatcaccaaatatcycctgctcccggccagtaagagtgagggccgaattcccacagcccccaggtgcgtgtttccctcgcggcgaagagtaacaactctagttctgcggaaccacatgtgtgtgcctggtgctctctggctgcacttgtaacagccaacctcacaaaagctgaggccttttgaaactcaaaactgccaagctgaacaccacagtttttctttttatctaccatcacaggagtctagcccaccactttaaaacctttagcactggccaggcgtagtggctcacgcctgtaatcccagcactttggg

SEQ ID NO: 185138 - DNA, 601 bp, Human
gtgttgtttctacttcgttttattctcttccaaatgctatccacctggattttactttcaagtttggaattttaaaacacacagacattctggccaggcgcagtggctcacgcctgtaatcctgtaaaagggtcaggcagccctgacgtatgagaaccagcctggcactcgcagcttcgccctggtggaggtgttactattgaatagaataatctcgcagaacactaacatcagagaaggtcacctgtgtgactgtgctgaaataggaccaaaagtaagtaaactttaaaaaaaacaactsataatcgtttctaagtagtgacaaatccaagatcatcatacaaaccacaaaaatcaccaaatatctcctgctcccggccagtaagagtgagggccgaattcccacagcccccaggtgcgtgtttccctcgcggcgaagagtaacaactctagttctgcggaaccacatgtgtgtgcctggtgctctctggctgcacttgtaacagccaacctcacaaaagctgaggccttttgaaactcaaaactgccaagctgaacaccacagtttttctttttatctaccatcacaggagtctagccc

SEQ ID NO: 185139 - DNA, 601 bp, Human
aggaaacacagggaaacatttagacaacaaccttagaatgaagcatgcactttgctttctacatgttgctgggaaggacttgttggacgcagagcgtgtctaccagtggtgtggtcagacgcttcctgatccaccctttcagtttgtcagagggctcccaaaccaaacccagcatgtcaagccaccagttacttatgaaaatggggagcatgaagggagaatgatgctggaagctcttcaaggatcaggaggatcagaccagaccctcaggaggcttcctttacgcctaactatctaaaawgaaaaaatcaagtataaaggtatgattccaatatttctgtaaaatctggtttagagtacaaacagttttagatggtcactggttccaattaaactgcttcttcaggagctgcctgtcacagctcccagcaccaagcgggggctccaatatttgctacttgagcccttccctccacaaggaaggaggacttagtgtgtaagtggcaccttcacagctgacaaccaccctcacgctgccctagagtcagcacagccagggcctcaggagaactcgctcccggggcagctgtggctgacgcag

SEQ ID NO: 185140 - DNA, 601 bp, Human
gtggctcacagctataatcccaccactttgggaggctgaagctgaaagatcacttcaacccaggagtttgagacaagccagggtctacaaaaccagccatacaaaaattcttttaagattagccacgcatggtggtgcacatttatggtcccagcaactcaggaggctggggcaggagaactgtttgagcccaggagttcaaggctacagtgagctctgatgtcaccactacaactccagcctggacacaacagagtgagacctccgtctcaaaagaaaaaaaaaaacccaatcatgtacytaagtagcaaattgctaaaaccaatttaaataactaaaaattcctaggctaagtgatattttaaagtatttatttctgagaggatcattctataacttacatacacattttaaatccccacctacctttgcacggacattttcaaatgatgcaggactcacaagggaaaagcaaattaagaacacatcctacaaaaaggaaacacagggaaacatttagacaacaaccttagaatgaagcatgcactttgctttctacatgttgctgggaaggacttgttggacgcagagcgtgtctacc

SEQ ID NO: 185141 - DNA, 601 bp, Human
gcgggcacctgtaatcccagctactaaggaggctgaggcaggagaattgcttgaaccgggagggggaggttgcagtgacccaagattgtgccactgcactccagcttggatgacagtgcaagattctgtctcagccgggcacggtggcccacgcctgtaatcccagcactttgggaggccgagacgcgcggatcacctgaggtcgggagttcgagaccagcctgactgacgtggagaaaccacatttctactaaaaatacaaaattagccgggcgtggtggtgcatgcctgtaatcccagytactcgggaggctgaggcatgagaatcacttgaacccaggaggcggaagttgcagtgagccaagattgcgtcactgcactccagcctgggcaacaagagtgaaactccatctcaaaaacaaaaacaaaaacaaaaaaaaagactctctcaaaaataaataaataaaataaactgctgatgggccagatgcagtggctcacagctataatcccaccactttgggaggctgaagctgaaagatcacttcaacccaggagtttgagacaagccagggtctacaaaaccagccatacaaaaatt

SEQ ID NO: 185142 - DNA, 601 bp, Human
caagaacgaggggctgagacatttacaacagcaggcattttctcttcctcttcttcacgggaggcgggcagaggactgctcggatcgcttcgtcaaacactgtcttgaggcctcgctgtgtgagcgccgagcactccaggtattttacagcacctacaggaaacacgaccacacggcaatgtacactcgaccccactctcttctgatcacaccaccagcgggaggcagctcctggggcccgggcgccttctgccggctcccagccctgcttccaccttccaacgctgacgttaagacccasagggccttgccagctggttccccaagagtacaccaggccctgagtgggagacacacaccctcctttcccagactggactccagtctctgtcactacaataaaagaggtacaaggaggaggaaaaacacaggattccataccaatctccttagccatggctagaccctgcggataggtgatgggagtcagcttcttctccttcagtttctcgatcgtgtctttatcatccctaagatcaagtttagttcccactaggatgatgggagtgttgggacagtggtgccgcacctcaggatacca

SEQ ID NO: 185143 - DNA, 601 bp, Human; identical to SEQ ID NO: 185111

SEQ ID NO: 185144 - DNA, 601 bp, Human; identical to SEQ ID NO: 185112

SEQ ID NO: 185145 - DNA, 601 bp, Human; identical to SEQ ID NO: 185113

SEQ ID NO: 185146 - DNA, 601 bp, Human; identical to SEQ ID NO: 185114

SEQ ID NO: 185147 - DNA, 601 bp, Human; identical to SEQ ID NO: 185115

SEQ ID NO: 185148 - DNA, 601 bp, Human; identical to SEQ ID NO: 185116

SEQ ID NO: 185149 - DNA, 601 bp, Human; identical to SEQ ID NO: 185117

SEQ ID NO: 185150 - DNA, 601 bp, Human; identical to SEQ ID NO: 185118

SEQ ID NO: 185151 - DNA, 601 bp, Human; identical to SEQ ID NO: 185119

SEQ ID NO: 185152 - DNA, 601 bp, Human; identical to SEQ ID NO: 185120

SEQ ID NO: 185153 - DNA, 601 bp, Human; identical to SEQ ID NO: 185121

SEQ ID NO: 185154 - DNA, 601 bp, Human; identical to SEQ ID NO: 185122

SEQ ID NO: 185155 - DNA, 601 bp, Human; identical to SEQ ID NO: 185123

SEQ ID NO: 185156 - DNA, 601 bp, Human; identical to SEQ ID NO: 185124

SEQ ID NO: 185157 - DNA, 601 bp, Human; identical to SEQ ID NO: 185125

SEQ ID NO: 185158 - DNA, 601 bp, Human; identical to SEQ ID NO: 185126

SEQ ID NO: 185159 - DNA, 601 bp, Human; identical to SEQ ID NO: 185127

SEQ ID NO: 185160 - DNA, 601 bp, Human; identical to SEQ ID NO: 185128

SEQ ID NO: 185161 - DNA, 601 bp, Human; identical to SEQ ID NO: 185129

SEQ ID NO: 185162 - DNA, 601 bp, Human; identical to SEQ ID NO: 185130

SEQ ID NO: 185163 - DNA, 601 bp, Human; identical to SEQ ID NO: 185131

SEQ ID NO: 185164 - DNA, 601 bp, Human; identical to SEQ ID NO: 185132

SEQ ID NO: 185165 - DNA, 601 bp, Human; identical to SEQ ID NO: 185133

SEQ ID NO: 185166 - DNA, 601 bp, Human; identical to SEQ ID NO: 185134

SEQ ID NO: 185167 - DNA, 601 bp, Human; identical to SEQ ID NO: 185135

SEQ ID NO: 185168 - DNA, 601 bp, Human; identical to SEQ ID NO: 185136

SEQ ID NO: 185169 - DNA, 601 bp, Human; identical to SEQ ID NO: 185137

SEQ ID NO: 185170 - DNA, 601 bp, Human; identical to SEQ ID NO: 185138

SEQ ID NO: 185171 - DNA, 601 bp, Human; identical to SEQ ID NO: 185139

SEQ ID NO: 185172 - DNA, 601 bp, Human; identical to SEQ ID NO: 185140

SEQ ID NO: 185173 - DNA, 601 bp, Human; identical to SEQ ID NO: 185141

SEQ ID NO: 185174 - DNA, 601 bp, Human; identical to SEQ ID NO: 185142

SEQ ID NO: 185175 - DNA, 601 bp, Human; identical to SEQ ID NO: 39871

SEQ ID NO: 185176 - DNA, 601 bp, Human; identical to SEQ ID NO: 39872

SEQ ID NO: 185177 - DNA, 601 bp, Human; identical to SEQ ID NO: 39873

SEQ ID NO: 185178 - DNA, 601 bp, Human
ttttagccaggtgcggtggctcacgcctgtaatcccagcactttgggaggccgaggcgggcagattgcctgaggtgaggagtttgagactagcctggctaacatggtgaaaccccgtctctactaaaaatacaaaaattggccaggcatggtggcgggcacctgtaatcccagctacttgggaggctgaggcaggagagttgcttgaatatgggaggcagaggttgcagtgagccaagatcatgccactgcactccagcctgggcaacagaaaaagactctgtctcaaaaaaaaaaaaaaattgaaattttgatgcttttatgtagttatttgatactttctccatctcttctccagattgagttatcccacctcctttaggatcttcttatgagtgtctcttttcagctcttttaccatctatttctcttctctaatgtcttttgtagtttccttcttatgaatctaatattttcatgagttagactattggttcattcagttcagtatcttttaagtccctgaacacagcaccaagagatataacatggtataatgttataattgtcccctataacattaaactgataagcttagaaat

SEQ ID NO: 185179 - DNA, 601 bp, Human
cttttaccatctatttctcttctctaatgtcttttgtagtttccttcttatgaatctaatattttcatgagttagactattggttcattcagttcagtatcttttaagtccctgaacacagcaccaagagatataacatggtataatgttataattgtcccctataacattaaactgataagcttagaaatggatcgtggttatcccctgcccaattattttctatggacctgtcatccatagatttgtctaaatgagcatttctcaaagggcattctgttcaaaactataaaatataatragttatgtgggaaaataaagctcttgtggtcaaacaagtttggaaactgttaggctgagcaaagctaaaaatgttcccttactgcatgacttcttatagccttaaatacgctaatatgaactataaaatctccatagaaggttgtagtatgtagtgtttcccaaaccagtttgactatggaatattttttctggatattttgtggacccagtgttccaaggaattctctttagtaaacaatggtttatagcttactttggccgatatatgttcattattctataagtgtttaatcagcac

SEQ ID NO: 185180 - DNA, 601 bp, Human
atcaatccttcttgatgtatttattattgtttttaatttatttttattgggatataacttacataaagtacacaaattcaaaagccttaactgtacaccttgatcagtttttatgtatgtatcaccatcacctagatcactctccctagggtctctgtaccctcactattcccctctcttgccttcaaattctcccagagaaccagagtcttttccttcaactagaagcaggagcaaatctttaatagctttaaatgaacaaaactcatcttgactctcttttcctatcatttttctcctkttacattaaccccatattataaaaataatcctctgtatgtgttgcctttctcactcttcattatcagttcttatggtagagtaatataatataatgcaatataatccaattcaatttaatttgatttgacccaatttaattcaataaatgtttattgagcaccttctgtttgtccaaggaaccatggaggatgaagaggtgaattacacatactacctaattcatattgttcatattcaaatagctttaatacagatcatattgtagtacaataagatatactgtaaatcatcttttttc

SEQ ID NO: 185181 - DNA, 601 bp, Human
agtatatttttctcactctcgtcctcttatatcttttcttacttatctggcttctcttttgcctcttgtttacttcactctttcctgagtgtaagcattttcccaggttataacttttaccctcttctctttctctagattcttccttagcaaattctgtggtgtggatattagctatatgcagatggctcctcaaattccagtgaattacatattggcattcacctccacaaatctgttctttcttctgtcttctctacattcccaccttcaatcagttatcaaattctaccaattctgyttgccacaatctctctcacatttatcccttttcagcacaacatccactgcattagttgccatcacccagttttggtcttcattgtctcaatgtctttaaattgagatattaaaatggacatctaaaatgtttttactgcttcccatctctttttcctacaattgagcatatatgctactgccaaattaattttcctaaaagaaatcctgatcacattactactctgctcagcaatttctggtgactattaaatcactgtctactaatctcactccaactgacttttctgtgcttactgtc

SEQ ID NO: 185182 - DNA, 601 bp, Human
cagcaacaaaagggaataagtatttaaaactacccttccttaagttggaaaatcagaaaaaagacaagactcttcctttactgtcttttctaatttgaacctgtagcctattttcttcatttgctagaggaaaatggatagatttttgtttcaaaccgttaagttcttccccacctctcatatgtttctctgcctgagtatgtgtttgtgtgtgtgtgtgtgtgtgtggtgtgtttacttttattcacgtgttactttgagggtgaaaagccttctctaacattagaaagattgttcaaaycctgaaggggcaatttcctgaagttagtaaacaacttctattaaaaatctttcctctgtttgctatcccagaataatagatatgttaagaggaaatgggcatccagagtccctgactcttgtttaaggaactccctatgccaggaaagaagtgaggcttccttcagagctacatacaggaaagactaatcaataggtacgcagtgggaaaacaaaaattattaaacatgcatattggtttctcaaggatgctatttgtagtgtcaagttggttttaagaaaggaaaacatttttagtcat

SEQ ID NO: 185183 - DNA, 601 bp, Human
gccttgctaggttggggaagttctcctggataatatcttgaagagtgttttccaacttggttccattctccctgtcaatttcaggtacaccaatcaaatgtagatttggtctttttacatagtcctatatttctttgaggctttgttcatttctttttactcttttttctctaaacttctcttcttgcttatttcatttatttgatcttccatcactgatacccttttttccacttgattgaatcagctattgaagcttgtgcatgcatcacatagttctcgtgccatggttttcagctccatcaggtcatttaaagtcttctctgcagtgtttattctagttagccattcatctaatcttttttcaaggtttttagcttccttgtaatgggttcaaacattctcctttagcttgaagaagtttgttattaccaaccttctgaagcctacttctgtcagctcatcaaagtcattctccgtccagctttgttccattgctggcaaggagctgcgatcctttggaggagaagaggcactctggtttttagaattttgagcttttctgctctggtttctccccatctttgtggtttttatctac

SEQ ID NO: 185184 - DNA, 601 bp, Human
gttattaccaaccttctgaagcctacttctgtcagctcatcaaagtcattctccgtccagctttgttccattgctggcaaggagctgcgatcctttggaggagaagaggcactctggtttttagaattttgagcttttctgctctggtttctccccatctttgtggtttttatctacctttgttctttgatgctggtgacctacagatggggttttggtgtggatgtcctttctgttgatgttgatgctatttcttcctttttattagttttccttctaacagtcaggtccctcagctgcrggtctgttggagtttgctagaagtccactccagaccctgtttgcctgggtatcaccagtggaggctgcagaacagcaaatattgcagaacagcaaatattgctgcctgatccttcctctggaaacttcgtcccagagggacacccgcctgtaatgaagtgtcagttggtccccactgagaggtgtctcccggttaggctacacaggcttcagggacccacttgaggaggcagtctgtccgttctcagagctcaaaaaccctactgggagaacgagtgctctcttcagagctgtcagacag

SEQ ID NO: 185185 - DNA, 601 bp, Human
ctacttctgtcagctcatcaaagtcattctccgtccagctttgttccattgctggcaaggagctgcgatcctttggaggagaagaggcactctggtttttagaattttgagcttttctgctctggtttctccccatctttgtggtttttatctacctttgttctttgatgctggtgacctacagatggggttttggtgtggatgtcctttctgttgatgttgatgctatttcttcctttttattagttttccttctaacagtcaggtccctcagctgcgggtctgttggagtttgctagargtccactccagaccctgtttgcctgggtatcaccagtggaggctgcagaacagcaaatattgcagaacagcaaatattgctgcctgatccttcctctggaaacttcgtcccagagggacacccgcctgtaatgaagtgtcagttggtccccactgagaggtgtctcccggttaggctacacaggcttcagggacccacttgaggaggcagtctgtccgttctcagagctcaaaaaccctactgggagaacgagtgctctcttcagagctgtcagacagggacgtttaagtctgcagaagt

SEQ ID NO: 185186 - DNA, 601 bp, Human
tttttatctacctttgttctttgatgctggtgacctacagatggggttttggtgtggatgtcctttctgttgatgttgatgctatttcttcctttttattagttttccttctaacagtcaggtccctcagctgcgggtctgttggagtttgctagaagtccactccagaccctgtttgcctgggtatcaccagtggaggctgcagaacagcaaatattgcagaacagcaaatattgctgcctgatccttcctctggaaacttcgtcccagagggacacccgcctgtaatgaagtgtcagtyggtccccactgagaggtgtctcccggttaggctacacaggcttcagggacccacttgaggaggcagtctgtccgttctcagagctcaaaaaccctactgggagaacgagtgctctcttcagagctgtcagacagggacgtttaagtctgcagaagtttctgctgccttttgttccgctatgccctgaccccagaggtgggtggggtctacagaggcagcaggccttgcagagctgcagtgggctctgcccagttcaagcttccccagctgctttgtttacctactcaagcctcagcaatg

SEQ ID NO: 185187 - DNA, 601 bp, Human
agggacacccgcctgtaatgaagtgtcagttggtccccactgagaggtgtctcccggttaggctacacaggcttcagggacccacttgaggaggcagtctgtccgttctcagagctcaaaaaccctactgggagaacgagtgctctcttcagagctgtcagacagggacgtttaagtctgcagaagtttctgctgccttttgttccgctatgccctgaccccagaggtgggtggggtctacagaggcagcaggccttgcagagctgcagtgggctctgcccagttcaagcttccccagctkctttgtttacctactcaagcctcagcaatggcagatgcccctccccctactaggctgctgcctcgtgggtcgatctcagactgctgcgctagcagtgagcaaagctccatgggcatgggacccaccaagccaggcgcaggatataatctcctggtgttccgtttgctaagacctttggaaaagcacagtatttgggtgggagtgttgcgattttccaggtacagtctgtcacggcttcccttggctaggaaagggaaatcccccaaccgcttgtgcttcctgggtgaggcaatgctccac

SEQ ID NO: 185188 - DNA, 601 bp, Human
tgtgcttcctgggtgaggcaatgctccaccctgcttcagctcgccctctgtgggctgcacccactgtccaaccagtcccaatgaaatgagccaggtacctcagttggaaatgcagaaatcaccatcttctgcatcaactacgctgggagctacagaccggagtggttcgtattcagccatcttggagttattatgcttttgaatgtcctctccacacttctcttttctctttctctgagtgggtctgtatagtatgtcctttctctctcctcttttttgtctgatcagaactgaccttctyttcttcatgcaagctctcttcctctgccatcactacacactctcagcctctgtatatacctcttcttagttcctaagtgcctattaaaaatggctctggctttttatattcatatggtgaaataaaatgtattacttctttctcttccattttctttttccacattaacttgttcatgataaaaccaaaggaatgctggattatgagttaaatatagaagctctacacctaaccctaatactaattaaaatgtcactttggggccagatgtagcggctcatgcctgtaatcccagcactt

SEQ ID NO: 185189 - DNA, 601 bp, Human
gaactgaccttcttttcttcatgcaagctctcttcctctgccatcactacacactctcagcctctgtatatacctcttcttagttcctaagtgcctattaaaaatggctctggctttttatattcatatggtgaaataaaatgtattacttctttctcttccattttctttttccacattaacttgttcatgataaaaccaaaggaatgctggattatgagttaaatatagaagctctacacctaaccctaatactaattaaaatgtcactttggggccagatgtagcggctcatgcctgkaatcccagcactttgggaggctgaggcaggaggattgcttgaggccaggagtttgagaccagcctggtcaacatagcaagaccccatctctacaataaaaaaaaagtcactgttcatttattgatttttatttttatttatttatttattttttatttctttgagatggagtcttgctctgtctcccagtctggagtacagtgttgtgagatctcagctcactgcaacctccacctcctgggttaaagtgatcctcccatctcagcctcccaagtagctgggattacaggcatgcaccac

SEQ ID NO: 185190 - DNA, 601 bp, Human
ccaccatgcctggcaaatttttgtatttttagtggaggtggggtttcactgtgttggccaggctggtcttgaactcctgacctcaagtgatccgtccacctcagcttcctgaagttctgggattacaggggtgaaccactgcaactggcccaaaagtcactgtttagaaatgtcatttgacctgtctggatttcagtttcttgatttgtaaaattgaaggattagtgaagtcaacctaaagcatttctgtgtgctatggttgggattacaatgaccctaatatctcgtttcaaatgcagawttttcaggtctcttgacttcttgctcctcctattagtttcctgccattagtttcctctcttatatccctcatagctaaactatttcctatgaggtttttgtttgtttgttgtttttgtttgttttttggttgtttttttaatctataagttgcctattttcctcctaaaccacttacacttctttcattcatttagtccaagcttgtccaacctgcagcctgcaggccacatgcagcccaggacagctttgaatgtggcccagtacaaatttataaactttcttaaaacattattagatt

SEQ ID NO: 185191 - DNA, 601 bp, Human
ctgtgtgctatggttgggattacaatgaccctaatatctcgtttcaaatgcagaattttcaggtctcttgacttcttgctcctcctattagtttcctgccattagtttcctctcttatatccctcatagctaaactatttcctatgaggtttttgtttgtttgttgtttttgtttgttttttggttgtttttttaatctataagttgcctattttcctcctaaaccacttacacttctttcattcatttagtccaagcttgtccaacctgcagcctgcaggccacatgcagcccaggacakctttgaatgtggcccagtacaaatttataaactttcttaaaacattattagatttttttttttagctcaccaattattgttagtgttggtgtattttatgtgtggcccaagacaatatatcttccaatgtggcccagggaagccaaaagattggacacccctgatttagtccatcaattggataccgatcttactacccagactatatcactccagctcaaactcctttttttttcctctatgatgatctaacatagatcatctgtttggggttcatgatagctagcatttttttttctg

SEQ ID NO: 185192 - DNA, 601 bp, Human
tctcttgacttcttgctcctcctattagtttcctgccattagtttcctctcttatatccctcatagctaaactatttcctatgaggtttttgtttgtttgttgtttttgtttgttttttggttgtttttttaatctataagttgcctattttcctcctaaaccacttacacttctttcattcatttagtccaagcttgtccaacctgcagcctgcaggccacatgcagcccaggacagctttgaatgtggcccagtacaaatttataaactttcttaaaacattattagatttttttttttagctcaccaattattgttagtgttggtgtattttatgtgtggcccaagacaatatatcttccaatgtggcccagggaagccaaaagattggacacccctgatttagtccatcaattggataccgatcttactacccagactatatcactccagctcaaactcctttttttttcctctatgatgatctaacatagatcatctgtttggggttcatgatagctagcatttttttttctgttcctttttattccctttctatttattctttttattacaacaaagagaacctttctctagaag

SEQ ID NO: 185193 - DNA, 601 bp, Human
cttctttcattcatttagtccaagcttgtccaacctgcagcctgcaggccacatgcagcccaggacagctttgaatgtggcccagtacaaatttataaactttcttaaaacattattagatttttttttttagctcaccaattattgttagtgttggtgtattttatgtgtggcccaagacaatatatcttccaatgtggcccagggaagccaaaagattggacacccctgatttagtccatcaattggataccgatcttactacccagactatatcactccagctcaaactccttttttcttcctctatgatgatctaacatagatcatctgtttggggttcatgatagctagcatttttttttctgttcctttttattccctttctatttattctttttattacaacaaagagaacctttctctagaagatgttacaagatcttttgggaaagttgttccctcccctgatgttaattagtcctagattagtcacctaactttttttttttttttttttttgagacggagtcttgctctgtcgccagtatggagtgcagtggcaccatctctcggctcactgcaacctctgactccctgg

SEQ ID NO: 185194 - DNA, 601 bp, Human
agattggacacccctgatttagtccatcaattggataccgatcttactacccagactatatcactccagctcaaactcctttttttttcctctatgatgatctaacatagatcatctgtttggggttcatgatagctagcatttttttttctgttcctttttattccctttctatttattctttttattacaacaaagagaacctttctctagaagatgttacaagatcttttgggaaagttgttccctcccctgatgttaattagtcctagattagtcacctaactttttttttttttttttttttgagacggagtcttgctctgtcgccagtatggagtgcagtggcaccatctctcggctcactgcaacctctgactccctggttcaagcgattctcctgcctcagcctccccgctagctgggattataggtgcatgtcaccacgcccagctaatttttgtatttttggtagacacagggtttcaccatgttggtcaggatggtctcgatctcctgacctcgtgatccacccaccttggccccccaaagtgctgggattacaagcgtgagccaccgtgccctagtcacctaacttctt

SEQ ID NO: 185195 - DNA, 601 bp, Human
gccctagtcacctaacttcttgtccgctacccgccatacactttaagttcccttccctagaaagctaacccaaggattaggcacttagaatgagaaatccacatcctgagagttctgacatctctggcctctctttgctatctttattccattctattctctttattccacattagcataaaacaccttaaaaattgcaggtgtaaactgtaatttccaaggttcattataatgctaacattctacttatatgtgggaatgctggtgtggtagtacacataaggaatatatgttgtagtgygccatatttcaatgtgtgaatctctctatatgttcttactggagttccttattcttctactttctatttgctgttcaagttctttgagaaaacaatacaacaggatgttccttccaactgcatgatttttgtcactggacagtctattctaagtccctggctcctttcttacccttgttaacttgtccctgaggaaactgtggtgaggattacaattaatccaagagtccaagttacccaggctgaacctgagagctttttacctcccagtgcttcttgagttttgaggaagttgtttgg

SEQ ID NO: 185196 - DNA, 601 bp, Human
tatcctcttctactggttctcccaatttaaagcactgtcacttttgctacaaatccaccttgttcttgtcatgtctgtacaaagtagggtttctctgtgtgtgtgtggagtgagcgggtagaggcaaaggggaaggtgggtataggaagggaacttgaagggaatgtctattacctctaacactaaagagtgaagaattccactcctttttcctagtctgttcacttcattcaccattattgtctctatttggatttctcagataattctttcctcctccctcctcctcctcctccatttrtccccacactgagaacagtatgaaccctaagtctgtattattcaaatctctcagttctggttttagactgactgatttagctctctcaacaggacaatcatctatctctccttggtgtatgtgcttggccatgtgatcaagtccttgggtgccttaccaatactgggaggacaagtggtacacacgtgagtaaaatcatggaatcaactaaactacttttctcagacatttgttacaaattattttctgttttcttaccagagatgtctctttattttcaatctacagtttactacaaaa

SEQ ID NO: 185197 - DNA, 601 bp, Human; identical to SEQ ID NO: 39874

SEQ ID NO: 185198 - DNA, 601 bp, Human; identical to SEQ ID NO: 39875

SEQ ID NO: 185199 - DNA, 601 bp, Human; identical to SEQ ID NO: 39876

SEQ ID NO: 185200 - DNA, 601 bp, Human; identical to SEQ ID NO: 39877

SEQ ID NO: 185201 - DNA, 601 bp, Human; identical to SEQ ID NO: 39878

SEQ ID NO: 185202 - DNA, 601 bp, Human; identical to SEQ ID NO: 39879

SEQ ID NO: 185203 - DNA, 601 bp, Human; identical to SEQ ID NO: 39880

SEQ ID NO: 185204 - DNA, 601 bp, Human; identical to SEQ ID NO: 39881

SEQ ID NO: 185205 - DNA, 601 bp, Human; identical to SEQ ID NO: 39882

SEQ ID NO: 185206 - DNA, 601 bp, Human; identical to SEQ ID NO: 39883

SEQ ID NO: 185207 - DNA, 601 bp, Human; identical to SEQ ID NO: 39884

SEQ ID NO: 185208 - DNA, 601 bp, Human; identical to SEQ ID NO: 39885

SEQ ID NO: 185209 - DNA, 601 bp, Human; identical to SEQ ID NO: 39886

SEQ ID NO: 185210 - DNA, 601 bp, Human; identical to SEQ ID NO: 39887

SEQ ID NO: 185211 - DNA, 601 bp, Human; identical to SEQ ID NO: 39888

SEQ ID NO: 185212 - DNA, 601 bp, Human; identical to SEQ ID NO: 39889

SEQ ID NO: 185213 - DNA, 601 bp, Human; identical to SEQ ID NO: 39890

SEQ ID NO: 185214 - DNA, 601 bp, Human; identical to SEQ ID NO: 39891

SEQ ID NO: 185215 - DNA, 601 bp, Human; identical to SEQ ID NO: 39892

SEQ ID NO: 185216 - DNA, 601 bp, Human; identical to SEQ ID NO: 39893

SEQ ID NO: 185217 - DNA, 601 bp, Human; identical to SEQ ID NO: 39894

SEQ ID NO: 185218 - DNA, 601 bp, Human; identical to SEQ ID NO: 39895

SEQ ID NO: 185219 - DNA, 601 bp, Human; identical to SEQ ID NO: 39896

SEQ ID NO: 185220 - DNA, 601 bp, Human; identical to SEQ ID NO: 39897

SEQ ID NO: 185221 - DNA, 601 bp, Human; identical to SEQ ID NO: 39898

SEQ ID NO: 185222 - DNA, 601 bp, Human; identical to SEQ ID NO: 39899

SEQ ID NO: 185223 - DNA, 601 bp, Human; identical to SEQ ID NO: 39900

SEQ ID NO: 185224 - DNA, 601 bp, Human; identical to SEQ ID NO: 39901

SEQ ID NO: 185225 - DNA, 601 bp, Human; identical to SEQ ID NO: 39902

SEQ ID NO: 185226 - DNA, 601 bp, Human; identical to SEQ ID NO: 39903

SEQ ID NO: 185227 - DNA, 601 bp, Human; identical to SEQ ID NO: 39904

SEQ ID NO: 185228 - DNA, 601 bp, Human; identical to SEQ ID NO: 39905

SEQ ID NO: 185229 - DNA, 601 bp, Human; identical to SEQ ID NO: 39906

SEQ ID NO: 185230 - DNA, 601 bp, Human; identical to SEQ ID NO: 39907

SEQ ID NO: 185231 - DNA, 601 bp, Human; identical to SEQ ID NO: 39908

SEQ ID NO: 185232 - DNA, 601 bp, Human; identical to SEQ ID NO: 39909

SEQ ID NO: 185233 - DNA, 601 bp, Human; identical to SEQ ID NO: 39910

SEQ ID NO: 185234 - DNA, 601 bp, Human; identical to SEQ ID NO: 39911

SEQ ID NO: 185235 - DNA, 601 bp, Human; identical to SEQ ID NO: 39912

SEQ ID NO: 185236 - DNA, 601 bp, Human; identical to SEQ ID NO: 39913

SEQ ID NO: 185237 - DNA, 601 bp, Human; identical to SEQ ID NO: 39914

SEQ ID NO: 185238 - DNA, 601 bp, Human; identical to SEQ ID NO: 39915

SEQ ID NO: 185239 - DNA, 601 bp, Human; identical to SEQ ID NO: 39916

SEQ ID NO: 185240 - DNA, 601 bp, Human; identical to SEQ ID NO: 39917

SEQ ID NO: 185241 - DNA, 601 bp, Human; identical to SEQ ID NO: 39918

SEQ ID NO: 185242 - DNA, 601 bp, Human; identical to SEQ ID NO: 39919

SEQ ID NO: 185243 - DNA, 601 bp, Human; identical to SEQ ID NO: 39920

SEQ ID NO: 185244 - DNA, 601 bp, Human; identical to SEQ ID NO: 39921

SEQ ID NO: 185245 - DNA, 601 bp, Human; identical to SEQ ID NO: 39922

SEQ ID NO: 185246 - DNA, 601 bp, Human; identical to SEQ ID NO: 39923

SEQ ID NO: 185247 - DNA, 601 bp, Human; identical to SEQ ID NO: 39924

SEQ ID NO: 185248 - DNA, 601 bp, Human; identical to SEQ ID NO: 39925

SEQ ID NO: 185249 - DNA, 601 bp, Human
gtgtgggatataatctcgtggtgcgccgttttttaagcccgtcggaaaagcgcagtattccggtgggagtgacccgattttccaggtgccgtctgtcacccctttctttgactaggaaagggaactccctgacccctcgcacttcccgagtgaggcaatgcctcgccctgctttggctcgcacacggtgtgctgcacccactgacctgcgcccactgtctggcactccctagtgagatgagcccggtacctcagatggaaacgcagaaatcacccgtcttctgcattgctcacgctgggarctgtagaccggagctgttcctattcggccatcttggctccagccacctccatgtctcttttaaccctcctggccaaaagcagcaacactttaacccttgttgcaaaagaatctgttcttctaatcttgttcattttcttcaatttccactacttcttttctaccaggctgataaccatagcaggcctgggcatagcctgagaagtataatctctgctcaaagaataaacacacccttaccaagggaattatctgaaaatttattttgtttgtgtaattcagatgccattttatgtttaaa

SEQ ID NO: 185250 - DNA, 601 bp, Human
ggagtgacccgattttccaggtgccgtctgtcacccctttctttgactaggaaagggaactccctgacccctcgcacttcccgagtgaggcaatgcctcgccctgctttggctcgcacacggtgtgctgcacccactgacctgcgcccactgtctggcactccctagtgagatgagcccggtacctcagatggaaacgcagaaatcacccgtcttctgcattgctcacgctgggaactgtagaccggagctgttcctattcggccatcttggctccagccacctccatgtctcttttaacyctcctggccaaaagcagcaacactttaacccttgttgcaaaagaatctgttcttctaatcttgttcattttcttcaatttccactacttcttttctaccaggctgataaccatagcaggcctgggcatagcctgagaagtataatctctgctcaaagaataaacacacccttaccaagggaattatctgaaaatttattttgtttgtgtaattcagatgccattttatgtttaaaatgttgtccaggatcaaaatgcctgatagggcaaaacggtggaaatccaaactgcaatatcaaaa

SEQ ID NO: 185251 - DNA, 601 bp, Human
acggtgtgctgcacccactgacctgcgcccactgtctggcactccctagtgagatgagcccggtacctcagatggaaacgcagaaatcacccgtcttctgcattgctcacgctgggaactgtagaccggagctgttcctattcggccatcttggctccagccacctccatgtctcttttaaccctcctggccaaaagcagcaacactttaacccttgttgcaaaagaatctgttcttctaatcttgttcattttcttcaatttccactacttcttttctaccaggctgataaccatagcargcctgggcatagcctgagaagtataatctctgctcaaagaataaacacacccttaccaagggaattatctgaaaatttattttgtttgtgtaattcagatgccattttatgtttaaaatgttgtccaggatcaaaatgcctgatagggcaaaacggtggaaatccaaactgcaatatcaaaatattctcttatttaaagtctctgtcaataatgatatctgattgaatctaggcgagtgagcataatattacgaaaagaagttttgaaaagctggaattgtgtagaaatgctcaatttcc

SEQ ID NO: 185252 - DNA, 601 bp, Human
caaaagcagcaacactttaacccttgttgcaaaagaatctgttcttctaatcttgttcattttcttcaatttccactacttcttttctaccaggctgataaccatagcaggcctgggcatagcctgagaagtataatctctgctcaaagaataaacacacccttaccaagggaattatctgaaaatttattttgtttgtgtaattcagatgccattttatgtttaaaatgttgtccaggatcaaaatgcctgatagggcaaaacggtggaaatccaaactgcaatatcaaaatattctctyatttaaagtctctgtcaataatgatatctgattgaatctaggcgagtgagcataatattacgaaaagaagttttgaaaagctggaattgtgtagaaatgctcaatttcctgaaaatggctgaagaatgaaaatacaaaaaggatggatataagatcgtagaatgctgtagttagaaatatttacttgagactactgacaagtccatttccattttctctttccctaagaacaccaatcagggtcttcaggcctggaagattgaagacattccagccaacaaaatgtccattgcgtggcag

SEQ ID NO: 185253 - DNA, 601 bp, Human; identical to SEQ ID NO: 39926

SEQ ID NO: 185254 - DNA, 601 bp, Human; identical to SEQ ID NO: 25162

SEQ ID NO: 185255 - DNA, 601 bp, Human; identical to SEQ ID NO: 25163

SEQ ID NO: 185256 - DNA, 601 bp, Human; identical to SEQ ID NO: 25164

SEQ ID NO: 185257 - DNA, 601 bp, Human; identical to SEQ ID NO: 25165

SEQ ID NO: 185258 - DNA, 601 bp, Human; identical to SEQ ID NO: 25166

SEQ ID NO: 185259 - DNA, 601 bp, Human
gaactcttttatgccatctacattttaggcttgaggcttctcaaagggcctcgaatacagaagagtagacaccccatcttccatgtctgccatttcctaagaggttgttacctagtaatactaccacttcttaagcctctattattttaccagattctttgtatacctaatctaatttaatccatgcaaaatccttgccttcaatggtggtattgtccccacttacagttgagaaaactggctcaaagaagtaaagctgaactaactaagatcaagtagctagtaatagtctcctatgaargcaaaacaactgctatcatttactgagtactcttgatgtgctaggcatgtagaggactcactttgttgttatagcaatcctatgggcgcaaatactatcctcattatacaaatgagaaaactaaggttcagagaggttgtaacctgcccaaagtcccacagctaggaagaggcagagccaggattcaaactcacatctggaagattcaggagcctgagcttttaaccactaagtcacttgagcctataggctttccaccaagctgtacttctttttaatttcttttcaactttggtccga

SEQ ID NO: 185260 - DNA, 601 bp, Human
cttaagcctctattattttaccagattctttgtatacctaatctaatttaatccatgcaaaatccttgccttcaatggtggtattgtccccacttacagttgagaaaactggctcaaagaagtaaagctgaactaactaagatcaagtagctagtaatagtctcctatgaaggcaaaacaactgctatcatttactgagtactcttgatgtgctaggcatgtagaggactcactttgttgttatagcaatcctatgggcgcaaatactatcctcattatacaaatgagaaaactaaggttyagagaggttgtaacctgcccaaagtcccacagctaggaagaggcagagccaggattcaaactcacatctggaagattcaggagcctgagcttttaaccactaagtcacttgagcctataggctttccaccaagctgtacttctttttaatttcttttcaactttggtccgaaacctggcttttactacaaacttgatctccttctcaagccccacctgttccctctctctctaatctctgtcaaatgaccataaccaaagaatcttaacatttgcagagttcttgggacctgatggtcat

SEQ ID NO: 185261 - DNA, 601 bp, Human
aaaccacctcagttctgctttctgtagccaaagctggaagcatggggttttgaaaaaaagctgcatcgtgccagcctgttgctaactgattgaaagcagaaaatgaagccaggcaaagctgaggcccagatttagatagttaggctgatactgaacaagtcagatcagtacttacattagctgagaccattagatcagagtagctgccgccagcagcccagggtaggactggaggaaggggaagaggggaatgccactgggattgaactttgcaggagggagggaaggagggctgagttaytgtgtgcgctgagctgatagaatctggccagtctcaaggcttggcaacagacaagacaaattttactgtgacgagtataagttgagttacccaaccttctacccagattgataggaaggtcacgacatgacttaaaaacagaagcagaggtctacattaaagttttccttttcttggctatgtctcagaagagccaagtcatagtgagaagagggacaggggagggaaatcaatatcatattttgaatgctgattatacgccagatattttgtcattccttttaatcctagcaataataa

SEQ ID NO: 185262 - DNA, 601 bp, Human
tgccactgggattgaactttgcaggagggagggaaggagggctgagttactgtgtgcgctgagctgatagaatctggccagtctcaaggcttggcaacagacaagacaaattttactgtgacgagtataagttgagttacccaaccttctacccagattgataggaaggtcacgacatgacttaaaaacagaagcagaggtctacattaaagttttccttttcttggctatgtctcagaagagccaagtcatagtgagaagagggacaggggagggaaatcaatatcatattttgaatgcygattatacgccagatattttgtcattccttttaatcctagcaataataattctaacaggtgaactgttttcccattttacagatctggaaaccaaggtacaaacagcttacataaattaactgtgatcgcatgagtgatcacatcagcatcagtggatcaaaccagagcattcagagtcaactacttgtggaaattgtactggacttgtagaaattgtactggaccccctcccatccgcacactgaatagcttttactaaattgtgctctgagacaatgccattggttcatactgaggtt

SEQ ID NO: 185263 - DNA, 601 bp, Human; identical to SEQ ID NO: 25167

SEQ ID NO: 185264 - DNA, 601 bp, Human
gattcataaaataatcaataaactgaacatcaaatttgaaaactcatgattttctaaaagacactgttaagaatgaaaagaaaaaccacagactgagttaaaatatttgtaaatcatatgtctgataaagaacttgtattatatatatattatataaagaactcccaaaactcaataactcaataataagaaaacaagtaaatcagtttttaaagaataagcaaaatatttgaatagacactttaccaaagaaaacatacaaatggcaaacataaaaaaagttcaacatcattaagtcaayagggaaatgcatgctaaaaacatgatgcgatgccactgaacacctattagaatggttgaaattttttagactgaccataccacatgttgaaaagaatatggaggaactggaactttcactgctgatgggaatgtaaaatcatacaatgtcatagtgaattaaaaaaaaaaaccacccaatgaaatagatcatctgaatagtcctataaccattaaaaaatttcaattcatagtttaaaaacttccaaagaagaaatctctagacccagagagtttagctggaggattccaccaaacatat

SEQ ID NO: 185265 - DNA, 601 bp, Human
gattttctaaaagacactgttaagaatgaaaagaaaaaccacagactgagttaaaatatttgtaaatcatatgtctgataaagaacttgtattatatatatattatataaagaactcccaaaactcaataactcaataataagaaaacaagtaaatcagtttttaaagaataagcaaaatatttgaatagacactttaccaaagaaaacatacaaatggcaaacataaaaaaagttcaacatcattaagtcaatagggaaatgcatgctaaaaacatgatgcgatgccactgaacacctaytagaatggttgaaattttttagactgaccataccacatgttgaaaagaatatggaggaactggaactttcactgctgatgggaatgtaaaatcatacaatgtcatagtgaattaaaaaaaaaaaccacccaatgaaatagatcatctgaatagtcctataaccattaaaaaatttcaattcatagtttaaaaacttccaaagaagaaatctctagacccagagagtttagctggaggattccaccaaacatatacagaattaacatgagttttacagtctcttccagaaagtacaatgat

SEQ ID NO: 185266 - DNA, 601 bp, Human
tgtacacaaatgtttgcagcagacccaaactgaaacaacccaaatgtccattaactagtgaatagacaaccaaattttggtatatatgatggaatactactcagtactaaaaaggaatgaactattgactcactataacaacttaaattaatctcagaataactatgctgaaccaaagaagccagaccaaaagaaaagtatatactgcattattccgtttatacaaaactttaggaaacacaaattatactaacagaactgattagtggttgccttaggtgaagagtttagtgtgggagtrgcctggagaggggaggattttgaagcgaccagccactgaaaaggacatacaaaggaaaagaaaatgaaatagcttgtgaacataaaaatcaacttcactaataattataaaactacaattcaaacaagatatcacattttgcctattagactgataaattaagaaaaatcgatattgtcctaaactgacaaagaagtgggtaaaaacagtcacctttataagctgttattgggaggatgatttggtttatccatattgggggtcaatctggtagtagcaatcatgattttaaataggcaa

SEQ ID NO: 185267 - DNA, 601 bp, Human
aacccaaatgtccattaactagtgaatagacaaccaaattttggtatatatgatggaatactactcagtactaaaaaggaatgaactattgactcactataacaacttaaattaatctcagaataactatgctgaaccaaagaagccagaccaaaagaaaagtatatactgcattattccgtttatacaaaactttaggaaacacaaattatactaacagaactgattagtggttgccttaggtgaagagtttagtgtgggagtggcctggagaggggaggattttgaagcgaccagccaytgaaaaggacatacaaaggaaaagaaaatgaaatagcttgtgaacataaaaatcaacttcactaataattataaaactacaattcaaacaagatatcacattttgcctattagactgataaattaagaaaaatcgatattgtcctaaactgacaaagaagtgggtaaaaacagtcacctttataagctgttattgggaggatgatttggtttatccatattgggggtcaatctggtagtagcaatcatgattttaaataggcaagacctctgatctccctacttttaaaacccctattaa

SEQ ID NO: 185268 - DNA, 601 bp, Human
acacaaattatactaacagaactgattagtggttgccttaggtgaagagtttagtgtgggagtggcctggagaggggaggattttgaagcgaccagccactgaaaaggacatacaaaggaaaagaaaatgaaatagcttgtgaacataaaaatcaacttcactaataattataaaactacaattcaaacaagatatcacattttgcctattagactgataaattaagaaaaatcgatattgtcctaaactgacaaagaagtgggtaaaaacagtcacctttataagctgttattgggaggrtgatttggtttatccatattgggggtcaatctggtagtagcaatcatgattttaaataggcaagacctctgatctccctacttttaaaacccctattaagcagaaatcctgacacatacacacactgatatctatgcaagttccatgtaccataaaaaaaataaaactacataaatatctattaacatgggaaagttacataaattgtggttcactcactgaggaatattacacaactgttaaaaggtggtgatgtagatttgtaagaactgaggtggaaagattaaatattttaaagta

SEQ ID NO: 185269 - DNA, 601 bp, Human
ttttttattatctaaaacaatgccaatgtccaagccacaaatctggacattattatcttaaaatcctccccctctctcacatcccacatccatttagtcaccaagttctatcaattatacttccttaatgtctctctaatctgtcccctctgctcactaccactgacttggttgagtctcatcatgtctctctatgattataatagtctcctaattgttccttctgtctccagccactcctgtctttaatctgtctacccaagtgcaggtagagtgatctttctcaactctaatctaattrtgttactccactgcttaaaatgtttcaatgactcttcactgtcttcgggacaaaggccaaattccttagttagcacacaaagtactcaataatctggccacatcctgaaatctccagccccatcttccccatcttccactattcccctacattcaccctccactatagccatgctgaattattaaagttctttagtctcttagttatttagttctttggttattttatggaacttaatttctctggtgtctcattcctgtatgtatccagagtgatctatacacagaacactttcactct

SEQ ID NO: 185270 - DNA, 601 bp, Human
gagtagattttgcataattcttaagggccctaggatttacagaatggtcaatgagccttggcttcaccagctgcattagtccttaatgaaaagagtcagcctgtcctgtgaaactttgaacccaggcattgacttctttgcagctatgaaagtcctacatggcatcttcttccaacagaaggctatttcatgtacactgaaaatgtgttttttagtgttgccaccttcatcaatgatcttagctgcattttctggataacttggtacagcttttacatcagcacttgtcgcttcaccttgyacttttatgtcatggaactggtttatttccttaaacatcatgaaccaacctctgctagtttctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtct

SEQ ID NO: 185271 - DNA, 601 bp, Human
agtagattttgcataattcttaagggccctaggatttacagaatggtcaatgagccttggcttcaccagctgcattagtccttaatgaaaagagtcagcctgtcctgtgaaactttgaacccaggcattgacttctttgcagctatgaaagtcctacatggcatcttcttccaacagaaggctatttcatgtacactgaaaatgtgttttttagtgttgccaccttcatcaatgatcttagctgcattttctggataacttggtacagcttttacatcagcacttgtcgcttcaccttgcrcttttatgtcatggaactggtttatttccttaaacatcatgaaccaacctctgctagtttctttttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctc

SEQ ID NO: 185272 - DNA, 601 bp, Human
tgacttctttgcagctatgaaagtcctacatggcatcttcttccaacagaaggctatttcatgtacactgaaaatgtgttttttagtgttgccaccttcatcaatgatcttagctgcattttctggataacttggtacagcttttacatcagcacttgtcgcttcaccttgcacttttatgtcatggaactggtttatttccttaaacatcatgaaccaacctctgctagtttctttttttttttttttttttttttttttttgagacggagtctcgctctgtcgcccaggccggactgcrgactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcaacctctgctagtttcaaacttttcttttgcagcttccttacttcctc

SEQ ID NO: 185273 - DNA, 601 bp, Human
agtacacctatctggccctctggcacactggccccagtcttactgtattatctagactctggtgttccaacctgagacctcaggccactcaaaggagaacagcaaaggaaaaaatatatgatacaagaaaatcgctggccattgaggggaatggacaatatgaccttggagatattttcgattctcaaaaatctctgattctatattcttccccacccacacacactcgaagcctccaaaaagaaaataaaaacagatatttgattttgatagtccatagaaacttaacctctgtagacckcagtttacctgtaagtaaatactacataaagttgtgagaaatcgaggagatgctttgtgtcaaatgtatagcaccatgtctgacacatagcaagctgtcaaaaaatgctatcatttttactgtgataattattattacagccccagctagagagagaaaaagggaaggagtggatattttcacctcattctgaatcatcggcataattcccagaatcaaaaggggaatcttttctgctctctgaacattggagcaaacctcagatcacaactgcatcctacatttatcaccctatctcat

SEQ ID NO: 185274 - DNA, 601 bp, Human
ccctctggcacactggccccagtcttactgtattatctagactctggtgttccaacctgagacctcaggccactcaaaggagaacagcaaaggaaaaaatatatgatacaagaaaatcgctggccattgaggggaatggacaatatgaccttggagatattttcgattctcaaaaatctctgattctatattcttccccacccacacacactcgaagcctccaaaaagaaaataaaaacagatatttgattttgatagtccatagaaacttaacctctgtagaccgcagtttacctgtaastaaatactacataaagttgtgagaaatcgaggagatgctttgtgtcaaatgtatagcaccatgtctgacacatagcaagctgtcaaaaaatgctatcatttttactgtgataattattattacagccccagctagagagagaaaaagggaaggagtggatattttcacctcattctgaatcatcggcataattcccagaatcaaaaggggaatcttttctgctctctgaacattggagcaaacctcagatcacaactgcatcctacatttatcaccctatctcattgggtttggacatgc

SEQ ID NO: 185275 - DNA, 601 bp, Human
ccatatttgttgctccccaagtcttatagttatcccattgcatcccactgcctgcttgtctaacttttctggagaaatcaaaactcatatgtgagctcttctaagctaaagccaccttctgattctctgagggagttacttggcatcccatttaggatactcttccttcttggccttcttatgagatttggaagttcacctattctttggggaaattgctttgcatttagtgtctctctttttattatatattttgaaaatcagtatgggggataagtaacattccaaattgtgggttaayaagatgaatgaaaccaaaaacaagagtatgtgatgttatttgacagcaaaggaatcttgaactctctagtccactgaggttggttgtgagaagcctccagtacagaataaaatgattctgattgcatggtttagattagaggtcataaatttaaatgtctagaggggcaaggcaggtaacttacatgagagaaatgggcctggtgagaagtggctgccacatttaaacaagcagacattctttagaccaccattttcccgccactcacttagagacacaccatcaacagaataacttcta

SEQ ID NO: 185276 - DNA, 601 bp, Human
tattctttggggaaattgctttgcatttagtgtctctctttttattatatattttgaaaatcagtatgggggataagtaacattccaaattgtgggttaacaagatgaatgaaaccaaaaacaagagtatgtgatgttatttgacagcaaaggaatcttgaactctctagtccactgaggttggttgtgagaagcctccagtacagaataaaatgattctgattgcatggtttagattagaggtcataaatttaaatgtctagaggggcaaggcaggtaacttacatgagagaaatgggcstggtgagaagtggctgccacatttaaacaagcagacattctttagaccaccattttcccgccactcacttagagacacaccatcaacagaataacttctagttttaagaaagggaaattcctaggtcacatctaatgtaactctaatataatatttgttaaaacacttgggagtggtgagggctatggcaaattagaagcttgtgcccattccaaagcaagaaaccattactcaaccccaactgattgctgccacgtgggcatgcagatccagtgtgctaacatcctctttttttcctga

SEQ ID NO: 185277 - DNA, 601 bp, Human
caatggttaatcttaacatcagtaaggtgaatcaaccaatcttatgcatcttcagatgtgatgcagcatatggtgtatacaacatcacatgtgatttgttccagccaacaaatagttaactggaatccatctagcctttagatataacctctactttacaaaacatacaagaagtagagtaattagctgaaatatatgacaaagaagaaagcagacaaaactaggaagtaacattctacaggacaattggtcttctcttgttggtaaaacagtatcataaaaaaaggcactgggcaggggycatgctaatcttctctgtatcgttccaattttagtatatgtactgccaaaacactcctcagcaaatgcaaaataacagaaatcataacaaacagtctctcagaccacagtgcaatcaaattagaactcaggattaacaaactcactcaaaaccacacaactacatggaaagtgaacagcctgctcctgggtgactactgggtaaataacaaaattaaggcagaaataaataagtcctttgaaaccaatgagaacaaagacacaaaattccagaatctctgggacacagctaaagcagtat

SEQ ID NO: 185278 - DNA, 601 bp, Human
tttagtatatgtactgccaaaacactcctcagcaaatgcaaaataacagaaatcataacaaacagtctctcagaccacagtgcaatcaaattagaactcaggattaacaaactcactcaaaaccacacaactacatggaaagtgaacagcctgctcctgggtgactactgggtaaataacaaaattaaggcagaaataaataagtcctttgaaaccaatgagaacaaagacacaaaattccagaatctctgggacacagctaaagcagtattcgcagggaaatttatagcattaaatgtcyacaggagaaagcgggaaagatacaaaatcgaaacactaacatcacaattaaaagaactacagaagcaagagcaaacaaactgaaaagctagcagaacacaagaaataactaagatcagagcagaactgaaaaagatagagacacaaaaaatgcattaaaaaaaatcaatgaatccaggagctggtttttgaaaagattaactaaacagatagactgctagccagactaataaagaagaaaagagagaaaaatcaaatagacacaataaaaaatgataaaggggatatcaccactgatacc

SEQ ID NO: 185279 - DNA, 601 bp, Human; identical to SEQ ID NO: 25168

SEQ ID NO: 185280 - DNA, 601 bp, Human
aaggacagatcatataacaacatgaggtttgtgggcatgtctacacagtccccaggcatgctgctaatcgattcacttcctttttgttggtagctggctgatagcctcaactctccatagatgtgttaagtggaaaccagcataaactacataatcttcacatcactcagttggaagagaggttgtaagaggaatactatttagctttgactttgaaaatgcatgtggtgtgtatctatgggcacaaacacatgtatatttcaaggaagaggggtacagaaacaaaaaggcaatgtgatayatgagtttgcgaataagaaatccagatagacactaaatcctgtttataaaatagtagtgctatgaaaaacataaaagagctgaacaacacaagttcatgtattgtatgactatatgggctgctacatatggccacacggactactcattgtacagcaccataaaaagtatcattcaaaagcctacaagataaacagtgaaccctggcgtagaacaatacagcagccctggctataccgtacaagacaatggagaaataaaaatatagtaccacaatagttaatgtacactgaatacctac

SEQ ID NO: 185281 - DNA, 601 bp, Human
ggagaaataaaaatatagtaccacaatagttaatgtacactgaatacctactcaaagacagacactgttcaaaatgctctacacacattggatttggttattcctcacaacagtactatgaattacatgctactatgatccacaatctacaaataaggagaaatgcagtgagtttgataggacttgcccaaggtcatacagctactaagttgtggagctggaatacaaacccagatagtctgactatagagcccgtgtacttaaaaaccatgttgtaaacaaaacaaaacaaacaaatgamaaataaccaggaacttacctggcttaatctgtaaaattaaaactgaataccacctctaaagtatttttgccaaaaaattaaacctacaactgattaagcgtctagatcaaaataccaatgtatagaaaaaacagtcaccagactatatttggtaacagaatcagaagaacgcggaataattctacagaataaacaactcagttatttccacaaataaatgaaaaaaaagtgaggggagctatagattaaaagaggctcgagacttaacaaaatgcaatgtgtggaccttgtttggatcct

SEQ ID NO: 185282 - DNA, 601 bp, Human
cctccatacagggttaggaggtcagaaaagaaattttccaattagttacagagagaagctccctagaagtttgaaactatgcttggtggtaaaggcattagagttgaagatgtccaggagaggaaaaatgtttttatgtttttgacaccaagagacaacaaaatgaaatcaaatttcttcatctttgggaaacgggtaccttggtgatgacaaaggcccatccacagctgttaatggggctaagtgaggagacagtgactactagaactgacaacatgactcactatgcctagaatgcctrtacaatgtggtttatgctgaatacctgcattccttctgggggtctagcattttcatatgtgctggacagaggttgccttcataactagcccccaataaacctgtgccaattaataatttaataatatcccccggtagacaacacttcatatgtgctgtcacaagcaatactggaggaattttgtacatcctgagtgactccactagagaactcctggaagcttgtgtctggtttcctctgaacatcgctctatgtgccttttcccgttgctaattttgtgttgtatcctttgactgtaat

SEQ ID NO: 185283 - DNA, 601 bp, Human
ggagaatgccaccacacctggttattttttttaatttttttatttttttggtagagaccgggttttgccatgttgcccagtctggtctcaaactcctgggctcaagcaatcctctcacgttagcctccccgagtgctgggattatcgaccacgatttcctttttaatcttttggtaactcaactgactaggccatgttgtaccataaagggtagcagtgatagaaagtgaaggactaagaacaacactgaaaaaacaatagcacagataataagcattaagtataaagaaggtttgcatartcacacaaataagtttcagttgagaaaaggaaccatagttggaatttagacattaacgtttatgaaaaaaagtaaaaagaaaacatcaggaacttagaaatcaaattatattaatgtaagaagtaaaaacttagggaacacagggtgaaactccaagttaataaatcataaactcagaattctgaaagtttccttctgccactgcaatgtctaaagctgcctttggaataacaccacattccaccagaaaccatgtaaaattatatcctctgaaaagaataatggcattcatttatttat

SEQ ID NO: 185284 - DNA, 601 bp, Human
catattattagaaatgtacaatgctttgcaggttttctaggacagtactgaggaaagtcttcgatgatgagtagaaatggtaaattggattatgaaataattagatctaataagaacaagctgacactgtataaaactctgagaaacctcagagggaacagaaagatactatgaggaatgctagataacaaggtcattaaaaagtaattataatatatgtacattgtcaagaagttatgcctgattttgtaaacagaaataaaagaaatgatataggttgatgaaaaccagcttacatctyggttatcattcatatcacctatcacaaactgttattgcattgaaaacctccaaatatatgggtagtagattccaacttgttgacataaagactcatcattttctacaaagctgatatccttagaatgcttgcacgcatgaacagcagaggttgttcaaaatgatggcatctgagtcaaattaagtctgcagacatgttttgattgccttgcatactaatgttttttattcgtaaagtatttcaaatataaagacaaaaaggtggggggaagcaaacacccatgtactaatcatattttaa

SEQ ID NO: 185285 - DNA, 601 bp, Human
gaacaggagatgataaatccccacttacttgctgagtgacttagggcaaattatttgatttcaatgacatgaggtaaaaaatagcacccagtttataagagttatgagaattaaataagttcataaatgcaaaaagcttagactttggtactcactaaacactatataaacatttgttactatgaatgatgataataatgttgctattcctgttatcataaaaatgtaaaggaagttatgatgatgaaatagagcctaagaatcaatgcgtggatagtcaatgccttaaaagaatcgtttyaacatcaatttgattaagcttcatggctagctccaaaaattaatggtttaacatgacctgtggcctgttttcctgtaatcaaggatctctaaagaatttgctttctatgtgagctcctatgcttttgacttgagcaccatctctcagtaagggaaatgaaggtttcctgagagatctgttatttccagttatgagaaaggaagaagaaaggcttagtgctatggactgtggcttgaatgaggaagtgggattttaaatgacattgctagaagacactaagactggcttatgggaaaggag

SEQ ID NO: 185286 - DNA, 601 bp, Human
atcataaaaatgtaaaggaagttatgatgatgaaatagagcctaagaatcaatgcgtggatagtcaatgccttaaaagaatcgttttaacatcaatttgattaagcttcatggctagctccaaaaattaatggtttaacatgacctgtggcctgttttcctgtaatcaaggatctctaaagaatttgctttctatgtgagctcctatgcttttgacttgagcaccatctctcagtaagggaaatgaaggtttcctgagagatctgttatttccagttatgagaaaggaagaagaaaggctwagtgctatggactgtggcttgaatgaggaagtgggattttaaatgacattgctagaagacactaagactggcttatgggaaaggagaaagcagatcattaataaaaaatgccagtgatggaaggaagatgatgacaggcaatgagatttggaaaagtgaacatggaacaagaaaaaaaccacaaaggatgttaaaggatacgataatatgataacaccataaaaaagaagagttagcaataaacttgtatactatcccaaagctagtctgttctccttgctagtatcagggttgtttatg

SEQ ID NO: 185287 - DNA, 601 bp, Human
atattcaagaggtcagctggctggagagcatgcctttccagtcttagtaggtatgagtcaattgaggctgaaagacatatcgagacccatcctccaacaaaccatcatgaaaataaaatgatgctgagcaaggaaagaccttaaacttcataggcagtaacattcaacctgttatgattttatcaacagtttttagtccacccctggatgaggtgaacccagcattgacaagtcctgcacaggggcagctagatgctgctaaaaaagtcacacaacaggtaagactggtgtcaccatataytcacaatcaacaatctcccctgggcatttaacaccttctagcaagtctgtgttctcaggtcaatgtactccttccctcccttgaaacggttatttcaaacttcctccaatttcccaagacctgaaatccctcacatctttacttccttgtattagtctgctctcgaactgctataaagaactacctcagactaggtaatttataaagaaaagaggtttaattggctcagggttccacaggctgtacagaaagcatggcagcatctgcttctggggaggcctcaggaaacttataatcatg

SEQ ID NO: 185288 - DNA, 601 bp, Human
aaaccctgaacattgagtgtctaatggccttccctagacagaaacattgcatgtgttgctttctttttgttactggggtaagaatgtgctttgtgtgaccccttgttgaagggagagagcgtaaggaagcttgcacaaggattcctgcacatgccacctgtgtctttttcccttatgatttggctatatgttctcacttatgccattataataaccctcagccactaatacaagtatatgctgagaccccgtgattccttctagtaaatttatgaacctgagacaggtcttggggatttaygatatagtggtcatacactgtagccctggactactattttgtttctattaccattaaagaataatattaacatttttcaaaattatatgtatacaggttatagatctttgattttcattccataatattaaaggaggagttaccaaatgttcgttataagagaaggaccttatgtctaaaaaggttaagaaacactgctgtagacaaagaacaacattggcagcaattttattaacaatcatgaaaataatagcagctaatatttacagagtgcttaccatatgccaaacattgcactaa

SEQ ID NO: 185289 - DNA, 601 bp, Human
gagccaactagactagcagcataactagcagatggcagggacaaggttttaaggcaagtatctagattccagagcccctttcacctattcaggcatggtgttgccaccaaaacaacacagcagaatccaaataaatatatcacctaaggacagctcataatttgtgaggactgataagcaaatatgttaataaattctgccagctaaaattatatcgattcttcctcatctctcttggaataattctctcatatttaatgtttgacacagaatgcaaataccgggatcataaatgtgaagsatacctttttagatagtgcattttataactggtctactatgattcttattttgaagtcacagttcttagtcctttctttacaaatagaatataaattcccacaacttttcagattgctggaaaaggttagaagccatagcaatttagaaatggtcaggtcaatacgtctatgtatttcatattttctgtgaaaggtcagaggttacaggtatttaaaattgtaatactgttatccctatggttttatggatttataagaaggaccaaagcataaaagaacattagcagaacaatagtaca

SEQ ID NO: 185290 - DNA, 601 bp, Human
gaagccatagcaatttagaaatggtcaggtcaatacgtctatgtatttcatattttctgtgaaaggtcagaggttacaggtatttaaaattgtaatactgttatccctatggttttatggatttataagaaggaccaaagcataaaagaacattagcagaacaatagtacacaccacacacacacacacacacacacacacacacacacataaacggagtagcagagattttttttaagtctattaaaggtgaagtctatgctgaccaagttaagtagtgtagaaatcgggagtagagccrggtgacaaaaagcatgctagagggtgcaaagcacagtttttattagacaagcaagatcaagtagagaggcaaaaatcagtttcaagtgaaactgcaaaattctacccatcccaagaaaagcaaatataatgaccaagttaaggaagaatcagaatgaattttaaaactgttctgaagttgtgtattagagaacataaaggcacagatcactacataaatcagtggttctctcatctacagttttggcacacaaaaaaaggaaaatgaaaaatttacgtcagttgctctcagacttcagtg

SEQ ID NO: 185291 - DNA, 601 bp, Human
acctgatatgattagcctttgtgtccccacccaaatctcatcttgaattgtaatccccatactccccacatgtctagagacagacctggtgggaggtgattggatcagggggcagtttcccccatgctgctctcctgccaccatgtgaagaaggtccttgcttcccctttgccttccgccatgactgtgaatttcctgaggccaccctagccatgtggatctgtgagtcaattaaacctttttctttacaaattacccagtctcgggtagtatctttacagcagtgtaaaaacagactaayacactacctcttcagaaattttgattctcagatcccaggatatttaacaaacattccagatgattaagacacagattgcccaccaccacatgttggacatactctgccctgtgtaggctgtgcttctgatatcttactagaaaacccaacctgataagcagcttacaaaatgtgaagactgggataatgtagagaaagagttcttgtttctctacaataggtttcaaagtaatggtaaaacagttgtaataacagaggttatggtatggcaagtaccaaatctattttttaaagaaaaat

SEQ ID NO: 185292 - DNA, 601 bp, Human
aggaatgttaaatactaaattccagatactggttatctgtatcagaacaggaaagcaatatgatctgggagggttatgtgaaggggtatgcaggaggctttcaagctattgaaaatgttctgttttttatgctgagttcttatagactcattatattattgattataccttatatatgttatttaagatccttcatataaaccaaattttattataaattaatagtaataaaataataaaaaaactaaatgaagagattattttttgaaagcgtatgactgagcaatatatatccatgtcmtcaaaggcaaacagcctaagcctctggatagtataaaaaacgtaagtaacactgcaggaacagaagaaagaagtagacaacattagagtacatacagagtaggagggaagaattgtctctctatggaaattattctacttaaattgccaagaaccttaaaaatatagaggtatataattttaaattatgctttctaaaatgtaaattcacatgtcattatatggaaacagtggcatttgaaatttcaaagctgaaaagggttttaggaatatgttttatattgtaaatcagctaattatg

SEQ ID NO: 185293 - DNA, 601 bp, Human
tattgtaaatcagctaattatgttacttaatcaagtgaaaaaataggctcatgtaagtcataaactattattttagaatacggacaagctgatcacataataaaatgtatttaccaggcatttagcttgaagaaacaacttcttttattattaaataataaaacatatttttaagttaaaggatattttatgtctcagttcaaaaacaagaaaatataataaatcatgtattatttaaaacctgctagtactttagtctgaatctttgcaaaggaagactttgcctaaataataggctttygcgaactccaactatttttgttaacagataaatgtacttgaaaaacatgcacctctctcataaaaaagaataaaaattaagttacaaagggcattttgatatctaaaggttgtagttccaaactgaagaaaaataaaaatggttcttaaaatgcacagttagaaatatcttgctaatttaaagtactctaccttggatcttctattgtactaatttacacaaaaaccactgaatttttttttgttgtttaaattccacatataaatgagaccatgcagtatttttctttctcttttgggc

SEQ ID NO: 185294 - DNA, 601 bp, Human
tgctagtactttagtctgaatctttgcaaaggaagactttgcctaaataataggctttcgcgaactccaactatttttgttaacagataaatgtacttgaaaaacatgcacctctctcataaaaaagaataaaaattaagttacaaagggcattttgatatctaaaggttgtagttccaaactgaagaaaaataaaaatggttcttaaaatgcacagttagaaatatcttgctaatttaaagtactctaccttggatcttctattgtactaatttacacaaaaaccactgaatttttttttgttgtttaaattccacatataaatgagaccatgcagtatttttctttctcttttgggctaatatcattatgatgttcatccatgttgtcgcaaatggcacatctctttcttttttaaggctgaatgaaaatccattctgtgtgtgtgtgtgtgtgtgtgtgtgtgtgtatataccacaatttatccattcatttgtcaacagacactggttatttccatatattgactaatgtgaataacaatgcaacaaaaacggaatgcagacatgattatgaggtgctgatttcatttcctttgggt

SEQ ID NO: 185295 - DNA, 601 bp, Human
aggaagactttgcctaaataataggctttcgcgaactccaactatttttgttaacagataaatgtacttgaaaaacatgcacctctctcataaaaaagaataaaaattaagttacaaagggcattttgatatctaaaggttgtagttccaaactgaagaaaaataaaaatggttcttaaaatgcacagttagaaatatcttgctaatttaaagtactctaccttggatcttctattgtactaatttacacaaaaaccactgaatttttttttgttgtttaaattccacatataaatgagaycatgcagtatttttctttctcttttgggctaatatcattatgatgttcatccatgttgtcgcaaatggcacatctctttcttttttaaggctgaatgaaaatccattctgtgtgtgtgtgtgtgtgtgtgtgtgtgtgtatataccacaatttatccattcatttgtcaacagacactggttatttccatatattgactaatgtgaataacaatgcaacaaaaacggaatgcagacatgattatgaggtgctgatttcatttcctttgggtatataaccagaagagggattgctgagtca

SEQ ID NO: 185296 - DNA, 601 bp, Human
gttgtagttccaaactgaagaaaaataaaaatggttcttaaaatgcacagttagaaatatcttgctaatttaaagtactctaccttggatcttctattgtactaatttacacaaaaaccactgaatttttttttgttgtttaaattccacatataaatgagaccatgcagtatttttctttctcttttgggctaatatcattatgatgttcatccatgttgtcgcaaatggcacatctctttcttttttaaggctgaatgaaaatccattctgtgtgtgtgtgtgtgtgtgtgtgtgtgtrtatataccacaatttatccattcatttgtcaacagacactggttatttccatatattgactaatgtgaataacaatgcaacaaaaacggaatgcagacatgattatgaggtgctgatttcatttcctttgggtatataaccagaagagggattgctgagtcatatggtcattctatttttaatttctttagaaatgttcatactattttccacagtggctgtactaatctaccttcctaccaactgtatagaaggtttcctgtttctccacactctcaaaaacacttgttatcttttgtc

SEQ ID NO: 185297 - DNA, 601 bp, Human
tgtagttccaaactgaagaaaaataaaaatggttcttaaaatgcacagttagaaatatcttgctaatttaaagtactctaccttggatcttctattgtactaatttacacaaaaaccactgaatttttttttgttgtttaaattccacatataaatgagaccatgcagtatttttctttctcttttgggctaatatcattatgatgttcatccatgttgtcgcaaatggcacatctctttcttttttaaggctgaatgaaaatccattctgtgtgtgtgtgtgtgtgtgtgtgtgtgtgtrtataccacaatttatccattcatttgtcaacagacactggttatttccatatattgactaatgtgaataacaatgcaacaaaaacggaatgcagacatgattatgaggtgctgatttcatttcctttgggtatataaccagaagagggattgctgagtcatatggtcattctatttttaatttctttagaaatgttcatactattttccacagtggctgtactaatctaccttcctaccaactgtatagaaggtttcctgtttctccacactctcaaaaacacttgttatcttttgtcta

SEQ ID NO: 185298 - DNA, 601 bp, Human
gtctatttaataacagccattcaaataagtgtgacgtgtatctcattgtggttttggcttgcatttctttaatgattagtgctgttggtataggtattgagaagaaatgtggttatatcctataaagggtgatgctgaggtaaaaaaaatcacaggataaattataaaatgaaattaaaacatagaatcataaagatcataatggtgattataccaacaacattttttaaaaaactccttccatttatggacggtttactgcagacattttccatataaaatgtcatctaatcctcacaayggtcatatgaggtgggtactactgtgattcccattttatagatggagatcaggctctacattaaataatgtgtccaaggtcaaaaagctagataatctagccaaaagcactcatagtgtaatagaattcattgaactgctcatgttcccatgaatcacaaatgttcttaatggcatctacaatggtgaaccctttccaggttttcaatatactctgcccatatccattagaggaatcactgtttatggcagctatggccttacaaaatgtatttcttaataagacttaaaggcaaaatta

SEQ ID NO: 185299 - DNA, 601 bp, Human
ctgtagccgcctttgtcaatgatcttagctacaccttctaactacaccttctagacaacatgcatctacattagcacttgctgcttcactttgcccttttatgttatagagacagcttctttccttaaacttcatgaaccaacaacctatgctagcttcaaatttttcttctgaggcttcctcaccattctgaagcttcaaagaattgaagagttagagtactgctctttattaaactttggtttaagggaatgttgtggctggtttgaccttctatccagaccactcaaactttccccaygtcaactataaggctgttgttctttcttatcatttgtgtcttcactggagtagcacttttaactttttagcaaaaaacagttcctacaaggatttctcatttgcattcacaacttgactattttgcacaagagacttagtttttggcctatctcagctttcgacatgccttcctcattaagcttaatcatttttagcatttcatttaaagtgagagatgtgtgactcacttggaccctaagagatgatggtagagttattcgttgccataactgcaatattgctgtatctcagggaacag

SEQ ID NO: 185300 - DNA, 601 bp, Human
ttagcaaaaaacagttcctacaaggatttctcatttgcattcacaacttgactattttgcacaagagacttagtttttggcctatctcagctttcgacatgccttcctcattaagcttaatcatttttagcatttcatttaaagtgagagatgtgtgactcacttggaccctaagagatgatggtagagttattcgttgccataactgcaatattgctgtatctcagggaacagggaggcccaaggagaggcacagagataaggaactactgattggcagagcacagcacaacatttacakattaagtttaccatcttatatagcgtggtttgtggcaccctaaagcaattacaatagtaacatcaaagatcaatgatcacagatcaccataacagatataataaaaattgtaaagtttgaaatattccaagatttacaaaaatgtgacatagagataagaagtgggcacatgctgttgaaaaaatggcaccaagaaacttgctcagtacatcgccacagtgcttcaatttatataaataattgtttaaaaacacaatatctgcaaaatgccatgaaatgaggtatgccagaataaagcta

SEQ ID NO: 185301 - DNA, 601 bp, Human
aaaggcgcttaatgtcactgatcatcatataaacgcaaatcaaaactacaaggagatatcatcttatctcattaaaatggcttttatgtaaaagacaggaagtaacaaatgctggcaaggatgtggagaaaaaggaaacctttgtacactcttggtaggaatgtaaattagtacaaccaccatagataacaacttggaggttccacaaaaaatctcaaaattgagttaccatataatccagcaatcaaattgttggatatatatgtgtgtatatatatgtgtgtgtgtgtgtatatgtgtrtatatgtatgtacaggtatatatatgtacatatgtatatctgtatacatatacacatgtatacatatctgtatacatgcgcgcatgcatgcatatatatgcatacatatatgcatgtatacatatgtatgcatacacatgtatatatgtatatatacacatatgtgtatatgtgtgtgtgttatatatatatatacacccaaaagaaaggaaatctgtatactgaagagatatctgcccatccatgtttgttgcagcactgttcacaatagccaagatcctggaagcaacttaagtatcc

SEQ ID NO: 185302 - DNA, 601 bp, Human
agaaaaaggaaacctttgtacactcttggtaggaatgtaaattagtacaaccaccatagataacaacttggaggttccacaaaaaatctcaaaattgagttaccatataatccagcaatcaaattgttggatatatatgtgtgtatatatatgtgtgtgtgtgtgtatatgtgtatatatgtatgtacaggtatatatatgtacatatgtatatctgtatacatatacacatgtatacatatctgtatacatgcgcgcatgcatgcatatatatgcatacatatatgcatgtatacatatrtatgcatacacatgtatatatgtatatatacacatatgtgtatatgtgtgtgtgttatatatatatatacacccaaaagaaaggaaatctgtatactgaagagatatctgcccatccatgtttgttgcagcactgttcacaatagccaagatcctggaagcaacttaagtatccatcaacagatgaatggataaagaaaatgtagtacttatacacaatggagtatgattcagaatgagattctgtcattagctgcaacctggatggaactggagatcattacgttaaggaaaataagcc

SEQ ID NO: 185303 - DNA, 601 bp, Human
acacatgtatacatatctgtatacatgcgcgcatgcatgcatatatatgcatacatatatgcatgtatacatatgtatgcatacacatgtatatatgtatatatacacatatgtgtatatgtgtgtgtgttatatatatatatacacccaaaagaaaggaaatctgtatactgaagagatatctgcccatccatgtttgttgcagcactgttcacaatagccaagatcctggaagcaacttaagtatccatcaacagatgaatggataaagaaaatgtagtacttatacacaatggagtaygattcagaatgagattctgtcattagctgcaacctggatggaactggagatcattacgttaaggaaaataagccaggcacaaaaagacaaacatcatatgttctcaagttatttatgagatctaaaactcaaaacaactgaaatcatggacataaagaatagaaggatgccaccccactgtcaacattagacagatcaacgagacagaacgttaacaaggatacccaggaattgaactcagctctgcaccaaacggacctaatagacatctacagaactctccaccccaaatcaacagaa

SEQ ID NO: 185304 - DNA, 601 bp, Human
acagatgaatggataaagaaaatgtagtacttatacacaatggagtatgattcagaatgagattctgtcattagctgcaacctggatggaactggagatcattacgttaaggaaaataagccaggcacaaaaagacaaacatcatatgttctcaagttatttatgagatctaaaactcaaaacaactgaaatcatggacataaagaatagaaggatgccaccccactgtcaacattagacagatcaacgagacagaacgttaacaaggatacccaggaattgaactcagctctgcaccaarcggacctaatagacatctacagaactctccaccccaaatcaacagaatatacatttttttcagcaccacaccacccttattccaaaattgaacacatagttggaaataaagctctcctcagcaaatgtaaaagatcagaaattataacaaactgtctctcagaccacggtgcaatcaaactagaactcaggattaaaaaactcactcaaaaccactcaactacgtggaaactgaacaacctactcctgaatgactactgggtacataatgaaatgaaggcagaaataaagatgttctttg

SEQ ID NO: 185305 - DNA, 601 bp, Human
aattgacttggcccattgatcccttacaccatgcatggactgtgcagatatgccacggtgacaacctccccatcgagacgttcatccagtataactcatgcctgcttgctctacacccactaatgagaactcatcagaggtaacctgctttggtaacatactggacccaataaaggcctcaactcattatctctccacctgctggttgagcacatttcctctacagtatttccaacagcccctgtcggtacccctgttttcccatcaacctgtgaataataaactgtctacattatttcayctgtttttgttgtgctgtctcctctgtatagtattacccaactgacacacctatatctccccagactgatacattcagacttaacttttctcccagttaagcctctcctacacagtggctatcttgacaggaataaacgggacacaggtctgataatagccacaagcatctgccagtataaaataatttctggtgagaaagacacttgttcacacctcagacaattaggcatcataccatctgccaggataaagaagtatcctgtgaaaggcacattgtaaacatccacaaccaaatccc

SEQ ID NO: 185306 - DNA, 601 bp, Human
agaaatgtaactacttaaaccaaacaagaattttttttcctatttaaatcttcgaaaaaggaaaaaaaaatcattgtctattcaaagtccagacaaaaaaagtttactaaactgtagtgaccatgatgaacttcacttgaaccctgtgctccaaggaagcatcaatggtttagaaataccacacctccccgatctttttgtgtcctcagaaacaagtaacttcaaaagtctaccctgtctttgcatataggacacatctccatcctacctcatgactcatgtaagcctcatgatgactctsttgtaatctgcctctaaaaagccttaaatctccttctcctgggaaatattcctcaataatgaaggttctccctattgcaacagtctaaataaagacattccctaatggtctggaacatcttgtctttgacaaagcaatcgtactcaaaacaatgtggtactggcataaagacagacctgcagtccggtggaatagaacagagagcacagaaagaatccctaacatatatggtgcaataattttcaacaaagataccaagaccatctaatgtgtaaaggacagtctttgaaacaaatgatg

SEQ ID NO: 185307 - DNA, 601 bp, Human
tgtgtgttagagatgaggggttaatactgaaaatatataaagacctcctaaatctcaacaaaaaataaacaaactgattctaaaatgagcaaagaatttgaatagacattccttaaaagaaataaatagcccgtgagcacatgaaaagatattcaacattgtcacatggaaaatgcaaatcaaaaccacaatgagataccacctcacacccattagaatggctacatatcaaaaataaataaataaggaaaattcaaagtgttggtgaggatgtggaaaaactggaacccttgtgcactgytggtggcaatgtgaaatggtaaagccactatgcaacatagtatggtggttcctaaaaaactagaaacagaattactatataacccagcaattctactttctcgacatatacttaaacccatttatgctggcagttgcaatttttttgaatttttgcaatcagaccttgatgatgaccttgagtagtaagatataaataactcctacatgcttagcattccaataatggaacactaggcataaatgggttaaagaagtaaaagcagcttcttgaagggatatttgtatatccatgtttaca

SEQ ID NO: 185308 - DNA, 601 bp, Human
tgcattattataaagaaatacctgagattgcataatttaattaaaaaaaagaggtttaattggctcacggttccgcaggctatacaggaagcatggtgctaacatctgctcggtttctggggaggcctcaggaagcttacatcatggtagaagatgaagggggagttgacacttcatgtggccagaatgggaggaagagagagagtggggaggtgctacacacttttaacagccagatgtcacaagaactgactcattatcactggaacagcaccaagtggatgaggctaaaccattcacragaaattcacccccatgatctaatcatctcctactaggccccacctccaacattggagattacgattcaacatgagatttgggcagggacacagatacaaaccatatcagctgctcatagaatagacctatattttaagaggaatgttatgccaattgactggcagtgtatatgttattttgtattatctcaattagaaaagtttggagattttaacattaatacttacatttgggagaattttattgatctctgatatatccatgtcaaaataccccattacacactatattaggtagg

SEQ ID NO: 185309 - DNA, 601 bp, Human
ttaaaaaaaagaggtttaattggctcacggttccgcaggctatacaggaagcatggtgctaacatctgctcggtttctggggaggcctcaggaagcttacatcatggtagaagatgaagggggagttgacacttcatgtggccagaatgggaggaagagagagagtggggaggtgctacacacttttaacagccagatgtcacaagaactgactcattatcactggaacagcaccaagtggatgaggctaaaccattcacgagaaattcacccccatgatctaatcatctcctactaggcyccacctccaacattggagattacgattcaacatgagatttgggcagggacacagatacaaaccatatcagctgctcatagaatagacctatattttaagaggaatgttatgccaattgactggcagtgtatatgttattttgtattatctcaattagaaaagtttggagattttaacattaatacttacatttgggagaattttattgatctctgatatatccatgtcaaaataccccattacacactatattaggtaggttttgttttcctatggcagcatttttattcctttgcctag

SEQ ID NO: 185310 - DNA, 601 bp, Human
ttttcacctgctaaatttggcatccctaggccaggaatggtggttcacgcctgtaatccgagcactttaagaggccgaggcaggtggatcacttgaggtcaggactttgagaccagcccggccaacatggtgaaacactgtctctactaaaaatttaaaaaaaattagccgggcatggggccaggtgcccataatcacagctacttgggaggttgaggcaggagaattgcttgaacctgggaggcagaggttgcagtgagctaagattgcgccactgcactccagcctgggcaacagagcragactccatcaataaataaatacataataaataaatttggcaaccctattccatctttatcttagtgtcactttccacttacatctaaatcctgagttcaagtccatggtgttcacaaatcctatgtctagaactctggccagaggctagatggccaaagccattaaagcaagtatttcatctctgcagaaggcaaattaactatcaaactcaacagttggcttgatagtggtaggatctcccggacgactggtgggtacatatggacatagaacaatggctacaccttaggcaccggag

SEQ ID NO: 185311 - DNA, 601 bp, Human
tgtcatctctcatttatttggcttcccagatgttgctgccactagagattcaaagtccttttactttgtcttgtcacatctttaaaaaaaatacaattaaaaaattactattctttgttgaaggtgatctataacctgaaatttaaagctacctctttgagaattactcatttcctgggtatcccccatgtatgcatgaaatatacgtattaattagcttgttttctcctactaatcttgtcttttgttacaagggtatgttctgactaagaacttacgagagttgaagaaaaattgtttkttactctacaacacctaaacagaaaattgactgataagcagcaatttacaaggtgttcaaatataaaggcataacaaatataacctgactctaggctgtgaatttttttctttctgaaatggcaatttctccactagagggagaccacagcatgctttaaaaggcaatgagtcggaggggggagggatagcatcagaagatatacctaatgctaaatgacaagttaatgggtgcagcacaccaacatggcacatgtatacatatgtaacaaacctgcacgttgtgcacatgtaccctaaa

SEQ ID NO: 185312 - DNA, 601 bp, Human
aatagtgtatgtagtaggcagatttctggttcccaaaggtgtccacatactaatatcaggaacctgggaatatgttaagtcacatgccaaaggagaattaaggttacagataggtttaaggtcactaatcagatgaccttgagataggaagattattctgatgatctgggtggaatgaatgtaatcacaagggtcctttaaagcagaagaggaaggcagaagagaaagaaccagagtgatggcagcatgagagggactctgcctggtgttgttaaagtggaccatgagacaaggaaagttytagaagctgaaaaggtaagggaacagactgtcttctccaaaaaaaaaaaaaaagtagccttgctgacaccttgattttagctccagaagaatgattttaggctactgacctccagaactataagaggataaattcgtattggttttttgtttgtttgtttgtttgtttgcttgtttgaggtggagtcttgctctgtcgcccaggctggagtgcagtggtgccatctcagctcactgcaagctctgcctcccaggttcacgccattctcctgcctcagcctcccgattagctgggactaca

SEQ ID NO: 185313 - DNA, 601 bp, Human
gatgaccttgagataggaagattattctgatgatctgggtggaatgaatgtaatcacaagggtcctttaaagcagaagaggaaggcagaagagaaagaaccagagtgatggcagcatgagagggactctgcctggtgttgttaaagtggaccatgagacaaggaaagttctagaagctgaaaaggtaagggaacagactgtcttctccaaaaaaaaaaaaaaagtagccttgctgacaccttgattttagctccagaagaatgattttaggctactgacctccagaactataagaggatamattcgtattggttttttgtttgtttgtttgtttgtttgcttgtttgaggtggagtcttgctctgtcgcccaggctggagtgcagtggtgccatctcagctcactgcaagctctgcctcccaggttcacgccattctcctgcctcagcctcccgattagctgggactacaggtgcccgccaccacacccggctaattttttgtatttttagtagagatggggtttcaccatgttagccaggatggtctcgatctcctgacctcgtgatccgcccgccttggcctcccaaagtgcggggatt

SEQ ID NO: 185314 - DNA, 601 bp, Human
tgaagcagctataactagcaaggcacagtaccagagaagagtgagctatgtggaaaaagagctcaacaaccttacctgggggtggatactttatatctggcccaacaaagcttaaaaagaagactcaaataaatcaaattgatccacaaataactgcccacaaaacaaaattcagtcctctttaaaagaaatcaacaaaatcaagacattcagtaagtcacaacatccagcaaccaataaagattacaagaaatgttttttaagaaacaaaaatgtgagccataaccagaataaaaaaaaatcaatcaatagaaaaacatattaaaaaaaaagaagtaaaccaagaacaaagatagaactgtaggaaacacacagtcaaggtgtaaaaaacagaaagataaaggttcagcaagttattgaaaaggaatcctataagatgttagaagaggtcaggcattgtggctcatgcctgtaatcccagcactttgggaggcaaaggcaagaggatgattgaaggccagaagttcaagaccagcctaggcaatatagtgagaccccatcactacaaaaaaattaaaaatcagcctggtgtagtggcaca

SEQ ID NO: 185315 - DNA, 601 bp, Human
caagaaatgttttttaagaaacaaaaatgtgagccataaccagaataaaaaaaaatcaatcaatagaaaaacatattaaaaaaaaagaagtaaaccaagaacaaagatagaactgtaggaaacacacagtcaaggtgtaaaaaacagaaagataaaggttcagcaagttattgaaaaggaatcctataagatgttagaagaggtcaggcattgtggctcatgcctgtaatcccagcactttgggaggcaaaggcaagaggatgattgaaggccagaagttcaagaccagcctaggcaatayagtgagaccccatcactacaaaaaaattaaaaatcagcctggtgtagtggcacacgcctatagtcccagctacccaggaggctcaggttgaggatgcagtgagccatgatcatgccactgcactccagcctaggcgacagagctagaccctgtctcaaaaaaaaaaaaaaaaagatgtgagaagaatcagaagagtgctgatgtgttatggaagtcacgaagtcatgtaaggagaaagtttcaaaaaagagaaagtggtcaacaaggagatcaagtaagacacaaactcaaaagtattca

SEQ ID NO: 185316 - DNA, 601 bp, Human; identical to SEQ ID NO: 25169

SEQ ID NO: 185317 - DNA, 601 bp, Human; identical to SEQ ID NO: 25170

SEQ ID NO: 185318 - DNA, 601 bp, Human; identical to SEQ ID NO: 25171

SEQ ID NO: 185319 - DNA, 601 bp, Human; identical to SEQ ID NO: 25172

SEQ ID NO: 185320 - DNA, 601 bp, Human
acttggatacagggtggggaacatcacacactggagcttgacgtggggtggggggaggggggtgggatagcattaggagatagacctaatgtaaatgatgagttaatgggtgcagcacaccaacatggcacatgtctacatatgtaacaaacctgcacgttgtgcacatgtaccttataatttaaagtataataaaaaaaagaagatgaagatatcaacgaaattaacaacaggaaatcaacaaaaccaaaaagctggttctttgaaaaaaatcaataaaattgttaatattttagccacrttaaataagtaagagagtaaatacacaaagaagtggcatcagaaataaaagaatgaaaaaaatgagatcccgtcatttgcaacaacatggatggaactgaaagttattttgttaagtcaaataagccaggcacaaaaagacaagatatttaagaggagaactacaaaacactgatgaaaaaaatcaaaggtcaaaataaatggaaagatattccatgtacatattaggttggtgcaaaaggaactgtgatttctgccattacttttaatggtacaacgcagaatagtgacaaggatgtgg

SEQ ID NO: 185321 - DNA, 601 bp, Human
ggacaggccattacaactggctttcaacacccttatagtccaccaaggacaagagatgcatcccaaaagcccaatattcctttcagttgtaaaaagaaatgttgacattaagttatgtgctagccatgtccttcccagagttacagtaaatcaagaataaattgccaggtggagcgcagtggctcatgcctgtaatatcagcactttgggaggccaaggcgggaggattgcttgagcccaggagtttgagaccagcctgggtaacatggcaaaacccagtctctacaaaaaaaaaaaaaaacacacaaaaattagctgggcatggtggggtgtgcctgtatttccagctactctgaaggctgaggtgggaggttgcaatgagctgagatcacgctactgcactccactcatctcaaaattttaaaagaataaattgccaattattgtggaaagatgcagagcaagatgtcgaaatagaaggctccaccgattgtccccctccactgcagtgacaccaagttaacaactatctacacagaaaaaaataccttcatcagaaccaaaaatcatgtaagcactcatagtacaaagtacctggttg

SEQ ID NO: 185322 - DNA, 601 bp, Human
tgggaggttgcaatgagctgagatcacgctactgcactccactcatctcaaaattttaaaagaataaattgccaattattgtggaaagatgcagagcaagatgtcgaaatagaaggctccaccgattgtccccctccactgcagtgacaccaagttaacaactatctacacagaaaaaaataccttcatcagaaccaaaaatcatgtaagcactcatagtacaaagtacctggttgtaacttcatatcgccgaaaggacactgaggagatagataaaacagtccagaattgcagacaccamcaccctgccaactcctggcagcagcagcatgtttcagagaacatctctggctgctggaggagggagaacacagcaattgtgatgcattgaactcagtgctttcctattgaagcagaaaagaaaactggaccaaaaatgggcaaaagatttgaatagacatttctcaaaaaaaaaaagacatacaaatggcaaacgggcatatgaaaagatgctcaacatcattgatcaaagcaatgcaaatcaaaactataatgagatatcatctcacccagttaaaatggcttatatccaaaagacagg

SEQ ID NO: 185323 - DNA, 601 bp, Human
gatgtcttagtcagacaatttggccctggtcccaccagaaaccacaaaaaagctcaattcagtggctgttcctctctggcaagggcacccttgaaaaagaactgaaaacatcatactgtgggcaactctgacaagacccaaaaaatatgaatcaaagggtacaaataccctccctgtcataaggctagaggggatgactgagtctttattctgccatccctactggacagtctagcattctacactgcgggatgaaagacccattataaacagagctggactaagacttgcttgtcctccyttaatcttgggtcagagaagtcggtggggggaggcggggaagttgcatgattataggaaggcgaatagtggtgagaacagttctgcaaatcaagtgataaagtgtacacatggggaaggatgcacaaactttgcatgtgttgggaattttgagaggtgggagggataggagtgaaccaaaaagaaatctagagtgtggctgctcaaagaactttaaacatagtagagaagaaattaggaaaaaggggcaaagaaaggaatcatccttcatctatcgttggctccagaaattaactcttac

SEQ ID NO: 185324 - DNA, 601 bp, Human
atttttcaagcaaattcttacatgaaagcccaatataaaccgctgtttcatttgatcatgaaagacgggagacactgaggatccaaggagcacagtttggaaaagcttgagatctgtcctggggttacaaaatgctcgctgatgttataaagactatgtaaaaatcaaggccctgggctccgctatagaaattctgattctttaggtataaggtaggtcctgtgacaggataaacgagatcctcaggtgactcggatatgaagttatacgagaaataatgaactaaatactatttaaggtycctgccaacatggacattttacaatcctatattttcctttggttaatttgggaaatataatttcaaaccaacactgttttccacaaattaccttctatagtgttcctagtagaatcaataacaatgaattattgagcaccaactatatgccagacactgagctaaatgatttacagacactctctgatataagtattatctgatttgctcctcatgaccttgtgaggtggattatactcccccactatactgatgtggaaaacagatgctcaacaagctcaattaatgttaccaagatcc

SEQ ID NO: 185325 - DNA, 601 bp, Human
ctctcataataatgaaatttgaatgtatccattactcattcatttaccaacatttcattgaacatctactgtatgccaggcactcctttatgtgctgggaaaacagtagtgaacaaaacaaggccatacaaaccacccataaaacttgtgaaaaatcttaaattacatgggaaaatgcttataataaaatatttggttagaaagataatattatatatttaatatgaactacattgcatacaaagaaaacagatatatgtagagaaaaagacttaaaggataatataaaagtatgtccaasatactatttctgtgcaggaatatcttcctatcataagtaacttatacttttatatattattaaaattgactataataggcatttattaataataatacattttcacattttagttccagggctaataaatataactgtgttactaacttgttccagtaacaatagatcattcataatagctctttggttcagtgttctcatctagcaaatgctctacactaaccctttaactcaggaatcagcaaactttttcttaaatggccagaagataacgattttaggctttgaggaccatccagt

SEQ ID NO: 185326 - DNA, 601 bp, Human
aacctgaagcgtcgctcgtatcccttgctcaactgtctctgattcgcagtttgagaagcgcgaggggtgcaatgatatttccaattctacttccttgggtcactttgcctcagttatcttatcagcgtaaaagggaaattaatatctccctcgtcgcaatggcaagaaaatttatagggccaatgcacacgatagagcacttgggtcatagaaagcactgagctcattcgggttgaaagtcatccactagttatcctcttgtgccctttaacttttctaaggccaaggggaaggacttccragcacgggcagctggaactccagggctgtcagagccaccgcgggcaccttcacaaacagcgggttaacatcccaaccctatacaggcaagcccgccctggggacagcaaacgagtggggaagcacatccttttcactggactgaagcagccaatttcccttccgcgacaaacttggccacttacaaagaagagagaaaacggagcaagctgcagcaaaaataaacggtgaagcgcgacgatgccggccaagaagacccccagttacttaccggcctgcttaccagccattttgaccagaa

SEQ ID NO: 185327 - DNA, 601 bp, Human
gccaaattaataaaataattatttaaaaagtctcccccacccccaaaaagctcaatgtcaattaggttaacggatgtttctggcaacctgatgtttcctaacagcttcacaattgctgggggcggggagaaaaggatcaacattttttaagctactccaacttggttgcattgcagtgagacgagattgtgccattgcactccagcctgggcgacaaagcaagactccgtctcaaagacaaaacaaacaaacaaacaaaacggctactccaacttgtaccgccagagggcagagattagcaaaaaaaaaaaaaaagaaagaaaaaagaaaaaaagaacctacaataaattcaaatttctccaaacctactgatcaagctgacgctctagataatccaaggtcaacctgaagcgtcgctcgtatcccttgctcaactgtctctgattcgcagtttgagaagcgcgaggggtgcaatgatatttccaattctacttccttgggtcactttgcctcagttatcttatcagcgtaaaagggaaattaatatctccctcgtcgcaatggcaagaaaatttatagggccaatgcacacgatagagca

SEQ ID NO: 185328 - DNA, 601 bp, Human
tagctaatgggagttgagatctggtctatgtagttcccaaacacgcacagaagcagtgtcttgaatttagtaagactccttcaatatctgccaaattaataaaataattatttaaaaagtctcccccacccccaaaaagctcaatgtcaattaggttaacggatgtttctggcaacctgatgtttcctaacagcttcacaattgctgggggcggggagaaaaggatcaacattttttaagctactccaacttggttgcattgcagtgagacgagattgtgccattgcactccagcctgggmgacaaagcaagactccgtctcaaagacaaaacaaacaaacaaacaaaacggctactccaacttgtaccgccagagggcagagattagcaaaaaaaaaaaaaaagaaagaaaaaagaaaaaaagaacctacaataaattcaaatttctccaaacctactgatcaagctgacgctctagataatccaaggtcaacctgaagcgtcgctcgtatcccttgctcaactgtctctgattcgcagtttgagaagcgcgaggggtgcaatgatatttccaattctacttccttgggtcactttgcct

SEQ ID NO: 185329 - DNA, 601 bp, Human
cattaaacagcacagctgcttacccagtttattgaatcctgcagcattgtaataccattttcgaataccatccagccacttgcctgatgctgaaactgataattgtcacactgttaattgctacaatttaattatactatatgaacacattgataggcaagcaaccagtactcagttatcttgctgatgaatgcaaacatagaaataaatttccttttaaaagtatatagtatatacagcaagaatttaatcaaaagaattagatttaaaagaaaaaagtttatactctataaaatgttgrtaaaaagtgcttattttatttatgagcaaaagtggttgcaggaaaatggtggcaagtcatgaaagaaaagggtaaactcaaacactgaatgtacaaaagatccataggtacatcgtgtgcccttatgcctgccctgttaccttcagaaatgaaggggtgggagataggaaaaggacttggaaatttccatcatttgtagtttcataaatagatcacaggaaataattgtaaacttttcatttcaagagagctggagttgtagggaaaagacagtgagatttcagcatagactggcaggtc

SEQ ID NO: 185330 - DNA, 601 bp, Human
cagatacggttcaaggtagaaattttcctaaagaatgaatgaaatattatatgttaccatcacgtactgatatatcccaaacactcaacaggtcttcaataacaagaaaaaagcaattacttttgaatttccaattttagaaaacatattctcaacctaagaactatctgctttttaaaatgtcaaatctgtggtgatggtgtgataagttgctttgataggttatgagggggaagtcttttcgggaagaaaaagaaatgaatgtccacaggcctttgcctagtttcaatgcagttcaagrggtgagagtttgcttcacagaagctcttcttgggatctggagggacactcaatgggctgatcttttcatctaagtaggaagcagagtgcagagctggaacagcaaagacctgggaggcaacagacctggattttagtcctggctctctatattagagacttgcttagtaatttcagaagaatcatttcacacgtaagactcaatgtggttttcttctaaaacggaaataacatttgctttattaacctcacatatttatttgacatgactcagagaactctaacactatgcaaatgaaca

SEQ ID NO: 185331 - DNA, 601 bp, Human
ctctgcactggaacttgaggcttcctgtctcctccatgggccccaccagtcacagggacatgaaatccgtggcctggaggagggagagggagagcaggagcagcagcagccacgaggtgttctgagccagcaggctgatgccctcacacttgaccagtttgtctgcagaaagagaagggggccgggggcagggtaggaaggaagacggatcaggactcaggcaggcacaggcccaaagcaagggtgtactccctttgggaggtgggtactgcaatgtcttagctgggaccaggaacagccyggtctcacagaaccagccatctttcccatttgcagattactgatctcttgcacacatatcatcttatgaaaaccttactaaacatcatgacaagaaaactggctgagggaggtggtgtcatccctgttttcccgctgggagaaggaagattagggaggccaaaggccttgcccacagttctggtggaaccacactgctctgcctgtctggccctgagctcttcaccccattcacaccgaaggcaatggttccccagttgaccaggcagcagttgggagagggtgagagcgttatggggct

SEQ ID NO: 185332 - DNA, 601 bp, Human
tatgcataattgaaacttacaagtctaagtccaggaacacaagtggaaactagatatgtggtttctgccaaaactgagctaagaaagacttgctagaagattctcagtaaacaatgtggctttgctgtctttgttttgaaaagaattaaattagaaaggtgacagtcttcctagagttagaaattaacctcgaggtcagaataacttagcacttattattttccccacatgtaaggttgcatctgaacaatgcacatgtctgttctgggtgtttcattgaatattctaatttgagacagcmagagcctgtgaataacctggttactacccactagtgtgtgtgttgtgtgtgtgtttgttgtcatgaaagtgcttacctccttcattgcattacttaattatagttcatctatttcgtcagctgccaagcccatttccaaatgagttaggtcagtttctgttttcccagtttgtttggatatttctctgccactaggaaagttcctgtttcaagttctgtattatatctctaaactctattcagttatgcagagcccatagccttattttggcaagaccacctgttatttctgaaattgcc

SEQ ID NO: 185333 - DNA, 601 bp, Human
cacccttaacacatacagatttaaattgctatgcacaatcatttggttacttttaaattttacacttgtttaatattgaggctcttgttttataaattggggaactgtgacccaagttcacatagaaaaatagtgacaaagtgagagtccacacttgggcttgctagcatttttggcctactgaacattaagtagaagagttgaaataccggataacatttttttaaataatctataattttagagcagaattttgtcttttttatcttgtgatttttctaaagagaggaggataaatttktatgttgaattctgcagttatgttcaggggctttctatttaacatcaaacatttttattcatgcctacatgggtttttgaatatgttcctgaatgacatctccaagataatttagtcgtacttcatcaatgagagagaattaagcagaagaaatattcttttttgaaaatatgaggagcataaatctcaatgagacaataggcttgtctttgatcatttctgttgactctgagagtttatgagttacctgagtcttggcacaacctgagatgacaaatcttgtcagaaaacgtgatgaca

SEQ ID NO: 185334 - DNA, 601 bp, Human
tatattaaacacaattaatatttgctagatggatgatcacattgatactttatttggagttatcaccactatgttatagactcaattagctgcactttaaaaatgtatttaaaaatattaaaaaagatattttgagaagcaaaatacctagaggttaagtaacagttttggaaaattcaattctgttgttgtttctgatgaagtctaataagttttcttctctctctttcacatttttatctcttattatattattatattattcagtattaactgaagatatttgtgtgtgtgtgtgtgwgagagagagagatagagagagagagacagaaagagaggaagagaggaagagagaggggttactgagctatgatatgactgaataaagtggcagtgatatgactgccagtggcagaaagagaagcattgttttagaaattaaagaaaccttagagaaatctaatccaaacttcatttcaccctctaccccacctcattccttgttctctgttttcagagataaggcagctcagttgcagggaaacaaaataagtatgtgagctagaactggattccatttctcatgagtctaatgcagggt

SEQ ID NO: 185335 - DNA, 601 bp, Human
aattgcagacacttatagtccaaactgttgcgccttcaggagatgtttcttttggaataataatgtaagaataatttaagttggatttatagaagtgagaagcccgatggaagggagtcaaggtagaaaaggttataaaaaagctcttcttatgtaagattgtcttgagaaaaaaatatgtttccaacagaaaatttgaaacaatactctataaatgaagctttggcttttaggggaggcaagtcccacctttagagattttagtcacagagttccaaacactcagattaatttaaattgkacttttttttttttttttttttttgaaacagagtcttgctctgtcaccaggctggagtgcagtggggtgatctcggctcactgcaacctctgcttcccgggttcacgccattctcctgcctcagcctcccgagtagttgggaccacaggcgcccaccaccacatctggctaattttttttttttttttttttttttggtattttggtttcaccatgttggccaggatggtctcgatctcttgacctcatgatccaccagcctcagcctcccaaagtgctgggttgtactctttacataag

SEQ ID NO: 185336 - DNA, 601 bp, Human
ttctttatttgactagctttaagtatagcattgtatgataatatgtaagcgaaatatattagcatttgaagtatgatttagaaatgactacctaaattggaaagtataacttaatgcttatgactagaaacacatggcatattaatatttttgctacttgtcaaggaagattctatggctatttttcaaaactcaaaattaaaataattacttatttttaacctgttatattaaccttgggtttcatatgttttatctcaaattgctatagaccgtttttaccttaggtcttaatgaagtrcagttacaaagctaacattaaaaatatataggaatagaattattactggcagaaggcaaggttagttttctatagatttatatatatgtgtgtatatatgtgagtgtatatatatatttatatataagtaatatatgtatatatgtgttcatatatatttatatataagtaatatttataagtatatatgtatgtatatatataagtatatacgtgtgcgtatatatatctatacacacacacacacacacacacatatatatactctctgaaaagtaggttgctactagaaggtgctga

SEQ ID NO: 185337 - DNA, 601 bp, Human
atagagaaattatgttcaaacaacactaaggtcatgaaaagcctgacattaaggaaatatatgcatgctttagcatttattccctccctgtatgactcattaaagtaatgactagcgattcttttttttttttttttttttttttttttttgagagggagtcttcctctgtcgcccaggctggagtgcagtggcgcgatctccgctccctgcaagctccgcctcctgggttcaagccattctcctgcctcagccgcctgagtagctgggactacaggcgcccgccaccatgcctggctaatttttttttttttttttgtatttttagtagagacggggttttaccgtgttagccaggatggtctcgatatcctgacctcgtgatccgcacgcctcggcctcccaaagtgctgggattacaggcgtgagccaccgcgcccggcctgaccagcgattcttaaggttaacaggatagtggatgtaatatttctctggagatagattttttattcattggatcgcattcactcttctaccctagtttgcaagtgtttgggagcagacgcatattgcaggaacatttgagaaccactattttaaag

SEQ ID NO: 185338 - DNA, 601 bp, Human
tatgttccaaaattttatcttttcactgaatacacatgatgaaacagctgattcagactcttcctatgctgatagaaactggattctagggctcagtatggttcatttgggatgcctgttcctcctcatattagacaagatatattctgattttacctagctttcactgtattaattaaaatctatactcatgtgtaatgcaatgcaaagagtaacttaggtacataaatcaataatgaatgtttcttaggttgagtttcttgttgttactgtaagtggaaaccgattttttatttagagyctttttttgtgatggggtctgattaggagcatttctctgaacacatgatggaataaaacagtggaaattctccaactgatgtgcgtcttaagaaatcaaacttcaaaatcaaatctttgaaaatgttactgtgaaatatttagagcaggtcaaatctgtaaccgtgaatgtaatgccaaggcttttatccttccacagaatagctgggggagtttgtattttctgttacatgcctgtttccatgaattattttgttttatggttttgatggaccaaatctgtgaaacaaaacaactctat

SEQ ID NO: 185339 - DNA, 601 bp, Human
ttaatggtatgagcttgcaactgctttggggagtaatagatttcagaaatgttttgggacttgagaaaaattagacaaattttgcttgaagaaataacacccacttggaggataatgacacctgtgtgttaaatttgccttctctacccttacaggttgtcttttgagaatgaaatcctttcatgttatcttcttttgtttagtctgttggacattttcctttggattcaagtgtttattgattggtctagggggtgtgacaactagagtgacttcctacttctcaaaattctccttgacwgattggcatctgacttgttgtgtagaagtagttcagtggttactgttatgaaagagtgagaaattcttccatgaaggctgcagaatatattcaactttccacttcttttacagttcagacagaagacaatccacgtgtggctcaagtgtcaataacaaagtgtagctctgacatgaatggctattgtttgcatggacagtgcatctatctggtggacatgagtcaaaactactgcaggtaatatgtcagaaataaacaaacacagtttgtaaaattttgttttatagatttaggggtaca

SEQ ID NO: 185340 - DNA, 601 bp, Human
tgccatgacagaactaaatattattaaaactgaaatatgcctgcaaatctttgaccacaatcctttcctttatagatggggcactgaggtttagagaggttcattcaaatatcccagctcatatagttgacaaatgccagagtgaagaacaaattctttctaattcatattcttacagtaaacatagacatgatgtggtttcctcaaagctacatgtcttatttccaaaatagggacaaaataaactcaaaaatattaggaaaatagcttaatgaataaatgaaagaagattctaaattaygataaatctatgaatcctagctatgagaccttggaccttgggcacattatatacaacccatttgtatttcactttcttcatctgtaagatgaggatggtaacagcaaatgtgagagtaaaataaataatgcatgtatagcacttagaaaattgtaggtcaccaaattagtgcctgataaatattatttttattttgattagtgatagcattatatcaatgtgatggaaagagtgtattaatgtagcatgatttgtaaatattcattccttagaagggaggaaggaaaaagaaagagagac

SEQ ID NO: 185341 - DNA, 601 bp, Human
gctatgagaccttggaccttgggcacattatatacaacccatttgtatttcactttcttcatctgtaagatgaggatggtaacagcaaatgtgagagtaaaataaataatgcatgtatagcacttagaaaattgtaggtcaccaaattagtgcctgataaatattatttttattttgattagtgatagcattatatcaatgtgatggaaagagtgtattaatgtagcatgatttgtaaatattcattccttagaagggaggaaggaaaaagaaagagagacagaaaaagaaaacctaaaaytcagacttaaatgtggccacacgcctcttggaatttcacaatattcatgatcacgttaaagactttgagaaactctttaagtgtattttatcatttcattccaaaattgtttgactacagcacatcacctcttcatccctctttttttttttttttttaacattgtccaacctaaatctgttcaactttgtcattttggaaacactatgctaatgtgcctttggagtccatatataacacacttgttcctttgctattaactgcagtgctaacagtttcgtttgtgaatatttccaggta

SEQ ID NO: 185342 - DNA, 601 bp, Human
aaagaatagaaaaaaagagttcattatccaacctgattttgtccattttgtggctagatttagggaacctgagtgtctgatacaaactttccgacatggtcaaaaaagccttccttttatctgtcttgaaaatctttcatctttgaaggcctacactctcgtttcttcttttaagatttgccaatgatgatctgtcagaggtaatcactgtgcatgtgtttaaagatttcaccactttttatggtggtgatcactatagtgaaatactgaaacttgtttgtcaaattgcacagcaaggggmcacagttcttgtttatcttttcatgataatttttagtagggagggaattcaaagtagagaattttactgcatctagatgcctgagttcatgcattcattccataaatatatattatggaatgctttattttcttttctgaggagtttactgatgttggtggaggagagactgaaatgaattatacacaaaatttaaaaattagcaaaattgcagcccctgggatattagcgtactctttctctgacttttctcccacttttaaggctctttttcctggcaatgtttccagttggtttcta

SEQ ID NO: 185343 - DNA, 601 bp, Human
ttcttgtttatcttttcatgataatttttagtagggagggaattcaaagtagagaattttactgcatctagatgcctgagttcatgcattcattccataaatatatattatggaatgctttattttcttttctgaggagtttactgatgttggtggaggagagactgaaatgaattatacacaaaatttaaaaattagcaaaattgcagcccctgggatattagcgtactctttctctgacttttctcccacttttaaggctctttttcctggcaatgtttccagttggtttctaactacwtagggaattccgctgtgaccagaatgatcgaatgatctttccttttcttagagagcaaaatcattattcgctaaagggagtacttgggaatttaggcataaattatgccttcaaaatttaatttggcacagtctcatctgagcttatggaggggtgtttcatgtagaatttttcttctaattttcatcaaattattcctttttgtagctcgatgaacttcgggatgaagggaaggcttcgtctgccaaacagagactcaagtgtgccagtctccaaaaatttggagaaagagctttcaaa

SEQ ID NO: 185344 - DNA, 601 bp, Human
gttgaagttacttcttatttttgcatagctccagctctgatcttcatctcatgtttttgcctgagcctctgttttcatattacttagttggttctgggagcatactttaatagccgagtcaagaaaaatactagctgccccgtcacccacactcctcacctgctagtcaacagcaaatcaacacaacaggaaataaaatgaaaataatagacattatgcatgctctctagaaactgtcaattgaactgtatttgctcatcattcctaccatctacaccaccaaaatcaaccaaatttatgaaaaaaaaacagccccaacataaaattatacacagataaacaggctatgattggttttgggaaagaagtcacctttacctgatttaggcaactgtgaaatgactagagaatgaagaaaattagacgtttacatcttgtcatagagtttgaagatagtgctggatctttctttttataagtaagatcaataaaaactccctcattctgtagaagttatgatttcttttctaagagacctttagaagtcagaaaaaatgtgtttcaattgagaaaaaagataactggagtttgtgtagtactt

SEQ ID NO: 185345 - DNA, 601 bp, Human
ttcaatctttccctgcctatggtggtggtacctttctgtttttaacctggctataaattaccagataaacccattcactgatttgtaactcctttcagtcatgctctaactgtaaatgaaggcttaaactgaagtagaacagttacaaggttttacttggcagaacatcttgcaaggtagatgtctaagaagatttttttttctttttttaagacagagtttcgctcttgtttcccaggctggggtgcaatggtgtgatcttggctcagcgcaacctctgcctcctgggttcaagtgattytcatgcctcagcctcccaagtagctgggattacaggcatgcgccaccacacctggctaattttgtatttttagtagaggcggggtttcaccatattgtccagactggtctcgaactcctgacctcaggtgatccacccgccttggcctcccaaagtgctgggattacaggcatgagccaccttgcccagcctaagaagattttttgagggaggtaggtggacttggagaaggtcactacttgaagagatttttggaaatgatgtatttttcttctctatattccttcccttaattaactc

SEQ ID NO: 185346 - DNA, 601 bp, Human
cttgaagagatttttggaaatgatgtatttttcttctctatattccttcccttaattaactctgtttgttagatgtgcaaatatttggaatgatatctcttttctcaaaacttataatattttctttctccctttcttcaagattaaacttatgggcaaatactagaatcctaatctctcatggcactttctggaaaatttaaggcggttattttatatatgtaagcagggcctatgactatgatcttgactcatttttcaaaaatcttctatattttatttagttatttggtttcaaaargcctgcacttaattttgggggattatttggaaaaacagcattgagttttaatgaaaaaaacttaaatgccctaacagtagaaacataaaattaataaataactgagctgagcacctgctactgattagtctattttaattaagtgggaatgtttttgtagtcctatctacatctccaggtttaggagcaaacagagtatgttcatagaaggaatatgtgtatggtcttagaatacaatgaatatgttctgccaacttaataaaggtctgaggagaaagtgtagcaatgtcaattcgtgtt

SEQ ID NO: 185347 - DNA, 601 bp, Human
agtagataagaaattattcttttatagctttggcatgacctcacaacttaggaggatagcctaggcttttctgtggagttgctacaatttccctgctgcccagaatgtttcttcatccttccctttcccaggctttaacaatttttgaaatagttaattagttgaatacattgtcataaaataatacatgttcacggcaaagctcaacattccttactccttaggggtatttctgaaaatacgtctagaaacattttgtgtatatataaattatgtatacttcagtcattcattccaagtrtatttcttgaacatctataatatatgtgtgtgactatgtattgcctgtctatctaactaatctaatctaatctagtctatctatctaatctatgcaatgatagcaaagaagtataaaaagaaatatagagtctgacaccaggtgctttatatttggtgaaaagaccagaagttcagtataatggcaatatggtaggcaactcaattacaaaataaatgtttacatattgtcagaagttgtggtgataaactgcatttttgttgttggattatgataatgcactaaataatatttcctaaa

SEQ ID NO: 185348 - DNA, 601 bp, Human
gggtatttctgaaaatacgtctagaaacattttgtgtatatataaattatgtatacttcagtcattcattccaagtgtatttcttgaacatctataatatatgtgtgtgactatgtattgcctgtctatctaactaatctaatctaatctagtctatctatctaatctatgcaatgatagcaaagaagtataaaaagaaatatagagtctgacaccaggtgctttatatttggtgaaaagaccagaagttcagtataatggcaatatggtaggcaactcaattacaaaataaatgtttacrtattgtcagaagttgtggtgataaactgcatttttgttgttggattatgataatgcactaaataatatttcctaaaattatgtaccctacaagatttcactcatacagagaagaaagagaatattttaagaacatatctctgcccatctatttatcagaatccttttgagatgtagtttaaatcaaacaaaatgttaataaaaataacaagtatcattcatcaaagacttcatatgtgccaagcagtgtgtgctttgtgtagattatgtcatatagttctcataatccaccttccgagac

SEQ ID NO: 185349 - DNA, 601 bp, Human
cctacaagatttcactcatacagagaagaaagagaatattttaagaacatatctctgcccatctatttatcagaatccttttgagatgtagtttaaatcaaacaaaatgttaataaaaataacaagtatcattcatcaaagacttcatatgtgccaagcagtgtgtgctttgtgtagattatgtcatatagttctcataatccaccttccgagacagatactatttattttttgagacagagttttactcttgttgcccaggctggagtgcaatggtgccatctcggctcaccacaacctycgcctcccaggttcaagcgattctcctgcctcagcctcctgggattacaggcatgcaccaccatgcctggctaattttgtatttttagtagagatggggtttcaccatgttggtcagactggtctcaaactcctgacctctggtgatatgcctgcctcagcctcctaaagtgctgggattacaggcatgagccactgtgcccagccgacagatactattattatttccattctaccgagaaggagactaaggctctgatcatttaaataagttgcctaaggtgatgcagtgatataagta

SEQ ID NO: 185350 - DNA, 601 bp, Human
atttgtccaacaaagtctattttattttcatcttaattaggtttttgtatgaatatgcaagaaggcatcctgattactctgtcgtgctgctgctgagacttgccaagacatatgaaaccactctagagaagtgctgtgccgctgcagatcctcatgaatgctatgccaaagtggtaggtttattgttggaaaaaaatgtagttctttgactgatgattccaataatgagaaagaaaaataatgcaagaatgtaaaatgatatacagtgcaatttagatcttttcttgagatggtttcaatwctggaatcttaaacatgaaagaaaaagtagccttagaatgattaacaaaatttagactagttagaatagaaagatctgaatagagcaatctctaaaaaattttgatctttttttctctttttcacaatcctgagaacaaaaaaaaattaaatttaaatgttaattagaagatatttaacttagatgtaaagtgagttaacctgattccaggattaatcaagtactagaattagtatcttatggcaaattatagaacctatccctttagaatattttcaaatctttttgaggatgtttagg

SEQ ID NO: 185351 - DNA, 601 bp, Human
ctgttctggaggatttttagggttcccactagcatatgtaatggtttctgaactattcagaatcagagaaaactcatttttcctgctttcaagaagctactgtatgccaggcaccatgcacaaacaatgaccaacgtaaaatctctcattttggagagcctggaatctaactggaaaggtgaactaataataataatatgtacaatcatagccatcatttattaaacttttattatatgcaaggcactgtttaatttcattagcttacctggtttacagagcagctctatgagatgagtgycatctttgcccctattttagggataaggattctgaaatgtggagatggtaagtaaaattgcacaactgaagaatgagttacatgacttggctcaaatactggtcattgaactccagagcctgaatattcttaaccacttacatgatgcaagctcaccaaataaatagttcgaatgtattgtgacagagcggcattgatattcatctattcatgtggctttgagtaggaagaagaaaggatatcattctgaccagaggggtgaaaaacaacctgcatctgatcctgaggcataatactatt

SEQ ID NO: 185352 - DNA, 601 bp, Human
gatgcaagctcaccaaataaatagttcgaatgtattgtgacagagcggcattgatattcatctattcatgtggctttgagtaggaagaagaaaggatatcattctgaccagaggggtgaaaaacaacctgcatctgatcctgaggcataatactattaacacaattcttttatgtttcagttcgatgaatttaaacctcttgtggaagagcctcagaatttaatcaaacaaaattgtgagctttttgagcagcttggagagtacaaattccagaatgcgtaagtaatttttattgactgattttttttatcaatttgtaattatttaagacttaatatatgagccacctagcatagaacttttaagaatgaaaatacattgcatatttctaatcactctttgtcaagaaagataggagaggagagataaaatagttgatggggtggagaggtctatatttgaatgtagtctaaaaattgttctcttaagattggaagtatgtaggctgggagggtaaataccaaatcttggtatatcagaactgagcatgtcccttgaaggttaagaaatagttaatgggcaaatagagcatggcaatatt

SEQ ID NO: 185353 - DNA, 601 bp, Human
cctccatagaagagacagagacagaatggcttgctggactaatgtcccaattcaatagagtcttatctatgaaggttaaaaacaagaagagacatattatacagtagatatttattgtgtggctcatacacatggtgctcttctgattatggattttagagataataacagtgaacaagacatagtttctttcctcgagtagattaaagtcatacattgacttttaatggtgactggcattcttaatacatgattattatatattaggtaccatgtcagattaattataatactttactayttttaatttaacccttgaactatccctattgagtcagatatatttccttccattttctacttgtatctttcaagtttagcatatgctgatacatatgaagctctctccaggttttattgaaagaagaaattaataaatttattaatgtcactgaattaggcaactcactttcccaagattatgcaagtggtacaggtggaactcaaagccaagtttaactagttgttcaggagaatgttttctaccctccactaacccactactctgcagatggagataatatgatgaatggaacatagc

SEQ ID NO: 185354 - DNA, 601 bp, Human
tgaaaacacatgacttctttttttcaggctattagttcgttacaccaagaaagtaccccaagtgtcaactccaactcttgtagaggtctcaagaaacctaggaaaagtgggcagcaaatgttgtaaacatcctgaagcaaaaagaatgccctgtgcagaagactatgtgagtctttaaaaaaatataataaattaataatgaaaaaattttacctttagatattgataatgctagctttcataagcagaaggaagtaatgtgtgtgtgtgcatgtttgtgtgcatgtgtgtgtgcatgcaygtgtgtgtatgtgtgatattggcagtcaaggccccgaggatgataattttttttttttttttgagacggagtctcgctttgttgtccaggctggagtgcagtggtgccatctcggctcactgcaacctccgcctcccaggttcaagccattctcctgcctcagcctcccaagtagctgggactacaggtgcatgccaccatgcctggctaattttttgtatttttagtagaaaattttcagcttcacctcttttgaatttctgctctcctgcctgttctttagctatccgtggtcctgaa

SEQ ID NO: 185355 - DNA, 601 bp, Human
gatatatgcacactttctgagaaggagagacaaatcaagaaacaaacgtgaggagtatttcattactgcatgtgtttgtagtcttgatagcaagaactgtcaattcaagctagcaactttttcctgaagtagtgattatatttcttagaggaaagtattggagtgttgcccttattatgctgataagagtacccagaataaaatgaataactttttaaagacaaaatcctctgttataatattgctaaaattattcagagtaatattgtggattaaagccacaatagaataacatgttagrccatattcagtagaaaaagatgaacaattaactgataaatttgtgcacatggcaaattagttaatgggaaccataggagaatttatttctagatgtaaataattattttaagtttgccctatggtggccccacacatgagacaaacccccaagatgtgacttttgagaatgagacttggataaaaaacatgtagaaatgcaagccctgaagctcaactccctattgctatcacaggggttataattgcataaaatttagctatagaaagttgctgtcatctcttgtgggctgtaatcatc

SEQ ID NO: 185356 - DNA, 601 bp, Human
agaggaaagtattggagtgttgcccttattatgctgataagagtacccagaataaaatgaataactttttaaagacaaaatcctctgttataatattgctaaaattattcagagtaatattgtggattaaagccacaatagaataacatgttaggccatattcagtagaaaaagatgaacaattaactgataaatttgtgcacatggcaaattagttaatgggaaccataggagaatttatttctagatgtaaataattattttaagtttgccctatggtggccccacacatgagacaaayccccaagatgtgacttttgagaatgagacttggataaaaaacatgtagaaatgcaagccctgaagctcaactccctattgctatcacaggggttataattgcataaaatttagctatagaaagttgctgtcatctcttgtgggctgtaatcatcgtctaggcttaagagtaatattgcaaaacctgtcatgcccacacaaatctctccctggcattgttgtctttgcagatgtcagtgaaagagaaccagcagctcccatgagtttggatagccttattttctatagcctccccactatt

SEQ ID NO: 185357 - DNA, 601 bp, Human
gtgggacagggatcttattttacaaacaattgtcttacaaaatgaataaaacagcactttgtttttatctcctgctctattgtgccatactgttaaatgtttataatgcctgttctgtttccaaatttgtgatgcttatgaatattaataggaatatttgtaaggcctgaaatattttgatcatgaaatcaaaacattaatttatttaaacatttacttgaaatgtggtggtttgtgatttagttgattttataggctagtgggagaatttacattcaaatgtctaaatcacttaaaattkccctttatggcctgacagtaacttttttttattcatttggggacaactatgtccgtgagcttccgtccagagattatagtagtaaattgtaattaaaggatatgatgcacgtgaaatcactttgcaatcatcaatagcttcataaatgttaattttgtatcctaatagtaatgctaatattttcctaacatctgtcatgtctttgtgttcagggtaaaaaacttgttgctgcaagtcaagctgccttaggcttataacatcacatttaaaagcatctcaggtaactatattttgaatttt

SEQ ID NO: 185358 - DNA, 601 bp, Human
tatctcctgctctattgtgccatactgttaaatgtttataatgcctgttctgtttccaaatttgtgatgcttatgaatattaataggaatatttgtaaggcctgaaatattttgatcatgaaatcaaaacattaatttatttaaacatttacttgaaatgtggtggtttgtgatttagttgattttataggctagtgggagaatttacattcaaatgtctaaatcacttaaaattgccctttatggcctgacagtaacttttttttattcatttggggacaactatgtccgtgagcttccrtccagagattatagtagtaaattgtaattaaaggatatgatgcacgtgaaatcactttgcaatcatcaatagcttcataaatgttaattttgtatcctaatagtaatgctaatattttcctaacatctgtcatgtctttgtgttcagggtaaaaaacttgttgctgcaagtcaagctgccttaggcttataacatcacatttaaaagcatctcaggtaactatattttgaattttttaaaaaagtaactataatagttattattaaaatagcaaagattgaccatttccaagagccatat

SEQ ID NO: 185359 - DNA, 601 bp, Human
agcagggattgaaagtggccggtgctcttgtcccagtgcaagtgaagtgaatccagtacacaaactaggtgttttatgagcgtagtccccagggtgtttctgagaaataaaggtgatactcctttaagactggaaactcataagccactgggctaatactctgctatcagctggggagccagaacccattccattaaaaggaattttttttcctttcatgtgtttttgcaaattctaagggagatctagatttttgatggtggtaaaatgaatgaaaataagactggtttggatgaaaggycagagttggtccttgaaccaaagcctagaaggtttgagttgctttcagctgagaaagacaactccacactcaaaatatgatttaatatggaaaagttatttagagtttctttgtaagctgcgttttgggctgattttattgttccatgtcttagaatgctgtatattctttgttatctcttggacttaaagaaaatcagcagggtggatgatttcttctgtagttgaaataatcttagtaataacaagtattgtttaaagtctcaatgcacaccagggctttgcacactttcaccacatt

SEQ ID NO: 185360 - DNA, 601 bp, Human
ccctgggagtcccaggccagagctggcaggctcaagtactccctggcttctgccttcatagtcttagagagaggagggccttggtttaaggcctcactgccccagttcagtagagagataggagtcatacgccaagacaggtgtcaaggtacaatttctttatgaggaatgaggtaaccgtctagtccagaacaggcaggaacacagtcttaccttggcgttcattccttagaagccagggttagaactctcaagttgagatgcccctcatttccttcaggtactgtttcaggtacataayggctttggtttaacatgaaagcccttgtttagtacagggaggaggcccagttcctaaaagatggtgacactgagggagtatgaggggaccccctccaagaaagaggtaacacagatagagccctatccccactgagacctgggagatccaggtatggtgacatgatgagtctcactcacttcttcctagagcatctcagggaagtggggaacttcatcaaagggggcagccttatgttagcagctagaggattcctaggtaattccaggagtcaaaaagaagaccctgagaactggggga

SEQ ID NO: 185361 - DNA, 601 bp, Human; identical to SEQ ID NO: 185359

SEQ ID NO: 185362 - DNA, 601 bp, Human; identical to SEQ ID NO: 185360

SEQ ID NO: 185363 - DNA, 601 bp, Human
aaggagctctacagaaacgtgatggagagtaactatgagacactggtctctctgagtgagtagcagttttctccctagaattctgtctcagacatactacaattcctggctggcagcctgtaattcagaccacacctgtggctcctgtggctgtgggtcctctgtcggcctgcacgggcagagaaatgccagtctctaggtcctcccatttacagacctgcacgggtggagaaatgccagtctctaggtcctcccatttacagagacttttggaaagctcgcagcattgtgccttttgtgttttttttttttttttcctgtggtcacatagtctgttcttgatagtattttctaataaataaaatgtcatataccctatagtgtgatatggctagggttcctcatgttgttttttaatttattttatcttttttttttctttttttctttgagacagagtcttgctctattgcccaggctggagtgcagtggcacgatcttggctcactgcaacctctgcctcacaggttcaagcgattctcctgcctcagcctctcgagtagctgaaattacaggtgactgccaccacgcccagctaatt

SEQ ID NO: 185364 - DNA, 601 bp, Human
aacgtgatggagagtaactatgagacactggtctctctgagtgagtagcagttttctccctagaattctgtctcagacatactacaattcctggctggcagcctgtaattcagaccacacctgtggctcctgtggctgtgggtcctctgtcggcctgcacgggcagagaaatgccagtctctaggtcctcccatttacagacctgcacgggtggagaaatgccagtctctaggtcctcccatttacagagacttttggaaagctcgcagcattgtgccttttgtgtttttttttttttttycctgtggtcacatagtctgttcttgatagtattttctaataaataaaatgtcatataccctatagtgtgatatggctagggttcctcatgttgttttttaatttattttatcttttttttttctttttttctttgagacagagtcttgctctattgcccaggctggagtgcagtggcacgatcttggctcactgcaacctctgcctcacaggttcaagcgattctcctgcctcagcctctcgagtagctgaaattacaggtgactgccaccacgcccagctaatttttgtatttttagta

SEQ ID NO: 185365 - DNA, 601 bp, Human
ctaggtcctcccatttacagacctgcacgggtggagaaatgccagtctctaggtcctcccatttacagagacttttggaaagctcgcagcattgtgccttttgtgttttttttttttttttcctgtggtcacatagtctgttcttgatagtattttctaataaataaaatgtcatataccctatagtgtgatatggctagggttcctcatgttgttttttaatttattttatcttttttttttctttttttctttgagacagagtcttgctctattgcccaggctggagtgcagtggcacratcttggctcactgcaacctctgcctcacaggttcaagcgattctcctgcctcagcctctcgagtagctgaaattacaggtgactgccaccacgcccagctaatttttgtatttttagtagaaatggggtttcaccatgttggccaagctggtcttgaactcctgacctcgtgatctgcccacctcagccccccaaagtgctaggattacaggtgtgagccactgcgtctggcctgttttatccttttttttttttttttttttttttgagactctgtcacctaggctggagtgcagtgg

SEQ ID NO: 185366 - DNA, 601 bp, Human
tcactgcaacctctgcctcacaggttcaagcgattctcctgcctcagcctctcgagtagctgaaattacaggtgactgccaccacgcccagctaatttttgtatttttagtagaaatggggtttcaccatgttggccaagctggtcttgaactcctgacctcgtgatctgcccacctcagccccccaaagtgctaggattacaggtgtgagccactgcgtctggcctgttttatccttttttttttttttttttttttttgagactctgtcacctaggctggagtgcagtggtacgatctyggctcactgcagccttgacagcttgggctcaaatgattctcccacctcagttttccgagtagctgggattacaggcacatgccactgcgcctggctaattttttaaattttttgtagagacgtgggtcttactgtgttgcccaggctggtcttgaacttctgggctcaagtgatccacccacgtcggcctcccaaagtgcagggattacaggcgtgagcctccgcacctggcctctcatgctgtttttaatatttaagactatttgagatgggtgtggtagctcacatctgtaatcccaa

SEQ ID NO: 185367 - DNA, 601 bp, Human
cacctcagttttccgagtagctgggattacaggcacatgccactgcgcctggctaattttttaaattttttgtagagacgtgggtcttactgtgttgcccaggctggtcttgaacttctgggctcaagtgatccacccacgtcggcctcccaaagtgcagggattacaggcgtgagcctccgcacctggcctctcatgctgtttttaatatttaagactatttgagatgggtgtggtagctcacatctgtaatcccaacactttgggaggccaaggtgggaggatagcttgaggctaggarttcgaaatcagcctggtcgacatagtgagatctctgttgcttaaaaaaaaaaaaaaaaaaaaaagatgatttgataaccctatgttaccttggatgaggcaggcagcacaggctgatcaaaagcattttcttggtgtttggccggaattatagctggtcattgtggtctcagtgattttttcttgttgattaggagtgctgcttaatagatataagtctttatatgcaaaatgttacctattacataataaatgtgttttgtttggtagacaaagtcttttaaaacctaggtacatggag

SEQ ID NO: 185368 - DNA, 601 bp, Human
ttttttgtagagacgtgggtcttactgtgttgcccaggctggtcttgaacttctgggctcaagtgatccacccacgtcggcctcccaaagtgcagggattacaggcgtgagcctccgcacctggcctctcatgctgtttttaatatttaagactatttgagatgggtgtggtagctcacatctgtaatcccaacactttgggaggccaaggtgggaggatagcttgaggctaggagttcgaaatcagcctggtcgacatagtgagatctctgttgcttaaaaaaaaaaaaaaaaaaaaaagatgatttgataaccctatgttaccttggatgaggcaggcagcacaggctgatcaaaagcattttcttggtgtttggccggaattatagctggtcattgtggtctcagtgattttttcttgttgattaggagtgctgcttaatagatataagtctttatatgcaaaatgttacctattacataataaatgtgttttgtttggtagacaaagtcttttaaaacctaggtacatggaggagtgtcaagtgcctggagcagagtaggaggtaaaggaaatagaaaatgggccagaaaagtgacc

SEQ ID NO: 185369 - DNA, 601 bp, Human
ctctcatgctgtttttaatatttaagactatttgagatgggtgtggtagctcacatctgtaatcccaacactttgggaggccaaggtgggaggatagcttgaggctaggagttcgaaatcagcctggtcgacatagtgagatctctgttgcttaaaaaaaaaaaaaaaaaaaaaagatgatttgataaccctatgttaccttggatgaggcaggcagcacaggctgatcaaaagcattttcttggtgtttggccggaattatagctggtcattgtggtctcagtgattttttcttgttgaktaggagtgctgcttaatagatataagtctttatatgcaaaatgttacctattacataataaatgtgttttgtttggtagacaaagtcttttaaaacctaggtacatggaggagtgtcaagtgcctggagcagagtaggaggtaaaggaaatagaaaatgggccagaaaagtgaccttgtaagcttggttgggtcacatgctctcattgtgactgtttccttgtctgtcccagtgcccatcttaccttgcagtgccttagcaaggatgaaattagatcccctgaaaggaagcattggcaag

SEQ ID NO: 185370 - DNA, 601 bp, Human
taagactatttgagatgggtgtggtagctcacatctgtaatcccaacactttgggaggccaaggtgggaggatagcttgaggctaggagttcgaaatcagcctggtcgacatagtgagatctctgttgcttaaaaaaaaaaaaaaaaaaaaaagatgatttgataaccctatgttaccttggatgaggcaggcagcacaggctgatcaaaagcattttcttggtgtttggccggaattatagctggtcattgtggtctcagtgattttttcttgttgattaggagtgctgcttaatagatrtaagtctttatatgcaaaatgttacctattacataataaatgtgttttgtttggtagacaaagtcttttaaaacctaggtacatggaggagtgtcaagtgcctggagcagagtaggaggtaaaggaaatagaaaatgggccagaaaagtgaccttgtaagcttggttgggtcacatgctctcattgtgactgtttccttgtctgtcccagtgcccatcttaccttgcagtgccttagcaaggatgaaattagatcccctgaaaggaagcattggcaagacttaagctgcacgcacatgga

SEQ ID NO: 185371 - DNA, 601 bp, Human
gaggctaggagttcgaaatcagcctggtcgacatagtgagatctctgttgcttaaaaaaaaaaaaaaaaaaaaaagatgatttgataaccctatgttaccttggatgaggcaggcagcacaggctgatcaaaagcattttcttggtgtttggccggaattatagctggtcattgtggtctcagtgattttttcttgttgattaggagtgctgcttaatagatataagtctttatatgcaaaatgttacctattacataataaatgtgttttgtttggtagacaaagtcttttaaaacctargtacatggaggagtgtcaagtgcctggagcagagtaggaggtaaaggaaatagaaaatgggccagaaaagtgaccttgtaagcttggttgggtcacatgctctcattgtgactgtttccttgtctgtcccagtgcccatcttaccttgcagtgccttagcaaggatgaaattagatcccctgaaaggaagcattggcaagacttaagctgcacgcacatggagaggcagaggtgggtggtggtgccatcaagggcagtggtagctctgtagcctgcctgcctgagccacagcccctctaa

SEQ ID NO: 185372 - DNA, 601 bp, Human
gaattttataattgtcccaaactgctaggggaaactgacaagaacagtagcctttgaatctatatttcctccctgccattggtcatcttggtcactggcagctgatcagtgtgcagtgagctttcactctctcctgggctcacactgtgctgtttcccacccagaggtccttggccagacagagggagaagcggagttgggtacagagatgctgggtgacttggaagaggaaggtcctggtggtgcccacccaggtgagtggctctggaatattctgttccccttccatagccctctgtarcctagagtgagctttcccacggctgaagtgccaggtgctgacttggtgacctcatctggcatctgcttgttctggactcctttatgattgtcgttagttcagctgttacatatgcctcaactcctaccaccctgtggggtctttaagactaacggccacatcaatcattattcttcatgccctacagaatagagtaccgtacgaggcggtagtcaaaacctgctggagattgagcgtaggtatgtcagagcttcaggagggaaggcagtgcaggaaaagcacttgtcagtaggtaatttg

SEQ ID NO: 185373 - DNA, 601 bp, Human
gtcactggcagctgatcagtgtgcagtgagctttcactctctcctgggctcacactgtgctgtttcccacccagaggtccttggccagacagagggagaagcggagttgggtacagagatgctgggtgacttggaagaggaaggtcctggtggtgcccacccaggtgagtggctctggaatattctgttccccttccatagccctctgtagcctagagtgagctttcccacggctgaagtgccaggtgctgacttggtgacctcatctggcatctgcttgttctggactcctttatgattrtcgttagttcagctgttacatatgcctcaactcctaccaccctgtggggtctttaagactaacggccacatcaatcattattcttcatgccctacagaatagagtaccgtacgaggcggtagtcaaaacctgctggagattgagcgtaggtatgtcagagcttcaggagggaaggcagtgcaggaaaagcacttgtcagtaggtaatttgggaggttatggaggaagaacagagctggacatgaattcttaagctgtaggtttagtttgtctttaatcattcaaatttgttattttaaca

SEQ ID NO: 185374 - DNA, 601 bp, Human
gctcctgaatgaccaatgggtcaatgaataaattaagaaggaaattaaaattttattgaaataaaaatggaaatacaacatagcaaaacctatgggatacagtgaaagcagtagtaagaggaaagtttatagcagtaaacacctacatcaaaaaagtagaaaaacttcaaataaacaacctaatgatgcatctcaaagaactaaaaaagcagaagcaaaccaaacccattcttaataaaagaaaagacataacagagagcagaaataaagaaattgaaatgaaggaaaacaatacaaaagwtcaatgaaaccaaaagttggttttttgaaaagataaagttgaaaaaccattagccagactaagaaaacaagagaagactcaaataaataaaatcagataaaaaaaaggaggcattacacctgatactgcagaaattcaaaggatcattagagactactacgagcaactatatggcaataaattggaaaacttagaagaaacagataaattcctagatgcatacaatccactaaaattgaaccagaaaggaactcaaaacctgaatagaccaataataagtaatgagatcaaagccataat

SEQ ID NO: 185375 - DNA, 601 bp, Human
accaatgggtcaatgaataaattaagaaggaaattaaaattttattgaaataaaaatggaaatacaacatagcaaaacctatgggatacagtgaaagcagtagtaagaggaaagtttatagcagtaaacacctacatcaaaaaagtagaaaaacttcaaataaacaacctaatgatgcatctcaaagaactaaaaaagcagaagcaaaccaaacccattcttaataaaagaaaagacataacagagagcagaaataaagaaattgaaatgaaggaaaacaatacaaaagttcaatgaaacmaaaagttggttttttgaaaagataaagttgaaaaaccattagccagactaagaaaacaagagaagactcaaataaataaaatcagataaaaaaaaggaggcattacacctgatactgcagaaattcaaaggatcattagagactactacgagcaactatatggcaataaattggaaaacttagaagaaacagataaattcctagatgcatacaatccactaaaattgaaccagaaaggaactcaaaacctgaatagaccaataataagtaatgagatcaaagccataataaaaagcttcc

SEQ ID NO: 185376 - DNA, 601 bp, Human
attcaacatagtactggaagccctagttagagcaatcagacaagggagagaaatagaagacatccaaattggaaaggaagaagtcaaattatccttgtttgaagactatataatcttatacttggaaaaacctaaagacttctccaaaaacctattagaattgataagcaaattcagtaaagttgcaggatccaaaaatcaacacacaaaaatagtagcatttctatatgccaacagcaaacaatctgaaaaagaaattaagaaagtaattccacttacaataactacaaataaaaaaaamtctgggaataaacttaaccaaagaggcaaaagaactctacaatgaaaactataaaacaatgatgcaaaaaattgaagagttcacaaaaaatgagaagatattccatagtcacggattgggagaatcaatattgttaaaatgtccatactacccaaagcaatctacagattcaatgcaatccctatcaaaataccaatgacattctccacagaaatagaaaaatgatcctacaatttatatggaaacacaaaagacctagagtagccaaagccatactgagcaaaaagagcacaactggag

SEQ ID NO: 185377 - DNA, 601 bp, Human
attggggaaaaagatagtcttttcaataaatggtgctgggaaaactaaatatctatatgctgaagaatgaaaccagactctgtctcttgccatgtgcaaaaaacaaatcaaaatggattaaaaacttaaatctaagatctcaaaccatgaaaccactgtaagaaaacattaaggaagctctccaggacattggtctaggcaaagatttcttgagcagtaccccaaaaacacaggaaaacagagcaaaaatccaccaatgggatcacatcaagttaaaaagcttctgcatagcaaagaaaasaatcaacaaagtgaagagacaacccacaaaatgggagaaaatatctgcaatctatccatctgacaagggattagtaaccagaatatgtaaggagctcaaacaaatctataggaaaaaaatctaataatctgattaaagaatgggcaacagttctgaatagacatttctcaatagacatacaaatggcaaacaagtatatgaaaaggtgctcaacatcattggtcatcaaagaaatgcaaattaaaactacaatgagatatcgtctcaccccaagttaaaatgacttttatccaaaagaca

SEQ ID NO: 185378 - DNA, 601 bp, Human
ctctccaggacattggtctaggcaaagatttcttgagcagtaccccaaaaacacaggaaaacagagcaaaaatccaccaatgggatcacatcaagttaaaaagcttctgcatagcaaagaaaagaatcaacaaagtgaagagacaacccacaaaatgggagaaaatatctgcaatctatccatctgacaagggattagtaaccagaatatgtaaggagctcaaacaaatctataggaaaaaaatctaataatctgattaaagaatgggcaacagttctgaatagacatttctcaatagacwtacaaatggcaaacaagtatatgaaaaggtgctcaacatcattggtcatcaaagaaatgcaaattaaaactacaatgagatatcgtctcaccccaagttaaaatgacttttatccaaaagacagggaataacaaatgctagtgagggatgtggagaaaaggaaactcttgtacactgttggtgggaatgtaaattagtacaaccgttatggaaaacagtttggagtttcctcaaaaaaatataaatagaactaccatataatccagcaatcccactgctagataaacccaaaagaatgca

SEQ ID NO: 185379 - DNA, 601 bp, Human
aaatatctgcaatctatccatctgacaagggattagtaaccagaatatgtaaggagctcaaacaaatctataggaaaaaaatctaataatctgattaaagaatgggcaacagttctgaatagacatttctcaatagacatacaaatggcaaacaagtatatgaaaaggtgctcaacatcattggtcatcaaagaaatgcaaattaaaactacaatgagatatcgtctcaccccaagttaaaatgacttttatccaaaagacagggaataacaaatgctagtgagggatgtggagaaaaggraactcttgtacactgttggtgggaatgtaaattagtacaaccgttatggaaaacagtttggagtttcctcaaaaaaatataaatagaactaccatataatccagcaatcccactgctagataaacccaaaagaatgcaattcagtatgtcaaagacatacctgtactaccacgtttgttgcagcactattcacaatagccaagatttggaagcaacttaagtgtccatcaacagatgaatagataaagaaaatgtggtacatatacacaatgaagtactattcagccataaaaaaataga

SEQ ID NO: 185380 - DNA, 601 bp, Human
gacttttatccaaaagacagggaataacaaatgctagtgagggatgtggagaaaaggaaactcttgtacactgttggtgggaatgtaaattagtacaaccgttatggaaaacagtttggagtttcctcaaaaaaatataaatagaactaccatataatccagcaatcccactgctagataaacccaaaagaatgcaattcagtatgtcaaagacatacctgtactaccacgtttgttgcagcactattcacaatagccaagatttggaagcaacttaagtgtccatcaacagatgaatagmtaaagaaaatgtggtacatatacacaatgaagtactattcagccataaaaaaatagatcctgtcatttattccaacatagatagaacttgaggtcattatattacgtgaaataagccaggcacagaaagacaaagttcgcatggtctcactcatttgtggaagctaaaagttaaaacaattgaactcatggagatagaaagtagaaggatggttaccagaggctgggaaggaaagtcaggaatggagggagaaaatgagaatggttaatgggtacaaaatatagttgatagaatgaataa

SEQ ID NO: 185381 - DNA, 601 bp, Human
gaaaacagtttggagtttcctcaaaaaaatataaatagaactaccatataatccagcaatcccactgctagataaacccaaaagaatgcaattcagtatgtcaaagacatacctgtactaccacgtttgttgcagcactattcacaatagccaagatttggaagcaacttaagtgtccatcaacagatgaatagataaagaaaatgtggtacatatacacaatgaagtactattcagccataaaaaaatagatcctgtcatttattccaacatagatagaacttgaggtcattatattacrtgaaataagccaggcacagaaagacaaagttcgcatggtctcactcatttgtggaagctaaaagttaaaacaattgaactcatggagatagaaagtagaaggatggttaccagaggctgggaaggaaagtcaggaatggagggagaaaatgagaatggttaatgggtacaaaatatagttgatagaatgaataagatctagtatttaatagcacaacagggtgactgcagtctacaataatttattgcacattttaaaataactaaaagagtaataattggatggtttgtaacacgatga

SEQ ID NO: 185382 - DNA, 601 bp, Human
aatagaactaccatataatccagcaatcccactgctagataaacccaaaagaatgcaattcagtatgtcaaagacatacctgtactaccacgtttgttgcagcactattcacaatagccaagatttggaagcaacttaagtgtccatcaacagatgaatagataaagaaaatgtggtacatatacacaatgaagtactattcagccataaaaaaatagatcctgtcatttattccaacatagatagaacttgaggtcattatattacgtgaaataagccaggcacagaaagacaaagttcrcatggtctcactcatttgtggaagctaaaagttaaaacaattgaactcatggagatagaaagtagaaggatggttaccagaggctgggaaggaaagtcaggaatggagggagaaaatgagaatggttaatgggtacaaaatatagttgatagaatgaataagatctagtatttaatagcacaacagggtgactgcagtctacaataatttattgcacattttaaaataactaaaagagtaataattggatggtttgtaacacgatgaaatgataaatgctcaaggtgatggataccgcat

SEQ ID NO: 185383 - DNA, 601 bp, Human
gaaataagccaggcacagaaagacaaagttcgcatggtctcactcatttgtggaagctaaaagttaaaacaattgaactcatggagatagaaagtagaaggatggttaccagaggctgggaaggaaagtcaggaatggagggagaaaatgagaatggttaatgggtacaaaatatagttgatagaatgaataagatctagtatttaatagcacaacagggtgactgcagtctacaataatttattgcacattttaaaataactaaaagagtaataattggatggtttgtaacacgatgaamtgataaatgctcaaggtgatggataccgcatttactctgacatgattgttacccattgtatgcctgtatcaaaataactcatgtaccccatactatatgcaatactatgcacccataaaaattaaaaagaaagaaagaaaagaagtctgcaataaaaatccaaagaatgtattctctcttatttcattcttctcaaaagacaatagtgttctgcaatgcactcttcttttcctctacaactgggcagtaagcagggctattcattcaatcttctaggcatcaaattgggagagaaaagta

SEQ ID NO: 185384 - DNA, 601 bp, Human
cagaaaaccactttcctctattgagtgccactgacccataagaaaaaagatcaatagtctaaatgtacaagtacaaagtgacttaatcgaatttttttacaaaaagagaaaattcaatccatttgtttttaagtttaataacggggtgaaaaaagagtaaactattggttagtgtgtgccactaaccaattattatgttattatgtttcatggtctactttaaacacttttacatgtattgttttacttagtctcccaagcaacccagaaaggcaaatattattattcccatttttacagytgaggaaacaaaaactcagagacggtaaattgacttgtccaaagtcacagagttggcatatggtgatgccaggaggcaaacaaacaaatggccccatctgctgctctcacttatcttttcatcaggccatgttgccctatctaaagaaaatcttagtgaatgatacttcaccaagcaacagaaattttctgtccaagccaatgaaagggatagatggagctggacaattgaaagaaggaaagagaagaagtagagagtaagaagaatgaaagacagtgcaagctaagggaagggtcagaa

SEQ ID NO: 185385 - DNA, 601 bp, Human
gttatagaaggagatcaactcccaaacctaatcccagaaagtaaatacacaacgatatagtatatgcttagatccattcttcagtttattgaatcacaaaatattggcgctgagaggaatcttagaagccaacagtttcaaactctccgtggtacagactaagccctaaagatgttaagtgactttctcaaggtcacacagctagttagtgacaaaacagggcctataaccaatcacttattatgagtgcatgctctgatcctttgctgctcgctgttgtttgcagaccagcaatatcagyatcgcttgagagcttgttacaaaggcaggctctcagactccacccaagaccctctaaagcagaatttgaattgtaacaaatctttttctttttttttttaaacagggggtgtcactgtgtcatccaggctggagtggtgcagtgacacaaccacggctcactgcagcctggtactcccaggctaaagctatcctcccaccttagcctcccgagtagctggaactacaggcacacactaccacacgtggctaattttttttatttttaattttatgtagagacgggatcttgctatgttgc

SEQ ID NO: 185386 - DNA, 601 bp, Human
gtggaaaacaataatagctaactacttttagtgctgtgcttagagaggaaagaacttctcccaaagccaagtcataataataataataataataataataacccacaacattcttaaaatatcttgactctagagcctataaacctggcttctccagaagccagtgagtatcagctgccactgatgctgtaattttcttaggcagagactcaactgccatgggcagatgccacaacattggcaaaagtggggcacagttaaagatgacgtttcatcaccaacatgtcacacttgtcagcaytttaaagaaaaaaacagattgaagaggaaagaagaagttgagttttagtatccaaatttgaactaaaattttggaaaaatacagcatagtacagagtatgaaaccataccaaagtgatattttgaaggagatacttttgggaaaatgtgattttaacatcaattagaaaaccacgttctcctaaggcagtaattctcaatcccggcagtatgttacaatcagctaaggaagatttaaaaagattgaatgcaaatttctgagagaggaccaggctctagtgttttcttaaaaattcccagt

SEQ ID NO: 185387 - DNA, 601 bp, Human
gcaaacaaacagaataattaatttagaaattaaagaagagagaggtttttaagctaagggcattacagactgtttatcaaatattctttaaattgtttttttaaatattgaagtgatacaaatgaatatttattacatatgttaatatacaaagtgatattataaacatccaggtacccatcattcagtttaaaaaacaaaacaatcagaatttttgaagcccttgaggatgctttcccaatactattctactccccatcaatcaatatcaatcaatatcctgaattttgggcatatcatwccccgattttttttcatgagtttatcacatttggatctttaaacaatatattgtttccatccaaatgtttggagacttcatgtaaatggaatcatgccatatttattctgcaacttgtttttttcaccaaacattatgttgttatgatttaccaatgctggcgtgagtcgctgcagttcattttatctgctatgtagtctcccactacatgaacatactaccatttattcatccagtctactgctgagcaacatttgcattatttccagttcttttgtcattgccaacaatgatgctatt

SEQ ID NO: 185388 - DNA, 601 bp, Human
caaacaaacagaataattaatttagaaattaaagaagagagaggtttttaagctaagggcattacagactgtttatcaaatattctttaaattgtttttttaaatattgaagtgatacaaatgaatatttattacatatgttaatatacaaagtgatattataaacatccaggtacccatcattcagtttaaaaaacaaaacaatcagaatttttgaagcccttgaggatgctttcccaatactattctactccccatcaatcaatatcaatcaatatcctgaattttgggcatatcattmcccgattttttttcatgagtttatcacatttggatctttaaacaatatattgtttccatccaaatgtttggagacttcatgtaaatggaatcatgccatatttattctgcaacttgtttttttcaccaaacattatgttgttatgatttaccaatgctggcgtgagtcgctgcagttcattttatctgctatgtagtctcccactacatgaacatactaccatttattcatccagtctactgctgagcaacatttgcattatttccagttcttttgtcattgccaacaatgatgctattc

SEQ ID NO: 185389 - DNA, 601 bp, Human
ttaccaagtaatgccatggttttccaaaggagccatacatgagattcccattgctcaacagccttgtttagagttttcggatttctaattttcagtaatcaagagggtattattattttaattttcatttctcagattattaatgagattgagtatatttccttagtcgttttttctgagttgactgtttaaatatttgccccaattaggtcaaatacttgactgtttaaataatttgcaattatttcattagatttatatttaagtaacattttgcagcaattataatcatacctcttaycatttttctactggattgtttgtcttttacttgacttgcaggaattctttataaaagtccatattaattatttatctgctatatgtatgtaaatagcttctcccagtttgtggtttggcttttcactttctttttcatgtcttttgataaatatattaatatgttcttaatttttttattattatacttttaagttttagggtacatgtgcacaacgtgcaggtttgttacatatgtatacaggtgccatgatggtgtgctgcacccattaactcgtcatttagcattaggtatatctcc

SEQ ID NO: 185390 - DNA, 601 bp, Human
aatttattaattaatttgtgataaatttacatctttatgtcaccaagtctttctctgaatgaatacgattaacctctacattggtttgtcttccctagtatctcctaataaagttttgcatttaaaaaaagtgtacatcatttattagatttattcctaagtactacctttgtattgaaatggcattgaatttattgactaactgaattgttttaaatattgagtctccacatcccggaatataattccttatttattcatgaattatatcatgaattatcatgattgcagtatcaatcaygatatcattttgcaattatttcattagatttatatttaagcaacattttgtggcaattataatcatacctcttatgttatatatgtgtttttactgctgatgtgtagaaatgctactgcttttgtagttactgatttttttctatcaatcaaccttgtagaactcagtatgcttttaaatagttgctgatagatttgttttgatttccctatttgtattttctacaaataacaatgtttctttgtttccaatccttacggttttttctcatgtgttacactcttactctattggcaggaa

SEQ ID NO: 185391 - DNA, 601 bp, Human
ggctgccttttccaaactcaagttactttttaactcatcatttgtttgtgtaattttggtctgtttaattcagccaaactaattaagtctttaaaattgtattctattttctcccatttggaaatttggatatttcatttatgtttttagataattacattttcatatgtgtgcatgaattgaccaatatgaagataattaatgctttcattatcctgccaaaaaagaaacttgaacgacccctactctcataacttcactacgttgttgttgttgttgttgttgttgttgttgttgttgytgctgctgctgttgtttttctaatcgtagactcaggaggtacatgtgcaagatttgttatatgggcatattgagtaatactgaagtttgggcctctattgaacccatcaaccaaatagtgaaactagtacccaataggtagtttttcaactcttttttcctccctccctgcccccttttggagtccccagtgtctactgtttccagttttatgtccacatgtacccattgtttaactcccatgtgttaagtgagaacatgcagtatttggttttcggtttctgcgttaattcacttaggg

SEQ ID NO: 185392 - DNA, 601 bp, Human
attaatgctttcattatcctgccaaaaaagaaacttgaacgacccctactctcataacttcactacgttgttgttgttgttgttgttgttgttgttgttgttgttgctgctgctgttgtttttctaatcgtagactcaggaggtacatgtgcaagatttgttatatgggcatattgagtaatactgaagtttgggcctctattgaacccatcaaccaaatagtgaaactagtacccaataggtagtttttcaactcttttttcctccctccctgcccccttttggagtccccagtgtctaytgtttccagttttatgtccacatgtacccattgtttaactcccatgtgttaagtgagaacatgcagtatttggttttcggtttctgcgttaattcacttagggtaacagcctcccgctgcaaatgacatgatttcattcttttttatggctgtgcaatatttgatggtgtatatgtaccacatttgatgaacacttaggttgattctatgactttactattatgaatagtgctttgataaacatatgagtgcagatattctttgatagaatgatttcttttcctttgggtagatacccac

SEQ ID NO: 185393 - DNA, 601 bp, Human
ttttgggaattagccattgagaaactgatcctttagcaagttggcccttggcgtatcagtttgcttctcctgtacacacctatctaatcagtctcattgccatacactgcaatgactgacatctcactcagctcccttgggactctaagtcttatttatttggtatcgccagaacttagcacattgtgtttcatctgatgaagacttagaaatgttgactaatgaataagcaaattaattcataagtggcctttatgctgccttaacctgaatacttttctccttctctttataggatagmtaccaagggaatctgaatttaaatgggtgtgacagccaaggaggaaaaactttctttcacattttgctctttatatccatatttgtatgtgcatggcctcaaaaataatttgtttatgaattatgggctgacccccaatatcaaacttcaagaaactacataaaaggagctcaaaataaaattttactaggttgactaatgcttggcgtaaaattgattgaagccttactaaacaattgaaaatattttgtttacaagatatttatcacaaacacttttgttatacttggatttgccctg

SEQ ID NO: 185394 - DNA, 601 bp, Human
tcaaaaataatttgtttatgaattatgggctgacccccaatatcaaacttcaagaaactacataaaaggagctcaaaataaaattttactaggttgactaatgcttggcgtaaaattgattgaagccttactaaacaattgaaaatattttgtttacaagatatttatcacaaacacttttgttatacttggatttgccctgtagatttattaataacttctattctccaaaggctttgaacagaatgttccctatatatagtaaagactgcacatatctactatttgttattgtcaacaygtggttcaccctgaagccaagactatctcaacagaccttaaatatggtgctttgccaggacacaccaaggctagatcagcttcaaacttataaagtcaaattcctgctctacacccactgttgggcagcacacttagtcaaaactgaatttgtagtcataccccagactcattcttcctcctgagctctccacatcagtgaattgtccctcattccattattcttagcactaccacccccaccctcaattcctctcaggtagattcataaagaatagacagaaagaaccaaaaggtgata

SEQ ID NO: 185395 - DNA, 601 bp, Human
aaggagctcaaaataaaattttactaggttgactaatgcttggcgtaaaattgattgaagccttactaaacaattgaaaatattttgtttacaagatatttatcacaaacacttttgttatacttggatttgccctgtagatttattaataacttctattctccaaaggctttgaacagaatgttccctatatatagtaaagactgcacatatctactatttgttattgtcaacatgtggttcaccctgaagccaagactatctcaacagaccttaaatatggtgctttgccaggacacamcaaggctagatcagcttcaaacttataaagtcaaattcctgctctacacccactgttgggcagcacacttagtcaaaactgaatttgtagtcataccccagactcattcttcctcctgagctctccacatcagtgaattgtccctcattccattattcttagcactaccacccccaccctcaattcctctcaggtagattcataaagaatagacagaaagaaccaaaaggtgataagctatcagccttgttaatacttacatggtaactcacacattacaaggcttcctagtatggaaga

SEQ ID NO: 185396 - DNA, 601 bp, Human
tgactaatgcttggcgtaaaattgattgaagccttactaaacaattgaaaatattttgtttacaagatatttatcacaaacacttttgttatacttggatttgccctgtagatttattaataacttctattctccaaaggctttgaacagaatgttccctatatatagtaaagactgcacatatctactatttgttattgtcaacatgtggttcaccctgaagccaagactatctcaacagaccttaaatatggtgctttgccaggacacaccaaggctagatcagcttcaaacttataaagtcaaattcctgctctacacccactgttgggcagcacacttagtcaaaactgaatttgtagtcataccccagactcattcttcctcctgagctctccacatcagtgaattgtccctcattccattattcttagcactaccacccccaccctcaattcctctcaggtagattcataaagaatagacagaaagaaccaaaaggtgataagctatcagccttgttaatacttacatggtaactcacacattacaaggcttcctagtatggaagaggatacatagggctgtggcccaaaatatg

SEQ ID NO: 185397 - DNA, 601 bp, Human
atatttctccatgtatcgtttcttctttatacatcctaccttgatcctagatccagccctcactgtcctttgccaacactacagtaacaatccccccattcctctctctgatttaagccttatcctgtttcttaaactctgcacagaagccagagtgatcattttgaaactcaatcgtgtcaccctctgacagattcctattcactacagaataaaggccaagctctttagaatgacttacaaaacccttcatggcctacctacctttgcaaactcatctgcctctttttccctgtcccayaggcatctcagtaatattaaaacagttgtagtttctgatattcaccatgcaattgcaagtctccatccctttgttcatgtgagtctttctgtctaaaatacctttgactctttgtctcatttggttaactctgattcaatcttgaagattttgtttaaggtgtttctccttcaggaacctttccctaaattcaaccctggctctctgtcctgctccctcaagctggggtatccttccctcttctctattcccataacactctgtgaattgctccatcattaagtttttcaccccacgctg

SEQ ID NO: 185398 - DNA, 601 bp, Human
ccaacactacagtaacaatccccccattcctctctctgatttaagccttatcctgtttcttaaactctgcacagaagccagagtgatcattttgaaactcaatcgtgtcaccctctgacagattcctattcactacagaataaaggccaagctctttagaatgacttacaaaacccttcatggcctacctacctttgcaaactcatctgcctctttttccctgtcccataggcatctcagtaatattaaaacagttgtagtttctgatattcaccatgcaattgcaagtctccatcccttygttcatgtgagtctttctgtctaaaatacctttgactctttgtctcatttggttaactctgattcaatcttgaagattttgtttaaggtgtttctccttcaggaacctttccctaaattcaaccctggctctctgtcctgctccctcaagctggggtatccttccctcttctctattcccataacactctgtgaattgctccatcattaagtttttcaccccacgctgatatttatatacatgtctgttttcctttggggcaggggccatatccccaataacaagagattaccagcattc

SEQ ID NO: 185399 - DNA, 601 bp, Human
ctacagtaacaatccccccattcctctctctgatttaagccttatcctgtttcttaaactctgcacagaagccagagtgatcattttgaaactcaatcgtgtcaccctctgacagattcctattcactacagaataaaggccaagctctttagaatgacttacaaaacccttcatggcctacctacctttgcaaactcatctgcctctttttccctgtcccataggcatctcagtaatattaaaacagttgtagtttctgatattcaccatgcaattgcaagtctccatccctttgttcaygtgagtctttctgtctaaaatacctttgactctttgtctcatttggttaactctgattcaatcttgaagattttgtttaaggtgtttctccttcaggaacctttccctaaattcaaccctggctctctgtcctgctccctcaagctggggtatccttccctcttctctattcccataacactctgtgaattgctccatcattaagtttttcaccccacgctgatatttatatacatgtctgttttcctttggggcaggggccatatccccaataacaagagattaccagcattcaggaga

SEQ ID NO: 185400 - DNA, 601 bp, Human
cccataggcatctcagtaatattaaaacagttgtagtttctgatattcaccatgcaattgcaagtctccatccctttgttcatgtgagtctttctgtctaaaatacctttgactctttgtctcatttggttaactctgattcaatcttgaagattttgtttaaggtgtttctccttcaggaacctttccctaaattcaaccctggctctctgtcctgctccctcaagctggggtatccttccctcttctctattcccataacactctgtgaattgctccatcattaagtttttcaccccaygctgatatttatatacatgtctgttttcctttggggcaggggccatatccccaataacaagagattaccagcattcaggagaagtgtgtgaacctaaactgaactctttgctcttccaaatcatttattcatttcttttattttccattaattctataatcatttactaatgaattccatgggtatggcccactccactcacccactttcattttgctgggtagtatcctgatttctcagatatttttgggctgtatgaaaatcattcacttttcccctctctatacattccagagcata

SEQ ID NO: 185401 - DNA, 601 bp, Human
agtctttctgtctaaaatacctttgactctttgtctcatttggttaactctgattcaatcttgaagattttgtttaaggtgtttctccttcaggaacctttccctaaattcaaccctggctctctgtcctgctccctcaagctggggtatccttccctcttctctattcccataacactctgtgaattgctccatcattaagtttttcaccccacgctgatatttatatacatgtctgttttcctttggggcaggggccatatccccaataacaagagattaccagcattcaggagaagtktgtgaacctaaactgaactctttgctcttccaaatcatttattcatttcttttattttccattaattctataatcatttactaatgaattccatgggtatggcccactccactcacccactttcattttgctgggtagtatcctgatttctcagatatttttgggctgtatgaaaatcattcacttttcccctctctatacattccagagcatatcaaaaacatttgttaaccactttcaaattgtgatttgtttttgaattacacgtttgaatcatttttatatgcttcttgttctgat

SEQ ID NO: 185402 - DNA, 601 bp, Human
ttcaatcttgaagattttgtttaaggtgtttctccttcaggaacctttccctaaattcaaccctggctctctgtcctgctccctcaagctggggtatccttccctcttctctattcccataacactctgtgaattgctccatcattaagtttttcaccccacgctgatatttatatacatgtctgttttcctttggggcaggggccatatccccaataacaagagattaccagcattcaggagaagtgtgtgaacctaaactgaactctttgctcttccaaatcatttattcatttcttttattttccattaattctataatcatttactaatgaattccatgggtatggcccactccactcacccactttcattttgctgggtagtatcctgatttctcagatatttttgggctgtatgaaaatcattcacttttcccctctctatacattccagagcatatcaaaaacatttgttaaccactttcaaattgtgatttgtttttgaattacacgtttgaatcatttttatatgcttcttgttctgatgacactgattacacttcttctcttttatgggtataggctgacataagtgatgc

SEQ ID NO: 185403 - DNA, 601 bp, Human
cttctcttttatgggtataggctgacataagtgatgctgtgtgacagtctaataccctggaattgtgagattatgctccctccttgctgtcttctatctgcaggaaattcagatctctatggcagccatcagagttaaatacatgttgataaataatataagtgaagtaacagcagattattattttacagcaggtctttgaagctactcagactcagcctgtctcttcctgattcagaaaagctttcagcccactggctttagctgctaacggacactgattttttaaaatttgagttcmtaaagggtgaagttttaaaagctttgatgtaaatcctagaatttccaaacaaaatctcaaaaaagaatgaagaaacacagagggtgggtggttgccagtctgtggaagtcaaaaacagggcaggccagctaatccagaggcattgggattgggagctggggaacaatgaaagatatgggctctccaggcctctggcaatgaccatgagcagccaagagcaagtgagagtgggaagaagccaggaaagacaaggccgtgaaatgatgataaacaaaggcctgtatttagctctgactctcc

SEQ ID NO: 185404 - DNA, 601 bp, Human
tctatggcagccatcagagttaaatacatgttgataaataatataagtgaagtaacagcagattattattttacagcaggtctttgaagctactcagactcagcctgtctcttcctgattcagaaaagctttcagcccactggctttagctgctaacggacactgattttttaaaatttgagttcctaaagggtgaagttttaaaagctttgatgtaaatcctagaatttccaaacaaaatctcaaaaaagaatgaagaaacacagagggtgggtggttgccagtctgtggaagtcaaaarcagggcaggccagctaatccagaggcattgggattgggagctggggaacaatgaaagatatgggctctccaggcctctggcaatgaccatgagcagccaagagcaagtgagagtgggaagaagccaggaaagacaaggccgtgaaatgatgataaacaaaggcctgtatttagctctgactctcctactacaatgggctcacttctcaaggaaagagtaagatttatacaaaccacctcaaaaagagaactttaaaataataataagaagaagctaatcagttaattttgcacaaccaat

SEQ ID NO: 185405 - DNA, 601 bp, Human
ccactggctttagctgctaacggacactgattttttaaaatttgagttcctaaagggtgaagttttaaaagctttgatgtaaatcctagaatttccaaacaaaatctcaaaaaagaatgaagaaacacagagggtgggtggttgccagtctgtggaagtcaaaaacagggcaggccagctaatccagaggcattgggattgggagctggggaacaatgaaagatatgggctctccaggcctctggcaatgaccatgagcagccaagagcaagtgagagtgggaagaagccaggaaagacarggccgtgaaatgatgataaacaaaggcctgtatttagctctgactctcctactacaatgggctcacttctcaaggaaagagtaagatttatacaaaccacctcaaaaagagaactttaaaataataataagaagaagctaatcagttaattttgcacaaccaatacttagattaataaatactcggccctacaacctcatggaaatatattaagtacatacacactccatcacctctataaggaatcaaaatgtttagcaaccagcccagaagggatcagccaatcagaacagatactgg

SEQ ID NO: 185406 - DNA, 601 bp, Human
agctgctaacggacactgattttttaaaatttgagttcctaaagggtgaagttttaaaagctttgatgtaaatcctagaatttccaaacaaaatctcaaaaaagaatgaagaaacacagagggtgggtggttgccagtctgtggaagtcaaaaacagggcaggccagctaatccagaggcattgggattgggagctggggaacaatgaaagatatgggctctccaggcctctggcaatgaccatgagcagccaagagcaagtgagagtgggaagaagccaggaaagacaaggccgtgaaaygatgataaacaaaggcctgtatttagctctgactctcctactacaatgggctcacttctcaaggaaagagtaagatttatacaaaccacctcaaaaagagaactttaaaataataataagaagaagctaatcagttaattttgcacaaccaatacttagattaataaatactcggccctacaacctcatggaaatatattaagtacatacacactccatcacctctataaggaatcaaaatgtttagcaaccagcccagaagggatcagccaatcagaacagatactggccataaacacc

SEQ ID NO: 185407 - DNA, 601 bp, Human
gggtggttgccagtctgtggaagtcaaaaacagggcaggccagctaatccagaggcattgggattgggagctggggaacaatgaaagatatgggctctccaggcctctggcaatgaccatgagcagccaagagcaagtgagagtgggaagaagccaggaaagacaaggccgtgaaatgatgataaacaaaggcctgtatttagctctgactctcctactacaatgggctcacttctcaaggaaagagtaagatttatacaaaccacctcaaaaagagaactttaaaataataataagaagmagctaatcagttaattttgcacaaccaatacttagattaataaatactcggccctacaacctcatggaaatatattaagtacatacacactccatcacctctataaggaatcaaaatgtttagcaaccagcccagaagggatcagccaatcagaacagatactggccataaacaccagtcaggccatcctggagcacaaagctaaatataagccctgaataaacacacaactgcgcaaacaacaggcatatcttccctcccccgcaaagttccactttagagtcaactctggttcctctc

SEQ ID NO: 185408 - DNA, 601 bp, Human
tttttgaatgggagcatttattactaatctcttgtcactcattgtcttttttttttcgagatggagactcgctctttcacccaggctggagtgcagtggcatgatcttggctcactgcaagctccgcctcccaggttcacgccattctcttgcctcagcctcccgagtagctgggactacaggcgcccgccaccacgcccggctaattttttgtattttttttttttagtagagacggggtttcaccatgttagccaggatgatctcaatcgtctgatcttgtgatccgcccgcctcggcmtccgaaagtgctgggattacaggcatgagccaccacacccggccaaatctcatgtcagtcattctcttaaataatttgcgtgtatcatgtcacttagccattaaaatgcatttaaacattattttcactttgcaggcgactggggatcagaaagactaaggcacttgttattgatcacacagctaacaagcagtgaaatcagtctgaactcaggagacagttgatttcaatttcttgttctttcttaccctacattgctgctctaaaataaaaaacaaaaatactaataaaattgtccaa

SEQ ID NO: 185409 - DNA, 601 bp, Human
ctcattgtcttttttttttcgagatggagactcgctctttcacccaggctggagtgcagtggcatgatcttggctcactgcaagctccgcctcccaggttcacgccattctcttgcctcagcctcccgagtagctgggactacaggcgcccgccaccacgcccggctaattttttgtattttttttttttagtagagacggggtttcaccatgttagccaggatgatctcaatcgtctgatcttgtgatccgcccgcctcggcctccgaaagtgctgggattacaggcatgagccaccacrcccggccaaatctcatgtcagtcattctcttaaataatttgcgtgtatcatgtcacttagccattaaaatgcatttaaacattattttcactttgcaggcgactggggatcagaaagactaaggcacttgttattgatcacacagctaacaagcagtgaaatcagtctgaactcaggagacagttgatttcaatttcttgttctttcttaccctacattgctgctctaaaataaaaaacaaaaatactaataaaattgtccaaagttatagggcctgggctcgatttgaatgacactttt

SEQ ID NO: 185410 - DNA, 601 bp, Human
ttctcttgcctcagcctcccgagtagctgggactacaggcgcccgccaccacgcccggctaattttttgtattttttttttttagtagagacggggtttcaccatgttagccaggatgatctcaatcgtctgatcttgtgatccgcccgcctcggcctccgaaagtgctgggattacaggcatgagccaccacacccggccaaatctcatgtcagtcattctcttaaataatttgcgtgtatcatgtcacttagccattaaaatgcatttaaacattattttcactttgcaggcgactggrgatcagaaagactaaggcacttgttattgatcacacagctaacaagcagtgaaatcagtctgaactcaggagacagttgatttcaatttcttgttctttcttaccctacattgctgctctaaaataaaaaacaaaaatactaataaaattgtccaaagttatagggcctgggctcgatttgaatgacacttttctaactcaatcgaaagttttcacatataagaatagctgggtcaccactctacatcttcacactgcttatcaatctcaagccaacaaagccctaagcagctctcagct

SEQ ID NO: 185411 - DNA, 601 bp, Human
attaaaatgcatttaaacattattttcactttgcaggcgactggggatcagaaagactaaggcacttgttattgatcacacagctaacaagcagtgaaatcagtctgaactcaggagacagttgatttcaatttcttgttctttcttaccctacattgctgctctaaaataaaaaacaaaaatactaataaaattgtccaaagttatagggcctgggctcgatttgaatgacacttttctaactcaatcgaaagttttcacatataagaatagctgggtcaccactctacatcttcacacygcttatcaatctcaagccaacaaagccctaagcagctctcagcttgagaaaaatgttaaccaaaataacttctacctatcactactgaagaaaaatgaaagattaatttgatatattcctagtatatgttgccatttatttgaatcaatgctccattaggtattccaaaattatctaaaaatcaataatgatcagatttgggttaaatggtaaagtcaacaaacccaaagcattattttgagggttgaggggattggtttctttctttagaattagatagaaggaaaattaatttgcagt

SEQ ID NO: 185412 - DNA, 601 bp, Human
caagcagtgaaatcagtctgaactcaggagacagttgatttcaatttcttgttctttcttaccctacattgctgctctaaaataaaaaacaaaaatactaataaaattgtccaaagttatagggcctgggctcgatttgaatgacacttttctaactcaatcgaaagttttcacatataagaatagctgggtcaccactctacatcttcacactgcttatcaatctcaagccaacaaagccctaagcagctctcagcttgagaaaaatgttaaccaaaataacttctacctatcactactraagaaaaatgaaagattaatttgatatattcctagtatatgttgccatttatttgaatcaatgctccattaggtattccaaaattatctaaaaatcaataatgatcagatttgggttaaatggtaaagtcaacaaacccaaagcattattttgagggttgaggggattggtttctttctttagaattagatagaaggaaaattaatttgcagttaagacattggccccagagtaaagaaggagggcttatttctgctcaggactggtacacatacaagcgtgcatgtgcttgtgagtgtg

SEQ ID NO: 185413 - DNA, 601 bp, Human
tcagcttgagaaaaatgttaaccaaaataacttctacctatcactactgaagaaaaatgaaagattaatttgatatattcctagtatatgttgccatttatttgaatcaatgctccattaggtattccaaaattatctaaaaatcaataatgatcagatttgggttaaatggtaaagtcaacaaacccaaagcattattttgagggttgaggggattggtttctttctttagaattagatagaaggaaaattaatttgcagttaagacattggccccagagtaaagaaggagggcttattyctgctcaggactggtacacatacaagcgtgcatgtgcttgtgagtgtgtgtacatgcatgtgtgtgcttgtgtgggaggtagtggacacacactgaggtccagctgcactgaagcaggtttggagggccctaggaaggcatgggcagaaactgacctgctctctaggggcatgctgattaactaaacttaatgtaagaccatattgtttttaacctcagaaatatttaccagaaaatcagggaccatgacctcctgggacaaaaggaaaacagtcacagcactgaaggcaggagaggacc

SEQ ID NO: 185414 - DNA, 601 bp, Human; identical to SEQ ID NO: 33260

SEQ ID NO: 185415 - DNA, 601 bp, Human; identical to SEQ ID NO: 33261

SEQ ID NO: 185416 - DNA, 601 bp, Human; identical to SEQ ID NO: 33262

SEQ ID NO: 185417 - DNA, 601 bp, Human; identical to SEQ ID NO: 33263

SEQ ID NO: 185418 - DNA, 601 bp, Human; identical to SEQ ID NO: 33264

SEQ ID NO: 185419 - DNA, 601 bp, Human; identical to SEQ ID NO: 33265

SEQ ID NO: 185420 - DNA, 601 bp, Human; identical to SEQ ID NO: 33266

SEQ ID NO: 185421 - DNA, 601 bp, Human; identical to SEQ ID NO: 33267

SEQ ID NO: 185422 - DNA, 601 bp, Human
ttttccagtccactaagatattcaagtccacatggtagatattcaacgaatgtgtattttattaaagctttacataaaatttacatttataaggtctgggatgaccaggaaggtgtcagcagaaccaacttgccattacaattttaagttaaatatattgagttttggatttgtggtaacaattcgatatgcagaataatctcatatgccaagacaactcgatgccactcttggctcttattaccaggataaacccttctgacctctaatctttcttgtaaaagcttttcttttcattaarttgtcagcacttaaatgatataacttatagttattgaaaaaaatgcagtagattcaaggttcaatactagcacatagagagtgaatgggatttgtttctgataaacccaccttgaacttttgttacaataacttaaaggaattcttgcaaatatctctgaggactcaacataataaatatttcagagaatgttgtttgaaaatgctggctctgattttctttcatttgtagtagccacaaataataccagtcccagcgctgtgctgcagtatgtaaagcctagctctctcacaaagtgct

SEQ ID NO: 185423 - DNA, 601 bp, Human
tcatttcctcattttgacaatttatcactacagccctgtgaatgcattatttaggctataaacggagagggaagctaccaataaatgtcccagatatgtattcaggactggtaccttatttgctctcagcataatactaggtcatcatttgttttattggccccactatcttgttttttaaagtaaattataacatacagaactgtgcatgaaatgaaaaagtacagctcaagtatgacaaacagattcgtaaccaccgtgtaaccaccttaagggtaaagaaatacaacattttctgtamcccaaaaacaccctacatgccccctctcaataactacaggctctgcctccaccaaagacaactatcctgactgtttatggcaattattttcttacttttctttgtacttttatcacctaaggatatatccttaaacatacatattttgttaatagttttgcctcatttttaagcattatataaatggaatcacatagaatactttcctttctgtctggttttcttcacatagtgttatgtttgttagatttattccatttggttacagttcattcattttcattactgtatcatattcca

SEQ ID NO: 185424 - DNA, 601 bp, Human
tcccagatatgtattcaggactggtaccttatttgctctcagcataatactaggtcatcatttgttttattggccccactatcttgttttttaaagtaaattataacatacagaactgtgcatgaaatgaaaaagtacagctcaagtatgacaaacagattcgtaaccaccgtgtaaccaccttaagggtaaagaaatacaacattttctgtaacccaaaaacaccctacatgccccctctcaataactacaggctctgcctccaccaaagacaactatcctgactgtttatggcaattaytttcttacttttctttgtacttttatcacctaaggatatatccttaaacatacatattttgttaatagttttgcctcatttttaagcattatataaatggaatcacatagaatactttcctttctgtctggttttcttcacatagtgttatgtttgttagatttattccatttggttacagttcattcattttcattactgtatcatattccattgtatgagtatgtctgtttgtttactcattctactgctgatggacattttgaattgtctatagtttgggactactacaagtaattc

SEQ ID NO: 185425 - DNA, 601 bp, Human
attcaggactggtaccttatttgctctcagcataatactaggtcatcatttgttttattggccccactatcttgttttttaaagtaaattataacatacagaactgtgcatgaaatgaaaaagtacagctcaagtatgacaaacagattcgtaaccaccgtgtaaccaccttaagggtaaagaaatacaacattttctgtaacccaaaaacaccctacatgccccctctcaataactacaggctctgcctccaccaaagacaactatcctgactgtttatggcaattattttcttactttyctttgtacttttatcacctaaggatatatccttaaacatacatattttgttaatagttttgcctcatttttaagcattatataaatggaatcacatagaatactttcctttctgtctggttttcttcacatagtgttatgtttgttagatttattccatttggttacagttcattcattttcattactgtatcatattccattgtatgagtatgtctgtttgtttactcattctactgctgatggacattttgaattgtctatagtttgggactactacaagtaattctaccatgaatat

SEQ ID NO: 185426 - DNA, 601 bp, Human
gtcatcatttgttttattggccccactatcttgttttttaaagtaaattataacatacagaactgtgcatgaaatgaaaaagtacagctcaagtatgacaaacagattcgtaaccaccgtgtaaccaccttaagggtaaagaaatacaacattttctgtaacccaaaaacaccctacatgccccctctcaataactacaggctctgcctccaccaaagacaactatcctgactgtttatggcaattattttcttacttttctttgtacttttatcacctaaggatatatccttaaacatayatattttgttaatagttttgcctcatttttaagcattatataaatggaatcacatagaatactttcctttctgtctggttttcttcacatagtgttatgtttgttagatttattccatttggttacagttcattcattttcattactgtatcatattccattgtatgagtatgtctgtttgtttactcattctactgctgatggacattttgaattgtctatagtttgggactactacaagtaattctaccatgaatattctcatatatgtctctggtgcacaagcacacacacttccat

SEQ ID NO: 185427 - DNA, 601 bp, Human
ttttgctgttctgtttaagtcttatgtccaccctaatatcataaagtcattctcctaaatgtcattctaggtgtactattgttttccctttcatgtatacagtaaaatctgactggaattaatttttatatatggatcaagtttcttttttgtttgtttgttttttcatatggacacccacgtgctccagtccatttttgaagagatcacacttttcctcattgaattatttttagaatctcatttcttcctctgttttatcagaagttatctattctgttactattctttttaaagtcaraaaataacagataatggtgaggttgcaaagaaaaaggaacgcctatccacttttggtgggaaagtaaactggttcagccattgtgttcagagaacacaaagcagaactatcattcatcccagcaatcccagtattgggtatataccctgaacaatacaaattgttctgccacaaagacacatgtacatgtatgttcatggcagcagttctcacaatagcaaagatatggaatcaacctaaatgcccatcaacagtggacaggataaagaaaatgtggtacatatacaccatggaataata

SEQ ID NO: 185428 - DNA, 601 bp, Human
atcttgactaatcaaagacattgaaacattttaactccacttttttattcttttcccaacttatatattatcatttttatgttatgtatacttgaagctcatgtagacattactattgttgttgtatatagtcaatgttaatttacatggatccacatttttccatttttattattcgtattcctttatctctgttcttctatctaggatcatctttactagtatttattttagtgcaatgacacccctaaaaaatgttctcatttttcatttgtctgaaagcatttttcattttattttkcttctggaaggacacattcactgagtataaaattctaagttggctattttttttccattgtcttctggtgagcattgttactattcagaaatcagccctcagtctaactgctgcttctttgaaggtaatcttggccattcaggatcacctcattctgacttcataaactgtgatattcaaatctgaactgaagtccctatgaggacctatctatttcaggctgactattctcccaggatgcagcccttcagaatcccaacccaaagtgaataggggaattatcaagaccccagcttgata

SEQ ID NO: 185429 - DNA, 601 bp, Human
atttatgtttcacatgagcaatgtttttttttccatttttggtttttgtttgtttgtttgtttgtttacttcatggacattgtagactaggacctggttactaaggagtttttacagtacatgtgtggcccacctctatgatggtacagtctttactgaaaggctttttagccacattctcaattcatttcatcacccatctgtgtttttttctgtttcgctatacattctatattgtttatgtttttgtcacctatatataacatgctacatggtatattggagccaacaaatatcgcayggattttatcaaatttctaaccccatttcaagaataagacaattccctctttataaaaaggcaaatgaagaacacacctttcccttgaagtgatctgagaaatggatagctcccttcctaccatcacaaggaaaaggaggctgacagtgaggttattcagccaaaaacactttcttactgcctcctcccttccccacatcttttatttttaagatgaaggcatgtcactcttcgcttcacacaagcctagtgaggcatgtctgaaaaaaagcccaacaggtaattctcaaaacttctgtc

SEQ ID NO: 185430 - DNA, 601 bp, Human
tgtattcacatttattcttagctggttaaattttaaggtgtcaaccagaccttgctacaagaacagcacattaaacgtggtttacgataaatgccagcatgctcatcctccattcttaactaatcaaagaaacttcctgctgtttatagtcaaataattcaatgactacagctcagccaaaaaaaaaaaaagcaaggtgcctgtgtgcccactgataaagtcatgggaaagagtaattcaaatatatttcattagccaaaactctttgttttttaaatactttgttcctgggaaatctacyggtctaaatttttctgaaatttcaggcttctaccccaaaacctatatcaatgtacctcaaagttcacccgcttccttatctgtgtctctgcatatagtcatggaggttgtgcattgcacagaggtaccaatcacattgtaaaagtcatatatgtgaatatttatagttacaatgcaaaaattggtaaatgacagtaagacgtgagttttataaaaaaaataagtttattaggataattttccaactgaaaattataatgttttgaagaaggagcacagtgtttcaactcacactaaaaca

SEQ ID NO: 185431 - DNA, 601 bp, Human
ccaggtccttccctgacacgtggaaattacgatttgagatgagacttgggtggagacacagagccaaaccatatcattctgccccggctcttcccaaatctcatgtcctttatacatttcaaaaccaatcatgccttcccaacagtcccccaaagtcttaaatcattccagcattaactcaaaattccaagtccaaagtctcatctgagataaggtaaatcccttccgcctataagcctgtaaaatcaaaagcaagttagttacttccaagatacaatgggggtacaggcaatgggtaaayagacccattccaagtgggagaaattggctaaaacaaagggaccacaggccccatacaagtccaaaacctggacaggcagtcattaaatcttaaagttccaaaataatctcctttgactccatgtctcacattcggggcacactgatgcaagagatgggttcccaaggccttgggcagcttcaccctgtggtgtggttctgcaggatacagcccctgcagttgctttcccgggctggctctgagtgcctgcagcttttctaggcacacagtgcaagctgtcggtggatctatccttctggg

SEQ ID NO: 185432 - DNA, 601 bp, Human
gacacgtggaaattacgatttgagatgagacttgggtggagacacagagccaaaccatatcattctgccccggctcttcccaaatctcatgtcctttatacatttcaaaaccaatcatgccttcccaacagtcccccaaagtcttaaatcattccagcattaactcaaaattccaagtccaaagtctcatctgagataaggtaaatcccttccgcctataagcctgtaaaatcaaaagcaagttagttacttccaagatacaatgggggtacaggcaatgggtaaacagacccattccaartgggagaaattggctaaaacaaagggaccacaggccccatacaagtccaaaacctggacaggcagtcattaaatcttaaagttccaaaataatctcctttgactccatgtctcacattcggggcacactgatgcaagagatgggttcccaaggccttgggcagcttcaccctgtggtgtggttctgcaggatacagcccctgcagttgctttcccgggctggctctgagtgcctgcagcttttctaggcacacagtgcaagctgtcggtggatctatccttctggggtctgaaggacagc

SEQ ID NO: 185433 - DNA, 601 bp, Human
tcagaattctgcctggacacccaggcatttctatctatcctctgaaatctaggtggaagttccaaaaccttaactcttttgcacacctgcagtcccaacaacacctggaagctgccaaggcttggggcttgcaccctctgaagcaatggcctgagctgtacattgaccccttatagccacagctggagcagctggaaaacagggcaccaagtctcaaggctgcacagagcagcagggccctaggccatttttccctccaatgcctccaggcctgtgatgggaagagctgctacaaaaatcyctgacatacctagagacattttccccattgtgttggctattaacattcagctcctccttacttatgccaatttctgcaggaagcttgaatttctccccagaaaatgggtttttcttttctaccaacatggtcaggctgcacattttccaaatttttatgcttttaaacataagctccaatttcaaatcatctctttgtgaatgcatgtaactgcacatttcaagaaaagccaggtcacctcttgaatgctttgctggttagaaatttcttctgtcagatatcctaattcatttctctcaa

SEQ ID NO: 185434 - DNA, 601 bp, Human; identical to SEQ ID NO: 33268

SEQ ID NO: 185435 - DNA, 601 bp, Human; identical to SEQ ID NO: 26211

SEQ ID NO: 185436 - DNA, 601 bp, Human; identical to SEQ ID NO: 26212

SEQ ID NO: 185437 - DNA, 601 bp, Human
agacagagattgcagtgagccaagatcgcgctactgcactccagtctaggtgacaaagtgagagtccatctcaaaaaaaaaaaaaaagttatttagttctgatgcaattcaattgatggattttttccttttgttactttgtgagcctgtttttgaaccacagctgacctcagagccctgaggcatctctccatgctgagaagcagttacaccttacgattatgagcatggaccctggagctggatggctagcattcaaatcccagtttacttacctgtggtcttggggaagttttatttwttttttttttttgagacagagtttcactcttgttgtccaggctggagtgcaatggcacgatctcggctcaccgcaacctccacctcccaggttcaagcgattctcctgcctcagcctccctagtagctgggattacaggcatgtgccaccatgcccggctaattttgtatttttagtagagatggggtttctccatgttggtcaggctggtctcgaactcctgacctcaggtgatccgcccgcctcggcctcccaaagtgctgggattacaggcatgaaccaccacacccggcagtcttg

SEQ ID NO: 185438 - DNA, 601 bp, Human
agagattgcagtgagccaagatcgcgctactgcactccagtctaggtgacaaagtgagagtccatctcaaaaaaaaaaaaaaagttatttagttctgatgcaattcaattgatggattttttccttttgttactttgtgagcctgtttttgaaccacagctgacctcagagccctgaggcatctctccatgctgagaagcagttacaccttacgattatgagcatggaccctggagctggatggctagcattcaaatcccagtttacttacctgtggtcttggggaagttttatttatttwttttttttgagacagagtttcactcttgttgtccaggctggagtgcaatggcacgatctcggctcaccgcaacctccacctcccaggttcaagcgattctcctgcctcagcctccctagtagctgggattacaggcatgtgccaccatgcccggctaattttgtatttttagtagagatggggtttctccatgttggtcaggctggtctcgaactcctgacctcaggtgatccgcccgcctcggcctcccaaagtgctgggattacaggcatgaaccaccacacccggcagtcttgggga

SEQ ID NO: 185439 - DNA, 601 bp, Human
accacagctgacctcagagccctgaggcatctctccatgctgagaagcagttacaccttacgattatgagcatggaccctggagctggatggctagcattcaaatcccagtttacttacctgtggtcttggggaagttttatttattttttttttttgagacagagtttcactcttgttgtccaggctggagtgcaatggcacgatctcggctcaccgcaacctccacctcccaggttcaagcgattctcctgcctcagcctccctagtagctgggattacaggcatgtgccaccatgccyggctaattttgtatttttagtagagatggggtttctccatgttggtcaggctggtctcgaactcctgacctcaggtgatccgcccgcctcggcctcccaaagtgctgggattacaggcatgaaccaccacacccggcagtcttggggaagttgcttaaactttctgtgcttcagtttcctcatctagaaaatggggataatgatgtctgcctcataggcttgctctgaggttcaaatatgtaaattcatgtaaagtacttacaacaacctccaaattgtataaacagtataattgataga

SEQ ID NO: 185440 - DNA, 601 bp, Human
tgcatgctgtaattattgtggcacttgctataatatcgttattgttatagtattttccgttgttgttgtacaagtatcttctatagtattgttgctgtttatcttccaacttggaaggtgagtatgggccaggtggggtggctcaggcctgtaatcccagcacttgggaggttgaggagggaagatcgcttgaggccaggagtttgagaccagcctgggcaacatagtgaggcccctgtctctataatataaaaattaaattaaaaaaaaaatttaaaaaagaaggtggctggccaggcgyggtggctcacgcctgtaatcccagcactttgggaggccaaagcaggcggatcacgaggtcaggagatcgagaccatcttggccaacatggtgaaaccccatctctacttaaattacaaaaacttagctaggcatggtggcccgtgcctgtaatcccagctacttgggaggctgaggcaggcgaatcacttgaacctgggaggcagaggttgcagtgagctgaggttgcggtgagctgagattgtgccgctgcactccagcctggcgacaaagcacgactccgtctcaaaaaaaaaaagaa

SEQ ID NO: 185441 - DNA, 601 bp, Human
aatatcgttattgttatagtattttccgttgttgttgtacaagtatcttctatagtattgttgctgtttatcttccaacttggaaggtgagtatgggccaggtggggtggctcaggcctgtaatcccagcacttgggaggttgaggagggaagatcgcttgaggccaggagtttgagaccagcctgggcaacatagtgaggcccctgtctctataatataaaaattaaattaaaaaaaaaatttaaaaaagaaggtggctggccaggcgcggtggctcacgcctgtaatcccagcactttkggaggccaaagcaggcggatcacgaggtcaggagatcgagaccatcttggccaacatggtgaaaccccatctctacttaaattacaaaaacttagctaggcatggtggcccgtgcctgtaatcccagctacttgggaggctgaggcaggcgaatcacttgaacctgggaggcagaggttgcagtgagctgaggttgcggtgagctgagattgtgccgctgcactccagcctggcgacaaagcacgactccgtctcaaaaaaaaaaagaaaagaaaagaaaaaagttaaaaaaaaaaatta

SEQ ID NO: 185442 - DNA, 601 bp, Human
atcccagcactttgggaggccaaagcaggcggatcacgaggtcaggagatcgagaccatcttggccaacatggtgaaaccccatctctacttaaattacaaaaacttagctaggcatggtggcccgtgcctgtaatcccagctacttgggaggctgaggcaggcgaatcacttgaacctgggaggcagaggttgcagtgagctgaggttgcggtgagctgagattgtgccgctgcactccagcctggcgacaaagcacgactccgtctcaaaaaaaaaaagaaaagaaaagaaaaaagttaaaaaaaaaaattacccaggagtggtggtgtgcacctgtagtaatcccagctactcaggaggttgagacaggagaatcgcttaaacttgggacgcggagattgcagtaagccaggatcatgccactgcactccagcttgggcgacagagcgagactctgtctccaaaaaaaaaaaaaaaaaaaaaatgcgtatcgttccacctatttgacagatgaggccactaagccccaccagaaagcatgcttggccgatgagctcatccattcctgttgcccctgacgtttctgccggtttcttgtc

SEQ ID NO: 185443 - DNA, 601 bp, Human
cagcctgctcttctttttcaatctcttcaggatctctgtagaagtacagatcaggcatgacctcccatgggtgttcacaggaaatggtgccaagcatgcacagaacttcccgagccagcatccaccacatcaaacccactgagtaagctcccttgttgttgcatgggatggcaatgtccacatagcgcagaggagaatctgtgttacacagcgcaatggtaggtaggttaacataagatgcctccgtgagaggctggtggtcagccctggggtcagtaaccacaagaagccgtggctcccrgaaggctgcctggatctggttagtgaaggttccaggagtgaagcgcccagcaattggagtggctccagtggcagcagcaaacttcagcacagccgtctggccagtattcctggaggatataacactgacatcagcagggttttcaatggcaacaatagcatgagctgccagcagaagcttctcccaggtcctcttcagatttatgatatagatgccatcacttttcctttcatagatgtactgttccatctggaagtcaagattggtgccacctaagtgggttcctgctgcaaggaactt

SEQ ID NO: 185444 - DNA, 601 bp, Human
cactgtattatgcccttaatgggaccatcatttatctggcaagaaatctaagcgtttcttaggccttgctcttctttccacctgctcagccatcacctggctctgtgtctgtcaggtgtgtatctgaagtgtccccaagggagtgctctgctgcctcctttgtgcttgtttcttcttttccagattgccttatccccttcctacttgccagtctccgtttccgtggtgtccctcaccatctccctgaagtcctttttccacattgctcctagattggctgtttatagtacacatctgatcttgtccctccattctcttaaaatatttcagttgactcactatcttagaattccctgaaccagcctaccaactaccttgaggatctctcctctccttgtcttttattttaacaactttattgaggtaaaattgacctatagtaaagctaaagtatttaatatgtacaatttgatttttaatagttaatttatgcagctgtgaaatgatcatcacaatcaaggtactgcgcatatccttcaaacttttgaccttcaaaagttttccttgtgccccttatgtaaccctctcccccaccccaaac

SEQ ID NO: 185445 - DNA, 601 bp, Human
ggcaagaaatctaagcgtttcttaggccttgctcttctttccacctgctcagccatcacctggctctgtgtctgtcaggtgtgtatctgaagtgtccccaagggagtgctctgctgcctcctttgtgcttgtttcttcttttccagattgccttatccccttcctacttgccagtctccgtttccgtggtgtccctcaccatctccctgaagtcctttttccacattgctcctagattggctgtttatagtacacatctgatcttgtccctccattctcttaaaatatttcagttgactcmctatcttagaattccctgaaccagcctaccaactaccttgaggatctctcctctccttgtcttttattttaacaactttattgaggtaaaattgacctatagtaaagctaaagtatttaatatgtacaatttgatttttaatagttaatttatgcagctgtgaaatgatcatcacaatcaaggtactgcgcatatccttcaaacttttgaccttcaaaagttttccttgtgccccttatgtaaccctctcccccaccccaaacctttttaagaattatataaatggaatcgtatagtagg

SEQ ID NO: 185446 - DNA, 601 bp, Human
ctatttaagataaaatgtgctcaaataaggaaattaacatttaaataacagtttaagattatggaggaattgtcatttaacacattatttccaaccatattatgaatagtttagaggaggaagcgattgtcacatgccaaaattttattgaagtcaattttaaagtgagagtaggatgtcagttgtggggcgaggattgggaagggctttccgagaagttggaacggtgccagccaagcgtgggagcaggagagcatagccagatcccaggctggctgggagtgaggcggctcacccagarcgcaggttgtcacttcagcttgtgcatataatttcattccttcatttatcaatatccagcaagcttttattgtgcgcttatttgatagatactgtgctgggtactgggcaatcaaaaacaaactaaagaacccagtctcctggggccagcagtctgtaggtcatgatgacctctctttattggctttcccctctcggcttctgtggccctgaagaactctcttctctttctaactgccctttcattttcttttctgtttagtagttgtgctttggctcacctcattgcagtggtgtttat

SEQ ID NO: 185447 - DNA, 601 bp, Human
tttattgtgcgcttatttgatagatactgtgctgggtactgggcaatcaaaaacaaactaaagaacccagtctcctggggccagcagtctgtaggtcatgatgacctctctttattggctttcccctctcggcttctgtggccctgaagaactctcttctctttctaactgccctttcattttcttttctgtttagtagttgtgctttggctcacctcattgcagtggtgtttatgcatatttttctgtctagattgatctttcttccttaacataccactagcatggactctggaaccasgttacttgggtgaaaccccagctctgctacattctagctctgtgagcctgcagtcactcagcctccgtgtgcccaggttccttatctgcaacatggagatcacagaagtatcgcgcctacaggtctggagggggtctgaggaagcaagatgtgtgaagctttgagcacagtgcttggcacggaggactctgtgtgttactgtagtaggcatcagtggattcaattaactgcgaattgaaaatattcggataggctgagcgcggtagctcatgcctgtaatcccagcactttgggaggccg

SEQ ID NO: 185448 - DNA, 601 bp, Human
acagggcactgggcagcagacacagatgactcctgtggaagttgggctagaacaggtacttaccattttggaaaaaaaatgtgtgaaagtagaaaactgggagagtgaactactatttgaaggggtaaagtatttttaatgaaagttgttatttggtattttttcttgagataaaatgaagtagggaaacaaattcaaggagggcaaaaagtagatcttagagaattacaggatattatttgtctggagagtagggagaagggaagtgaggaagtaaatcctggaatggtagacctgggayagatttcagtggagaaagacagtatcctgttcaaagtgaataaatgaaatattttgcaggtaattagaatctagggatgtgtagaaggtttttgagggggtaaaattagaggaaaatctaaaaaggatggttactttaataagaaataaaataccaacattgtatagtgtttttaaatgctaaaattctattggagtgtaattggtatatttgtgttttatttttaaatgtattttaattttaaactaaaatattttagggtgcacttgatctatctgatgtacattctccaccaaagtc

SEQ ID NO: 185449 - DNA, 601 bp, Human
agggagaagggaagtgaggaagtaaatcctggaatggtagacctgggacagatttcagtggagaaagacagtatcctgttcaaagtgaataaatgaaatattttgcaggtaattagaatctagggatgtgtagaaggtttttgagggggtaaaattagaggaaaatctaaaaaggatggttactttaataagaaataaaataccaacattgtatagtgtttttaaatgctaaaattctattggagtgtaattggtatatttgtgttttatttttaaatgtattttaattttaaactaaaayattttagggtgcacttgatctatctgatgtacattctccaccaaagtcaccagagggaaaaacaagtgcacagacaacaccaagtaaggtgagttagctgtggaacacggaagtcatgtctggacttaactccagagtgctctgcttttctctctctagtctttcttgttacaagttgtattgttttatataaacacatgggctctttagtttcttgaaggtgctttttttccattaagtatacattaaaaaaaaagttttgctttgttggtagttgtttgacatttgtattgtagaaag

SEQ ID NO: 185450 - DNA, 601 bp, Human
ttcagggtaaaatattaaagtctattttacgtactcttattctccctacatacattttaagatctaagaattataatgagaatctcaatgttttaagtcagtcaggaaatgatgctgtgagtttttccagagaaggggggactgtcctgaggctgctttagagaatagcgtttgtcctaacagctgtctctgccgtcatcccgttattctagtttagtctccgtttctcagttggcctcataaacccacttcagaaataccctagatagtccttgtgtagggttgcatctgttctaaaatraacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacgcaacctttaggaaccagctttgtgtgctcctgagaaaggtcagatgaggtcaggacaagtcttcaaggaagttgcctaggaactcaagtgaggcttatttagaatgccgctaaaatgtagcatgaaagagctgattctc

SEQ ID NO: 185451 - DNA, 601 bp, Human
agaatagcgtttgtcctaacagctgtctctgccgtcatcccgttattctagtttagtctccgtttctcagttggcctcataaacccacttcagaaataccctagatagtccttgtgtagggttgcatctgttctaaaatgaacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacscaacctttaggaaccagctttgtgtgctcctgagaaaggtcagatgaggtcaggacaagtcttcaaggaagttgcctaggaactcaagtgaggcttatttagaatgccgctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgag

SEQ ID NO: 185452 - DNA, 601 bp, Human
acccacttcagaaataccctagatagtccttgtgtagggttgcatctgttctaaaatgaacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacgcaacctttaggaaccagctttgtgtgctcctgagaaaggtcagatgaggtcaggacaagtcttcaaggaagttgcctaggarctcaagtgaggcttatttagaatgccgctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgagacatttttcagtaggtatctttgtttggtaatgagttagtttattttttaaagatttctattttgtggtaaaatctcatttt

SEQ ID NO: 185453 - DNA, 601 bp, Human
tccttgtgtagggttgcatctgttctaaaatgaacccttattttggcacttaaaatgcaatttctctagtactaaaggacctggatttgggatccagtactttccctaccgtcttcttgctagctacctcctaccaaatcagccttgagggcccacggagaatgctagaaactctccaagagtagggtccacgcaacctttaggaaccagctttgtgtgctcctgagaaaggtcagatgaggtcaggacaagtcttcaaggaagttgcctaggaactcaagtgaggcttatttagaatgcygctaaaatgtagcatgaaagagctgattctccacccagtagaagctgagcaggtggaggctaaggtatctgtgtttgacctagtaactattggaaacagtaaacatgaggtagatcactctaggaatagttaagaaaggaccaaaaaaagcaggcctcacagaacatattaactagatgttccacttctgagacatttttcagtaggtatctttgtttggtaatgagttagtttattttttaaagatttctattttgtggtaaaatctcattttattctcatgctcagataccaaggtat

SEQ ID NO: 185454 - DNA, 601 bp, Human
ctcaattacttggaaacctttttccctgtacatttctgatcttgtttctgaactgccttgtgagaagtctgtattgtaccccatgtggcctattgccagccttacttatatgggtaagcccttagctctttgttcccctgcctttctgctttgccttgtgcatgcagtgagttcccaacagccttaacattctcaacatcttcatcatccagatgctatgttgcatgtggtggttgaggttgtacacagcaagactccagatggagccatccgcatggtaggtgagtggcatctcccaagrtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaag

SEQ ID NO: 185455 - DNA, 601 bp, Human
ggtaggtgagtggcatctcccaaggtatgcaaagccatcatgggagccctgcctgtcctgcagacgtgaactgggcatgcgatgcaggagggcctagggtaccgctgctcccggagctctggagcactgatcaggagtgtcgcatgtgtccggttgctttcgaatgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatacaaggagtataaatatgaaatgagagggcattttaaaaatgaattaataattttgaaatatatattaatacttgctgacttccaaagtatcatctgtgataatttatctcattgtattccatttcgttgtaccaaacatcctaattgtttggaaaaaaaaaaaagtatcagaaaattataacagacttttgataggcccta

SEQ ID NO: 185456 - DNA, 601 bp, Human
atgcaggaggcgacaagtactagtggctcactcagagacccttggcactttcttcagggaagctatattcatattataaataaacttaaaaaaacattcatatgtatagttagaattgatttgtagggtttttgaactgatgtaacttgggcaaaactgaagttcttatttttgttgttgctaagagacaataaagataaaaataaaataaagattaaagataaaagatttggtatacaaggagtataaatatgaaatgagagggcattttaaaaatgaattaataattttgaaatatatrttaatacttgctgacttccaaagtatcatctgtgataatttatctcattgtattccatttcgttgtaccaaacatcctaattgtttggaaaaaaaaaaaagtatcagaaaattataacagacttttgataggccctactagcttaggtttttaccatttagttggaaatgttgagtaagatctatatttttttgtttttaatatttagaattagttgctctttatcattatattaaatgtaatatgaaagatcatcctttcttcttacaaatagttttcaggtgtctgtttctttttaga

SEQ ID NO: 185457 - DNA, 601 bp, Human
attacaagtaatctagagatgattcaaagcatatgggaggatgtgtgtaggctatgtgcaaatactacagcattttatacgagggacttgagcatcctcggactttggtgtctgcaggtgtcctgggtactgagggacaactgtattgcatgaattttttgaatacttttgcaaaacaatagtatttctttgatatttttcctacatgaacagtttggaaaaaaattcttttttttttttttcaggttcttaagtcagtctgatacaattcagtttttgactactgaaaaattaaggtttytcattgtgaaacttctctagtgctgactttttgttaatctagaaatgattggcttctttattatatgagtgtactattggataatttaaatatatactaaagctttcttatggctgcactataatttcccatagagcttattattagtcttgagctccagccaagagaacttaatgaccgttgtagtgctgtgcaataggtccctcacttttatgaaaagacaaaacttgttttagttttttgttataaatgacttgatttgtttcctagggctaatgtaatataagtaccaatattggg

SEQ ID NO: 185458 - DNA, 601 bp, Human
attagtcttgagctccagccaagagaacttaatgaccgttgtagtgctgtgcaataggtccctcacttttatgaaaagacaaaacttgttttagttttttgttataaatgacttgatttgtttcctagggctaatgtaatataagtaccaatattgggtggcttaaaacaacacatgtgttgtgtcacagttctagaggcttaaaaatgtgaaatcaaggttcgcggagggctgtggctcctgttctagcttctggtggctgctagacccagatgctgtttggcttgtagatggattactycagtctttgcctccatcttcacatggacttctccctgtgtttctctgtgtctcttccccccagcaaggataccactcattaggttaggacccaggcccaccctactctttgaatggactcatcttaactaaatacatctgcagtggacactgtttccaaataaggtcacactctgaagtactgggagttaggggtttcaacatatttcatttgtgggatacagtttgacccataacttttgtgcttgtccagagaatgaattctaaggcattgccatggtatgtgtgtgtgtgtgtattt

SEQ ID NO: 185459 - DNA, 601 bp, Human
gacactgtttccaaataaggtcacactctgaagtactgggagttaggggtttcaacatatttcatttgtgggatacagtttgacccataacttttgtgcttgtccagagaatgaattctaaggcattgccatggtatgtgtgtgtgtgtgtatttttttttgagacggattctcgctctgtcaccaggctggagtgcagtggcggcgattacagctcactgcaacctccaacttcctggttcaagcgattctcctgccccagcctcctgagtagctgggattacaggcacgtgccaccacrcccagctaatttttgtatttttagtagagacggggttccactatgttggccaggatggtttcggatctcctgacctcatgatccgcctgcctcggcctcccaaagtgctgggattacaggtgtgagccactgtgcctggccttatattttttaaatcttatttgttagtttttaaacaatacttaaccttagttatttagcttcattttgaatcttcaacttagccaaatccaggtgatacaaaacccaagtaactgaagtttatgtacgtaacataagttcgtcttaactcatgataag

SEQ ID NO: 185460 - DNA, 601 bp, Human
aggatggtttcggatctcctgacctcatgatccgcctgcctcggcctcccaaagtgctgggattacaggtgtgagccactgtgcctggccttatattttttaaatcttatttgttagtttttaaacaatacttaaccttagttatttagcttcattttgaatcttcaacttagccaaatccaggtgatacaaaacccaagtaactgaagtttatgtacgtaacataagttcgtcttaactcatgataagggtttttaaagcagattcccgggtatacatacgtatacagatggtccccaaygttacaacagtttgatttatgcttttttgactttatgatggtacaaaagtgatatagattaagtagatagcatacgttgagttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgagg

SEQ ID NO: 185461 - DNA, 601 bp, Human
atagattaagtagatagcatacgttgagttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcatacacctgctgtgcacacgcatacacctgctgtgcacacgcatacacctgctgtgcacacgcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtg

SEQ ID NO: 185462 - DNA, 601 bp, Human
tgagttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcatacacctgctgtgcacacgcatacacctgctgtgcacacrcatacacctgctgtgcacacgcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagca

SEQ ID NO: 185463 - DNA, 601 bp, Human
agttttgatcttttcccaggacagtaatcggtggtacgattctctctcggggccaggcagtgacgttgagccacggcttccagtcagccacatggtcacgaggcactctgatgccaggggactgaatagccagcattttttggatattgtgtttttgcacctcatgtttatgaagtgcccgttttccactttgtgatattttcacttgacggttgatgaggtgaagcgctgttgtgggttgagcatctgtgcacatgcatacacctgctgtgcacacgcatacacctgctgtgcacacgcrtacacctgctgtgcacacgcgtacacctgctgtgcacacgggtacacctgctgtgtacatggaggagccactgaaactgctctcagcgttttcagtgctttggttttaatctgcaaaatgtgttgatgacaaatctttctcctcttcctgtagatttttttaatagtgaagtttatttggaattaagtttagtgaattcattaataacctagttggtaatggtcttttggcaaaaatgagccatagttataaagtagtaacatgttactgtgtggtttagaactagattttgagagcagt

SEQ ID NO: 185464 - DNA, 601 bp, Human
tgtttagaaggagagaatctgtcgtggccacaggctgtgtcattgtacatatgtttaaatatcacatcagggtatttatttccaaatgcatattcttttaaaaagacataaatccattattaaaacagtgtaaaaatcagaaattacaactgctgtgaattacataatatttttctatatttgataataccaggaaaatgtcaagaaagttgttaggaaatttttgaaagtttccatccctttgaaaatatgttgtctaaaattataacttgctatttattttttcagacatctctttataatcattaatttatattaataacatggaatgtgtagctctctagaaggcaataaaatttgcacagcatatatcttgcctactgtcaactagtcaagacctctacctggtgtaaagatgtaaacgtatatcataagacatgcataatgcattctgtctgtacccatatgaaaagtgaaaccatccttcaagagcgtcttgttcggtaatgtctaacccagactttggtcaccatgcttcagtagttactactctttaattctttctcagccatccatcccttcctagatataatttgatctg

SEQ ID NO: 185465 - DNA, 601 bp, Human
gttaggaaatttttgaaagtttccatccctttgaaaatatgttgtctaaaattataacttgctatttattttttcagacatctctttataatcattaatttatattaataacatggaatgtgtagctctctagaaggcaataaaatttgcacagcatatatcttgcctactgtcaactagtcaagacctctacctggtgtaaagatgtaaacgtatatcataagacatgcataatgcattctgtctgtacccatatgaaaagtgaaaccatccttcaagagcgtcttgttcggtaatgtcyaacccagactttggtcaccatgcttcagtagttactactctttaattctttctcagccatccatcccttcctagatataatttgatctgaaaaatatgaatctagttcaattcttgaggaaactcatgcctaggaaattaatttacttaagattacacgggccgtgtatggtggctcacggctcacacctgtaatcccagcactttgggaggccgaggcgggtggatcacttgaggtcagaagttcgagaccagcgtggccaacatgttgaaaccctgtttctactaaaaatacaaaaat

SEQ ID NO: 185466 - DNA, 601 bp, Human
atagacccgtctaagggcagaaagaaatctgaccaagaatggagtgaaagtcggctgtgaaggttaggactccctgaaaacaaaaaagaaaagtggtaacatcactctgtatccaagggcatggataaggatgattcagaatttttttataacattgatgttaatatacatagagaaatacacacacacacacacgtatatatgtccatggacatcaaaatgaggtataggttaggaagttaccctggaagttagaattgagataattactttgattagcaaaggtttatgttagaaataygagtggttgaaggcagcgcctttcaccttgatgcctgttgtgtttagcactggatagaaaattgctatttttactgatgactactttaatgcttggttcattcatatgaaataatctttcttttctcctttaataataatgatctctcctgatttcaagttgaaaatgtattaatttaagataacttatgaagcaatgacatatggaagaggagatgggaaattgtttctcaatgggaaagtgtttataaatgggataggtatactaaaggtatttccatttagggaaagaggaaaggaa

SEQ ID NO: 185467 - DNA, 601 bp, Human
cacctgagttcatagttgagtgaggatggaggacggaggttggagataagaggagagtggagaaagcatgaaatctttctataagaaagtaaggcgagaaggcactgtggaaacccggagggttgttgggcagttttaaaggtccccttgaggttagtggtcatgactttaaggggagttcatcagcatggctgttagtggcttctgtaagcaatattaaatctgagaggtggcacttatttgctagtaaactcctgtattgtcccttggctgcatgtctgggtaatggaaaagggcttcygaaaaaaatcacagtgaagaggtcaatttagtttatatcaaacagaattctaaagagaggtgagctgatttcttacgccctggctgtgccgattgtggttgatctgtagtttgcactcccttggtgtactttatggttttgaatctttaaagtgtatattcttgatttccagccaccacacgtataaaatatctttaagttgcttttgtttctgtggcagaataaaagtgtttagtggcagaacataagagcaccgattaactgtccttgtttcttgttaggaggaaggaacctaggaag

SEQ ID NO: 185468 - DNA, 601 bp, Human
gccccatattgaacaacgacaaaaattgatgtggtttagagactgttatattctaagtcactctaatgttaatattttctcctgttcacaggtaaaaggggaaatacagttttgaaagatctgaaattgatcagtgataaaattggatcacttggattaggtaattagatttctagtttttgtgttgatcgttttaaagtgattatttttagggtaaggctgtaaaagaagtgactccgtctgcctacgctgagcaccttcctgctgctgctcattcagcaggtgtttgaatggcttttaygtgttcaggattacacgctatgcgagagatggctacagcaacagccatcatgttctcgtgaacctctgtcttcatggagtttaaattctggtcaggaatatgaacattaaacgggcatctacagatattttgactgtaaaagggtcagtatatatgggtatagaaatggctagtaggttacctttgtccagtcttggcattcagggaagacttcttataagaagtgacttctgtgcagaagcttcatggttaagtagatgtataagagagaagggaagatatttcagttcagactgagaa

SEQ ID NO: 185469 - DNA, 601 bp, Human
agttgctgggtacaggcaggagggtggtgtgctccttcacttcactttgtcttgggacttaggcatatctcgggttggaattggggtagttatgcaggtgagaactaccagttcactagctggatgtttgtcatttagctaggcattaggattcagtagaaataaagttttatttcgttttgcaacaatgttgttttctgtttgggttgtttacattttaaatatacagtactctaggtattttgagtaatatgtagacagatgttagtggaccagcctaggagaataatgatgttagtgrtaagtgcttggcactgtaccaaggaattattttatttaattcatatcctatgaggtaggttttattactatctccatttttacagatgaagaatctaggttaagtaacttgcccaaggtcatgctgcttttagagtcctgatgcatcacacagagccctcaccactgtgttttactgcctgtatgttatttagacatattgaaataatcatttcaatgggaacataaattctgagttccaaataaataatctacaaataaagctttagagcaccatctattttagtttggcagacaaata

SEQ ID NO: 185470 - DNA, 601 bp, Human
ggtacaggcaggagggtggtgtgctccttcacttcactttgtcttgggacttaggcatatctcgggttggaattggggtagttatgcaggtgagaactaccagttcactagctggatgtttgtcatttagctaggcattaggattcagtagaaataaagttttatttcgttttgcaacaatgttgttttctgtttgggttgtttacattttaaatatacagtactctaggtattttgagtaatatgtagacagatgttagtggaccagcctaggagaataatgatgttagtgataagtgcytggcactgtaccaaggaattattttatttaattcatatcctatgaggtaggttttattactatctccatttttacagatgaagaatctaggttaagtaacttgcccaaggtcatgctgcttttagagtcctgatgcatcacacagagccctcaccactgtgttttactgcctgtatgttatttagacatattgaaataatcatttcaatgggaacataaattctgagttccaaataaataatctacaaataaagctttagagcaccatctattttagtttggcagacaaatattaattaa

SEQ ID NO: 185471 - DNA, 601 bp, Human
gccaaagatgactggggtaagggcagataagacagagggtatgggatggggaggagagactgtcaaaaaatgaagaaaacaagaatccttggcctgagggccaaaatttgctgacccttaaagtaatgtagtacaggttgagtatcccttaatgcaaatgcttgggaccagaagtatttcagagtctggatttttttggattttgaaatgtttgcatttttcttaccagatgagcatcccaaatctgaaaatctgaaagtccgaaatgctccaatgagcagtttctctgagcattacgtcmgcactcagaaagttctggatttcattcaagtttggttttcaaatttttgaatttgggatgcttaacctgtatgtattctgttaatcattttgacactggcttaaattattgtaatactaaacaatacataaccaagaagtcagaatctgatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtg

SEQ ID NO: 185472 - DNA, 601 bp, Human
ccaaagatgactggggtaagggcagataagacagagggtatgggatggggaggagagactgtcaaaaaatgaagaaaacaagaatccttggcctgagggccaaaatttgctgacccttaaagtaatgtagtacaggttgagtatcccttaatgcaaatgcttgggaccagaagtatttcagagtctggatttttttggattttgaaatgtttgcatttttcttaccagatgagcatcccaaatctgaaaatctgaaagtccgaaatgctccaatgagcagtttctctgagcattacgtcascactcagaaagttctggatttcattcaagtttggttttcaaatttttgaatttgggatgcttaacctgtatgtattctgttaatcattttgacactggcttaaattattgtaatactaaacaatacataaccaagaagtcagaatctgatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtgg

SEQ ID NO: 185473 - DNA, 601 bp, Human
cagataagacagagggtatgggatggggaggagagactgtcaaaaaatgaagaaaacaagaatccttggcctgagggccaaaatttgctgacccttaaagtaatgtagtacaggttgagtatcccttaatgcaaatgcttgggaccagaagtatttcagagtctggatttttttggattttgaaatgtttgcatttttcttaccagatgagcatcccaaatctgaaaatctgaaagtccgaaatgctccaatgagcagtttctctgagcattacgtcagcactcagaaagttctggatttyattcaagtttggttttcaaatttttgaatttgggatgcttaacctgtatgtattctgttaatcattttgacactggcttaaattattgtaatactaaacaatacataaccaagaagtcagaatctgatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtggattatcattagttcttacaggt

SEQ ID NO: 185474 - DNA, 601 bp, Human
attgtaatactaaacaatacataaccaagaagtcagaatctgatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtggattatcattagttcttacaggttttgggataggtggtggagttaagagcaatgttttgagggaaggggttggatcttacaaagtacattctcaagggtggggagaaytacaaagaaccttcttaagcatgggggagattataaagaaccttcttaagggtgggggagattacaaagtacattgatcagttagggtagggcagaaacaaatcacaatggtggaatgtcatcagttaaggctattttcacttcttttgtggatcttcaattgcttcaggccatctggatgtacacgtgcaggacactggggatatgatggcttagcttgggctcagaggcctgacaatcttgtgttttgaattggctacaaatgctgccaggtggggaatccagttagctttctttaaa

SEQ ID NO: 185475 - DNA, 601 bp, Human
gatgtgttatagcacattattcagtaaatatctttgtctcatgtgtctgtctgaagagaccaccaaacagtctttgtgtgagcaacatggctgtttatttcacctgggtgcaggcaggctgagtccgaaaagagagtcagcaaagggttgtggattatcattagttcttacaggttttgggataggtggtggagttaagagcaatgttttgagggaaggggttggatcttacaaagtacattctcaagggtggggagaactacaaagaaccttcttaagcatgggggagattataaagaaycttcttaagggtgggggagattacaaagtacattgatcagttagggtagggcagaaacaaatcacaatggtggaatgtcatcagttaaggctattttcacttcttttgtggatcttcaattgcttcaggccatctggatgtacacgtgcaggacactggggatatgatggcttagcttgggctcagaggcctgacaatcttgtgttttgaattggctacaaatgctgccaggtggggaatccagttagctttctttaaatccacattgcagccacagccgtcctcgctgtctcagctcag

SEQ ID NO: 185476 - DNA, 601 bp, Human
cacatatgtagtttgtttaatcagatttccacttctccttcttggccctgacagtgcctggtttctggcaagcacttgcagccctttaacctttgaggctacagtggagacgagctcttgattctcaagaggagaggaagctcctgacatgtccctcctgactgcttatgatcagggatttccagttcattactgggcaaggtttggatgtagcaggaacaaggactcatgttttcttcgtttgctgatattcttcccaccccatatcatctacccgtctgtcttatctgtgggacacctkccttgacccaagccttttacccctgttctctttggcctggactttctgacagccttctgctttccttactttcattgttgcctcctgtacacacatttcttctggcggtggtacgattatttctgggaaaacagaagtgaggtagtgctaccctgcactttttcactcctgtcttcccccaccccaccccatcccagacagcttccctttgtattcaggctaagatccttattgcaaccaaccaagccctaatgatccggcttctgccaacccttctgatcgccactccttttttcttcc

SEQ ID NO: 185477 - DNA, 601 bp, Human
gaggctacagtggagacgagctcttgattctcaagaggagaggaagctcctgacatgtccctcctgactgcttatgatcagggatttccagttcattactgggcaaggtttggatgtagcaggaacaaggactcatgttttcttcgtttgctgatattcttcccaccccatatcatctacccgtctgtcttatctgtgggacaccttccttgacccaagccttttacccctgttctctttggcctggactttctgacagccttctgctttccttactttcattgttgcctcctgtacacayatttcttctggcggtggtacgattatttctgggaaaacagaagtgaggtagtgctaccctgcactttttcactcctgtcttcccccaccccaccccatcccagacagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaa

SEQ ID NO: 185478 - DNA, 601 bp, Human
ttctcaagaggagaggaagctcctgacatgtccctcctgactgcttatgatcagggatttccagttcattactgggcaaggtttggatgtagcaggaacaaggactcatgttttcttcgtttgctgatattcttcccaccccatatcatctacccgtctgtcttatctgtgggacaccttccttgacccaagccttttacccctgttctctttggcctggactttctgacagccttctgctttccttactttcattgttgcctcctgtacacacatttcttctggcggtggtacgattatytctgggaaaacagaagtgaggtagtgctaccctgcactttttcactcctgtcttcccccaccccaccccatcccagacagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaattt

SEQ ID NO: 185479 - DNA, 601 bp, Human
gcaaggtttggatgtagcaggaacaaggactcatgttttcttcgtttgctgatattcttcccaccccatatcatctacccgtctgtcttatctgtgggacaccttccttgacccaagccttttacccctgttctctttggcctggactttctgacagccttctgctttccttactttcattgttgcctcctgtacacacatttcttctggcggtggtacgattatttctgggaaaacagaagtgaggtagtgctaccctgcactttttcactcctgtcttcccccaccccaccccatcccwgacagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaatttttaatttttgagggggtcttgcaatgttgcccaggctggtctcaaactcctgggtgcaagtgatcctcctgcctt

SEQ ID NO: 185480 - DNA, 601 bp, Human
caaggtttggatgtagcaggaacaaggactcatgttttcttcgtttgctgatattcttcccaccccatatcatctacccgtctgtcttatctgtgggacaccttccttgacccaagccttttacccctgttctctttggcctggactttctgacagccttctgctttccttactttcattgttgcctcctgtacacacatttcttctggcggtggtacgattatttctgggaaaacagaagtgaggtagtgctaccctgcactttttcactcctgtcttcccccaccccaccccatcccatacagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaatttttaatttttgagggggtcttgcaatgttgcccaggctggtctcaaactcctgggtgcaagtgatcctcctgccttg

SEQ ID NO: 185481 - DNA, 601 bp, Human
aaggtttggatgtagcaggaacaaggactcatgttttcttcgtttgctgatattcttcccaccccatatcatctacccgtctgtcttatctgtgggacaccttccttgacccaagccttttacccctgttctctttggcctggactttctgacagccttctgctttccttactttcattgttgcctcctgtacacacatttcttctggcggtggtacgattatttctgggaaaacagaagtgaggtagtgctaccctgcactttttcactcctgtcttcccccaccccaccccatcccagtcagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaatttttaatttttgagggggtcttgcaatgttgcccaggctggtctcaaactcctgggtgcaagtgatcctcctgccttgg

SEQ ID NO: 185482 - DNA, 601 bp, Human
ggtttggatgtagcaggaacaaggactcatgttttcttcgtttgctgatattcttcccaccccatatcatctacccgtctgtcttatctgtgggacaccttccttgacccaagccttttacccctgttctctttggcctggactttctgacagccttctgctttccttactttcattgttgcctcctgtacacacatttcttctggcggtggtacgattatttctgggaaaacagaagtgaggtagtgctaccctgcactttttcactcctgtcttcccccaccccaccccatcccagacagcttccctttgtattcaggctaagatccttattgcaaccaaccaagccctaatgatccggcttctgccaacccttctgatcgccactccttttttcttcctccacccattctgtcccccaaattcattgttttatggttgtatggcttccttactggtggtttttacattttttttgagacagtattttaaaaattaaaatttaaaaaataaaataaatttttaatttttgagggggtcttgcaatgttgcccaggctggtctcaaactcctgggtgcaagtgatcctcctgccttggcc

SEQ ID NO: 185483 - DNA, 601 bp, Human
aagctgagcctggagtgcagagagtgtggtcatcttggccagttgtgacatctgaacaggcaagccagactgggctaaaatccacaggagacaagacagtaggccataaagttagagtccgtatttgagatccaaactttacctttttatgtgggtggagaacagaagatccttcgatggtgagctgtagcattgcagggtcacctgtcagtacccacttcaagctgtccccagctcagaggagtctaccagtcaggttggaggttgccatggctgggtggggacttgctttccagaacawggtgggattctccaagcgctgtgattgtcacacagggagaaggcctttgagagaggtagcgtttacaatgcaaccacacaatctaagtcagcagcatccgtgtttgcattcttattctttcatatattttcttatttaagctttaacctttgactctcagtttctttacttgtaagatggaagtattaatacctatgtgataggattattttgaaggttaaatgataatatataaagcacttctctaattcctgatgtattatatacccttataattataaatttagctttctcttttca

SEQ ID NO: 185484 - DNA, 601 bp, Human
actgggctaaaatccacaggagacaagacagtaggccataaagttagagtccgtatttgagatccaaactttacctttttatgtgggtggagaacagaagatccttcgatggtgagctgtagcattgcagggtcacctgtcagtacccacttcaagctgtccccagctcagaggagtctaccagtcaggttggaggttgccatggctgggtggggacttgctttccagaacatggtgggattctccaagcgctgtgattgtcacacagggagaaggcctttgagagaggtagcgtttacartgcaaccacacaatctaagtcagcagcatccgtgtttgcattcttattctttcatatattttcttatttaagctttaacctttgactctcagtttctttacttgtaagatggaagtattaatacctatgtgataggattattttgaaggttaaatgataatatataaagcacttctctaattcctgatgtattatatacccttataattataaatttagctttctcttttcaccctgcatcatcctaaagaggcctgaagaatgttgctttaaagttataccaaagaaactatgaaggat

SEQ ID NO: 185485 - DNA, 601 bp, Human
gggactacaggcgcctgccaccacgcccagctgattttttgtatttttttatagagacaggacttcaccatgttagccaggatgatcttgatctcctgacctcgtgctctgcctgcctcggcctcccaaagtgctgggattacaggcgtgagccaccgcgcccagcaagttatttaacttttggggccttgggtctcacatctattttgcaagagagatggtggtagtgaaaattagagataagcgtgtaaagcatatagctcagtgcttagcagaacaggcattcaataaatggtatctratactattattcattgtagtcacaatagacatttctgtcgtaggcacagatatagacttcttccctcaaatttatgcaggatcagagagagaaaagccatgtacacaaacataggaaaatcaagataaaaagtgacaggtgccataaaatgccagtcattcatgggccatgaaaattcagaagcaggaactaatatttgaccgggattttgaaagatgactctgacttggttctgcgagggctgaggaggaacatggtaagctccatgagaacagaagggagatcccgggacatgtcagt

SEQ ID NO: 185486 - DNA, 601 bp, Human
atttgtattaatataacactcaattactttgtaaacgagatggaataccttactgatttcactctgtaataatgatgggaagagaaaattacagttccaaggtatcagtttgttttacagtctgtctgcaagcttttctgacttttcagtttttgtgtaaattggatttgaattgaatgcataagaactgtaattaagattcctaataattttctttgtgagatagttttacagcaggactatgtttggaccaagagaaagggcaaggacttatttgttgaaaaggattttacttacaacytaaatttctgaatatccgaagaataacaaaatgagaggatatgtggggggcagatgaacagacaaataaaagcatctcacagtatctcgggatgaaactgttgcatctctacaagatgttcctattcttgtgcgttattacctggcccaggtgttggcacacttgttctctaaaaggccatatagtgaatattttaggctttgcaggccataactactccaccttgccattgcatggagaagacagccatagacgatgcctaagagtgtgtgtgtgggtgtggctgtgactgtcccctgg

SEQ ID NO: 185487 - DNA, 601 bp, Human
aagaactgtaattaagattcctaataattttctttgtgagatagttttacagcaggactatgtttggaccaagagaaagggcaaggacttatttgttgaaaaggattttacttacaacctaaatttctgaatatccgaagaataacaaaatgagaggatatgtggggggcagatgaacagacaaataaaagcatctcacagtatctcgggatgaaactgttgcatctctacaagatgttcctattcttgtgcgttattacctggcccaggtgttggcacacttgttctctaaaaggccatrtagtgaatattttaggctttgcaggccataactactccaccttgccattgcatggagaagacagccatagacgatgcctaagagtgtgtgtgtgggtgtggctgtgactgtcccctggtctgttgccacaacaatgagtctaggtgggactgggaaggttgggttctgtccttgttcagctgtcagtgggacctgcccagctgtatgttctatattctggagcctgtatattcacccgtggttttttccttagttaagaaatgttttcccagcctgcattatgcttacatatctattaat

SEQ ID NO: 185488 - DNA, 601 bp, Human; identical to SEQ ID NO: 32913

SEQ ID NO: 185489 - DNA, 601 bp, Human
caaaatgtaaagggctctttgctctctaaatcttgtagagttttaggttatagttgtttctccctttaaactaagaagatggattacacataaccactaatttatgtgctgcttttattcagccgtaagtcttaggcacaacccttctctctgagattaacaatcggtttgaaagcgctattttgtaagaagggaatagacttagaccagctgtgttagtggcctctggatgcaggggttagcgtgacagtggggaaaattattaagatacttttcttctttttcattttggtattagaargagaaaggcaactaatactagtgacgggaatacatttttaaaaggtgaaacgccttattgcatgttcagggagggggaagaattttagtgtataacttaggtttcccccctctctccccaaatcagcctcataaatgttaattatctgtactacataattataatgggatttttgagatttatctgcttagcatttgtatgctatcgttagaggtttaactgaattgttcatctaactgacattatcccctgaacagctaaattattgtgaccatttaaatgtgtcttcatattattagt

SEQ ID NO: 185490 - DNA, 601 bp, Human
taacataaccttttttgaggaatcaaggtcattatgtacattaatttctgtactgtgctgttaatatggccggtgcgttctgctgtataaagttgttagcagtttcgtcctgtactaaaatgacttcgcaatgctataccagttcagtgttttgtttgcttttagtttctctctccagtactgttttctgtcaaaatatgcccttaactgctttctaatctgctacgtcttagctgaagtaggcagggaaaccagataagccagaactgtgggtcaagtcagaataaataggatcttagtraagcttagtgcagccctcaggaatctcacaatcaaatcaccattgtgccatgtaatttccaccataacatgccataagatcaaaagaagattaaaaatcttaaatgacccttaaatatagtaataaatattgtaaaataaaatgtaataaaataaaaaagttaaaatgcaggggctaggggcaggcatggtggctcacgcctgtaaccccagcactttggaaggcccatataggcagatcactgaggtcaggagttcgaaaccagcctggccaacatggcgaaactccatctctactaaa

SEQ ID NO: 185491 - DNA, 601 bp, Human
gctacgtcttagctgaagtaggcagggaaaccagataagccagaactgtgggtcaagtcagaataaataggatcttagtgaagcttagtgcagccctcaggaatctcacaatcaaatcaccattgtgccatgtaatttccaccataacatgccataagatcaaaagaagattaaaaatcttaaatgacccttaaatatagtaataaatattgtaaaataaaatgtaataaaataaaaaagttaaaatgcaggggctaggggcaggcatggtggctcacgcctgtaaccccagcactttggraggcccatataggcagatcactgaggtcaggagttcgaaaccagcctggccaacatggcgaaactccatctctactaaacatacaaaaattagctgggcatggtggcgggcactgtaatcccagctacttgggagtctgaggcacgagaattgcttgaacccgggaggcggaggttgcagtgagccaaaatggtgccactgcattccagtctgggcaacagagtgaaactctctctaaaaaaaaaaaaaaaaaaaagcaggggctggtttattgctacgcatgcttattattaaataaac

SEQ ID NO: 185492 - DNA, 601 bp, Human
gtcaggagttcgaaaccagcctggccaacatggcgaaactccatctctactaaacatacaaaaattagctgggcatggtggcgggcactgtaatcccagctacttgggagtctgaggcacgagaattgcttgaacccgggaggcggaggttgcagtgagccaaaatggtgccactgcattccagtctgggcaacagagtgaaactctctctaaaaaaaaaaaaaaaaaaaagcaggggctggtttattgctacgcatgcttattattaaataaacactgtcatcatatcctgcaggatgcraatttgttctttaccaaaattaattaccgaatattgtgtacttttaagactgctcttaaataaatgaaatagaaataatttcaggtccttagaatgtatggatttctctcctatataaaaacttcggcataagagcttgaccacagcatttgtggcttcatgatgacttatggtgcttttttcagggttttccagagtttgaaatagttgaagaaaatgaggtgtcacgtgtgcatagctaaggtccattgtaacgggtactaaaccctggtctgatgctatcttgtttagtcacagctg

SEQ ID NO: 185493 - DNA, 601 bp, Human
tttttgtttctgtcatttcctgttaactttaaagtgtacctaattgttctatttgagcaaattttggagaagagtgggtatgtgggagaggtttgtattttaggtgtcctttaaatagcagctttcttaaattgaaggatgtggctgggcgtggtggctcacacctgtaatgccagctacttgggaggctgaggcaggagaatcgcttgaacccaggaggcagaggctatagtgagccaagattgtgccactgtactgtagcctgggcgacaagagtgaaactcagtctcaagccaaaaaraaaaaaaaaactcatctgtaaaatagggttaataataccttccctgtcaagcctgggtcatgcaagtgacataaagcatgtgaaaaggtcaagttaaggtagtactttgagacatgataataggttggtaatagatcgcttactacagaagtagttagtagagatatcattaacatttgaaaatatcagaaagtatgtgaaattataagctacaaaactgttcctagtcaggtgaatacctattctacagcataatggatatgtgggtgaaatctcgtcggtaacaatgtgaagagatca

SEQ ID NO: 185494 - DNA, 601 bp, Human
gtatgtgaaattataagctacaaaactgttcctagtcaggtgaatacctattctacagcataatggatatgtgggtgaaatctcgtcggtaacaatgtgaagagatcagcacagttctgtctggtactccctaggcagcagatttcttctctatctgttgaaggtgtttattttatgtttaaaccttcttatgattttactcattcattaaatgtttattgagtgccatctgcaatgtaccctagtaggttgctcattcatttcttctttgctttaaaagtagcatttctgtgagcctttrgagcagtttatatgcactggggcaccataactggtatctaagccagagaactaggcacccaaatgattaaattgtgatattctgtctgctttatttttttttctagtttccacgttccttttcctgtttaaggacatgttttttctttgacagtgatttttataaaagcagtttatttccctggaatgaatcttttcagaagcaacaaggaaatttcagtaggaattacatgacaaatatagagaatccattgtcttattttgttactttatggccagatggggtttaacagaaaagtca

SEQ ID NO: 185495 - DNA, 601 bp, Human
tgaatacctattctacagcataatggatatgtgggtgaaatctcgtcggtaacaatgtgaagagatcagcacagttctgtctggtactccctaggcagcagatttcttctctatctgttgaaggtgtttattttatgtttaaaccttcttatgattttactcattcattaaatgtttattgagtgccatctgcaatgtaccctagtaggttgctcattcatttcttctttgctttaaaagtagcatttctgtgagcctttagagcagtttatatgcactggggcaccataactggtatctragccagagaactaggcacccaaatgattaaattgtgatattctgtctgctttatttttttttctagtttccacgttccttttcctgtttaaggacatgttttttctttgacagtgatttttataaaagcagtttatttccctggaatgaatcttttcagaagcaacaaggaaatttcagtaggaattacatgacaaatatagagaatccattgtcttattttgttactttatggccagatggggtttaacagaaaagtcagatttctttttagtaaggtgctgatacatttctccctttc

SEQ ID NO: 185496 - DNA, 601 bp, Human
gtaacatactaatcacatcttactgtaaagtgaaaaaaacaagggactctgagagaaaaatgctaaggactcattacttaaagtgaaataattaattaaagaccttttcctaagcagtatttgatactaggaattgaatgtctttctattaaggtaacatttttggaaaaagctaatttttaggccaggcgtggtggctcacgcctataatcccagtactttgggaagccgaggtgggtggatcacctgaggtccggccaacgtggcgaaacccagtccctattaaaaatacaaaaattarctaggcatggtggtgcacacctgtagtcccagctacttaggaggctgaggtaggagaatcgtttgaatctgggaggcagaagttgcagtgaactgagattgcgccactgcactctagtctgggtgacagagcaagactctgtctcaaaaaaaaaaaaaaaaaaaaaaaaaaagctgatttttagacatgtctctattagagacaaaattattcatttaattccgggatttgtagtcattttggaactttgctgctacttaattgctaaatgactaatgggaataaagggatgtcttagaa

SEQ ID NO: 185497 - DNA, 601 bp, Human
gagtctcgctctgtcgtccaggctggagtgcagtggcgcaatctcggctcactgcaagctctgcctcccgggttcatgccattctcctgcctcagcctcctgagtagctgggactacaggcacctgccaccatgcccggctaatttttttttgtatttttagtagagacggggtttcactgtgttagccaggatggtctcggtctcctgacctcgtgatccgcccgtctcggcctcccaaagtgctgggattacaggcgtgagccaccgagcctggcctaattttggtattttttatagargtggagtttcgccctgttgttgaggctggtcttgaactcctgggctcaagcgatcctcttgcctttgtctcccaaagtgctgggattacggtgtgagccactgcgccctgccttttatagtcttaatgttaaaatttagcagcattttacatttcaaaactgaggcctaaaactttcaacctaacctaagtggtatctttcttagttacccttatattctatctggttatccagatgaatgtagagagaacttttagttccccatattcaattttgttttgttggcactttagattatcc

SEQ ID NO: 185498 - DNA, 601 bp, Human
acctaagtggtatctttcttagttacccttatattctatctggttatccagatgaatgtagagagaacttttagttccccatattcaattttgttttgttggcactttagattatcctgaagtcttttagtttcttgagtcttcgtttgttgtttgaagagggtttaacttggtaaccaggatctttaaattgggcacagaaagatatactggatggctggacaagataatgtatttctttgatgatcattactagatttactaattgctaacagttcatgaaggtttttttgcagtgtcyagacaatgtcagcccaagagactgaaattctaaatgaacaaacactgagaaatatttgaagaattcattcagtaattacctatgtaacattcttgctaaaggtgtttaatttaagctgagcttagttatagtagacaatcagacaaatccagtttgtgggactttctacaagacagttggcctgaactctaaaaatttcaaagtggtgaaaacgaaacgaaacaaaaagggcaggaagactgttctagatgaaagaagttgaaagagaaatgacagtcaagtacagtgtcaagcctggat

SEQ ID NO: 185499 - DNA, 601 bp, Human
ggaaaatttgaatatggtgtatatattagacggtattataccttttttttgtttttttttttttttgagatggagtttcgctcttgttgcccaggctggaatgcaatagcgtgatctcggctcaccgcaacctctgcctgccgggttcaagcgattctcctgcctcagcctcccgagtagctgggattacaggcatgcaccaccgcactgggctaattttatatttttagtagagacgaggtttctccgtattggtcaggctggtctcgagctcccgacctcaggtgatctgcccacctcsgcctcccaaagtgctgggattacaggtgtgagccaccgtgcctggcctatatcattgttaaatgtcttgaatgtgactatatggtattatggttatataggaaaatgatcttatttttaggcaatacctgatgaagtattagtatgttgaaatgtcgtgatttttgcaatttgcttttaaattgttcaaaaaaaaatcatttgtagagaaaaaagcgaaagtggcaaaacatttactatggtgaatctaggtaagagcatatgggtgttcattttatgattctttcactttttaaataga

SEQ ID NO: 185500 - DNA, 601 bp, Human
ggctgtcatcatatttgaggattccatagtgtcttaatgggggaaagctgaaaagaagaaaatgagccttaaagaatattatagctgatgtgaagtggaggcagcttgtttagcagaaaaagtagtggtttcagctgcatgatgggggttagaaaaacatacagaagtcagtatggagaaagaaaaggtacttaactaagaagtagagagaagatgggcaaactagaagggccagagaactgaaatacataaaatgaagaaaaagaagagggatagttgaaaactggtggagcagttgacatcaatttcattaatgggacagcaagactattttgatgactgttatttttttcttttcttttttttttttttttctgagacagagtctcgctgtcgcccgggctggaatgcagtggcgcaatctcggctcactgcaacctctgtctcccgggttcaagtgattatcctgcctcagcctcctgagtggctgggattacaggtgtgcgccaccacacccagctaatttttttttgtatttttagtagagaaggggtttcaccatgttggtcaggctggtcttgaactcctgaccttgtgatct

SEQ ID NO: 185501 - DNA, 601 bp, Human
ctgtcatcatatttgaggattccatagtgtcttaatgggggaaagctgaaaagaagaaaatgagccttaaagaatattatagctgatgtgaagtggaggcagcttgtttagcagaaaaagtagtggtttcagctgcatgatgggggttagaaaaacatacagaagtcagtatggagaaagaaaaggtacttaactaagaagtagagagaagatgggcaaactagaagggccagagaactgaaatacataaaatgaagaaaaagaagagggatagttgaaaactggtggagcagttgacatcaatttcattaatgggacagcaagactattttgatgactgttatttttttcttttcttttttttttttttttctgagacagagtctcgctgtcgcccgggctggaatgcagtggcgcaatctcggctcactgcaacctctgtctcccgggttcaagtgattatcctgcctcagcctcctgagtggctgggattacaggtgtgcgccaccacacccagctaatttttttttgtatttttagtagagaaggggtttcaccatgttggtcaggctggtcttgaactcctgaccttgtgatctgc

SEQ ID NO: 185502 - DNA, 601 bp, Human
aaatattaacactaatgagtagaggagaaaaaaaggattttctaagtgtatttttcatccctgttaattgcaccactcacccatttagtcactgattcagatgaccagcctgggaatcaggccagactctttcttctccattttactgcatgtccagtcccaccagactaaatgctgtgaacctttggtttgtacatatcctctacttcatcctattctcacaccttttgcttgtgccattgcaggagcctcttgctgagactatgtagtctgtccacgctgtcatcgtgatctgtgaacwatatcaagggtcattcttgtgctcaaaatccttcatgagcacttcctgcctgtgggataaactctttgttgatgggcagtaccctgcatgctaaacctctctaggcttgtgttccatttcttcctcctcatttcacaaccctcatccccaacctactttatttttatttatttatttatttatttatttatttatttatttatttatttatttattgagacggagtctcgctctgtcacccaggctagagtgcagtggcgccaccacggctcactgaaagctccgcctccggattcacgc

SEQ ID NO: 185503 - DNA, 601 bp, Human
taaatgctgtgaacctttggtttgtacatatcctctacttcatcctattctcacaccttttgcttgtgccattgcaggagcctcttgctgagactatgtagtctgtccacgctgtcatcgtgatctgtgaacaatatcaagggtcattcttgtgctcaaaatccttcatgagcacttcctgcctgtgggataaactctttgttgatgggcagtaccctgcatgctaaacctctctaggcttgtgttccatttcttcctcctcatttcacaaccctcatccccaacctactttatttttatatatttatttatttatttatttatttatttatttatttatttatttattgagacggagtctcgctctgtcacccaggctagagtgcagtggcgccaccacggctcactgaaagctccgcctccggattcacgccattctcctgcctcagcctcctgagtagctgggactacagccacgcgccaccacgcccggctaatttttctttttttttttttaatagagatggggtttcaccgtgttagccaagatagtcttgatttcctgagctcatgatctgcccaccacggcctcccaaagtgc

SEQ ID NO: 185504 - DNA, 601 bp, Human
aatgctgtgaacctttggtttgtacatatcctctacttcatcctattctcacaccttttgcttgtgccattgcaggagcctcttgctgagactatgtagtctgtccacgctgtcatcgtgatctgtgaacaatatcaagggtcattcttgtgctcaaaatccttcatgagcacttcctgcctgtgggataaactctttgttgatgggcagtaccctgcatgctaaacctctctaggcttgtgttccatttcttcctcctcatttcacaaccctcatccccaacctactttatttttatttatttatttatttatttatttatttatttatttatttatttatttattgagacggagtctcgctctgtcacccaggctagagtgcagtggcgccaccacggctcactgaaagctccgcctccggattcacgccattctcctgcctcagcctcctgagtagctgggactacagccacgcgccaccacgcccggctaatttttctttttttttttttaatagagatggggtttcaccgtgttagccaagatagtcttgatttcctgagctcatgatctgcccaccacggcctcccaaagtgctg

SEQ ID NO: 185505 - DNA, 601 bp, Human
atttatttatttatttatttattgagacggagtctcgctctgtcacccaggctagagtgcagtggcgccaccacggctcactgaaagctccgcctccggattcacgccattctcctgcctcagcctcctgagtagctgggactacagccacgcgccaccacgcccggctaatttttctttttttttttttaatagagatggggtttcaccgtgttagccaagatagtcttgatttcctgagctcatgatctgcccaccacggcctcccaaagtgctgggattacaggcgtgagccaccgcrcccggcccatttatttatttttgagacagagtctcactctgtctcccaggctggagtgcagtggcgccatcttggctcactgcaacctccgcctcccaggttcaagtgattctcctgccccagcctcccgagtagctgggattacaggtgcatgccaccacgcccagctagtttttgtatttttagtagtgatggggtttcaccatgttggccaggctggtctcaaacttctgacctcaggtgatctgccctcctcggcctcccaaagtgctgggattacaggcgtgagccactgtgtcc

SEQ ID NO: 185506 - DNA, 601 bp, Human
gggtagtgacacatttgctttctaattcagtgtacgcaaatttattttgtgcacaaaattattaaaaatatttataaaattatcttcacattctgtgtatatgaaacataaatgaattttgtgtttggacttgggttccattcccaacacatctcattatgtatatgcaaatattcccaaatctgaaacaatctgaaattgaaatgcttctggtcctaagcactttgaataagaagtcatacttgtcgtcctagaatgttttatatctgtgaatgggctctttgcttctgtgcataatggttttttttttttttaacagttttagagataaggcctcactctgttgtctaggctggagtgcagtaatgcgatcaatgctcactgtggcctcaaacaaactcctggcctcaattgatcgtcctgcctcatccctctgagtagctgggactacaggcgtgtgctgccatgtctggctaaatgttttatttttattacttttttgtagtgacagggtcttgctatgttgcccagcctggtctcaaactcctggcctcaagtgttcctcccacctcccagagagctgggattacaggcatgagcc

SEQ ID NO: 185507 - DNA, 601 bp, Human
tttctaattcagtgtacgcaaatttattttgtgcacaaaattattaaaaatatttataaaattatcttcacattctgtgtatatgaaacataaatgaattttgtgtttggacttgggttccattcccaacacatctcattatgtatatgcaaatattcccaaatctgaaacaatctgaaattgaaatgcttctggtcctaagcactttgaataagaagtcatacttgtcgtcctagaatgttttatatctgtgaatgggctctttgcttctgtgcataatggttttttttttttttaacakttttagagataaggcctcactctgttgtctaggctggagtgcagtaatgcgatcaatgctcactgtggcctcaaacaaactcctggcctcaattgatcgtcctgcctcatccctctgagtagctgggactacaggcgtgtgctgccatgtctggctaaatgttttatttttattacttttttgtagtgacagggtcttgctatgttgcccagcctggtctcaaactcctggcctcaagtgttcctcccacctcccagagagctgggattacaggcatgagccactgtgcctggccctgcg

SEQ ID NO: 185508 - DNA, 601 bp, Human
tatgttgcccagcctggtctcaaactcctggcctcaagtgttcctcccacctcccagagagctgggattacaggcatgagccactgtgcctggccctgcgtagaatcttgtccctcagcttgaccagctcctgtttgtttttcaagatttagccaaggggacttctgagaagctttttcttctctgctaagaagctgtggagagtaatggtttgagaacatgggcttcagtcagacatacctggattcaaatttctgtttgttttttttttcaaggagatggagtcttgctctgttagccrgctgaagaagtgcagtggcaccatcatagctcactgcagcctcaaactcctgggctcaagtgattctcttgcctcattctcatgcctggcactacaagcatgtgctactatgcccagctcaaattcttttagtgatgcatgaccttagataaatcacttacacttgttttacctgcatttctttatgtgtagaagagggataatgaaacttgcagtggcaagcacatagtgagtactccatatatgttatggtaggtgctgctgccgccatcgctatcatcatcatcatcataagaatta

SEQ ID NO: 185509 - DNA, 601 bp, Human
tcaaggagatggagtcttgctctgttagccggctgaagaagtgcagtggcaccatcatagctcactgcagcctcaaactcctgggctcaagtgattctcttgcctcattctcatgcctggcactacaagcatgtgctactatgcccagctcaaattcttttagtgatgcatgaccttagataaatcacttacacttgttttacctgcatttctttatgtgtagaagagggataatgaaacttgcagtggcaagcacatagtgagtactccatatatgttatggtaggtgctgctgccgccwtcgctatcatcatcatcatcataagaattactgtctcctatgagctcccataaacaatctcattgctttgcaaatcgctttaaatattttcttgtcctttcttcacaataaactcctctctttaagggcaaccactgtatccttaatgctgaatgcagtgcttaacacacgcttaggtgcttagtaaatatttaagtatgtgcaagcataagaagcttattttatggatgacagtgtaagaaagagtacagactctgctgattaccagccgtgtggcctttgagctttgttatttatttt

SEQ ID NO: 185510 - DNA, 601 bp, Human
atggagtcttgctctgttagccggctgaagaagtgcagtggcaccatcatagctcactgcagcctcaaactcctgggctcaagtgattctcttgcctcattctcatgcctggcactacaagcatgtgctactatgcccagctcaaattcttttagtgatgcatgaccttagataaatcacttacacttgttttacctgcatttctttatgtgtagaagagggataatgaaacttgcagtggcaagcacatagtgagtactccatatatgttatggtaggtgctgctgccgccatcgctatcatcatcatcatcataagaattactgtctcctatgagctcccataaacaatctcattgctttgcaaatcgctttaaatattttcttgtcctttcttcacaataaactcctctctttaagggcaaccactgtatccttaatgctgaatgcagtgcttaacacacgcttaggtgcttagtaaatatttaagtatgtgcaagcataagaagcttattttatggatgacagtgtaagaaagagtacagactctgctgattaccagccgtgtggcctttgagctttgttatttattttccttgcca

SEQ ID NO: 185511 - DNA, 601 bp, Human
ggtgtaaaatgggagatagtgcctacctcagaatttaaagattacatctcatattgtatgtaaagtgcttagcataatgcccatagtgggtggttaataaatgttagctattatttaaaaaataaatcaatcttggatcttggcgagatttgacagtagatctattttactttaagtgacatgtgaaatgaagatttaagagtactgtattttatatagtcacgcttacatagttgcttaataattcggagttctgacaaatgcatccttaggcgatttcatcattatgcaaacattgtayagtgtacagttatcccttggtatatgtgagagcttagttccaggacccccacatataccaaaatccctgaatattcaagtccagaagttggccctgtggaacctgagaattcaaaaagttggccctctgtatttgcaggatggggttttgcagcctgtgtttggttgaaaacatttgcatataagtgaaccagtgcagttcaaacccatgttgtttgagttaaccatacttatacaaacctagatgttatatatatctacaaacgtagatgttacacacctaggctgtatggtatatagc

SEQ ID NO: 185512 - DNA, 601 bp, Human
tatagtcacgcttacatagttgcttaataattcggagttctgacaaatgcatccttaggcgatttcatcattatgcaaacattgtatagtgtacagttatcccttggtatatgtgagagcttagttccaggacccccacatataccaaaatccctgaatattcaagtccagaagttggccctgtggaacctgagaattcaaaaagttggccctctgtatttgcaggatggggttttgcagcctgtgtttggttgaaaacatttgcatataagtgaaccagtgcagttcaaacccatgttgyttgagttaaccatacttatacaaacctagatgttatatatatctacaaacgtagatgttacacacctaggctgtatggtatatagcctattgctcctaatctacaaacctgtgcagcatgttactctatttaatactgtaggcaactgtaacacaacagtaagtctttgggtatctaaacatatctaaacctagaaaaggtacagtaaaagtacagtattaaagataaaaaatggtccacctgtggagggcacttaacatgaatagggcttgcaggactggaaattgctctgggtgagtc

SEQ ID NO: 185513 - DNA, 601 bp, Human
tatgccgtgatgttaagacaggtgaaaacatcactaggtgatagaaacttttcagctccattataatcttacaggatctctgtcatatatatatagtcttgtagactgaaatattgctatgtggcacatgactgttttctaactttagtcttagatattgaaaggatttaaggctgggcgcggtggctcacgcctgtaatcccagcactttgggaggccgaggcgggtggatcatgagttcaggagatcgagaccacggtgaaaccccatctctactaaaaatacaaaaaattagccgggygcggtggtggacacctgtagtcccagctactcgggaggctaaggcaggagaatggcatgaacccgggaggcagagcttgcagtgagccgagattgcgccactgcactccagcctgggcgacagagtgagactccatctcaaaaaaaaaaaaaaaaaaagaaagaaaggacttaaacctaaaatgcttaagaagaaaaatgatgaaattttccttttctatagtatagatagaattttggaagtgatgtattcataaatatttgatgagttcctattacatggagcacatttctggttatg

SEQ ID NO: 185514 - DNA, 601 bp, Human
tcatactcaccgcaggtcaacccatgtggctgtttctcatttatgcagatctacatcagattttacttgtgtttacctgaaaatacatattgtttatgtagtcaatgtatattgtagtagcatacagaatctgatcttgaaaaggttgcagaatttcttgagtgtactttaggaacttagtttttcaaaatttatttaatttttattttgataattatagattcacaggaggttgtaaataaagaaatgtaaagggaggtcccaaacacctctcccctaactcccttccctctctttgccmgtgtcagtatcccacaccaccacacacagtagtataccaaaaccaggaaattgacattggtacagtccatagagcttgttcagatttcaccagttatacatgcattcctgtctgtgtatgtgtgtttagctttacacaatttcacatataggtagcataactaccagcacaataagggtactcaacagtaccgtaaccacaagatttagttacttcccctgtatagctacaccagtcccccttctccacgggaaactcagttttatagtttggctattgtttttaatcatgtgcaaacct

SEQ ID NO: 185515 - DNA, 601 bp, Human
gatttgggaacactgaaagacttcttggatgcataggcttagaatgattctcagctgtgatttatttcctccctccctccctccctccctccctccctcccttcctcccttcctcccttcctccctcccttccttcccctccctccctccctccctccttccctccctccttccttccctccttccccctccatcccttcccctctctcaatattctgtaatattgaaatatttcgttaaaaatatacagcatattacatatatatctgaaattttctcctttcttccttttagtataccytctatttattttggtaccaagaatagagtgctgctgtaacaaacacctaaaagtgtggaagtggctttggaacttctgaaagacccagcccaagtcccatcttcatttatttatttatttatttttaagaattttttttccaaggctggatctcggctcactgcaacctccgcctcctaggttcaagtgattctcctgcctcagcctctggagtagctgggactacaggtgcacaccaccatgcccgactaatttttgtggtttttagtagagatagggagggtttcacgatgttggcca

SEQ ID NO: 185516 - DNA, 601 bp, Human
ctccctccctccctccttccctccctccttccttccctccttccccctccatcccttcccctctctcaatattctgtaatattgaaatatttcgttaaaaatatacagcatattacatatatatctgaaattttctcctttcttccttttagtataccttctatttattttggtaccaagaatagagtgctgctgtaacaaacacctaaaagtgtggaagtggctttggaacttctgaaagacccagcccaagtcccatcttcatttatttatttatttatttttaagaattttttttccmaggctggatctcggctcactgcaacctccgcctcctaggttcaagtgattctcctgcctcagcctctggagtagctgggactacaggtgcacaccaccatgcccgactaatttttgtggtttttagtagagatagggagggtttcacgatgttggccaggctgctcttgaactccaggcctcaagcgatccatctgcttcatcctcccaaagttctggaattacaggcatgagccactgcacccagcccaagtctcaactttctcatacacttaattgatttctgtagctatcgttgatt

SEQ ID NO: 185517 - DNA, 601 bp, Human
acagagtctagcactgctgcccaggctggagtatagtggtgcagtcatagctcactgcagcctggaactcctgggcccaagtgatcgttccgcctccacctacacctcccaagtagctggaattacaggcacatgccactgtgcccagaccattttagtgatttgttattttttaaatctctattctctttttaatacagagctgcaaatttcttacttttctttagtgcaatccatgtgtgaaatatgtgttataatttgtaactaacaatatttgaagtcctgaagtttttgaatgatyttgtatgtaagattagagtagattcatggttcccactaataaccacttcattattatcactttgttatgtgtgtgtgtgtgtgtgtgtttaaagagataaacttataggtggtttatctagaattgtgtaaaatactttcattttcatgagagagtatcttgcatgtgagtattatttgtcacatgttatgcctacattgttggttggacttaaactttagtgacctctcagagattattttcattctagttcatgtcatattactttgatatatgtattaagaagaagtacaagagatt

SEQ ID NO: 185518 - DNA, 601 bp, Human
ttcctttaatttggatatgggtcattcacctttgcaactgtcccatatttggtttatattttgccaaggataagcatcttgatagtgctaacagtaaggaaaagttatctgttagcagcctaaaatcttacaacagtggagagagaagaaaatgccaagagaataaaggacaaaatcatgcaagtctgtagtcatcagtggcttctggcatctgggaggttgtgttctgattatcttggacataaatagtctattcattttatcttctgcttctggaccataacagttctggaaatcttgrctcacccactgtttgtccatggcaatgatgtcggcagtatgcatcattaatttattctctgtagtgtcagtaatgggtgcatgatacaaacatttacaaaagttcttttgataagtcttccacaaggctcaattcctatctttagcttatagccaggaactttagatgaatgtaaggaagaagcggaaaccacctgtggatcatgggactataggctttagttgatttattatattaaccagcattatcagaatggaagggagtggaatcttctattgcagaaagtacataatgaatttt

SEQ ID NO: 185519 - DNA, 601 bp, Human
ctcactgcagcctcgacttcctgggctcaagtgatcctcccacctcagccgcccaagtagctgggactccaggcttgtgacaccacattcggctaatttttgttgtgtttttagtagagacggggtttcaccatgttgcccaggctggactcaaactcctgagctcaagcattctgcctggctcagcctgccaaagtgctaggattacaggcatgagccactgggcctggccttagactctacttcttgataggatagggtcaggtcactgctatgctttaaatatgatccccagaaagcrtatgttggctgcctgggtgatgggtatactagaagcccaaactttaccattatgcagtatatccatgtaaaaaaggtacacatataccccttgaatctgaaatttaaaaataaaataagtatgtattagaaaatttatcccaaatgcagtagtgtcgggaggtggggcctaatgagaggtgtttaggtcatgaagccacctctaatgaatgcattaatgttgattataaaagggcttaaggctgcaagttctatctcttgctctctcttatccctctttgcccttccactatgggatgat

SEQ ID NO: 185520 - DNA, 601 bp, Human
tgctttttgagatggagtctcactctgttgtccaggctgacgactgtagctgactgcagcctcaacctattgggttccagagatccttctgtgtcagcctcctgagtagctgggagtacaggcagatgccaccacacctggataatttaaaaaaaaaattttgtagagatgggggtctcaccatgctgcccaggctggtttcgaactcttggcttcaagcagtctccccaacttggattcccaaagtgctgggattacaggagtgagtcaccatgcctggctggttgcagccagttttggraaataaaatgtgctacagacattgtaagggcaaaatatttaacaataactgagatttctaaaaattgcagattggctaaatgttaataaattatgatctaagtaaattatatctacctaggagaaaataaaaaaaaatttatggtattttaaggtatttatttatgtacttatgcattgagatatttgccatcaaaatttttactagtgcgtataagtacctaacacatagtagcaattcaataaaattatttgaatgaattaattgaggatacttttcgatcatagtttttatggtgag

SEQ ID NO: 185521 - DNA, 601 bp, Human
gtagctgggagtacaggcagatgccaccacacctggataatttaaaaaaaaaattttgtagagatgggggtctcaccatgctgcccaggctggtttcgaactcttggcttcaagcagtctccccaacttggattcccaaagtgctgggattacaggagtgagtcaccatgcctggctggttgcagccagttttggaaaataaaatgtgctacagacattgtaagggcaaaatatttaacaataactgagatttctaaaaattgcagattggctaaatgttaataaattatgatctaagtarattatatctacctaggagaaaataaaaaaaaatttatggtattttaaggtatttatttatgtacttatgcattgagatatttgccatcaaaatttttactagtgcgtataagtacctaacacatagtagcaattcaataaaattatttgaatgaattaattgaggatacttttcgatcatagtttttatggtgagagttttcattttgttctgtcttatttttatgtgtattttagttagatgttcgcttagtctattcaagatgtgttttttgtttgtttgtttgttttgagacagagc

SEQ ID NO: 185522 - DNA, 601 bp, Human
agtacctaacacatagtagcaattcaataaaattatttgaatgaattaattgaggatacttttcgatcatagtttttatggtgagagttttcattttgttctgtcttatttttatgtgtattttagttagatgttcgcttagtctattcaagatgtgttttttgtttgtttgtttgttttgagacagagcattgctctgtcgcccaggttggagtttcagtggtgcgatctcagctcactgcaacctccacttcctgggttcaagtgattctcctgcttcagcctcctgaggcaagcacgygccaccacacccggctaattttttatttttagtagagatagggtttcaccatgttggtcaggctggttttgaactcgaccttatgatccacctgcctccgcctcccaatgttctgggattacaggtgtgagccaccgcccccggcctgttcaagatgttataacaaaatgccttagactgggtaatttgtgaacaacagaaatttatttcttacagtcctagaggctgggaagtccaagagtcagcttgccagcagattgtgtgtctggtgagggcctcttccttataagtggcaccttc

SEQ ID NO: 185523 - DNA, 601 bp, Human
gggattaggttttacctatgaatttttggaacattcaaatcatagcagctgttaagaaatgttgaatcagaagtttctagtcattcttttttttgtttttttgaggcagagtcttgctctgtcgcccaggctggagtgcagtggtgcaatctcggctcactgcaacctctgcctcccgggttcaagtgactaccctgtctcagcctcccgagtagctgggattacaggcgcccgctaccacgcccagctaacttttgtatttttggtagaggcaagagtgtcaccatgttggccaggctgrtctcaaactcctgacctcaggtgatctgcctaccttggcctcccgaagtgctgtgattacaggcgtgagccactgcacctggccagaagttgctagtcattctaaactggaagcttgacataatattttgaatcaagcattttaaaaatgtctgcttttcataaatagtttatttttacatatttatccctttcatttaggaaagaagattcatgagttttttttttaatcagctggcaaattagagaaaatatttatacagcttctaataggcatctcaaattattttgaaacattggg

SEQ ID NO: 185524 - DNA, 601 bp, Human
atcagaagtttctagtcattcttttttttgtttttttgaggcagagtcttgctctgtcgcccaggctggagtgcagtggtgcaatctcggctcactgcaacctctgcctcccgggttcaagtgactaccctgtctcagcctcccgagtagctgggattacaggcgcccgctaccacgcccagctaacttttgtatttttggtagaggcaagagtgtcaccatgttggccaggctggtctcaaactcctgacctcaggtgatctgcctaccttggcctcccgaagtgctgtgattacaggcrtgagccactgcacctggccagaagttgctagtcattctaaactggaagcttgacataatattttgaatcaagcattttaaaaatgtctgcttttcataaatagtttatttttacatatttatccctttcatttaggaaagaagattcatgagttttttttttaatcagctggcaaattagagaaaatatttatacagcttctaataggcatctcaaattattttgaaacattgggaatatatcttttgtaatgttttgcttgtaataattgaatagattttctcatttggtaataacttg

SEQ ID NO: 185525 - DNA, 601 bp, Human
cttgtgactgttcaaccaattgaatatggtggaaataatgtgatgggatttctgaggccatgatataaataggatacaactgatccagcaatcgcactactgagtatctacccaaaggaaaataaatcaacatgtttattgcagtactattcacaacagcaaagatacagaatcagcgttgagtatctattagtggatgaatggataaagaaaatatggtatatatacacaatggaatattgttcaaccataaaaaaacaaaacaaaataatgtcacttacagcaacatggatggaactgraggtcattatcttaagttaaataagctaggcacaaaaagacaaatatcatatattctcacttatatgtgggagctaaaaatttgaacacatggaggtagagaatggaaaatagataagagagactgggaagggtgagtgggggaaaggggaaggatgaagagaagtgagttaaagggtacaaacatacattaagataggagtagattcaatgtttgatagcagagcaggatgactatacctaacaaaaatgtattgtacctggtgatgaacatcctgaagaccctggcttaatactatgc

SEQ ID NO: 185526 - DNA, 601 bp, Human
gacctaatgaagttatttgaagttggaggatcacctagtaacacacgctacctctttctgggtgactatgtggacagaggctatttcagtatagaggtaaaaattaaactggatatgttgggactattatattgtctttcaaaaaagatgatttccattcttcagtagaagaaattaaaatgagaactctggcagaatttataaactttgttactttcaaaattaaagtagtagaaatgttttaattgatagaacagttattccttttttaaaaccagtcgaaaatctgacaaataggctwtatattaatattaacccaattttacaaatagttaaatgttcaccaacttttcctcttgaagatagtatacaggattgtataaaaatgacataaattgctgttcaccctaaatggggtttagattagctgaccttaattataagaccataagctgctgagctacaattaacacttagattaactgccagtgctaaataaacactaagctttttgtaggaataatgtctggtactggtacacatagtaagcacttaataaatgttcactgaaggggaaaaatgagttgtagttaattaaaac

SEQ ID NO: 185527 - DNA, 601 bp, Human
aggcaggcacctgtagtcccagctacttgggaggctgaggcaggagaatggcgtgaacctgggagacggagcttgcagtgagctgagatcacgcctctgcactccagcctgggcgacagagcgagactctgtctcaaaaaaaaaaaaaaaaaagttcaatgttagttgccagtgcacaaaattcatttagtgtcaaatgtgaggacaaaagttaaaggtataaactgacaaaatagtaaagcccatttttccttctgctccgtaaatgtccaaggtctctaaataggtactgggaataggyggagattatccttgcagactgtatcattgaggagcttccctgttgccactcatatcatgcatgtttcagtagacataagtcaaatgtatggatgtggggctgcgcgcaatggctcatgcctgtaatcccagcactttgggaggccgaggtgggtggatcacctgaggtcaggagttcgagaccagcctggccaacatggtgaaaccccatctctactaaaaatacgaaagtttaccaggcatggtggtgggcgcctgtaatcccagctacttgagaggctgaggcaggataatcacttga

SEQ ID NO: 185528 - DNA, 601 bp, Human
tgggagacggagcttgcagtgagctgagatcacgcctctgcactccagcctgggcgacagagcgagactctgtctcaaaaaaaaaaaaaaaaaagttcaatgttagttgccagtgcacaaaattcatttagtgtcaaatgtgaggacaaaagttaaaggtataaactgacaaaatagtaaagcccatttttccttctgctccgtaaatgtccaaggtctctaaataggtactgggaataggcggagattatccttgcagactgtatcattgaggagcttccctgttgccactcatatcatkcatgtttcagtagacataagtcaaatgtatggatgtggggctgcgcgcaatggctcatgcctgtaatcccagcactttgggaggccgaggtgggtggatcacctgaggtcaggagttcgagaccagcctggccaacatggtgaaaccccatctctactaaaaatacgaaagtttaccaggcatggtggtgggcgcctgtaatcccagctacttgagaggctgaggcaggataatcacttgaacctgggaggcagaggttgcagtgggctattgtgccgctacactccagcctgggtgaca

SEQ ID NO: 185529 - DNA, 601 bp, Human
aagtcaaatgtatggatgtggggctgcgcgcaatggctcatgcctgtaatcccagcactttgggaggccgaggtgggtggatcacctgaggtcaggagttcgagaccagcctggccaacatggtgaaaccccatctctactaaaaatacgaaagtttaccaggcatggtggtgggcgcctgtaatcccagctacttgagaggctgaggcaggataatcacttgaacctgggaggcagaggttgcagtgggctattgtgccgctacactccagcctgggtgacagagcaagactctgtctcaaaaaaaaaaaagaaagaaagaaagaaagtatggatgttagaaagacacattgagttcagtttatttctttgtgtttttgctagcatgagaaggtttcagacggtaaagattagaagaatacaaaaattactgaatttctaattaggcattttattttattttatttttttagagatggggtcctgccatgttgcctaggctggagtgcagtggctatacacaggtgcgatcatttcgtacctcagcctccaactcctggattcaagccatcctcctgcctcagcttcctgagtatatgga

SEQ ID NO: 185530 - DNA, 601 bp, Human
gtatggatgtggggctgcgcgcaatggctcatgcctgtaatcccagcactttgggaggccgaggtgggtggatcacctgaggtcaggagttcgagaccagcctggccaacatggtgaaaccccatctctactaaaaatacgaaagtttaccaggcatggtggtgggcgcctgtaatcccagctacttgagaggctgaggcaggataatcacttgaacctgggaggcagaggttgcagtgggctattgtgccgctacactccagcctgggtgacagagcaagactctgtctcaaaaaaaaagaagaaagaaagaaagaaagtatggatgttagaaagacacattgagttcagtttatttctttgtgtttttgctagcatgagaaggtttcagacggtaaagattagaagaatacaaaaattactgaatttctaattaggcattttattttattttatttttttagagatggggtcctgccatgttgcctaggctggagtgcagtggctatacacaggtgcgatcatttcgtacctcagcctccaactcctggattcaagccatcctcctgcctcagcttcctgagtatatggaactatagat

SEQ ID NO: 185531 - DNA, 601 bp, Human
gagaccagcctggccaacatggtgaaaccccatctctactaaaaatacgaaagtttaccaggcatggtggtgggcgcctgtaatcccagctacttgagaggctgaggcaggataatcacttgaacctgggaggcagaggttgcagtgggctattgtgccgctacactccagcctgggtgacagagcaagactctgtctcaaaaaaaaaaaagaaagaaagaaagaaagtatggatgttagaaagacacattgagttcagtttatttctttgtgtttttgctagcatgagaaggtttcagayggtaaagattagaagaatacaaaaattactgaatttctaattaggcattttattttattttatttttttagagatggggtcctgccatgttgcctaggctggagtgcagtggctatacacaggtgcgatcatttcgtacctcagcctccaactcctggattcaagccatcctcctgcctcagcttcctgagtatatggaactatagatgcacaccactgtgcctggctagtcattgtatttaataaaacaacttttaaaatatttatttatttatttatttatttattttttgagacaga

SEQ ID NO: 185532 - DNA, 601 bp, Human
atcccagctacttgagaggctgaggcaggataatcacttgaacctgggaggcagaggttgcagtgggctattgtgccgctacactccagcctgggtgacagagcaagactctgtctcaaaaaaaaaaaagaaagaaagaaagaaagtatggatgttagaaagacacattgagttcagtttatttctttgtgtttttgctagcatgagaaggtttcagacggtaaagattagaagaatacaaaaattactgaatttctaattaggcattttattttattttatttttttagagatggggtcytgccatgttgcctaggctggagtgcagtggctatacacaggtgcgatcatttcgtacctcagcctccaactcctggattcaagccatcctcctgcctcagcttcctgagtatatggaactatagatgcacaccactgtgcctggctagtcattgtatttaataaaacaacttttaaaatatttatttatttatttatttatttattttttgagacagagtttcgcttttgttgcccaggctagagtgcaatggcacgatctcggcccaccgcaacgtccgcctcccaggttcaaatgatt

SEQ ID NO: 185533 - DNA, 601 bp, Human
tatctgctggttttaagtgttttacttaaatggtcagtatgccagaatagttgaagagttttgaagaaagagtttagaaaaagataagaggaggcagagcgggaggggaaagctctagagaggaaagtgattcagctagctttgaggcagtgttttgtagtgagtcattctttgagtcctgaatccttttttttagcctcaaaatatcaatgagatacgcatatcttatttggagtatattattttctaactgtggtcttttagtttaaggaacaacagactgtttgaatgatccttacgrtgtttgaacatgttaccggctggaatcccagaaaatatcttggcatgcctttgaattttgagagcccattttattgtgggtgctctggtttaatcccaaatacacaaaaaccaattaaatataagcactgaatttgcaaaggccaaataaacgcaagcacagatgggaaaataaagtacccacttaccaagaaggacgataagaagccttctccaactgaaagaaaaaagagagatcccaaggcctcaacccaaagggaaaaatcccttccctgagaccccacagccagggtctacaagg

SEQ ID NO: 185534 - DNA, 601 bp, Human
ccagtgtggctaccttgtactatagttccaatggctgctgatcttctctgagatgagtcagccttagactcatacttgaccaagtatgtcaaagtcaaatgaaacacagagatgaatctctgaaattaagatgttttatttgtgaagaaagaattgcaatttagagcatgcatgcagacagaatggtatgtccgaagaacaaagagaaggttagaggttttatgaaaaagcgaaatgttatgtgttgctctttgagaaagttcattggcactagtaaggttctggagagcttgccagtttkgattggtgagtgatggcagtgggtaaaattagccttagaatttcagcagatcatttcagtagccattagataaaactggtttccagtaatagcaggcagtttcggcagacatgcttgcagagaattacatttttgggtcaatgttatatgtcctgagtgcttcccccccgccctcttgactctgttttagttgggtatgacaggaataacccagttcatatgatcaactttcacagtagttaatgatataaataccttaatttatttcaccattcctctactgttggaaaaataggttta

SEQ ID NO: 185535 - DNA, 601 bp, Human
tagactcatacttgaccaagtatgtcaaagtcaaatgaaacacagagatgaatctctgaaattaagatgttttatttgtgaagaaagaattgcaatttagagcatgcatgcagacagaatggtatgtccgaagaacaaagagaaggttagaggttttatgaaaaagcgaaatgttatgtgttgctctttgagaaagttcattggcactagtaaggttctggagagcttgccagttttgattggtgagtgatggcagtgggtaaaattagccttagaatttcagcagatcatttcagtagcyattagataaaactggtttccagtaatagcaggcagtttcggcagacatgcttgcagagaattacatttttgggtcaatgttatatgtcctgagtgcttcccccccgccctcttgactctgttttagttgggtatgacaggaataacccagttcatatgatcaactttcacagtagttaatgatataaataccttaatttatttcaccattcctctactgttggaaaaataggtttatagcaggtcatgctattgcatacattttccctctgtcttccttacaaacaatatctctatttta

SEQ ID NO: 185536 - DNA, 601 bp, Human
gggaactctgctgggtttttgtttgtttgtttgcttttggaaacactctttcttgatgaaaagactattgcaaggttgaagcttttggacccccattctaccatttcacttcatatgtggatgtgtgtactgtagcagccatgctgtgactatgaggaggtgacatgactaaggaggaaaagcagacctgtgaatcgctgatcacagaggtacagagggcttggtttcttggtgaagatgttgaactagtacaccaaacctggacatctcatctccagacttgatgtgttttttgttttgtttttttttttttttgggacggagtctcactctgttgcccaggctggagtacagtggcaccatctcggctcactgcagcctctgcctcccaggtttaagtgatcctcctgcctcaccctcccgagtagctgggattacaggcacccaccaccacgcctggctaatttttgtatttttagtagagatggggtttcaccatgttggccaggctagtctcaaactcctgacctcaggagatctgcctgcctcagccacccaaagtgctgggattacaggcatgagccaccgcgcccagcccaga

SEQ ID NO: 185537 - DNA, 601 bp, Human
ggcgcatgctaccacgcccagcaatttttttttgtatttttagtagagacgaggtttcaccatgttagccagggtggtctggatctcctgacctcgtgatctacccaccttggcctcccaaagtgctgggattataggcgtgagctgccgtgctgagccaatacatctaatatattaattttttaatgtatagagcttttacagataaaatattttaattttacataaatgatatggtgctgtccagtggtcttgaaatgttaacatacaccattattacctggaaagcttgtgcaaacasaggttgcaggaccctgaccctgtttctgactcatcaggcgtggggtggaacctggcaatctgtattctgtcgggttcccaggtgatgctgtttaccacactttgagatgaatgtgaccatactttgagaaccactgttgtagtgctatttatactgttgacttttttcacttaccactttttttatatttatatatattttattatactttaagttctagtgtacatgtgcacaacgtgcaggtttgttacatatgtatacatgtgccatgttggtgtgctgcacccattaactcgtcat

SEQ ID NO: 185538 - DNA, 601 bp, Human
tatttcataagtggtgtatacaattgattatcatcattcatgcgttctgtatttgtggatatgcctatgtctccttgctaaaattgatttgtaaactcaaaatcaatacagtgcttttgtggtcactggtagacatgtggagagtgatctactactttgagtctcccaatgcacatgttgccacctcagaccaaataaggccacactctcccttcttgttttagctctcatgctttaaacaagtattcttttcatagtctatttagtgcctgaatgcctgctataggtaaccaatctcttyagtttctggtttatctttcctgcattttttatgtacaaagtagatacatacatatgaatttcatatatcttctttattatatagagggtggcatactacagctactcttgtactttttattttttttaagagacaagagtctcactccgtcacccaggttggagtgcagtggcacgatcatgatcatagctcactacagcctcaaactcctcgcctcaagggatcctcctgcctcagcctcctgaatagctgggactacaggcacgtgaccaccacatctggctaatttttaaatgtttt

SEQ ID NO: 185539 - DNA, 601 bp, Human
accatgttggccaggctggtctcaagctcctgacttcaggtgatctgcctgcctctgcctcccaaagtgctgggattgcaggcgtgagccaccatgcctggcctattttcatttttgtgtggtcaaatttacccatcttttattttattgcctctggatttttagtcattagttacacagttcttacctacaccaaattttcacctacaccaggcttaagaagaactcactcatgttttcttctagaacttgtgtggctttttctttttacatttagattgctcatccttttgttgtttaytgtgctttgtgtgagatgtggatctaactttatgtttttttttttaaatggcaaccacttgtcccagagccatttatttaaaagttcatcattattactgtgatttgagatgccacctttattatttaccaaatttttgtaggtacttttatactatatctgtagtataaaattccactggtatgtttatctacataaggaccagtaccactgttttgattatagacattttatagtatgttttaacatctggtagggatagtctgccctcatagtgtctctttttagtgttttcctggt

SEQ ID NO: 185540 - DNA, 601 bp, Human
ttcaggtgatctgcctgcctctgcctcccaaagtgctgggattgcaggcgtgagccaccatgcctggcctattttcatttttgtgtggtcaaatttacccatcttttattttattgcctctggatttttagtcattagttacacagttcttacctacaccaaattttcacctacaccaggcttaagaagaactcactcatgttttcttctagaacttgtgtggctttttctttttacatttagattgctcatccttttgttgtttattgtgctttgtgtgagatgtggatctaactttatstttttttttttaaatggcaaccacttgtcccagagccatttatttaaaagttcatcattattactgtgatttgagatgccacctttattatttaccaaatttttgtaggtacttttatactatatctgtagtataaaattccactggtatgtttatctacataaggaccagtaccactgttttgattatagacattttatagtatgttttaacatctggtagggatagtctgccctcatagtgtctctttttagtgttttcctggttattctttcttgcatgttcatttttccatgttaa

SEQ ID NO: 185541 - DNA, 601 bp, Human
tgcctgcctctgcctcccaaagtgctgggattgcaggcgtgagccaccatgcctggcctattttcatttttgtgtggtcaaatttacccatcttttattttattgcctctggatttttagtcattagttacacagttcttacctacaccaaattttcacctacaccaggcttaagaagaactcactcatgttttcttctagaacttgtgtggctttttctttttacatttagattgctcatccttttgttgtttattgtgctttgtgtgagatgtggatctaactttatgttttttttttwaaatggcaaccacttgtcccagagccatttatttaaaagttcatcattattactgtgatttgagatgccacctttattatttaccaaatttttgtaggtacttttatactatatctgtagtataaaattccactggtatgtttatctacataaggaccagtaccactgttttgattatagacattttatagtatgttttaacatctggtagggatagtctgccctcatagtgtctctttttagtgttttcctggttattctttcttgcatgttcatttttccatgttaattttagtgtca

SEQ ID NO: 185542 - DNA, 601 bp, Human
caaatttttgtaggtacttttatactatatctgtagtataaaattccactggtatgtttatctacataaggaccagtaccactgttttgattatagacattttatagtatgttttaacatctggtagggatagtctgccctcatagtgtctctttttagtgttttcctggttattctttcttgcatgttcatttttccatgttaattttagtgtcaacttgtctaactccataaaatagcttgtttgtatttttcttggaatttcatgacttataagttaaattagggagaactgtaatcttttttttttttttttttttttttttttttgagacagagtctcgctctgtcacccaggctggagtgcagcggtatgatcttggctcactgcaacctctgcctcccaggttccagtgattcttttgcctcagcctcccaggcagctgggattgcaggcacttgccactacgcccagctaatttttgtatttttagtgagacggggtttcaccatattggccaggctggtctcgaactcctgaccttaggtgatccacctgcctcggcctccccaagtgctagtattacaggtgtaagccatt

SEQ ID NO: 185543 - DNA, 601 bp, Human
tactgaattattttattatttgagttagttttatcattgattttggggggttatatctgcaaatagagatagttttattttttctttacccattcttaaccctctaattgaggtgtaatcccattggctgatacccttacaccagttttgaacagtagcagagatagtaaatattcttgccttgttcctggtcttagtgaaaatgccgttagtgttttggaattaagtaaaatacaggttttacgactaatatatatgtgtgagtggctgagagagttctagatatttagatagaacatgrgaacagagattagagagagatttctatgaaggcttgtcaaattctagggcaataagtatatcacattcaaaaggtttcatttttcaatttgggagtaacaatgagatatgccattacagcaagtcatttgaattatataaattgtgtttatgcattataatggtcacaaagaaaattttatgcttgaatttgtcttgtagtgtgtgctgtatttatggagtttaaagattaatcatcccaaaacattgtttctgcttcggggaaatcatgaatgcaggcatcttacagactatttcacct

SEQ ID NO: 185544 - DNA, 601 bp, Human
tatctgtatatattttacaaataaaattgggctcatatgtactgtttaatacatttctgtttcacctaatgtagtagcattttttccatatcattaagtatttttgacaacatggtttgtaagtgttattttagtttttttaaagtattccatcttacgaacacacaatcatatatgtagccaatttagtaacaatcataggatatttaggttgtttctaactgtgactactgctgtaatagtaaaaataagtttaatataaaagtagaattattggccgggtgcggtggctcacgcctgyaatcccagcactttgggaggccaaggcaggtggaacacaaggtcaggagttcaagaccagcctggccaacatgatgaaacccctgtctctactcaaaatacaaaaattagccgggtgtggtcgtgcgtgcctgtaatcccagctactcaggacgctgaggcaggagaatggcttgaacccgggagatggaggttgtggtgagatcctgccactgtactccagcctgggcaacagagcgagactccgactcaaaaaaaaaagaaatagaattattttgaaagtcaaaacaggccgggcgcg

SEQ ID NO: 185545 - DNA, 601 bp, Human
atcctgccactgtactccagcctgggcaacagagcgagactccgactcaaaaaaaaaagaaatagaattattttgaaagtcaaaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcrgagcttgcagtgagccgagattgcgccactgcagtccgcagtccggcctgggcaacagagcaagactccgtctcaaaaaaaaaaagaaaaaaaaaagaaagtcaaaacattactagctgattttaaaaaacagataacatggtgggaggctgaggctagacgatcccttcagcccaggagttctacaccagccttggcaatacagcgagactccatctcaaaaaaacaaactcgtagatttccttgactagcatctagtactcataattggctgctcactaacaaacagtatgatgctga

SEQ ID NO: 185546 - DNA, 601 bp, Human
aaagtcaaaacaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcaacagagcaagactccgtctcaaaaaaaaaaagaaaaaaaaaagaaagtcaaaacattactagctgattttaaaaaacagataacatggtgggaggctgaggctagacgatcccttcagcccaggagttctacaccagccttggcaatacagcgagactccatctcaaaaaaacaaactcgtagatttccttgactagcatctagtactcataattggctgctcactaacaaacagtatgatgctgactatgttggggatgtttgggagatcctgccccagggcatttgcatttttagttcttcttttcccagatctctatc

SEQ ID NO: 185547 - DNA, 601 bp, Human
acacatttattatctcatagttattgtaggtcagaagtccaggccacagtgtggctagattctctgtataggatctcactgaaatcaaggtgttgccagggtttcagttctcatctggggcttagggtctttatccaaggtcacttgttggcagtccttgtaactgtaggattaaggtccctgttgtcctgttagttgttgaccagggatgactcttagcttccagatactgcttgcagttcggtaacatgtcgccaccagtggtagttcccaatatgaatgtttgcttttttccaggccrgcctgaatgcatctctctgaccttctcttctgtgatcagctagctggaaaaaaaccctcactcagtttttaaaaggctcaccttaggtcaggcatggtggctcatgcctgtaatttcagcactttgggatgccaaaggggagaggatcacttgaggccaggagttcaagaccagcctgggcaacatagtgagacctcctctctgccaaaaagaaaattaaaaaactagaattcagtcagcctgcatggtggtacaagcctgtagtcccggccagttaagaagctgagactgaaggataga

SEQ ID NO: 185548 - DNA, 601 bp, Human
tcagcactttgggatgccaaaggggagaggatcacttgaggccaggagttcaagaccagcctgggcaacatagtgagacctcctctctgccaaaaagaaaattaaaaaactagaattcagtcagcctgcatggtggtacaagcctgtagtcccggccagttaagaagctgagactgaaggatagattgagcctgggtgtttgagattacagtgggctatgattgtgccactgcactctagcctgggtgacagagtgagaccctgtccctaaaaataaataaataagtaaataaatgttcayctgattagatcaggccctcccaagataatctttcttttgccatataatgggacaaaataatgggagtctcatcatacttacagttttcatccactgaaagaggagtggattatacatacaaagatgtaggtcaatgcaggtcattttagaattcgtctaccacacagatatactcacaaaaagatagtaaaatatggatgcttaaggatgttcactgcagtgttaattgtaacaacaacaacaacaacaaaaaggtaatctaaatgtcaacaagacagtgatgaaataagtgataatatg

SEQ ID NO: 185549 - DNA, 601 bp, Human
cccaggaattcaaggctgcagtcagctatgatcaccacactccagcctgggtgacagagcaagactctgtctccaaaaacaaaagacaggcagaccaaggtagacccataatatgtactgatatggagagatgctaagatattttataaggcatttgcagagcatgtaaatggtcatctcctttgtaaattaaaaatatataatgtacagaagaaatcattaacagtgggaggttgggttaggaggacttagagggtttttttgttttgtttttgttttgtttttgtttttttagatgcartgttgacatgttgcccaggctaatctcaaactcatgcaatcctccagccttagcctcctaaatagctgggactataagtgcatgccatcgcgcatggcttacttttaattttatatcctctctagtattgtttgaattattttttaccaccactatgtactacttttataattattattatttttcaaattggtaatttaaaaattacccagttggggcccaagcatttgaaaagctttgtaagcacccaaggtagttcagctgtgtgctgctggttaagaacgacggctctggagtctt

SEQ ID NO: 185550 - DNA, 601 bp, Human
ggggcccaagcatttgaaaagctttgtaagcacccaaggtagttcagctgtgtgctgctggttaagaacgacggctctggagtctttaggaagcttctactatctgtcgtttgggaaccacttcaccaaatacaaaaatgggaaatattttattttatattatttttctaaaccaaattttagggtattccttaacaccttcatttcttacctgggaaaattaaataatgtgtataagttaacaaatgccctggaatgtaatactcgataaaagctaattttatgaattaggagtagataygtagtgaagaaagctgcctatggctgcctttgttttgaattaagtttcagagggttttttaggtgacatttttcttaattattcttttgtcttatcagattttttttatttttaatttttatgggtatatagtaggtgtatctatttatggaatacatgagatattttgatacagggatgcaatgtgtaataataacatcagggatttttttgacagactatttttagaagatggaacaataggtcctggaaacattttaagtatctccttttgcccagaatttcttaccttaggttttt

SEQ ID NO: 185551 - DNA, 601 bp, Human
ctgcctatggctgcctttgttttgaattaagtttcagagggttttttaggtgacatttttcttaattattcttttgtcttatcagattttttttatttttaatttttatgggtatatagtaggtgtatctatttatggaatacatgagatattttgatacagggatgcaatgtgtaataataacatcagggatttttttgacagactatttttagaagatggaacaataggtcctggaaacattttaagtatctccttttgcccagaatttcttaccttaggtttttatttgcttttcacrtgatttaactgtagttaaacctgatggctttctttttctcctatctaccaagatattccttcttttttattataatgctgcatctgaaatgtaaataaatcttggaacaagcacacagattcaagtataagtttaaaattttattcttgtataaggagagagcatgtgtgttgctctgcatgggtgtttttactgataagctgatctctcttcagtggccactgtggcttttagaactagcatcttatcattaataagggaggcttagtttcagattgtgcagctgtaatcttgttcatg

SEQ ID NO: 185552 - DNA, 601 bp, Human
ttctttccttccttccgtcttgctctgttccctaggttggaacacactggtaaaatcattgcttactacagcctcaacctcccaggctcaagtggtccctacacctcagcctcctgagtagctgggactacaggcacgagctctcatgcccagcctatttttatgtttttatgtatttatttatttattttctttgaaggaacctcgtgtttatattattccacaaatactctgggtgcaacctcatagctctggatcagagtttctaaagtaaatgaatttcttatttccacgaacctattttttttttttttttttttgatagggagtctcgcttcgtcacccaggctggagtgcagtggcacaatctcggctcactgcaacctccgcctcccaagttcaagtgattctcctgcttcagcctcctgagtagctgggattacaggcacgcaccaccacgcctggctaatttttatatttttagtagagacagggtttcactatgttggtcaggctggtctcaaactcctgacctcgtgatccacctgcctcggcctcccaaagtgctgggattacaggcgtgagccaccatgcccggccc

SEQ ID NO: 185553 - DNA, 601 bp, Human
ttggaacacactggtaaaatcattgcttactacagcctcaacctcccaggctcaagtggtccctacacctcagcctcctgagtagctgggactacaggcacgagctctcatgcccagcctatttttatgtttttatgtatttatttatttattttctttgaaggaacctcgtgtttatattattccacaaatactctgggtgcaacctcatagctctggatcagagtttctaaagtaaatgaatttcttatttccacgaacctattttttttttttttttttttgatagggagtctcgctycgtcacccaggctggagtgcagtggcacaatctcggctcactgcaacctccgcctcccaagttcaagtgattctcctgcttcagcctcctgagtagctgggattacaggcacgcaccaccacgcctggctaatttttatatttttagtagagacagggtttcactatgttggtcaggctggtctcaaactcctgacctcgtgatccacctgcctcggcctcccaaagtgctgggattacaggcgtgagccaccatgcccggcccttccatgaaccatttttttaaatgtatagttaaata

SEQ ID NO: 185554 - DNA, 601 bp, Human
tctcatgcccagcctatttttatgtttttatgtatttatttatttattttctttgaaggaacctcgtgtttatattattccacaaatactctgggtgcaacctcatagctctggatcagagtttctaaagtaaatgaatttcttatttccacgaacctattttttttttttttttttttgatagggagtctcgcttcgtcacccaggctggagtgcagtggcacaatctcggctcactgcaacctccgcctcccaagttcaagtgattctcctgcttcagcctcctgagtagctgggattmcaggcacgcaccaccacgcctggctaatttttatatttttagtagagacagggtttcactatgttggtcaggctggtctcaaactcctgacctcgtgatccacctgcctcggcctcccaaagtgctgggattacaggcgtgagccaccatgcccggcccttccatgaaccatttttttaaatgtatagttaaatagcttactgacaagttccagaaactcctgtaattttactaatgaaagcagtattgttatgacaactggattttttaaaaaaataaatactgtttgtcattgctcat

SEQ ID NO: 185555 - DNA, 601 bp, Human
cacgcaccaccacgcctggctaatttttatatttttagtagagacagggtttcactatgttggtcaggctggtctcaaactcctgacctcgtgatccacctgcctcggcctcccaaagtgctgggattacaggcgtgagccaccatgcccggcccttccatgaaccatttttttaaatgtatagttaaatagcttactgacaagttccagaaactcctgtaattttactaatgaaagcagtattgttatgacaactggattttttaaaaaaataaatactgtttgtcattgctcattgcarcattttttagagtagcaaaagattgatctaattagattgtggtatatccataaagcgaaatactaggtaaatgttaaaaaaattacaaagctctcctgtaggggaggcaaaattttacctttactctcagggtttttcagctgggcctgagaattaaattgacatgagataaattaataggagaagagcatataaatttatttaatataagttctacatgacataggagccgctataaggaaatgaagatccagagactcagagttgaacacttacatgctgaatcggacaaaaagtagt

SEQ ID NO: 185556 - DNA, 601 bp, Human
gtttcactatgttggtcaggctggtctcaaactcctgacctcgtgatccacctgcctcggcctcccaaagtgctgggattacaggcgtgagccaccatgcccggcccttccatgaaccatttttttaaatgtatagttaaatagcttactgacaagttccagaaactcctgtaattttactaatgaaagcagtattgttatgacaactggattttttaaaaaaataaatactgtttgtcattgctcattgcagcattttttagagtagcaaaagattgatctaattagattgtggtatatycataaagcgaaatactaggtaaatgttaaaaaaattacaaagctctcctgtaggggaggcaaaattttacctttactctcagggtttttcagctgggcctgagaattaaattgacatgagataaattaataggagaagagcatataaatttatttaatataagttctacatgacataggagccgctataaggaaatgaagatccagagactcagagttgaacacttacatgctgaatcggacaaaaagtagtaagttgtgaaaaagtaactaaatgatgtgaggaggctagaagataaga

SEQ ID NO: 185557 - DNA, 601 bp, Human
tgtcataggggtttgctatacagattattttgtcacccaggcactaagcctagtacccagtagttattttttctgatcctctccctcctcctaccctccatttttaagtaagtctcagtgtctgttgttctgggagggcatctttcaaatgggaatttcatctcctgcttttaaaaagcagcatgagccaggcactgtggcacgtgcctgtaatcacagctacttgggaggctgaagtgggaagatcgcttgagcccaagagtttgagaccatcctgggcatgtaacaagaccccatttcaaaaaaaaagaagaaacagcatgaaggccagagtgatcttcttgtacgtgtggtttttcaagtgcctttaactcaaagttgtcagtgtgccagagtggtgtattttggggtggcatattcttaactccactcttcatctgaagatgtggcatgatagccaaaatacgttcttaagtacgaaaagcaagtaaagaacagtacatatatgctatcatttatgtaaaaaccaaaaggatgttttggaaagagaagaaacatatatgtctgcatgtgtatgcatagaacatctttgtaaagacac

SEQ ID NO: 185558 - DNA, 601 bp, Human
attttggggtggcatattcttaactccactcttcatctgaagatgtggcatgatagccaaaatacgttcttaagtacgaaaagcaagtaaagaacagtacatatatgctatcatttatgtaaaaaccaaaaggatgttttggaaagagaagaaacatatatgtctgcatgtgtatgcatagaacatctttgtaaagacacccaggaaactggtaatattggttacctgcagagagagggcaggaggcacattatacccttttgtggcttctaaaatttgagctatgttggggccaggcacmgtggctcacgcctgtaatcccagcactttgggaggccgaggcgggcagatcacaaggccaggagattgagaccatcctggcgaacacagtgaaaccccgtctctactaaaaataaaaaaaaattagccgggtgtggtggtgggtgcctgtagtcccagctactcgggaggctgaggctggaggatggtgtgatcccgggaggcggagcttgcagtgagccgagattgtgccactgcactccagtctctcaaataaataaattaattaattaattaattaaattaaataaataaaaaataa

SEQ ID NO: 185559 - DNA, 601 bp, Human
gtggcttctaaaatttgagctatgttggggccaggcacagtggctcacgcctgtaatcccagcactttgggaggccgaggcgggcagatcacaaggccaggagattgagaccatcctggcgaacacagtgaaaccccgtctctactaaaaataaaaaaaaattagccgggtgtggtggtgggtgcctgtagtcccagctactcgggaggctgaggctggaggatggtgtgatcccgggaggcggagcttgcagtgagccgagattgtgccactgcactccagtctctcaaataaataaatwaattaattaattaattaaattaaataaataaaaaataaaaaatttgagctatgtctcacgcctgtaatcccagcacattgggaggctgaggtgggaggatctcttgaggccaggagttctaggttgcagtaagctatgataatgccactgcattccagcctgggtgacagaatgagaccctgtctcaaacaataataataaaaaataaataaagcaaataaaaattgaaacaaatatatcatcagtgactagaccagattgtgatttcttgcaagtagtgctgactctcaaaattgcttt

SEQ ID NO: 185560 - DNA, 601 bp, Human
tgtagtcccagctacttagaagattagacaggaggaccacttgatcctaggagcttgaggttacagtgagctatgattgcactactgcactccagcctaggcaacagtaagatcctgtctctaaaaaaatttttttaaaaggtggtataataataaatgttattatataaagattacatattcatcataaaaaagaaagaacagctaaactaagaaaaatatagataccattgtcagtctaacccctcagaaaattaaatactggtaattatatatgcaattcatatactttgaaaaaatraacatggtgatatttcatagcctattttattcacatattaatataacatgaacttctttttgcttaatttttgacctcctgttttaatttacaaaatgacaatacacttccttacttgtccagacttggcattcttttttggaagtaggctaaggaattattttgagtcattcttgggattgaaaggcatttatcaatgtaagatgttatggagcataaattaataagtaattgaaattcctacctctattcaagtgtggaactcccatggaggaattccttactgacactggcaacaga

SEQ ID NO: 185561 - DNA, 601 bp, Human
tcgtcttctctacccacacacatccctgagcacagcttgactttttgaaaccaaggccaaggaagaagaaaatgttcctttttctctttaaacacccattttccagtttcccacctattatttcatgacttttcctttccagagatttgtagagactcctccttccacccactgatgtatttccttattctgtagccccaagttgacagccacatcaaaatataatttattaagccaaacatttattttttattgtttagagacagaggctcactctgttgctcaggctggagtgcagtgrcactatcgtagttcactgcagcctcaaactcctgggctcaatctatcctcccacctcagcctcccaagtagcttggacagcaggtgtgtgccaccacagccagctaattttgtttttcaattttctgtaaaaacgaggccttggccaggcgcagtggctcacgcctgtaatcccagcactttgggaggccaaggcaggcggattgcggggtcaggagtttgagaccagcctggccaacatggtgaaaccccgtccctactaaaaatacaaaaattagccgggcgtggtggcgtgtgcctg

SEQ ID NO: 185562 - DNA, 601 bp, Human; identical to SEQ ID NO: 32914

SEQ ID NO: 185563 - DNA, 601 bp, Human; identical to SEQ ID NO: 32915

SEQ ID NO: 185564 - DNA, 601 bp, Human; identical to SEQ ID NO: 32916

SEQ ID NO: 185565 - DNA, 601 bp, Human; identical to SEQ ID NO: 32917

SEQ ID NO: 185566 - DNA, 601 bp, Human; identical to SEQ ID NO: 32918

SEQ ID NO: 185567 - DNA, 601 bp, Human; identical to SEQ ID NO: 32919

SEQ ID NO: 185568 - DNA, 601 bp, Human; identical to SEQ ID NO: 32920

SEQ ID NO: 185569 - DNA, 601 bp, Human; identical to SEQ ID NO: 32921

SEQ ID NO: 185570 - DNA, 601 bp, Human; identical to SEQ ID NO: 32922

SEQ ID NO: 185571 - DNA, 601 bp, Human; identical to SEQ ID NO: 32923

SEQ ID NO: 185572 - DNA, 601 bp, Human; identical to SEQ ID NO: 32924

SEQ ID NO: 185573 - DNA, 601 bp, Human; identical to SEQ ID NO: 32925

SEQ ID NO: 185574 - DNA, 601 bp, Human; identical to SEQ ID NO: 32926

SEQ ID NO: 185575 - DNA, 601 bp, Human; identical to SEQ ID NO: 32927

SEQ ID NO: 185576 - DNA, 601 bp, Human; identical to SEQ ID NO: 32928

SEQ ID NO: 185577 - DNA, 601 bp, Human; identical to SEQ ID NO: 32929

SEQ ID NO: 185578 - DNA, 601 bp, Human; identical to SEQ ID NO: 32930

SEQ ID NO: 185579 - DNA, 601 bp, Human; identical to SEQ ID NO: 32931

SEQ ID NO: 185580 - DNA, 601 bp, Human; identical to SEQ ID NO: 32932

SEQ ID NO: 185581 - DNA, 601 bp, Human; identical to SEQ ID NO: 32933

SEQ ID NO: 185582 - DNA, 601 bp, Human; identical to SEQ ID NO: 32934

SEQ ID NO: 185583 - DNA, 601 bp, Human; identical to SEQ ID NO: 32935

SEQ ID NO: 185584 - DNA, 601 bp, Human; identical to SEQ ID NO: 32936

SEQ ID NO: 185585 - DNA, 601 bp, Human; identical to SEQ ID NO: 32937

SEQ ID NO: 185586 - DNA, 601 bp, Human; identical to SEQ ID NO: 32938

SEQ ID NO: 185587 - DNA, 601 bp, Human; identical to SEQ ID NO: 32939

SEQ ID NO: 185588 - DNA, 601 bp, Human; identical to SEQ ID NO: 32940

SEQ ID NO: 185589 - DNA, 601 bp, Human; identical to SEQ ID NO: 32941

SEQ ID NO: 185590 - DNA, 601 bp, Human; identical to SEQ ID NO: 32942

SEQ ID NO: 185591 - DNA, 601 bp, Human; identical to SEQ ID NO: 32943

SEQ ID NO: 185592 - DNA, 601 bp, Human; identical to SEQ ID NO: 32944

SEQ ID NO: 185593 - DNA, 601 bp, Human; identical to SEQ ID NO: 32945

SEQ ID NO: 185594 - DNA, 601 bp, Human; identical to SEQ ID NO: 32946

SEQ ID NO: 185595 - DNA, 601 bp, Human; identical to SEQ ID NO: 32947

SEQ ID NO: 185596 - DNA, 601 bp, Human; identical to SEQ ID NO: 32948

SEQ ID NO: 185597 - DNA, 601 bp, Human; identical to SEQ ID NO: 32949

SEQ ID NO: 185598 - DNA, 601 bp, Human; identical to SEQ ID NO: 32950

SEQ ID NO: 185599 - DNA, 601 bp, Human; identical to SEQ ID NO: 32951

SEQ ID NO: 185600 - DNA, 601 bp, Human; identical to SEQ ID NO: 32952

SEQ ID NO: 185601 - DNA, 601 bp, Human
gcgaatagcctaagatacagcaaagctatcggacagtgcttcctctggactggaaagggaaggcaatgaggatcttttactttattccacatctactagcaacacagtagtaaccacccaccttcaaatcaagaagctaacaagagtagatcaacaggaaagttaaatcacccaaattaatcacttggcctagcagcctttctccataaaaagcaaacccaacatgtaattatctccgcgtccctctccccatccaacctaaaatatgagagctgccacaaatacaaatactttcgatacsctgcaatctgcaacgcaaaagccaaccactgccctcggccttattgaggccccaaattactcaatacttactccctcccccaccgcaattcactgataccctaggtatccccagctttacttgccacttcctcccacaccctttctgatgccctccaactccggactcacaatcccatgcacctaggacaggacattactcttccttcactgacccgtgttaccgtacaagccccttcaactcacaatccctcctccttcccctcccccagccgggcatcccctcctccggtccaagccc

SEQ ID NO: 185602 - DNA, 601 bp, Human
tcctgacctcatggtccacccgcctcggcctcccaaaatactggaattacaggcgtgagccaccgcgcccggcctacatctacttcttaagtacaatttcctgcataggaaacttttgaaatttaagaaaagaaagcaaaacaaaaaactaagccaaccttttttttttcttttttcttttctttttaagtctacagccaagtcactgattctaaaagcttagaagttaaggtagaccattgcaagaatcttaagaggtaacattttggggtaaaatccccaaaggcttaaggatacaatrtaagtaagacacacaaattaagaatagctataatattcttatctctgtaacaaattacatggaggatagctcataagtaggaaaactttgtaaacatgcaactttcaaggaagagaattttagtcatcatacctattaactatacaagaatgccaatacattttgaaattttatcttggtctctgtgcttaagctggaaattttttttcaaaatatatatcttaagtcatgtaaaaaaaaaagcagtaacttgaggaaaaccttttatcgacccttaattaaaagaaggccttaaatcaa

SEQ ID NO: 185603 - DNA, 601 bp, Human
tgtgtgtgtgtgtaacaaggtcttgctctgttgccaggctggagtgcagtggtatgatcttggcttactgcaacctctgcctcctaggatcaagcaatcctcctacctcagccacctgagtagctgggaccacagatggatgccaccaggtgtggctaatttttaaaattttttgcagagacgaggtctcactatattgctcaggttggtcttgaactcctgggctcaagtgatcctctagcctcagcctcccaaagtgctgagattacaggtgtgagctactgcactcagcctatattgktatctttcttgctgcgttaggcctttctgaaggtgagtatttacattctatcactctcttatctatcaataatgcttgtgtcaatgtttcatacttagtgctaaataagcagttatgaattccacaaattttcaacataaaaataaaggcatcatcaaaataatgtgtaaaaagataatgacgatatgcaaaacagtaaatgaaaagctaagatttaaaagttgtcaaagaatcggccaggcatggtggctcacgcctgtaatcccagcactttgggaggctgaggcacacagatcacga

SEQ ID NO: 185604 - DNA, 601 bp, Human
cccaaactaaatcatactaataacagaataatctacattttaacctttaattatatccttcttgtgaaactcctactttaaactttcatgggaccattctccctatttcccctcctcctccttcctacttcaattggagatatcacttataaatcagcccctgatcctctgccttgctttatatacaaggaattcatctaccacctgcacaaatttgtatctgtccaaatccaactttaacttagtgagatacatttgtttagcaaccaaactaaccccatccccccaaaaaatattatcyaaatagatgccttatcaattaacacctatcctaaaactgacaggttcacttctacttcttcccttacttccatatttaataccaaattcgatagattcttcccttacatcgctggtattgtccttgcttttcatttccccagccatcaaccactctaggtcattaattctcaaaagtattacttcagtagcctctcagcttatcacctaagctacttccaatctcttcatactttatccaacatacacaaaaagctgccagaattcaccacttcaatttgcctactcagaaacccacagt

SEQ ID NO: 185605 - DNA, 601 bp, Human
actgcttctattgtctccttttgctactgtacactgctgatgtagctaaattgaatcaatgacagtgtgtgggtgagagaggttaaaagaaaaaagggataaatcaagaaatgacagttgtaagggtggtaatggtaaaatcttagcttaaaccagttgtaaaattacagcacagcctaacacataagaattcatttgttgtactccaatttcatgaacttggcagagtggaggtgggcagaaaaaggcagaatcttagtgcatactgttgttgttgatgttttttaactaatagaaacayagctcatcaaaacttgagaagcaatgaacaccacaggaaaaatgaacctatttccctatattcaaaataataatgctttactcttataaagcccttcttatgaactcccacaccaattctcatacaatttcactaaacatagatacataaataagtcagttgccactttcttttcttttttcctttttttttttttttttggagacaaagtcttgttctgtcacccatgctggagtgcagtggtataatgataactcattgtaacctcgaacttctgggctcaagtgatcctcccatctc

SEQ ID NO: 185606 - DNA, 601 bp, Human
caaatgatattttctttttattttaaaccattgccagcttgcttttcagagtctttgtttccacaaatactgtatcaccctttaatacttgataatcttattgttactctaatattgtggtataccttccacacttttggaaacacagccctaatgtatatttcaacaaagagtaagggtctcctgctaaaagccctgctttattcccttctcagctccaggctactgtcaaaaataagtaaataaaatacataaactatttgaataaaagaacatatctttctattaaaaataaatgttmttgtaaaaaccctaaggaggaatcgccctttgctttacattaacagtatcttctcctctttattctctaacctaaaataagacaggaaaaaagcacattttcataattttgtatgggatacgatcttcattgttacattggtgataatgaaaaaagaacaaaattaaaataatatttgaggtctacatttcagtaaatttttgatctggcaaatatagttgcagtcttaacatatattgcctttactatacaacacaccagcaaacaaaagaagcctattaactaaaaagagagagagat

SEQ ID NO: 185607 - DNA, 601 bp, Human
aaatactttctaaagtatttagaaaaggctgggcatggtggctcatgcctgtaatcccaacactttgggaggctgaggcaggtggatcacctgaggtcaggagttcgagaccagcctgaccaagatggtgaaaccctgtctctactaaaaacacaaaaattagctaggcatgtgcctgtaatcccagctactcaggaagctgaggcatgagaattgcttgaacccgggaggcggaggttgcagtgagccaagatcatgccactgcactccagtctgggtaacacagtaaaactctgtctctataaataaataaataaataaataaataggttatcatcttcaatttccatatttctgaggaactggtgaaaaccctcaattataatagcatggttaataaaactatagatccttttctgtgtgtctcatactgggtttattcaatccaaattatgctgggaaatcctcttgtagcttcaggctctgaattgctaaattcttactttttaaattactcacttgctcaaagcttaatacatatacattgagactatttttattttcctctttattcttccctcaagttaacaacctagtattt

SEQ ID NO: 185608 - DNA, 601 bp, Human
atctttttattatttttcaatccttctgcttgattcaaggacaaagtctcactatcctgctagtctgcctttaatgcctaatactgttctttttttttttaatgagaactctatatagtttatgttaaatactttctaaagtatttagaaaaggctgggcatggtggctcatgcctgtaatcccaacactttgggaggctgaggcaggtggatcacctgaggtcaggagttcgagaccagcctgaccaagatggtgaaaccctgtctctactaaaaacacaaaaattagctaggcatgtgyctgtaatcccagctactcaggaagctgaggcatgagaattgcttgaacccgggaggcggaggttgcagtgagccaagatcatgccactgcactccagtctgggtaacacagtaaaactctgtctcaataaataaataaataaataaataaataggttatcatcttcaatttccatatttctgaggaactggtgaaaaccctcaattataatagcatggttaataaaactatagatccttttctgtgtgtctcatactgggtttattcaatccaaattatgctgggaaatcctcttgtagc

SEQ ID NO: 185609 - DNA, 601 bp, Human
tactaaaaatacaaaaaaaatttagccaggtgtggtggtgcacatctgtaatcccagctactcaggaggctgaggcaggagaattgcttgaacctgggatgcagtggttgcagtgagctgagactgcgccattgcactccagcctgggcaacaagagcaaaactctgtcccccaccaaaaaaaaaaaagaatgtgaggttctaccttcactgaggtcctttgtattgtccctaccctcactaaacagctctatcttatctctataaaggtagaacctagtacagtgcttagcctggtacawagtaggcaattaaaagtgtattgatcggccaggtgcggtggctcacgcctataatcccagcactttgggaggccgaggagggtggatcacaaagtcaggagactgagaccatcctggctaacacggtgaaaccctgtctctactaaaaatacaaaaaattagctgggcgtggtggcgggcgcctgtagtcccagctactcgggaggctgaggcaggagaatggcgtgaacctgggaggcggagcttgcagtgagcccagagactccgtctcaaaaaaaaaaaaaaagtgtattgattggt

SEQ ID NO: 185610 - DNA, 601 bp, Human
gagacggagtctcactcagccacccaggctggagtggagtggtgtgatctcagctcactgcaaccaccatctcccaggttcaagcgattctcccatctcagcctcccgagcagttgagattacaggcatccgccatcatgcctggctaatttttgtattttagtagagatggggtttcaccatgtgggccaggctggtcttgaactcctaacctcaggtgatccagccgcctcggcctcccaaagtgctaggattacaggccatcgcgcccggccaaaaccccatattttctgtgtaaatktatggggaaagatcagaaagaaacacgaccaagaacagtggttacctcttaggtggcagggaattattggcttttggggtagagctcaggaaggacttcaagccttcagaagtattggcttttggggtagagctcaggaaggacttcaagccttcagctttatacagaatgttctatttttttaaaaaagtattaatgtagggatgtgtaatttaagcagctctaggctatgagtcctttaaaaacagggataccttattcatcctcatacctctagcaccttgcacagtacctggctct

SEQ ID NO: 185611 - DNA, 601 bp, Human
tttccagaaatatttaaatttacattgagtatagttagcatgtgctcaggaaagccttaacattctaaagcttaagaaataaaatagatctcatgagattagaatcctcatacatttaatcaaaattattgtctataaaagatggcagggtttcacatacagatgtgtatcataattacactgaactatctctagctccaaatgagaagatcatgccatttaaaaatgttttgcctaccaagccaacagatcaacataccaaggcttcaactgactggaataaactggatagcaataactyctttgcaatttaccaaatttaaccttaagtgacctttaggatgtatgcaaccggctgggcacggtggctcacacctgtaatcccagcactttgggaggccgaggcgggtggatcacgagctcaggagtttgagaccagcctggccaacatagcgaaaccccatctctactaaaaatacaaaaattagccaggcctgatggtgggtgccttcaatcccagctactcgagaggcggaggcaggagaatcacttgaacccaggaggcggaggttgcagtaagccgagatcgtgccactcactg

SEQ ID NO: 185612 - DNA, 601 bp, Human
atagcttagaggaaaaaagcataagttttctcccatccataagaagtcagtacttgacttctacaggagacagttaactaattaactcattaaattagagacaattacttggcaatgtctgtaagcctgttgcctgaacaacacaaccaaagagggagtttagatctgaaactagaatctatctacccacagtcagtcaaaaatgctaaaatattttaggtattatgctaacaaagaaaagctggtacctcaaaaattggtgatatatttaaatcaggggtttgggttttttttttttggggggggggggactcaagtgatcctcccacctcagcctcctgagtagctgggaccacaggtacgtgccaccatgctcagctaagtttttcagtttttatttttttgtaaagatgggggtcccactaggttgcccccccacacacacatacacacttagtatagcaagcaatttaatagtttcataatataattttcattttgttcctgtgttttcaaaggatgaactaaaatgactttagatgaaattacccaagtatgtctatactccaagtaactttagagtttatcatttgccatttca

SEQ ID NO: 185613 - DNA, 601 bp, Human
ccactcaccttccatgttgccatcaggaatagcacagatcagattatgtctctcctttcttctaaaacttttagtattgttccatggcttgcagaataaagttcagactcttctgtttagcattcaaagcatttgagaggtgggagaatcacttgaacctgggaggcggaggttgcaatgagccaagattgcaccactgcactccagcttgggagacagagcaagaccctgtctcaaaaaaaaaaaaaaaaaaaaaaagtagcccaggggttgcttgatgacttgtgctatagaacaaaartaaaagacgtagcccaatatggactttttttttaactaattggtgctaccaaaagcattcaagaaatatcaccccaaaataaagtcatgttctctatacatgactataaaagccattcttgaaggggttttgggtttaaaccttggctctaccactaaccctttgtgagtccctagacaagtttattgtcctcccaggcctctagatatttcacacacttacacaatgaagacaaaataatctttgaaatttcaaaacaataaatatataaacacaggataaagaaaacaataagtttca

SEQ ID NO: 185614 - DNA, 601 bp, Human
acctgttctttcaataagaaaagagttaggccaggcacagtggctcacacctgtaatcccagtactttgggaggccaaggcaggaggatcccttgagctcaggagttccagcctgggcaacatggagagaccaggtctctacaaaaaattagaaaagtagctgggcatggtggtgcacacctgtactcccagctatgcaggatgctgaggagggaggatcactggaacttgggaggtcgagactacagtgagccatgattgtgccaccacactccagtctgagtgacagagcaagaccctrtccaaaagaacaaaaaacaaacaaaaaaagccacagagactaccaccacaagtgctatatcagcctgcataagaagtaacccagtggccgggcgcagtggctcacgcctgtaatcccaacactttgggatgccaaggcggccagatcacttgaagtcaagagttcgaggccagcctgaacaacatggtgaaatgccatctctactaaaaatacaaaaattatccaagcatggtggcatgcgcctttagtcacatctacctgggagactgagaggaatgggagaatcacttgaatttgtat

SEQ ID NO: 185615 - DNA, 601 bp, Human
aggagagggggaatgggagttaactgcttactggttatcagatttctctttggggatgatgaaaatgttctggaattagatagtggtaacatcatacaacatggtaaatatacttttttaaaaaacactgaattgtatacgttaaaatggtgaattttacattatgtgaattttatctcaattaaaaatacatatattggtaagataaaagatatgaaaagactaagaaaagtgaaagggcagccaggacctgaaagtgactcccagaggcttcctgtctacaagagcaccagggagacaygtaatctgccaaaccttagaagtgaaatgaatgagaaaagaataacaaacaagacctctcatcattccaagttccagtagccagaaataggaaataaattaaaatattctttgacatcagtaattttttacatcaataatttttttaaataaaataataataatacctgtatcaaagaaactcattaatttaagggctttatatactatgggatgaccaaacatgaacaaccaaagcccttctccttgagttgcatcagattgattgttacttcagtcaaccaacaaagcagtaagatca

SEQ ID NO: 185616 - DNA, 601 bp, Human
aaccccatctctactaaaaatacaaaaaaaattagcctggcatagtggcacatgcctgtaatcccagctatttgggtggctgaagtatgagaattgcttgaacccgcgaggtagaggttgcagtgagccgagatcgggccactgcactccagcctgagtaacagagacacactctgtctcacaacaaacaacaacaacaaaaaaccctcaaaacaaaaaacactagtaaataatgggcatgctaaaatatttaagaactatatcaatggctgcactttactctgaaatgtattaaaaaaaagatggattgatggaaggatagagggatggatggatatatgaaaaagcaagaatagtcagatgttaatagtagaatctggccaggtacagtggctcacacctgtaatcccagcacttgggaaggccaaagggggaggattgcttaagcccaaaagttcaagaccagcctaagcaacatagaaagaccctatctctacaaaaaataccaaaataaataaaaattagctgtgcatgaggcaggcgcctgtggtcccaactatttgggaggctgacgtagggaggatcatttgagctcaggaag

SEQ ID NO: 185617 - DNA, 601 bp, Human
ataaatcaactgagtacattattcagccttaaaaaggaatgaaattctgacatatgctgtaatatagatgtgccttgaaaacattatgctaaatgaaataaggcagacacaaaaggacaaatattatattgttccacctatgtgagatagctaaaatagtagcaataagtggagtactggttatcaggggctggttggagtggaaggaaagagaatggggagtcattatgtaattggtatggggtttcagtatggaatgataaaaacgttctgcaaatggatacaacaattttttttttttgagacggagttttgctcttgttgccccagctggagtgcaatggcatgatctcggcccactgcaacctccgcctccacctcctggattcaagcaattctcctgcttcagcctcctgagtagctgggattacaggtgcgtgccaccacaccaggctaatttttgtatttttagtaaaaacggggttccaccatgttagccatggctgattttgaactcctaacctcaggtgatccgcccacctaggcctcccaaagtgctcggattacagccatgagccactgcgcctggccttggatatga

SEQ ID NO: 185618 - DNA, 601 bp, Human
aagatgtgttttctttggcatgcaaagtactgttttttagttgcattagttgacattaagaaatcacaagatttcccataaatactcagtttttctggtttattttgataaactgcaagtgtgaacaacactaggtttccggtcccaagtagcaccagccccttgaagacaagcagtctttctccttcagaaaagcaaccaaacagggctcatcagttatctatctacagaccacactgtccttgtggatttgagactcttgtcacataggtttccaattaagtagccctttgtttaaaayagaaagtctatggaatttactaaatatctacattttgtctgtcagcatattcaaaaagacaaatcatatattcatgcaactttggagccagaaggacccttagaaaggcaaacgttaagtgatcttcctcaaagacattcagcaaatcagtgagtctacttaaagactcctaactcctgccttcaatttggtgttcttccattactgtatatctcctaaccctttcccaattttaaagctatagttgaaaaccagaaagagtatctggcattagtaagtagaccactattataagaagct

SEQ ID NO: 185619 - DNA, 601 bp, Human
taaaaataaaaataggctgattatgggttttctttaaaaaggcataacatattggtttctacaaaatagcatcaagacataaaaaatacacctaccctgaaatacagaatacgtagctttaaaacaaatttcatgctcagtagtaaaaccttctatatttatgagaagaggccaaaaacttcttccttaactagcaaaggtcacaaactatcagctggcagactgaatttggtccaaagatgtgttttctttggcatgcaaagtactgttttttagttgcattagttgacattaagaaatsacaagatttcccataaatactcagtttttctggtttattttgataaactgcaagtgtgaacaacactaggtttccggtcccaagtagcaccagccccttgaagacaagcagtctttctccttcagaaaagcaaccaaacagggctcatcagttatctatctacagaccacactgtccttgtggatttgagactcttgtcacataggtttccaattaagtagccctttgtttaaaatagaaagtctatggaatttactaaatatctacattttgtctgtcagcatattcaaaaagacaaat

SEQ ID NO: 185620 - DNA, 601 bp, Human
cattagtaatgagtgtccaagtaacagcattataaaaatgtgtctcatatgcatacagatctgcagactggtcttcaatgaagtattttcctaggaaactaatctttccttgattgtccaatgttaattactctatatatttcaaaatgtgttaattgatacaaggattttctatagtgtatttttcatgcaatttctgtttgaggaagaaaaaaacagactgaccaataattttaaaaataaaaataggctgattatgggttttctttaaaaaggcataacatattggtttctacaaaayagcatcaagacataaaaaatacacctaccctgaaatacagaatacgtagctttaaaacaaatttcatgctcagtagtaaaaccttctatatttatgagaagaggccaaaaacttcttccttaactagcaaaggtcacaaactatcagctggcagactgaatttggtccaaagatgtgttttctttggcatgcaaagtactgttttttagttgcattagttgacattaagaaatcacaagatttcccataaatactcagtttttctggtttattttgataaactgcaagtgtgaacaacac

SEQ ID NO: 185621 - DNA, 601 bp, Human
aggcatttaatctgcctttactatataaactgtagctcagggtaaccaaataattgataaagggtagtttgtttttatagaggtacttcagataaggaaggaaaggagaattagaatatcacccttttgtaagcccctagaaaatcaatgaaactgggcaataatcaatagctcctaacatcatgaagagagagaaccaggcaaaatataattaaacctgaatctgatcaagtctctggatcagtttctcaacctcagtactggtgacattttaagttggataattctttgttgtgggggyttcctgtgctttgtagcatgtttagcagcatccctggcctctacccactagatgccaatagcatccccaagttgtgaccagcaaaaatgtctccagacattgccaaatataccctggtgagcaaaatcacccctattgagaaccactgctctagaactattcactaatttacagaaaacacaacaaacaaaggaacatgttcactaccaccacataaatgcagactgtaggaaatgacagaagaaacattccatagctgcagaaaaataatttttaatgaagctatgaagaggattcttc

SEQ ID NO: 185622 - DNA, 601 bp, Human
ttcatgtcagatggcaattttaatattctagcctctttcctaaaactgaaatctaaaattcaggttcagagaacactaactaattttgccttgatatcctccttcggttccattcttggtgttacaatgacatagtagcaattttccaaggatgctacaagagaagctctgaactccctatctaaaaatcacttaaagaatgagaaaattgtttcatgttgttcaaaatcgaccttgtaaggaattttgcccaggctggcccagaacaagaaaatcttacaccatttattttaggaatgtgaaagtgtcagtgactcaatgagctaaagcaacagcattactacacttcttcatctttggcaacagtttaatgctttgaaaaaataaagccatcattatctgcataaatccttttaggaaattcaattatgggtcagatcccaaataagcagtaatctatattagttactagattcagcaattgaagactggaccagcatcattaacttatcacttataatcttctttttcccttaccaaatgtcacctctccatttccactcttgtcaaacaactggaaagccactatgaacatggaatc

SEQ ID NO: 185623 - DNA, 601 bp, Human
gacagagcaagactccgtctcaaaaaaaaacaaaacaaaaaactctgcatagcatttttttggaaagtcttctcatacagaagatagttgagtcaatgggcagaaggaagaagaaaacaatcaatgtcacgctagaaaatgtgtccaccaaaattacagccaaggcactactgatccttctgattgactgacctgtactttctcaccactttgaccattgcagtgataatttttccttcaagtttaactaaaggacatctattttataactcaaacacaatagtgaataagtgtttaatgycatagctcagggaaagcctgattttcaagggtgtttctacaaatatccatgccaattcacactataaaagggggcttaagtttaattttgcaagatgagaaatttctggagatgtctttcacaacgttgtggatatacttaatactactaaactgtacatttaaaatcattaagatagtagtaattttatcttgtgttttttgccacaacaaaaacagtggcaatctttaaaaaggtgggggcagtgctcaaggtccttgaactactacatggcttttattgaaaaaattgttgcaagaa

SEQ ID NO: 185624 - DNA, 601 bp, Human
ggaggccgagacagacggatcatgaggtcaactgttcgagaccagcctggccaacatggtaaaaccccatctccactaagaatacaaaaattagctgggcatggtggcgcatgcctgtaatcccagctattcgggaggctgaggcaggagaatcacttgaacccgggaggcaggggttgccgtgagccaagatcacgccattacaatccagtctgggcgacagagcaagactccgtctcaaaaaaaaacaaaacaaaaaactctgcatagcatttttttggaaagtcttctcatacagaasatagttgagtcaatgggcagaaggaagaagaaaacaatcaatgtcacgctagaaaatgtgtccaccaaaattacagccaaggcactactgatccttctgattgactgacctgtactttctcaccactttgaccattgcagtgataatttttccttcaagtttaactaaaggacatctattttataactcaaacacaatagtgaataagtgtttaatgtcatagctcagggaaagcctgattttcaagggtgtttctacaaatatccatgccaattcacactataaaagggggcttaagtt

SEQ ID NO: 185625 - DNA, 601 bp, Human
ttgttaagttggtcttgacagtctgttggatgaagtggcttgagttactaattttataataatcgaaactgggaaaagtaattaaatggaggagacacaaagaaccatgatatcaaggtagagggacaaaaattagaatttgattgtgagatctaattcttaatgcacacaggatataagcacagggcactgtcactaactcagacatctgaatccagttattttccaagcatttctgcatcacatttgtgagatatgtgagcatgtgtgatacctactgaaaatggaaaatgcagcattrctagtagtgcatggttaatgctgaatgagatgatggagggtttgtgccttaaactacagaatctaggtgtttctgaggaaagtcaacattcttcaggaggcaagatggtcgaagcttgctccaaaggaggaggatgccaagatttatatgcaaaaatctaaataactctgcatagcaggccaggcgcggtggctcaggcctgtaatcccagcactttgggaggccgagacagacggatcatgaggtcaactgttcgagaccagcctggccaacatggtaaaaccccatctccactaagaa

SEQ ID NO: 185626 - DNA, 601 bp, Human
atggcatgtgtcttattgttaagttggtcttgacagtctgttggatgaagtggcttgagttactaattttataataatcgaaactgggaaaagtaattaaatggaggagacacaaagaaccatgatatcaaggtagagggacaaaaattagaatttgattgtgagatctaattcttaatgcacacaggatataagcacagggcactgtcactaactcagacatctgaatccagttattttccaagcatttctgcatcacatttgtgagatatgtgagcatgtgtgatacctactgaaaatrgaaaatgcagcattgctagtagtgcatggttaatgctgaatgagatgatggagggtttgtgccttaaactacagaatctaggtgtttctgaggaaagtcaacattcttcaggaggcaagatggtcgaagcttgctccaaaggaggaggatgccaagatttatatgcaaaaatctaaataactctgcatagcaggccaggcgcggtggctcaggcctgtaatcccagcactttgggaggccgagacagacggatcatgaggtcaactgttcgagaccagcctggccaacatggtaaaaccc

SEQ ID NO: 185627 - DNA, 601 bp, Human
agaggaaacaattaactaatattttattcactcttaaaaaaactccagaaccctttcctgagttttcacgttctgaaatggatttccaaggcctcaatctaagtcctctccccagagcagaggtatctttaacaacaaaaaaccttatataaacactcaagtaaatgttcaatattactacttatataaatacttgcaaagatgcacacagtttaagtatataatttgatgtgtataaaatcatatctaaaaaaagcataaatgagaatatatacaagtacacagataacattatcatcayagtctacaagagatgctgatagcataacaggttttctccacttccttacacattgcagctaatattgtcttccaactttctctcatgtgcacaagagaaaactataaatagctccaaactagaaaacagaaggccatttggtgaaaaggatttaactctatttagaatggatctaaaatttccttttacctaaacatgtgcctataaatacataagcacaattcattttattaagtggttacaaacatgaaaactgacctttaccccagatccaaaatcctataaaaataaactccaagt

SEQ ID NO: 185628 - DNA, 601 bp, Human
tagctgggactacaggcatgtgccaccacacccggctaatttttgtgtttttagtagagatggggtttcaccatgtcacccgtgctggtcttgaactcctgggctcaagcagtctgcccacctcagcctcccaaactgctgggattacagacatgagtcactgctcccggcctttttttcaatttggattttaaatgcatggcagctactgacaacacaatgtagtataactgcttatctaggttacctgaatctaatagtactgaacaggatctccagtacacttgtggacaatggtgagaccaaggcaaacttacactgtagctagcacacaccagtcatgcaatagcctctacaaggctcatgccacctgacagtaacagatatacaaaccattaagtaattatccacggcatgcattagaagttttattaaagaaacatcaaagaggaaacaattaactaatattttattcactcttaaaaaaactccagaaccctttcctgagttttcacgttctgaaatggatttccaaggcctcaatctaagtcctctccccagagcagaggtatctttaacaacaaaaaaccttatataaaca

SEQ ID NO: 185629 - DNA, 601 bp, Human
ctcggcctcccaaagtgctgggattacaggcatgagccactgcacccggcccagccaggctggtcttgaactcctgacctcaggtgatcctcccgcctcggcctcccaaagtgctgggattacaggcgtgagccactgcacctggccaccatagaacttcatattattgcatgtctatagctttgtttccagtgagaaagggtacatttttcataactacacttccatctcctggctctttaaaataataacagtggttgtgcctaacccatcccaatttattctctccttcagggaaaamcagcctatttcagaggcacaaatggaacacatttttatttgctatatgtattaatggtcaaacatagtactacatttaaaggaatctctgctttttgaggtttcttcagtcagagggtgaggatgtgtccttggaaaagtttactttgaagagtgtccattcctaggcaaacaccaaatttggaacacaatgttgatgttaatagagaactcagaacatataacatgtttcatactcattttgttagttaacagacaacagtttgttgtggttttttcttgtttgtttttttttttggag

SEQ ID NO: 185630 - DNA, 601 bp, Human
tctgtagcatagttctggcctggaagaaagggaaatgacagtcacatcttattggcagcaaaatcacgatatagtattttatactaggttggcatagctaagagaaccaggaatccattagttttctgacatatagaaaacaaaagacaactttttcacttcctgcagagcatgggcttatgaaagggatggtttatacttccattgaaaagggaactggggctaaatacaaaagtagcctgtcattatgttctctttgctcaaaggagaggagcacaatgatttgtcaggagagcaggttaacggtgacaactgtgattaagtaaaaatgttcacagatgtgtaacattagtcagtttagctgtatcagtcacttatgatgattggactagatgaaatacacattaaatcatatatattatgtaaatatgtcttaacagaggttttaatttccccagaaacccatactgtgtctccccatctcatccaccctcatccctcccctggttcttatgggcacttcctactggtcttgttcacctttctgcagtacaaaattacctctgaccggggctggcactcttctccaagactgccacca

SEQ ID NO: 185631 - DNA, 601 bp, Human
caccaatagtctcaaatataccaaatacatctaactgaaactgtatagcaagttccacccacccccagagagaatcccatctttccagtggcaaacaaggatcttttttttgccatgtttaagaatgctatttctgtagcatagttctggcctggaagaaagggaaatgacagtcacatcttattggcagcaaaatcacgatatagtattttatactaggttggcatagctaagagaaccaggaatccattagttttctgacatatagaaaacaaaagacaactttttcacttcctgcagmgcatgggcttatgaaagggatggtttatacttccattgaaaagggaactggggctaaatacaaaagtagcctgtcattatgttctctttgctcaaaggagaggagcacaatgatttgtcaggagagcaggttaacggtgacaactgtgattaagtaaaaatgttcacagatgtgtaacattagtcagtttagctgtatcagtcacttatgatgattggactagatgaaatacacattaaatcatatatattatgtaaatatgtcttaacagaggttttaatttccccagaaacccatact

SEQ ID NO: 185632 - DNA, 601 bp, Human
ctgttatgaaaactaagctcacctggagaaactgcgtgaattctgtgtagttaagatgcttcttccggttatgcccaaaatgcagtcggataaattcacaatcccagttaaaagggatatgatgatgaataatagtctgtccaaaaatttctttgacattttcttaaaagggaaaacaaaaataaatcaattatatctggaataagtagtttaaaccactgcaatgttcctacagaaaaaaattaagagaagttttaaaagtcaatatcatctgcttctattaaaataactgcaatttttktgtgtgcccagaaaccatgcgcaggaacacaactgatacaaaaaatataattttacacttaagaatatgtaccattgcatataaggccatgagattcttaatttctctttatttaattttaattagaaagtgatttctatcttacatcataaatggctgctattttacatcccgtataaaatcaatagtgttttcccagtttctcaaggagtcgaattaaaccctttatcagaagcatgaatacctaaattacagtataatgcaatatttgtcatactaagtatggtttgattgaggctt

SEQ ID NO: 185633 - DNA, 601 bp, Human; identical to SEQ ID NO: 28428

SEQ ID NO: 185634 - DNA, 601 bp, Human; identical to SEQ ID NO: 28429

SEQ ID NO: 185635 - DNA, 601 bp, Human; identical to SEQ ID NO: 28430

SEQ ID NO: 185636 - DNA, 601 bp, Human; identical to SEQ ID NO: 28431

SEQ ID NO: 185637 - DNA, 601 bp, Human; identical to SEQ ID NO: 28432

SEQ ID NO: 185638 - DNA, 601 bp, Human; identical to SEQ ID NO: 28433

SEQ ID NO: 185639 - DNA, 601 bp, Human; identical to SEQ ID NO: 28434

SEQ ID NO: 185640 - DNA, 601 bp, Human; identical to SEQ ID NO: 28435

SEQ ID NO: 185641 - DNA, 601 bp, Human; identical to SEQ ID NO: 28436

SEQ ID NO: 185642 - DNA, 601 bp, Human; identical to SEQ ID NO: 28437

SEQ ID NO: 185643 - DNA, 601 bp, Human; identical to SEQ ID NO: 28438

SEQ ID NO: 185644 - DNA, 601 bp, Human; identical to SEQ ID NO: 28439

SEQ ID NO: 185645 - DNA, 601 bp, Human
taaggaaaggcagagaaagcactccccatcactctggataccaatcagagacccagggaagaagaaaatggtggtttttatcactgcccatttcctaaatatctgacaagacccttgaggccacccatcccagcataaaagcatcagcgctgccactgaagacaggcaaatcatcttgaatctgtcttaaaaagaattcacagcagtagcaaaattacatcactttcctaaggatgaagaaatgtgaaggatgcagactcagggtgccaaagattgcaaaacaagcttcagatatggcctstaggaaaattgctaggggcaagagaggtgggtgaatagaaaagtaagcagcagaaaaactgaggaggagaaatgagttgagacttttaaattcaatgtttttaataagctaaatgaaatattccccaattacaaatattaaggaaacctccagggagagctatatcaatagacacatgcaacactgcaaaatatcttcttttgaaatgcaatttttcaaaattcaagagcaaattttcacagatgtataggctacaaaaaataaaattaaattcagtaagagctctttaaatatttcaat

SEQ ID NO: 185646 - DNA, 601 bp, Human
atcacctgagccggggaggtcaggactgcagtgaacagtgattgtgcctggctgacagagtgagaccctgtctccacaaaaaaaaaaaaaattgtcctgagactctgaggttcttcctttggggacaatgtaagaatacctaagacttctaccagctctccagaaattctagatccctgtactatctcactggttaaggaaaggcagagaaagcactccccatcactctggataccaatcagagacccagggaagaagaaaatggtggtttttatcactgcccatttcctaaatatctgamaagacccttgaggccacccatcccagcataaaagcatcagcgctgccactgaagacaggcaaatcatcttgaatctgtcttaaaaagaattcacagcagtagcaaaattacatcactttcctaaggatgaagaaatgtgaaggatgcagactcagggtgccaaagattgcaaaacaagcttcagatatggcctctaggaaaattgctaggggcaagagaggtgggtgaatagaaaagtaagcagcagaaaaactgaggaggagaaatgagttgagacttttaaattcaatgtttttaata

SEQ ID NO: 185647 - DNA, 601 bp, Human
cagttttaatgtgtgttttcttgtactaatgatattaaacttttctattatttttccttaccatttggatatcctcttttgtgaggtttctgttcaggtatttagccaatttttctattgcattgcctgccttttgcttataaatttgcacaagtttattatactatatattctggatacagatcctctattatttaaattattgcaaatatctctgcctattgtgtaacttgtcttttcacactcttagtggtatattttgataaaagttcttaaatctaatgaagtttaacttattaawctttttctttatgactggtgttctgtactattcacaaaatctctgcctatctccagatcataaatagaatatcttgtgttatcctctttaatctttcacatttaggaacaggaaaagacttttgtgtatggtatggggtagtgattttttttccttgttgaatatccatcattaattaaaaatttttaaaaacaggcctggtaaaatttcagccagcatcaaaaaattaaaatataaaacatttcaggcacttaaaaaatacaaagatatattaatactttttcctcacttcccatcccc

SEQ ID NO: 185648 - DNA, 601 bp, Human
ataaacattctttttttttttttttttttttttttttttgagacagcgtctccctctgttgcccaggctaaagtgcagtggcgcattcctggctcactgcaacctctacctcctgggttcaagcaattctcgtgcctcagcctctcgagcagctgggactataggtgtgcaccactatgcctggctaaattttttgtattttttgtagagatggggattcatcatgttagactcctgacctcaagtgatccacccacctcagcttcccaaagtgctgggattacaggtgtgagccaccacrcccggcctaaactttcttgtacatatctcttaacacacatgtgtaaacatttttgttagggactacacccaggagaggaaccaacaggtcacggggtatgtgtttcttcaactgcagtggtactgacaaatagttgccaaagttgtgatgctagcaatttccattccttcacctcttgaacaacacttgccattgtcagagtataattttgatcaatctggatagtataaaatagcatcccattgcagttttaatgtgtgttttcttgtactaatgatattaaacttttctattattttt

SEQ ID NO: 185649 - DNA, 601 bp, Human
ataatacgtattatatatgtataatacgtattatatattaatatataatatataatacatattatatatgtatataatatatactaatatatataatgtatacattatatatttacataatatataatacataatatagaattataattatatataatacataatatataattatatatattattatatatgtatttatattatatataatatattatatataatatatattatataattatataagtatataattatgttatatacataataatatataatatataatacttattatatattatatatattaatatatatataattttcccctgaatgctaaacaatacatatttttctctcagcaaaaagggagttaagttgtgttaaagactatagttaagtcttcaaatctaataatttaaatgagttaaatttaaatgagttaaatgactaataaataatagctaataatagactaataaataaacctaactttctttttgagaacagacttccatttgtggtaaaatatcacaggtgaaagaggtaaaatgttccaaaaaaaggaattcctaaatggacagtaatgtcttcctat

SEQ ID NO: 185650 - DNA, 601 bp, Human
aatatatatatacataaaatatatatataatatataatacatattatatataaatataaaatatatgatatataatacgtattatatatgtataatacgtattatatattaatatataatatataatacatattatatatgtatataatatatactaatatatataatgtatacattatatatttacataatatataatacataatatagaattataattatatataatacataatatataattatatatattattatatatgtatttatattatatataatatattatatataatatattttatataattatataagtatataattatgttatatacataataatatataatatataatacttattatatattatatatattaatatatatataattttcccctgaatgctaaacaatacatatttttctctcagcaaaaagggagttaagttgtgttaaagactatagttaagtcttcaaatctaataatttaaatgagttaaatttaaatgagttaaatgactaataaataatagctaataatagactaataaataaacctaactttctttttgagaacagacttccatttgtggtaa

SEQ ID NO: 185651 - DNA, 601 bp, Human
ggccagcacagtggctcatacctgtaatctgagcattttgggaggccaaggtgggcggatcacttgagttcaggagttcaagaccagcttggccaacatggtgaaaccctctctctactaaaaatacaaaaattagtcaggtatagtggcaggtgcctataatcccagctacttgggaggctgaagtgggagcatcacttggacctggaggtggaggttgctgtgagctgagatcacatcactgcactccagcctgagtgacagagcaagactctgcctcaaaaaaaaaaaaaaaaaaaaaaatgtatgtagaatgttatttcccccacttagagtttctcaatcacaaaactggatgaaaataaatttcattctcatagattatgaattattttcaatcatgtatcctttcaaaagaatatgttgaattaaaactcacagaataaaaagcctatgatcctaaataagcatcaagtaaccactaatacccttattcatataaaaggtttctcctgtattcaactgcatatatttttctgtatactttcttcctttaaagaatgtttataagccctacaaaatcctatgaaaactgaaggat

SEQ ID NO: 185652 - DNA, 601 bp, Human; identical to SEQ ID NO: 28440

SEQ ID NO: 185653 - DNA, 601 bp, Human; identical to SEQ ID NO: 28441

SEQ ID NO: 185654 - DNA, 601 bp, Human; identical to SEQ ID NO: 28442

SEQ ID NO: 185655 - DNA, 601 bp, Human; identical to SEQ ID NO: 28443

SEQ ID NO: 185656 - DNA, 601 bp, Human; identical to SEQ ID NO: 28444

SEQ ID NO: 185657 - DNA, 601 bp, Human; identical to SEQ ID NO: 28445

SEQ ID NO: 185658 - DNA, 601 bp, Human; identical to SEQ ID NO: 28446

SEQ ID NO: 185659 - DNA, 601 bp, Human
acctataaacagggtcggtagctaggaagaacaaaggaactaaacatcttattttggtttaaccacttaggtcacatgtcagacatggaaacaggtcagcttcatgaccaaaaacctggatattgcaaatggaaacaaataattagctacatggaacagaaagagcatgacttatatttctggcaaaggtatgcatgtgctgtgataaaaatgagttagaaagcttcttaaccaaacagaaacttaaaatgaccaagaaaaagaatatttatgattggcaaaggttcgctctctagataaraaccaattacagaatctaattggaataaaggaagaagagaaacttcatttttggtgatccacctaagcaaaagttttattctatgtccactgttaactcttcattaaaaaagaaatgtagccaaagagatttccttcctgagaatgtgctggggcatgcatacaggcacacacacacccacacagcagtccacctcttccaaagcaactctgcagaggactcaggtatgtgccacactgacacatatcaaagagaacctggagcaacctctctctctctctgacccccgaggcagtgtct

SEQ ID NO: 185660 - DNA, 601 bp, Human
caaccttatcattctgcctagagtccaacctgactatttttcatgctgtcaatttcccactagacaatccatcaaagcctccagaaatgagtcatgattaaggaagagatttagagtgtcagcacaaccctcaaggcaacccagacttcaatagaaattcctaaagttcaaacctataaacagggtcggtagctaggaagaacaaaggaactaaacatcttattttggtttaaccacttaggtcacatgtcagacatggaaacaggtcagcttcatgaccaaaaacctggatattgcaaayggaaacaaataattagctacatggaacagaaagagcatgacttatatttctggcaaaggtatgcatgtgctgtgataaaaatgagttagaaagcttcttaaccaaacagaaacttaaaatgaccaagaaaaagaatatttatgattggcaaaggttcgctctctagataagaaccaattacagaatctaattggaataaaggaagaagagaaacttcatttttggtgatccacctaagcaaaagttttattctatgtccactgttaactcttcattaaaaaagaaatgtagccaaagaga

SEQ ID NO: 185661 - DNA, 601 bp, Human
actccatctcaaaacaaaaacgaaaacaaaaacaaaccagataataaaacaaaacatacaacaacaacaaaatatataatgcccaaggactagagattttcacttctaggtcacttcatgatctagtcaacacacaccatttttcctaaaagggaatattgtcatttccatggcaataaaatttccctctcatctatagggaactcaaggcctaggtcctagctaatccttcctctgggaaaaaaagcctagaactcaatttgagccatttcttcctaattaacctgcaataggttaatgyattaggtgcatctttaaaattgggtaatttttggaagaacagcagcattcttctcactagtggcactgacagcactcagccaaaagccataaggacaccgtacatcgtatcaccaccactactcaggatgatgaagactcagggtcaggctcacagacagccactcttcacagtgttaatctggtggctgtttgccaggtatcatttaggaaatggagtatcctatgtcccatacagcctgatattctataaagagagactcattctttttaagactttattctctgttgaaatttatag

SEQ ID NO: 185662 - DNA, 601 bp, Human
catgctacaacacagatgaaccttgaaaacacgctaagtgaaaaaagttaggcacaatgtcatgcttacaaaaggccacatatcatgattccttatttatttatttatttattttgagacagagtctctctctgttgcccaggctggagtgcagtgggcacaatctctgctcattgcaacctccgcctcccaggctcaagtgattctcctgcctcagcctcccaagtagccaggattaaaagcacctgccaccacgcctggctaatttttgcattttttataaagatggggtttcacaccrtgttggccaggctggtctcaaactcctgacctcaagtgatccacacacctcagcctcccaaagtgctggaattataagcatgagccaccacgcccagcctccatttatataaaatattcagaattggtgaatttgtaaaaacagaaagtatattaatagttgcctagaggccaagtgcagtggctcgtatctgtaactctagtactttgggaggaggaggcagaaggattgcttgaggccaggagctcaaggccagcctggccaagtaagaccctgtctctatgaaaaacttaaaaatta

SEQ ID NO: 185663 - DNA, 601 bp, Human
gctcaacattgtcagtcattaggccacaataaggtatcacttttcactcagtaagatggctatagtaaaaagacaataagaagtgttatcaaagatgtggaaagtagctgtgcatgatggcacatgcctgtagtcccagctactcaggaggatggggcaggaagatcacttgaggccaggagttcgaggctgtagcatgtgatgttcacacctgtgaacagtcactgcactctcagcttgggcaacatagtgagacgctaccattatttaaaaaaatacacacacacacacacacacacgagcgcacacacatactagcaaagatgtagagaaatcagaagcttcacactactagtagggatgcaaaaggatgtagccactttgaaaaacagtctggcagtcctgaaaatgctaattacagttgtcatatgacacaccaattccactcatacgtatatacccaagagaaatgaaaacatgtccatgcaaaaccttatataccaatattcatagcagcattattcataagtcaaaaggtagaaacaactcaaatgtttatcaactaatgaatgaacaaactgtagtatatccatatattcag

SEQ ID NO: 185664 - DNA, 601 bp, Human
tgctcaacattgtcagtcattaggccacaataaggtatcacttttcactcagtaagatggctatagtaaaaagacaataagaagtgttatcaaagatgtggaaagtagctgtgcatgatggcacatgcctgtagtcccagctactcaggaggatggggcaggaagatcacttgaggccaggagttcgaggctgtagcatgtgatgttcacacctgtgaacagtcactgcactctcagcttgggcaacatagtgagacgctaccattatttaaaaaaatacacacacacacacacacacacrcgcgcacacacatactagcaaagatgtagagaaatcagaagcttcacactactagtagggatgcaaaaggatgtagccactttgaaaaacagtctggcagtcctgaaaatgctaattacagttgtcatatgacacaccaattccactcatacgtatatacccaagagaaatgaaaacatgtccatgcaaaaccttatataccaatattcatagcagcattattcataagtcaaaaggtagaaacaactcaaatgtttatcaactaatgaatgaacaaactgtagtatatccatatattca

SEQ ID NO: 185665 - DNA, 601 bp, Human
ttagaaggaaatacaccaaaacattagcaatcaaaactaaaacaaaactgacatttagtaatatctctctctgttcaaggcaaaaaaaaaaaacctaaaaaacttaggcttaaaaatcggaaaagacctagatgtaaaagctaaaactataaaactctgaaaagaaaaaaggaggcatacatataaagtcaatttctatataccagaaaaaaaaggcatacatctttcatgatcttggattaatgacttcttagatataacaccaaaagcacaaacaacaaaagaaaaaatagattaaacraacttcattaaagcccaattcttcaaaagacatcatcaagaaaataaaaaatatctgaaaagggactcatatctagaatatacaaagaactctgtaaccaaaaaacaatccaatttaaaaataggcaaaaattctgaatagacattttttcaaagaagatatacaagtggtcaatatgcacacaaaaagatgctcaacattgtcagtcattaggccacaataaggtatcacttttcactcagtaagatggctatagtaaaaagacaataagaagtgttatcaaagatgtggaaagtagct

SEQ ID NO: 185666 - DNA, 601 bp, Human
gaagatcgagaccatcctggctaacacggtgaaaccccgtctctactaaaaatacaaaaaattagccaggcctggtggcgggtgcctgtagtcccaactactcgggaggctgaggcaggagaatggcgtgaacccgggaagcggagcttgcagtgagccaagatcacgctactgcactccagcctgggcgacagtgcgagactctgtctcgaaaaaataaaaataaaaataaaaatctgaaaatgcacaatctgtttatactactattcccaaaggttatatactacttctaaaataagayattccactgtgactccctctttcctgtagtaagtgagagttgcttgcatttccaatcaggaagtcagagtcaacaaaacttccatctggttttaaaaagtgtgtgtgtgtgtgtgtgtacacatgtgcacacatatgtctatgcataagagcatgtacacatgtatatgaaaacattagaaggaaatacaccaaaacattagcaatcaaaactaaaacaaaactgacatttagtaatatctctctctgttcaaggcaaaaaaaaaaaacctaaaaaacttaggcttaaaaatcggaaaag

SEQ ID NO: 185667 - DNA, 601 bp, Human
cttcccacctcagccttccaaagtgtggaggttacagtcatgagccaccacacctagccaaggtcaggcaatttaacctagagttcaatttatagatactacaaacaaataaacaaaaaacatgttgggatagcacatccaagttatcataaattctgaatgagtaagtttgtttgagaagattttgatatagatacaaaacacaagtttggttaatgttcacaatgagatttaaaaatctgaaaatgggccaggcactgtggctcacacctgtaatcccagcactttgggaggctgaagygggtggatcacgaggtcagaagatcgagaccatcctggctaacacggtgaaaccccgtctctactaaaaatacaaaaaattagccaggcctggtggcgggtgcctgtagtcccaactactcgggaggctgaggcaggagaatggcgtgaacccgggaagcggagcttgcagtgagccaagatcacgctactgcactccagcctgggcgacagtgcgagactctgtctcgaaaaaataaaaataaaaataaaaatctgaaaatgcacaatctgtttatactactattcccaaaggttatat

SEQ ID NO: 185668 - DNA, 601 bp, Human
aaatccaagaacaacaaaacttcagacagaaatcagaagtgtggttgcatggggtaagggagaagggactgaatggaaagacgcatgaacgacttttctggggtgaaatgttcattatcttaggtggtgattacatgggtgtatacaactgtcaaaactcattgagctgaatatctaaaatctgttccttttaaaaatgttaattatacctaaaaaaccaaatatgtaaatatgtcatattcatacacttattaaaggaaggaaggaaagaggcaagaaagtcactataaagttgaatagkgtcatctagatttattttgacacaatcaatgatttgattcccccaaaaggacatcatagaataaaaggacttggtctaaaaaaatcagaatacttgggttcacatgaaacctccagcatatattagctgtgtaaattggggtaagagagttagcctttttggacttctgtttctcatctacctattttatagagggtgacaataatgcataataatgtactttgaaaattctaggttgacattaaggtactatttttgcccacaatagatatcataatcaaacattcaattatatttgtg

SEQ ID NO: 185669 - DNA, 601 bp, Human
aaatgaaaatattggttgacaaaaagatttgtacaagaatgtttacagcaaccttatttgtaacagacaaaaacccaaacatccatcaagagaaaaatggataaacaaattgtggtaaattcgtacgatgaaatactactcagcaaaatttaaaacaaacacaaacctgatacccacacaaggatgactctctgaaaacatgttaaacaaaagaagccagccatgaaagaatgcatctcgtgcactccatttacatgaaatccaagaacaacaaaacttcagacagaaatcagaagtgtgrttgcatggggtaagggagaagggactgaatggaaagacgcatgaacgacttttctggggtgaaatgttcattatcttaggtggtgattacatgggtgtatacaactgtcaaaactcattgagctgaatatctaaaatctgttccttttaaaaatgttaattatacctaaaaaaccaaatatgtaaatatgtcatattcatacacttattaaaggaaggaaggaaagaggcaagaaagtcactataaagttgaatagggtcatctagatttattttgacacaatcaatgatttgattcccc

SEQ ID NO: 185670 - DNA, 601 bp, Human
aggggctgtatacaggattaggcctattcaaccttctgccctctcaatcctacccctggggcaaggttcacaaagaggttggaggctgggccctgcttgtgccaagtcctttgtttatttccttctttgatctgttgtctcctatagattgaaatgatttccctccaaccacaaaatatccaatctaagcaactcattataaagtcttcccttatcgagactgatgaaaatctaacttcaatttatttaaggtcacatcaactccagatgaacacagtatgtgcgtataaaataaccagayaaacagtaaaagtcacagaactagctgtcactaggactgactcaagaggaacaggaacagacagtgactcagccttgcacaccaccaaccgttcatatttttgtaaagcaataggaaatgctatggttctttctaaaataggatagtgatagtttaaaagaaataaatgcaatgtgctcattgctgagtgatgatatatgcgagggtgttacaaattaacactacatatactcctaactagggtaagggaagtgctatgatccgaatattggtgtttccccacaatgcatatgttggaac

SEQ ID NO: 185671 - DNA, 601 bp, Human
atcacaatgatacacagctatataaatgtaaatggacattgctaaatttggcatcttgctgcttctgttactaatgcttacattagataacataccactctatatcatacctttgctgaatttttttcactcatgaaatcaccaaaattagcttctaattctctaattgcttaaatttcccgcctattttttaaaagagatacaaacattaatactaaaacagacttagatgctttctatttttcagtattctgttgtcatttctttgttctagaactgagtttaaaagatacataaaagrgaacaaatctcattttgaatgagggttacccatatataacagaaatggaaagaataaaaaacttccatttaatcttatatcatatgaattttttaatgagaaaatcaactaaagctgacagcaaaagttagcggggaaaaggatgtaattttgagatgtcaccatgcctccacagtgccaaaggccgaggggctgtatacaggattaggcctattcaaccttctgccctctcaatcctacccctggggcaaggttcacaaagaggttggaggctgggccctgcttgtgccaagtcctttg

SEQ ID NO: 185672 - DNA, 601 bp, Human
gattgctgcatgaaaaattatgttaaaatgataatccaagtaattgctcctgtagctagtattaaagaccaaatcaattgaaaaagtttactacttccctgaaatctcttgtttaaataatggttgcaaagactatcttaaataatggttgcatatctgctttatgttttaactaaagcagatttaaaaatgaatagaaccacaaatttttattctaattcccccaaatttgccactaccagacagtgtcagtccctgggtgccaagtgttaaatgtggacattatgtttaaataaatacwaaggtctttcatgtttgtaatcattagtaaattataacatcctgctgggcaggagtactccaatccgtgtcccccacccccaccccacagctgcctcctcctcttccttctctcttttagaaataattgattgagatttatactcctttaacaatgcttcaaattttttgaagtatacaagtaataggctttctactgaaactttacaaaaatggtacaataaaaagaaataactgactacattttgtttgtgtttgtttgtttgagacagggcctcactctgtcacccaggctggagtg

SEQ ID NO: 185673 - DNA, 601 bp, Human
gagtacaacaccctcaagatcaaagccacattctatattcctgtggtgagtgacagagatttgaatttggataatgagagtatatttgcatctgaaatctgttaactagtagagaaaaaaaaaaaacgtttaacaaaacttctaccaacttcttttttttggtttctgtaagaaagaaaaaaatgtgtgtgactatggatatataaaaataaataaaatatatatctcctttcatgaaatgaaaaatcccatttgtacatcttcaactgtagctgtttatattatgtaatcataaccataytcatataatattcataatgatattcatatcattataatcattgtatataatcacatgtgaaatatgaaatctggggcactgtaattccacaggtatagaacacctaaaaattcacatgcagctttcaatggcacttcagtgctcaacctttgcccacattcctgctcacttatctaaaacccaaagccctcccagacccgcttccaaggggcaggaacatggctcagcccattttcctaattgccttgggactataaatcccccaactacccctattccaatcctgactccttaactcct

SEQ ID NO: 185674 - DNA, 601 bp, Human
tctcctccagttccaattctaaaatgtattatcctaagcaaaactctgatacaggtacatggctacacccacacaaaagggaagaatttagaaagataaatttcagtatcatttcaagacaaaaccagaaaaactcttcaaggcaaagctgagaaatggaacatctagttaccatgagtacaacaccctcaagatcaaagccacattctatattcctgtggtgagtgacagagatttgaatttggataatgagagtatatttgcatctgaaatctgttaactagtagagaaaaaaaaaaaacgtttaacaaaacttctaccaacttcttttttttggtttctgtaagaaagaaaaaaatgtgtgtgactatggatatataaaaataaataaaatatatatctcctttcatgaaatgaaaaatcccatttgtacatcttcaactgtagctgtttatattatgtaatcataaccatactcatataatattcataatgatattcatatcattataatcattgtatataatcacatgtgaaatatgaaatctggggcactgtaattccacaggtatagaacacctaaaaattcacatgcagcttt

SEQ ID NO: 185675 - DNA, 601 bp, Human
ggtttccacattctttcatattttattgagtacattataacctaaacctacccaccttatacagaccaaaaattcccaagtcccggagcacattcagggcgctgactctgggtcccgtggtgatctctccagctacttgcagacgaatcttcactatctccaatgggttggtaaaaatgacctgagagcctccagcctgtaggcaagggagaagagacaggcagattccacatcagagcccgactggcagcgtaaaaaaggaaaatccagcaaagcctccacatcttgctatcttgaaaaraaggaggtgaaacttccttcctcaggggggaatgacagtttgacacttaggccaaccctggagaggttcagagggatggtcccaaactctgtctcagatcaatctacctctgggtttgtttctagctgaaatgtcaagattgtttctcagaccagtctttccaggatcaccccagccatattcaaaataacaaaataaacccatttggaaaaaaaagcggagccagatgtggcagcaaggtactcaatgaaagaaaaagagatagtaaaagactgtcatattttacaagccagagctaaa

SEQ ID NO: 185676 - DNA, 601 bp, Human; identical to SEQ ID NO: 28447

SEQ ID NO: 185677 - DNA, 601 bp, Human
aggtgatcctcccacctcagcctcccgggtagctggctgggactacaggcacgcaccactacacctggctaatgacaaagtgttaacgattagaaaaaatacaaaaattgagttcaaggtggtttgctgaggggtactgcttactttggtctaatgagggcaatggtaggaagaagagggacagcttcacgacaaaagctcaattttcggccaaatcatgtagattccaatatacagaagagagaaagtaagagcatgctagatctgtgcatgagcatgagatacagctaagcaactgatwtgaggaaaaactttcccaccttaatgcttagcttggctgtactcaaggtttcaggggcacaggaaactaagaaacatgttaatgatgaaagcccaatttagatgggcagatctaatttggctctgagttgctaagctgcattaagctgtttatccacattatgcaaatgtaattaactctcatcagaattacagcacatcccacaaaggagaaaaagtgatatttaaactaagtcaggtacaaacaataatacttccagaaataaagggggaaagtacatagagattctgtactttttaa

SEQ ID NO: 185678 - DNA, 601 bp, Human; identical to SEQ ID NO: 28448

SEQ ID NO: 185679 - DNA, 601 bp, Human; identical to SEQ ID NO: 28449

SEQ ID NO: 185680 - DNA, 601 bp, Human; identical to SEQ ID NO: 28450

SEQ ID NO: 185681 - DNA, 601 bp, Human; identical to SEQ ID NO: 28451

SEQ ID NO: 185682 - DNA, 601 bp, Human; identical to SEQ ID NO: 40475

SEQ ID NO: 185683 - DNA, 601 bp, Human; identical to SEQ ID NO: 40476

SEQ ID NO: 185684 - DNA, 601 bp, Human
tatacaatgacaatactctacatataaaataagcggaagcacagtgcctttgtatgcctctgctgtatcttaggctcagtggagaatagcttgggagttgtttggtgtagacaaaagagcatgtgattcaaaaacacaaggcatgggtttgagaccttaatccatcacttaccagatgtacaaccttgggtgagttgcttaaccttcctgggttacttctttacctgtgaaatggggtcatggctcctgtctcaaaattgttttaaagtttgattgagattataattgtaaaagcaccttrtaaactcacttctctgctgttgaccaaatattctggttaatacaaggttaattcatgttgaattactggctatggaataatgagtctacaataatactaaaaatatctaaatgctctagagttgtttgatgagaacctctttcaggaagctggagagagcttagaaggtaggttcttaggtctccacgtcttttttaactagatataactgcaataaacttgatcccttagaaatattctgacctttttcagcctcactttaaaagaagaacagcttcccacccatggaatttttttttt

SEQ ID NO: 185685 - DNA, 601 bp, Human
ggccaggcgattagaaaaagtcagtgggtttcaactcagtgtggaagacttctgggtttgggatttcagaggcagactgctcacccactctctgaactctgacctcctcttctgtccaataggaatgtggccagagcagcaagattcaagccataatccctcaaggtgcttcagggtaaccaagaaggatgagcaagcaaaaccaccttcagctagagcagctcacttctgtctcttctctacgttgggcctaactgaagattttcaagaagaaaatgtgggccgggtgcagtggctcacktctgtaacccactttgggaggccgaggtgggaggatcacgaggtcaggaggtcgagaccatcctggccaacatggtgaaaccccgtctctgctaaaatacaaaaaattagtcaggcatggtggcatgtgcctgtcgtcccagctgctcaggaggctgaggcaggggaatcacttgaacccgggaggtggagtttgcactgagccgagatcccgccactgcactccagcctggcaacagagcaagattccgtttcaaaaaaaaaaaaaaaagaagaagaagaagaaaacgtgtactgggga

SEQ ID NO: 185686 - DNA, 601 bp, Human
tttggacatgttgatcatggggttggatcatgatttctaaggtcttagatgcacagaacatcaaggcaaagtagaccttagagaccatctggtttaaccgtttgtatttgaaagaggaggaaacagagtccattttaggtgcagtcatctgcccaaggttaatgagtatagaatgacacccaggacccaggctgcctgactccctgactagtatctgtgctttgcctcttgcctgcagcattaaccagccttgattcgtatgcctcatccgtacactacaggaatctaaacattgcagccmcatgccaaggaagcagatgctgctgtgcagatgtgcatgagtcttgaagaccaagaactgtgggaaatcaggcaggagaggaattttcataaatgtgagcatccggaccacagacttgggagtcctgctcttcttcaggctactgatgagcagtatgagcagttccatcatcatcgcccctatgggcctgggtgggaagggcagcttgtggggttgggctgggctggaaaatgttcctgtgagttggaaggtttcttaaacctactcctatgtaggcctgggaggagaatttagtcatag

SEQ ID NO: 185687 - DNA, 601 bp, Human
tggggagcacatgcttaaacccaaatttaccaaacatttctcagttgaccctcagataacctttctgggctttacatctccccaaaacatgccaactctgattattctcagttttgcatcattcccatcctcttcaacctccctgctttgatggtagctctgctaagaaatcctacttagagaactgcactgccaaattattatttacctctaaagactaatctcaaacatcaactatttccaaagccctccctggccatctaaaaatgaccactcccaaacttatatactgactgataayccttgtgttactttgtctggctttattatgcacttatttcattatattctatggaaccgtgaattccttgaggactttatagttcattttactgcgaagaattctttttactgatctttgcagacccagtctttggcatagtgtccagcttatggtagattttcaataggattactgtgcttcattccatagacaatggggaggcattgaaagatttttagagtagcataatcaaagctatgttccaagaagatccttctggatactcatagaaggtaggctagatggggagaggctgac

SEQ ID NO: 185688 - DNA, 601 bp, Human
ccaaggtgttttcaacagcaacctgtaatatactcaagcacagagatatgcaccccatgtgcacccacacctgggaccttcccagctcacactcacccacatgctcttcctcagcactgcgagcttccttttgttttccatcaccctgaagcctgtgctgtttgcacttttggcataaaatgagctttcattacactttcctgaagcaagctcattttcattttctaattcttctgaataagctagaattggtgtttgggtcctggtgtctctggagtgggagaattccaccggagactamaattgaaattcatgagaaatgtttacccatttctcatttccttctggggccaaggcctcctgtccactcccagagaatgagcagagttatgcagtaggtgaaatgagttcagccggaaggtcgagggcatgttctaagtaaacacagagcattgcacagaaattaggagcttaggggtcagaagagtcccacttgggagcgacttacctctcaattacacagcaggatgcagactgacccaatgtggcctgagggaaggggcattggactgggagtcacagaccatcagaactggaaggg

SEQ ID NO: 185689 - DNA, 601 bp, Human
cttttgtgaggactcacaacccaggctgatagagctggaagggcacctagagagacctcccagcccagcctcctcctctggcaggtggcatattagctgtttggctctttgcactttacaaagccttctaacagtcctggggctgagagacatcaaaagggtactcttaagttatgaaagacgatcagagcaaagtgagggatctctaaaggcttctgtccacaagaagatggcattaagtctaggaatttctctctttactttgctgtgcttcaaaagattttcctagatgcgtgagccrtaggccaatgattcaccgacagccccgggctgactcctgctcattgtgcgagctcggtactcctgagctcaccttcacggaaagtccatcactcccagctgctgggccagtggttaatggcccagtcctgctacttcaccaggtagctttaatttcagtcagtgatctgagtagaagcaagttaaaggcacctgataccagatagaaacttgggtctagaaacgaaggaggcatctggtatgtgtttgcatgtgtgtgctgcacttcagaaactcttgaaagccatgtaaagtaaaaata

SEQ ID NO: 185690 - DNA, 601 bp, Human
caacttaaacagccacctagtttgtggacatttattacagaagtcctaggaaactaatattctctgtatatagtttttctcatatgtaaaatagtgaaaataatcctatttatattacagaactgttgtaaataggatgggaggtgatatacataaaacactcagaaaagtgcccgggatacgttgagcactcagtacatcaatgagaaaaacaggactgctgagatccatccaccaactgagatgacacgttctggctcccagctagtggggcaagggtcacttcatgcatttggagaayattaagaagctgagattgtccctggatactatttctccatttcactcctttcctaatctcgctgaagccatcagcagtggtttccccttttgtgaggactcacaacccaggctgatagagctggaagggcacctagagagacctcccagcccagcctcctcctctggcaggtggcatattagctgtttggctctttgcactttacaaagccttctaacagtcctggggctgagagacatcaaaagggtactcttaagttatgaaagacgatcagagcaaagtgagggatctctaaaggct

SEQ ID NO: 185691 - DNA, 601 bp, Human
ttcaaaatgaaaagaggctcctgagcctcaggtttctatgtacagaaagcgaactgaatagactactcagctacaaacatgggccatttcttacagaaaggaaagaatgtctcagaagacaaagctaagaagccagaggcagagtcaagatcagaggcaagagccactctcaccactcccagagagcaatggactggggatccactctcacccctccaaggaagcagaactgggctctaatcaaggaacattcttggtatctggagttggcaacatgtgcctggctaaatttcagaattastatggagcagtaattgctatatgcctctcattttttccatttttcaatggaaattctattgtggttatcttattcttctctcaccaagacaaggagatattgagcatgtggagagcaaataacttttcttttgggttcagagatctctagatcaagaagagatatacttcaagagctatacctttgtgtgtcatctaattctagacatgatttagatcatgaggtcctggagttcaagcctgaacggctaatgggataaaactttgagagaaggggcaaaagcacatttcacatatgcaa

SEQ ID NO: 185692 - DNA, 601 bp, Human
tgacatttgacactcctgttttgaaactaatggtttatttatttaaaataagtgggagtttcaaagaaaaacaatttgccctggcaacaaaacgcaagtacaattaatcactaactttgggaattgaagtgtaaacagaagatgagatcatggctttgctatttattcctcttctctgcagataccagccgaactcacaccagtcttgttactatagaatgtgcctatctgcacacagctgaaatgtcacttccttgaacctcccagctgctgtgttattttatctgactcagttttccaratagccaaagctttacctaactataactaaaaattttctttttggtgtaacacttaaaaaaaaaaaagtactttaaagaagtacccactttctcaagtgaaacatgctaaccctttcttggtgatccagggacattgttatgaatgtcaaccattgtgatactatattaaagtgataatcttggggatattgagttgtgtaatgtcgcttgacctggcgttaaacattgccggactataaagccttgaacttctgaagtcttctttatgtcatgttttatttcctgtctttttatcagcc

SEQ ID NO: 185693 - DNA, 601 bp, Human
ttaagcaggaaagtcatgtaatgaaaactaatgtttaataggcagtcttaatacagaaactatttattggaatcacccaaaaatagtttgagtgtgtatctctgtgtgtacatgtttgtgttaagacttagatgcaaaaaacatgcctgtttgctaaaagaattcccttctttggaagagccagaggccctgtgcgaattcagagatccaagcagagatcctaaactggtggcttaaagctgattttatgtgagacaggagtttgggaagcttcgtatgatagctagttggtatatttatytgagtataaattcttgacgtatctattcgattatcttatacctaatccaattcttttaagttgtatttgtgtttgcaacctctggaccaaattttagccaagatgcatgaaaaaaatctcttaccaagaatgattcctgctgcctttcaaagtcattagagaaaagttctcaaaggcggctatctctagtagcttctaatgaattcattgttttgttcgttagcttagcatgtcagaaatatcttgacatttgacactcctgttttgaaactaatggtttatttatttaaaataagtggg

SEQ ID NO: 185694 - DNA, 601 bp, Human
ggcacataatagttatccaataaacatttgtttacaagaactgaaagtacaagccccattctgtgaacagtgagtagccagggagtctgtggggattgtaggaggagatgtacttggaaggatacatggaaagaaaattatggttgaccttgaatgccattaattctgtgagtaagtggaagacactgaaaacttttaagcaggaaagtcatgtaatgaaaactaatgtttaataggcagtcttaatacagaaactatttattggaatcacccaaaaatagtttgagtgtgtatctctgtktgtacatgtttgtgttaagacttagatgcaaaaaacatgcctgtttgctaaaagaattcccttctttggaagagccagaggccctgtgcgaattcagagatccaagcagagatcctaaactggtggcttaaagctgattttatgtgagacaggagtttgggaagcttcgtatgatagctagttggtatatttatttgagtataaattcttgacgtatctattcgattatcttatacctaatccaattcttttaagttgtatttgtgtttgcaacctctggaccaaattttagccaagatg

SEQ ID NO: 185695 - DNA, 601 bp, Human
ttaaaaagttagataacctcgcagacagattctctgcacaacaggaacttaccacatttccaaagaatggaaactgtatacacaatataagtcattcattgagtatccagtgtgtgcctactgccgagcaaagcatgagatggaggtgatgagagatagacacagtgctgtgcacacaatagcagtgttgagattgaggaacacagacacaggcaggtattacacagtgtgacaaatgctttcacacaagcagaagcactgcatatgcactcaaagcaggcaaacaatccacattagaatrtaagctacaggagagaaggactttattttctttatagatgtgtcttcagtgcatggaacaggacctggcacataatagttatccaataaacatttgtttacaagaactgaaagtacaagccccattctgtgaacagtgagtagccagggagtctgtggggattgtaggaggagatgtacttggaaggatacatggaaagaaaattatggttgaccttgaatgccattaattctgtgagtaagtggaagacactgaaaacttttaagcaggaaagtcatgtaatgaaaactaatgtttaat

SEQ ID NO: 185696 - DNA, 601 bp, Human; identical to SEQ ID NO: 23521

SEQ ID NO: 185697 - DNA, 601 bp, Human; identical to SEQ ID NO: 23522

SEQ ID NO: 185698 - DNA, 601 bp, Human; identical to SEQ ID NO: 23523

SEQ ID NO: 185699 - DNA, 601 bp, Human; identical to SEQ ID NO: 23524

SEQ ID NO: 185700 - DNA, 601 bp, Human; identical to SEQ ID NO: 23525

SEQ ID NO: 185701 - DNA, 601 bp, Human; identical to SEQ ID NO: 23526

SEQ ID NO: 185702 - DNA, 601 bp, Human; identical to SEQ ID NO: 23527

SEQ ID NO: 185703 - DNA, 601 bp, Human; identical to SEQ ID NO: 23528

SEQ ID NO: 185704 - DNA, 601 bp, Human; identical to SEQ ID NO: 23529

SEQ ID NO: 185705 - DNA, 601 bp, Human; identical to SEQ ID NO: 23530

SEQ ID NO: 185706 - DNA, 601 bp, Human; identical to SEQ ID NO: 23531

SEQ ID NO: 185707 - DNA, 601 bp, Human
atgtctttatcagcagtgtgagaacagactaatataccaaccgtgtactagtataccttctttatactgtatactgtagggttactgaaatgtaccattaatataatacactatgtcagtttacccaacactctcattcagcaaaatacaaatatcacccaatgcttaaccatattgcaaatttcctgctgtttgtgcaaacatgcagatggaattagacaaggcatttaattttcagtattcctcaatgctgtcttgagtgattgtatcattaaactactgccattcttgcttttttttwaaaaaaatgtaaattactatgttgtgaatattaaatttaactttttgtggattatttgtttaaccgtagagtgtgcattttggggctacacttttctaagttgacttgaatagctatacatgtgattgcaatgcaaatcacccatactatttatttatttatttttcaagacagagtctagctctggcacccaggctggagtgcaatggtgcaatctcagctcactgtagcctctgccccctgggttcaagcaattctcctctctcagcctcctgagtagctgggattacagatgcacac

SEQ ID NO: 185708 - DNA, 601 bp, Human
tcttctctgaggcttcactgcctggagtccttggttgtacttctgggcaagcctaattgaggtaaatggaatcagcggaatgggtgggatgaacattcccttattccacatcctcataagtttttctcagaaataaagacctcttatgtgaacccttcctagtcagttcttaccccttcattcatagacaaccaggcattgttacttccttcttctctgggatcccatagcacctgtgatggtcaaaacctgactcccaaatgctaacatgttcttcgcttcttaaggatgaatggtagayaactccatagcctttccattttagtgtctaatctgatatctagaaacctcctgatatggtttggctatgtcccaaactggctatgtctcatttctctcttgcctgccaccgtgtaagatgtgcctttcaccttccgccatgattgtgaggcccctccagccatgtggaactgtgaatcctataacctctttttctgtgtaaattacccagtcttgggttatgtctttatcagcagtgtgagaacagactaatataccaaccgtgtactagtataccttctttatactgtatactgtaggg

SEQ ID NO: 185709 - DNA, 601 bp, Human
tctccatcctggcctgcatcctggttcaatcacagtgttttgcgaagagagaatttacaaatttctggcctagtccaatgatacaccatggttctgcccaacattgggtgttaaaagaatgtcatgactcattgtatccaagatgctttgtacaaacatagaggatgatgaccattaaaagtcatagaatagctgggtgcatggctcatgcctgtaatcccagcactttgggaagctgaggtgggcggatcacctgaggtggggagttcgagaccagcctgaccaacatagagaaaccccrtctctactaaaaattaaaaaaaaaaaaaaaaaaagtcaggcatggtggtgcatgcctataatcccaactactcgagaggctgaggcaagagaattgcttgaacccaggaggcagagattgcagtgagctgagatcgcaccattgcacgcagcctgggcaacaagagcgaaactctgtctcaaaaaaaaggtcagaatatcataggtctcttggttctgatgctttacttctgaggtatgggatcccagacccagagatatgaaaatacttaccaaagatcacagttaggaaatggcagca

SEQ ID NO: 185710 - DNA, 601 bp, Human
agagaggggcttggctatgagccatctcccaaaacctgaatgctcttctcctagaggaaggattaggccaaggctagtcccagaaggcagagcaggaaaatatacagatgcagcattcagttcaatgttagaaaccattttctaatagtcaggtccaagctcagttataccaacagtaggaccgatgggtttgataagtggtcaggagtgaataaaggccactggggtaagaagcatggcctggaaaggagtgctgggattggcacagaggccttggttgagctcctgcattgtattactsggtagagtgaggcccagacagggaaagagacttggacaagctcaggaacacaggtctcctgcctggagccttttccctataccacactctgcctctcagggtcctgggggctgtctcggtaggagaagccaccgctaggtcagtgtgttccattccatatggtctgataagtaatgtggagtgtgctgtcggaagtgcggtgtagcttcgctcaggggaggcaggccccgaggaagtaagtcagctcaccgttccacctggggctccacaacactttgtggtaagcccatctgctcccac

SEQ ID NO: 185711 - DNA, 601 bp, Human
agccagttgggggcagagcagggactagaacccaggactcctggctcttttcactgcctgccatgggtgagcctctgattcctttgactctgaaaaatgaaggagtgggtccctctgaacatcctgcggggtggattctccgcccagctcatgccccagggatgccaggcagcctggcaggatttgggtgacttctaatgtgcccaccccactctttcttccattttcctgcccaaaagcacagcaggacacagtgtgggtcttttctttttccaggtaatcgactaagtccccatattcrggcctgggcttcaggtagcctttcagataatacatttcaaggctgaaagattgctttgtgcttgtctggagcagcaggtgtggacgcccatggtgtcagctggtgttccagggtggcatatgggcccaaatgtgttctgagttgacaatgggaatttaagggcttggtgggcctcccacggctattctgctcccagcagtcagcacaaaccttcccaactttctccatgtcttttgaaattcctttaatggggaacataagggataaggcttagactgcaagaagcttttgggagagaaa

SEQ ID NO: 185712 - DNA, 601 bp, Human
agctccagggagaaggagaacaatcagccctgtgagggccagagaggctgctagcagtcagggaagctctgagtgctccagctagaaggaacctgcaggggaccttatgccagcctgttgctgacggagaaccagagactcagacaaagaaaatgatttttcaaaggttatacagccagttgggggcagagcagggactagaacccaggactcctggctcttttcactgcctgccatgggtgagcctctgattcctttgactctgaaaaatgaaggagtgggtccctctgaacatcctgcrgggtggattctccgcccagctcatgccccagggatgccaggcagcctggcaggatttgggtgacttctaatgtgcccaccccactctttcttccattttcctgcccaaaagcacagcaggacacagtgtgggtcttttctttttccaggtaatcgactaagtccccatattcgggcctgggcttcaggtagcctttcagataatacatttcaaggctgaaagattgctttgtgcttgtctggagcagcaggtgtggacgcccatggtgtcagctggtgttccagggtggcatatgggccc

SEQ ID NO: 185713 - DNA, 601 bp, Human
catgtcacaaagtgctctctatgtacctcaatatgtcacaacctcagtacctcagtacctcaatacctcagtacctcaatatgtcacaacataaagtccaagtatcaaaagaaaaacaaaaattggaaatgtaatagaacatgagacacgatagtccttcaaaccataaagtgcaaagcgtaaataagctcttattttcattctcaatagtgtaaaaaggatggcattttcattatggtacaaaccaaaaacaaaggcgaaccatgagtgcgtcccatggtgagacttcactatcacgtgycactcatgcttgaacttatcaagagatgcctataggccaagccctgctgtatgtaccacttaaatcgatttaaactgcccctcctcctgtctgcactgtcacagccctatgggtggtgggtctgcaccatccctcatcaggacagttgcagaagttgcataactgctttcctagctcagccccttcctgtccactttccacaccatgctgcccaccctcagacatactgaattcaaattttccagtgggtgagacccagccatctgcatttttcaccagcaccccaagtgattctcatat

SEQ ID NO: 185714 - DNA, 601 bp, Human
ctgctaatgtctgaatcaatcacatccttgttgcctcccttttcttcaaccccatgttcaatcagtcgctgagctgctggtaaatccctaggagaaggagagtgatgtgtctccccgactccatgtcacaaagtgctctctatgtacctcaatatgtcacaacctcagtacctcagtacctcaatacctcagtacctcaatatgtcacaacataaagtccaagtatcaaaagaaaaacaaaaattggaaatgtaatagaacatgagacacgatagtccttcaaaccataaagtgcaaagcrtaaataagctcttattttcattctcaatagtgtaaaaaggatggcattttcattatggtacaaaccaaaaacaaaggcgaaccatgagtgcgtcccatggtgagacttcactatcacgtgccactcatgcttgaacttatcaagagatgcctataggccaagccctgctgtatgtaccacttaaatcgatttaaactgcccctcctcctgtctgcactgtcacagccctatgggtggtgggtctgcaccatccctcatcaggacagttgcagaagttgcataactgctttcctagctcag

SEQ ID NO: 185715 - DNA, 601 bp, Human
agcccttcctcagggccttgtggagttgaagatcccctccaccacagtgtctgcctgctccatcccattttccactggcttggattgacagacacgctcccacatacacactttacaactgaatagccctcggagaccatctggtctatacttttcatcattcagctaaagaaaccaaggcctggagaaggaaattgacttccaaaaggtattccatgagttagtagcaagactatagttctaggtctcctgactcccaattctgggcttttcttactctggccagccccataaacttttrattatgtggcttcccagaacactcataacccaagcccctggatccaggcagtcacctgctacctttgtagctgtcaccaggctggagaatatcacagataaatgctctgcatccacaaccttgatgcagcctcagcatctcccagcatcattccacatgcccacagccagcttccccaagctaatgccctgcctccattcccaacagacgctcagagcccaatgagtgggaactccctgagtgggaaccccactgaatgggaaccatcctcctcaccatctcttcttcctataaacttta

SEQ ID NO: 185716 - DNA, 601 bp, Human
tgcccattcaggtgtgacagcatggcaatccagggagtggtgcctttctgggctgggcgtccattgaagatcctggccatcagcttccgggagaacttggggagcccacacactgcatccaagggagggagggagagacagatcagactctgggctccatcttgcccactgccagagctcccagctcctcaccctgttaggaacatctattatttttgctcctccaccattaattgaccttcctgataatagcatcccagtctttctttggaggctgcactttccttattcttagtctatscagctagagttggattgacctcacctctggtttcagggataggaatgtgactgatcaaagccatgcactttctggtcacagcaattgctcagagatgggaatgtgaccttggctggaccaatgaaagcattacttgagaatttcgctaaacatattacagaagagaaagtcattccctactggaattgccaagctattagccataagcccagatctgccaacaatcacttcattaagagtctgctgagaatgatgaagaaaagtggagctgaaagttgagggacaaagagacagagagat

SEQ ID NO: 185717 - DNA, 601 bp, Human; identical to SEQ ID NO: 23532

SEQ ID NO: 185718 - DNA, 601 bp, Human; identical to SEQ ID NO: 23533

SEQ ID NO: 185719 - DNA, 601 bp, Human; identical to SEQ ID NO: 23534

SEQ ID NO: 185720 - DNA, 601 bp, Human; identical to SEQ ID NO: 23535

SEQ ID NO: 185721 - DNA, 601 bp, Human; identical to SEQ ID NO: 29453

SEQ ID NO: 185722 - DNA, 601 bp, Human
tcttcaaaaagccttaatgaggatacattgcctcatagttttgaatctcattctgatatacctcaaatttttgtctttgtaatttttaaggaaatttaatgttaagattagattatattaacattgttccgttctagaaagtgttttaaagcaactaaagtgtaaagtagcgtaagatacttatcaaattggtgatctagagggcatttcaaaaatcgcactgaggcaatgtgcacacaattaaaaggtttcttaagtaggatatgatgtagggagagccttgggctttcgggtcagtccstttaaatcctgggtaagtgaatctaagtctgtcaacctcatctattaaacgggagtagtgaaaaacctacctcttttggttgtccttaggattccagtgaggtgatcgaacattgtcttgagcgttcaagtgctcaaggaatgttagtttccttccattcaacaaatatttgagtacctactatgtgcccggctttgactgagacctataaataccagaatgagcaagactgatggacgtcctgcctccttagtttcttgcattcctcagggataagtttatgggcaagctcatgacaac

SEQ ID NO: 185723 - DNA, 601 bp, Human
aatttatcttggaagtggtagtatcactgaattattaagaatgttccttgttcatgagatgttcttggcttttgaattaaatatacctaggtttgaatggagtcactggatgtgcttactctgtgtttaattcaatgaaacaaggacaatagtatctatgtcataagatggctttttgagttgtgtgttaacattttgatagtgcatggttcatagtagacagtcaatgagtatcagttctcctcttttattaatcacaaaaggaagttttctgcagaatgaggatattcttgattgctarggagagaattctattctgtaatcactaaaagacccagtttctattttttattgggaaaaaaaaaacaacctttaaattttacctccagttagcattgaagttattcaagttggcaaatatttataaaacaatgacactaacaatatttggaaaggtgatggctgtggttactagggcagtttatgaaatttattctcaacttttattcatgtatatcctaaaactgacagtcccaaatggtaaatatcatttttcttcacaacatactgatagagtatctccttgattctatttccttcc

SEQ ID NO: 185724 - DNA, 601 bp, Human
acagaagtatttaaataactcgagtacaatttttaatattctggttctttttttttttttttttttttttttttttttaacagtcactgttcttttcatcctgtcaattagtaggccacttccaggttaggcattcagtaaatctttcagcttatatggagagacagcctccatatgtacaaaactacttgagtattgctaaggtaacattttagagccctgtctttgtaccttaatagcctacaagccccttctgaccctagaaatagaaaagactagtgtgcgttttgcctttccttaraagaaattggcaatgatgcctttacagagcaatcaagatcagatactatgagagttaagtatgtttttctggctttctgattttgttttgttcttattttttatgtgtttgtttggaactttcgtattgaggtatagcatacaaacagtacatacagtcaagtatgtggtgttactactcagattgagatattagatcttagctctctaatgcttcagtataccctatcagagatgaccatttttttttactatataatttttaacctattcaatgtaatattttattaggtaaaaagct

SEQ ID NO: 185725 - DNA, 601 bp, Human
atgtacaaaactacttgagtattgctaaggtaacattttagagccctgtctttgtaccttaatagcctacaagccccttctgaccctagaaatagaaaagactagtgtgcgttttgcctttccttagaagaaattggcaatgatgcctttacagagcaatcaagatcagatactatgagagttaagtatgtttttctggctttctgattttgttttgttcttattttttatgtgtttgtttggaactttcgtattgaggtatagcatacaaacagtacatacagtcaagtatgtggtgttmctactcagattgagatattagatcttagctctctaatgcttcagtataccctatcagagatgaccatttttttttactatataatttttaacctattcaatgtaatattttattaggtaaaaagctgcttttttcaagactttaggagtcttgaatccccatgaaatgcatttttaaaaagcatgggctgggcatggtagctcacacctgtaatcccagcactttgggaggctgaggcaggcagatcacttgaggccaggagttcgagaccagcctagccaacatggcgaaaccccgtct

SEQ ID NO: 185726 - DNA, 601 bp, Human
tgtttggaactttcgtattgaggtatagcatacaaacagtacatacagtcaagtatgtggtgttactactcagattgagatattagatcttagctctctaatgcttcagtataccctatcagagatgaccatttttttttactatataatttttaacctattcaatgtaatattttattaggtaaaaagctgcttttttcaagactttaggagtcttgaatccccatgaaatgcatttttaaaaagcatgggctgggcatggtagctcacacctgtaatcccagcactttgggaggctgargcaggcagatcacttgaggccaggagttcgagaccagcctagccaacatggcgaaaccccgtctctagtaaaaatacaaaaattagcgggtgtggtggcatgtgccagtagtctcagatttgggggtggctgaggcacgagaatagcttgaacccaggagacagaggttgcagtgagccaagattgtactgctacactccagcctgggtgacacagcaagactctatctcaattaaaaaaaaaaaaaaaaaaagtatgttatagtacagggatggtgtatttatccaggatgattttact

SEQ ID NO: 185727 - DNA, 601 bp, Human
taatttttaacctattcaatgtaatattttattaggtaaaaagctgcttttttcaagactttaggagtcttgaatccccatgaaatgcatttttaaaaagcatgggctgggcatggtagctcacacctgtaatcccagcactttgggaggctgaggcaggcagatcacttgaggccaggagttcgagaccagcctagccaacatggcgaaaccccgtctctagtaaaaatacaaaaattagcgggtgtggtggcatgtgccagtagtctcagatttgggggtggctgaggcacgagaatarcttgaacccaggagacagaggttgcagtgagccaagattgtactgctacactccagcctgggtgacacagcaagactctatctcaattaaaaaaaaaaaaaaaaaaagtatgttatagtacagggatggtgtatttatccaggatgattttactccttatgtttctaaatgttattgcttatcttatgctcatgtaaggtaattaaaaaactaattaacatttcaattttaaaaaggtatatagctgtccctttaatgtggtcacatgataattattacttaagttaggttttatccgct

SEQ ID NO: 185728 - DNA, 601 bp, Human; identical to SEQ ID NO: 29454

SEQ ID NO: 185729 - DNA, 601 bp, Human; identical to SEQ ID NO: 29455

SEQ ID NO: 185730 - DNA, 601 bp, Human; identical to SEQ ID NO: 29456

SEQ ID NO: 185731 - DNA, 601 bp, Human; identical to SEQ ID NO: 29457

SEQ ID NO: 185732 - DNA, 601 bp, Human; identical to SEQ ID NO: 29458

SEQ ID NO: 185733 - DNA, 601 bp, Human; identical to SEQ ID NO: 29459

SEQ ID NO: 185734 - DNA, 601 bp, Human; identical to SEQ ID NO: 29460

SEQ ID NO: 185735 - DNA, 601 bp, Human
gtttttgtaatggatctttcataaatgaaagctaatatgtctaaagaatcataattttagctaacatagatggcaatatagctaatttgacattcacattttataaacaagccatatagctcatattgatttttataaagagtaataggatgttttagacaacaaaatgcaattctggtaatagaagacaccaggtgtcgaagaaggacagtaataacaaaatgcatctgcagtctaaaatactaatcactttcaagatcacagaatcgttctctgtatctagcaatagtagcagggacctttttttttttttttcaaataagctctttttaaaaaaagtgtgctctgatacttttgaatatttgaaagcaaaaccttaaaaatggaatcgattacttaaacgattcttttcccaataatgctggtttcaaacgcaatcactatctccaaagtgctgctttctgtaaaacacataggaagaagaggtaccaaagggctgcgtgccaggctgtcagtgatctcacatcctatttatgcccaagaagcagctattaggaccgtctactagagtctgcgagggaacaaagagcagtatattgga

SEQ ID NO: 185736 - DNA, 601 bp, Human
ccaacaattctgtcataaaaaaaaagaaaaatatcaatttgtgcaaggaaaaccttagtttttgtaatggatctttcataaatgaaagctaatatgtctaaagaatcataattttagctaacatagatggcaatatagctaatttgacattcacattttataaacaagccatatagctcatattgatttttataaagagtaataggatgttttagacaacaaaatgcaattctggtaatagaagacaccaggtgtcgaagaaggacagtaataacaaaatgcatctgcagtctaaaatackaatcactttcaagatcacagaatcgttctctgtatctagcaatagtagcagggacctttttttttttttttcaaataagctctttttaaaaaaagtgtgctctgatacttttgaatatttgaaagcaaaaccttaaaaatggaatcgattacttaaacgattcttttcccaataatgctggtttcaaacgcaatcactatctccaaagtgctgctttctgtaaaacacataggaagaagaggtaccaaagggctgcgtgccaggctgtcagtgatctcacatcctatttatgcccaagaa

SEQ ID NO: 185737 - DNA, 601 bp, Human
aaaaaaaaaaacaccatgaagtatttttaaaatgtcactttacagaaacagcatgtgccattctgacattacaatggtggagttggtaggtgtacccaggccaagcagtgggactggacacaaggttggtggcccaaaaagagtgctgaatttttgctgcacatgcttaaaaatgcagagagtaatgctgaacttaagagtttagatgtagattctctggtcattgagcatctccaagtgaacaaagcacctacgatgtgccaacggacctacagagctcatggtcggattaactcacacrtgatctctccctgccacatcgaaatgatctttagtgaaaaggaacaaattgttcctaaaccagaagaggcggttgcccagaagaaaaagatatcccagaagaaactgaagaaacaaaaacttatggcacaggagtaaattcagcactaaaataaatgcaattaaaagtgaaaaaaaatgttttctcaagagcaatacaaaaaagttaaacacataaggcatgtgatcacagtcaagagaagtctcaatcacctctaaatagatcatctacagcaggatcacctatggggtgggtaaggtg

SEQ ID NO: 185738 - DNA, 601 bp, Human
aaaaaaaaaaaaaacaccatgaagtatttttaaaatgtcactttacagaaacagcatgtgccattctgacattacaatggtggagttggtaggtgtacccaggccaagcagtgggactggacacaaggttggtggcccaaaaagagtgctgaatttttgctgcacatgcttaaaaatgcagagagtaatgctgaacttaagagtttagatgtagattctctggtcattgagcatctccaagtgaacaaagcacctacgatgtgccaacggacctacagagctcatggtcggattaactcayacgtgatctctccctgccacatcgaaatgatctttagtgaaaaggaacaaattgttcctaaaccagaagaggcggttgcccagaagaaaaagatatcccagaagaaactgaagaaacaaaaacttatggcacaggagtaaattcagcactaaaataaatgcaattaaaagtgaaaaaaaatgttttctcaagagcaatacaaaaaagttaaacacataaggcatgtgatcacagtcaagagaagtctcaatcacctctaaatagatcatctacagcaggatcacctatggggtgggtaag

SEQ ID NO: 185739 - DNA, 601 bp, Human
cccaaactcctgacctcaagtgatctgcctgcctgcctcagccgcccaaagtgctgagattagagacctgagccacagtgcccggccagatcctcctcctcctctacttacttactttgttaaatatgctagcctggaaaagtttactttgaatttatgttctaaaaaatttttttaacaaagtaattttaattctgatatttaacttgataggcactctgtgtatccaaatgtaaagacatcatacagaataattctatgccattataaagcttaaacacaactggcgaaaaaaatgctkttccccattttatatcaaaaagagatactttagtttggactcctaaagaatgaaagtactcagaaaagtgtaaggactttgtttttctagaaatattaagcaacataaacactggggacagaactttatgcgtcaaaagttttgttctagaattaaggagtgaagtcaatatgtcattttgtggtatagcctatttaagactatatatacactaaaacctgtaattaataacattaccattgaatcaataaaaatgtcagtacctgagctatttgaatgaatgtttcctgagaatactga

SEQ ID NO: 185740 - DNA, 601 bp, Human
gtaacgttgattggttttgctttggtaacattttctggagatgttgaaaggagctgcatacaataaactttattcaaatttttttttttctgttgcagatccgtggccgttcacatggtttcaaggcacaatgagactcactggcccttggaaactttggctttggatgtcaatatttctgcttcctgcttccacttccgtgaccgttagggacaagacaggtatccaggccaactctttgcctaatcaccaaatgttatttatagcctttaagtcattaaaacaaatcttgttaagattsaaaaggccatagattaatgtactataacagaataaattacaattcattgctttcttccattgatcttcccatgatgcacaataggaattcctaaaattacctcatttttttcatacgcatagtatattagtctatgtttcctttcatcttcaatatttacaagtatacatacatgcatgtgtgcctctgtgtgtatatatgacattatgtatctttccctttcctcttcaataattattcaagttataagtatggaaactcattactaattaggattaacaaggacatatctaatcttaa

SEQ ID NO: 185741 - DNA, 601 bp, Human
ttttttttctgttgcagatccgtggccgttcacatggtttcaaggcacaatgagactcactggcccttggaaactttggctttggatgtcaatatttctgcttcctgcttccacttccgtgaccgttagggacaagacaggtatccaggccaactctttgcctaatcaccaaatgttatttatagcctttaagtcattaaaacaaatcttgttaagattgaaaaggccatagattaatgtactataacagaataaattacaattcattgctttcttccattgatcttcccatgatgcacawtaggaattcctaaaattacctcatttttttcatacgcatagtatattagtctatgtttcctttcatcttcaatatttacaagtatacatacatgcatgtgtgcctctgtgtgtatatatgacattatgtatctttccctttcctcttcaataattattcaagttataagtatggaaactcattactaattaggattaacaaggacatatctaatcttaattaggaaaaagtgaaaaatcggataggaggtataaaaggaaatgtagtttaattatatgttcattttgtagtatctcagat

SEQ ID NO: 185742 - DNA, 601 bp, Human
aatctgatttctaagcctgcaaggtcaaaggctagaccttggacactggtaaattcaccaaagcaataaatcctgtcctatgagacctcttggaagatggtcaacctttgccatgtaggacccttcccggatatcaggtggacaggcaggcttctgaatgtatgcccctcattacctcttggtagccttatgtcacagttaattgaatattgtcatattgtattattcataatacattgttattaaagtacagatgtgtggagatatgtgcattttagcaaagttaaaatataagttatawcttgaccagacaaattatgttttctttccctgcaatcagcaaactggtgtataagtaatacaagaaccctcactaaactgcaaagagtataacagaactcgtttacatttattttgcacgatgactgtaactttgattttcccatttgtttttgtattacccaaggaatgacctcatcccctggcttttcctaaggccagaagcctctgtgtccagagagcaactagtccattttcagtctgagtattagcagtatacacagatctttcaggtattaaatcagttgaaaaaacaaaacat

SEQ ID NO: 185743 - DNA, 601 bp, Human
aactggtgtataagtaatacaagaaccctcactaaactgcaaagagtataacagaactcgtttacatttattttgcacgatgactgtaactttgattttcccatttgtttttgtattacccaaggaatgacctcatcccctggcttttcctaaggccagaagcctctgtgtccagagagcaactagtccattttcagtctgagtattagcagtatacacagatctttcaggtattaaatcagttgaaaaaacaaaacattaaaataacggattttagctgatctgagcttcttagccattygagaggagaaaaaaggaattcaacatactttcagggaataataataaaaaaaaagtgtaaaagagggatttcaacatacctatgattaatactgtattaaactgaagatttatatgaatgggtatagaaagtatcagacctggccgggctcggtggctcacacctgtaatcccagcactttgggaggccgaggcaggcggattgcctgaggtcaggagttcaagaccagcctggccagcatggtgaaatcctgtgtctactaaaaatataaaaattagctgtgcgtggtggcaggcacct

SEQ ID NO: 185744 - DNA, 601 bp, Human
aactcgtttacatttattttgcacgatgactgtaactttgattttcccatttgtttttgtattacccaaggaatgacctcatcccctggcttttcctaaggccagaagcctctgtgtccagagagcaactagtccattttcagtctgagtattagcagtatacacagatctttcaggtattaaatcagttgaaaaaacaaaacattaaaataacggattttagctgatctgagcttcttagccattcgagaggagaaaaaaggaattcaacatactttcagggaataataataaaaaaaaagtgtaaaagagggatttcaacatacctatgattaatactgtattaaactgaagatttatatgaatgggtatagaaagtatcagacctggccgggctcggtggctcacacctgtaatcccagcactttgggaggccgaggcaggcggattgcctgaggtcaggagttcaagaccagcctggccagcatggtgaaatcctgtgtctactaaaaatataaaaattagctgtgcgtggtggcaggcacctataatcccagctacttgggaggctgaggcaggagaatcacttgaacccaggagg

SEQ ID NO: 185745 - DNA, 601 bp, Human
attcgagaggagaaaaaaggaattcaacatactttcagggaataataataaaaaaaaagtgtaaaagagggatttcaacatacctatgattaatactgtattaaactgaagatttatatgaatgggtatagaaagtatcagacctggccgggctcggtggctcacacctgtaatcccagcactttgggaggccgaggcaggcggattgcctgaggtcaggagttcaagaccagcctggccagcatggtgaaatcctgtgtctactaaaaatataaaaattagctgtgcgtggtggcaggcrcctataatcccagctacttgggaggctgaggcaggagaatcacttgaacccaggaggcagaggttgcagtgagccaagacaagatcacgccattgcactccagcctgggcgacagagcaagactttgtctcaaaaaaaaaaaaaaaagtatcagaccaatgagaggaaaaatgtttaacaaaagatgtgatgttatcttaagattagaatgcctagcaatacaataggaggtcaaaccagtaggataaaacagagattaaggggaaaagtgattttctgtgtgtgtgtgtttaagcacat

SEQ ID NO: 185746 - DNA, 601 bp, Human
ttttgtattttcagtagagatggggtttcaccatgttggtcaggctggtctcgaactcctgacctcaaatgatccacccaccttggcctcccaaagtgctgggattataggcgtgagccaccgcgctgggcccctttggctcttttcagtaccccccaccacctctgtaagttgcccaggtccttcaagccaaatcaggaggaaagtggggctgatagttattaacatcttagtatgaatttgttaaaaacatttgcctttgcttttgaaaaagatctgttaaggttctctaagcagtgcwtcttttaaaaaaattataaatatttaaaaaataaattttattgtgtatatttgaggtctatagcatattatgggatggatataattaaatgactactgtagtgaacagaataacacacctatcacctcacgtagttacttatttttgtaatgagtggctaaatcttatttaatgaaaatctcaaatgcaatacaattttattgtattttgttagtccttatgttgcacattccatctctagatacatttatcctacatatctgctattttgtaccctttgaagtgcatttctccatttcc

SEQ ID NO: 185747 - DNA, 601 bp, Human
taccccccaccacctctgtaagttgcccaggtccttcaagccaaatcaggaggaaagtggggctgatagttattaacatcttagtatgaatttgttaaaaacatttgcctttgcttttgaaaaagatctgttaaggttctctaagcagtgcttcttttaaaaaaattataaatatttaaaaaataaattttattgtgtatatttgaggtctatagcatattatgggatggatataattaaatgactactgtagtgaacagaataacacacctatcacctcacgtagttacttatttttgtmatgagtggctaaatcttatttaatgaaaatctcaaatgcaatacaattttattgtattttgttagtccttatgttgcacattccatctctagatacatttatcctacatatctgctattttgtaccctttgaagtgcatttctccatttcctccctacctcacaccagtgataaatattcttttattctctatctctgtgtatttaagctcttttaaaaaatattccacatgtgagatcacacaatattttttttcctgtgtctggcttattttacttagcatactgtccttaaggtcta

SEQ ID NO: 185748 - DNA, 601 bp, Human
taacacaaacgtggcaaggatatggagaaaagagaactctagcacactgttggtgggaatgtggattggtatagccattatggaaaacagtatggcggttctgaagaaattaaaaatagaaccaccatatgatccagcaacccctcttttgggtctacatccaaaaaagatgaaatccctaccttgtgaagatatatctgcacccccatattcattgcaacgttattcacaatagctaagacatggaaacaacctaaatgctcatggatggatgaatggaaaaagcagtgcgttttttttktgtgtgtggtgaaattttagtcattacttttgctatagtccagagagcctttgaaatgacacggtgctttgcctctgtctacttgacataatatttggatatttgagtcttttctgtagttcttcaaaatacatgcacatttactcaaaagtgctctttactttatattaaagtatgtattttaatacttaaagaaatgaacatatccaccttgtgatagctatttccactgccttgccatttttgtgtaatgaatccataatattcatgtattcagattattgtgccttaaatcttaca

SEQ ID NO: 185749 - DNA, 601 bp, Human
acacaaacgtggcaaggatatggagaaaagagaactctagcacactgttggtgggaatgtggattggtatagccattatggaaaacagtatggcggttctgaagaaattaaaaatagaaccaccatatgatccagcaacccctcttttgggtctacatccaaaaaagatgaaatccctaccttgtgaagatatatctgcacccccatattcattgcaacgttattcacaatagctaagacatggaaacaacctaaatgctcatggatggatgaatggaaaaagcagtgcgttttttttttktgtgtggtgaaattttagtcattacttttgctatagtccagagagcctttgaaatgacacggtgctttgcctctgtctacttgacataatatttggatatttgagtcttttctgtagttcttcaaaatacatgcacatttactcaaaagtgctctttactttatattaaagtatgtattttaatacttaaagaaatgaacatatccaccttgtgatagctatttccactgccttgccatttttgtgtaatgaatccataatattcatgtattcagattattgtgccttaaatcttacacc

SEQ ID NO: 185750 - DNA, 601 bp, Human
atttctatggatatatttatacccctgtgtaactactactcagacctaaatacacattctcaaaacccagaagccttctgtgtacctgctcctagttaacatttcaccaaggtagccactacactgacacagattagttgtataatctctagaatttcgtataaatggaattacacagtatgtattaatgttgcaggacttttccttagttcagctaaagatgagttccttgtcccatggccatgaaaattcaggctcacagacaacttgaatagtgagtaagacagggttttattgggtraaaaggaaggaaagggggaaacaggaactctcactaggccagagtccctgctagagcacttcccaccaggctgattgaatcccaggttccacacaggaaagaggatgggccaggctcctcccgctaaaaagggtgtgaagttcccaaggctccatctcagtgggcagcctggttggaatttctccaaggaccccctctcacctggctgtctcattcctccctctaaagaagtacatctaattgctcttagattaaggataaggatgaagaccaatcttaacttcttcctgctgacagggt

SEQ ID NO: 185751 - DNA, 601 bp, Human
aagaggatgggccaggctcctcccgctaaaaagggtgtgaagttcccaaggctccatctcagtgggcagcctggttggaatttctccaaggaccccctctcacctggctgtctcattcctccctctaaagaagtacatctaattgctcttagattaaggataaggatgaagaccaatcttaacttcttcctgctgacagggtgtgctgttttggggaaatggcaggtggagctccctcagaggcctatctaaggtttcccagcagaaagggccattgtcagaggttccagttgcattaccrtttagagtttgatggcctgaaggcaagaacagacaaagccggttattagaaaacacgtatcaaaatgaaacaaggggagggataaggcagctcaaaaattccaaggccttttaccagtttgcacagggagacggaggccaaacacccaactagcaaaaaaaaactttactcttttgccagcatgttgggcttctgggtttccttccccagagtccaatcctaagccaactagtttaaggtttgggaaattaactctttctagtttgaaggatgcatttaaggggactgtcctctagtaca

SEQ ID NO: 185752 - DNA, 601 bp, Human
gtgtgctgttttggggaaatggcaggtggagctccctcagaggcctatctaaggtttcccagcagaaagggccattgtcagaggttccagttgcattaccgtttagagtttgatggcctgaaggcaagaacagacaaagccggttattagaaaacacgtatcaaaatgaaacaaggggagggataaggcagctcaaaaattccaaggccttttaccagtttgcacagggagacggaggccaaacacccaactagcaaaaaaaaactttactcttttgccagcatgttgggcttctgggttyccttccccagagtccaatcctaagccaactagtttaaggtttgggaaattaactctttctagtttgaaggatgcatttaaggggactgtcctctagtacaaagacacaattacctatcagtgaagagaggacagaggagaagaaaggaaaaaaaaaaagagagagcacctgtaatcccatcactttgggaggctgagatgggcagattgcctgagggtcaggagttggagaccagtctggccaacatggtgaaacccatgtatactaaaattacaaaaaaattagccgggcgtggtggct

SEQ ID NO: 185753 - DNA, 601 bp, Human
ttggagaccagtctggccaacatggtgaaacccatgtatactaaaattacaaaaaaattagccgggcgtggtggcttgtgcctgtaatcccagctactcaggaggctgagtcaggggaattgcttgagttgcagtaagctgagatagcgccactgcactccatcctggtcgacagagtgagactctagctcaaaaaaaaaaaaaaaaaagcagtgttcccattttttcttgtttattcacacttctgtattatttttgttttattcttgtccagtgttactttacctttttttgttaactrgtgttctttttcccaacctgatatacttgatattcctttgtcagatgtattggcaaagtaggatgtgtacaggggggctgaggggaactagtaacaaggaaacaaagagcctttatttttttaagaagccttttttaaaaaatgcaaaatgcctaaaggctcttgttttgattcgtttatgaaaggaaaacaaaccagttctgtatctatggtatattgttgctctttatcttccccaactctaaccttgaggaaagaactgccatgagctttgtcactatttgtaaagaaaattatttt

SEQ ID NO: 185754 - DNA, 601 bp, Human
gaggttcgtgagaggagagacctaatgagtatgttggtctgatacctgttaggcatattcaatgccttgagccttgcttaatgtaaaactcccaaagaccgcttttgcaggggccttccagatagacatctgtcaggtccacaacccaggtactaacaagggtaaatcgtgagtctcaggcaaaatacaagtcaccttttatctctggataacaacgcagtaaccaagagcttctgccctgggcaatagtatcacaccttatcagttgcccatggttcttttgggtcctgtacctgtgctraagttatagggaagcttatgagaggccacacagacagcatatatgttccctggaggagggtcccttccctggccattcccctaccaacggttaattgtggaggccacactttaaatttccaaggagtaacttggaaattatactgcactctcacgccagggggccacaatagccaaccatctacggtgaggggcttggagggtccatggccaacaccaggtttttttgttattgttcccctacttttaggggtgttggggcaggcaataacagattactgttcatccccgtacctggctg

SEQ ID NO: 185755 - DNA, 601 bp, Human
gaggtggagcaagaaatgctgccagcctccttgtcccaaagacagagtggccaggcagggaggggcactgggtgctgctgacactgttacctaactctcacaactcagtgggtgtataagcactataagaggtgtgttccactactgtggggggttccagggctctccactgggttcccatcagatggtcatgttgtaccttttgacagatcatagggtgagcctgcagtggtggagccccctcctcctcaggatcagaccaaatgggactgtccagcctggaggacaggctcaaggtcamacttacagctgttgctaactcttgttccaggctgtttatctgggcctccaagtgccctgcttgcacctgaaggtccctcacccccggttctgctacaagctgtgcacttgggtccctaggcacacggcttgtgctgggatgtcccttacctgtggcactgagcatgtatttcacacagtgcagtcagaaatgcccatccaactctgctggtggaggtgcgttccttctcggtgctgcgtgcttccagctgcctcggtgctttctccacactcacaggagacctatccactgcctcccaca

SEQ ID NO: 185756 - DNA, 601 bp, Human
aataagaggtagctggtaggagctattctaaattatgtttatggatttacaaacataataatctttagcaagtaggaaacccaaactacaaatttggaagatgtgtaatgtttttcagaaatatttgaactctggactttaacagttcccttgaaaataatccaaaatatggacaaaactgtcatatgtgttgtaacatgatgtttaccttgtcttttctattgttgaatgatttatcccatgggactaccttttctacacggacctttacactatcttcagattattattattattattwttttttttttttttttttgagacggagtctccaaaaaaacagagtctccagctctgttgcccaggctggagtgcagtggcaccatctcggctcactgcaacctccacctcccggtttcaaacgattctcctgcctcagcctcctgagtagctgggattacaggtgcgtgccaccactcctggctaatttttgtatttttagtagagacagggtttcaccatgtcagccaggctggtctcaaactcctgacctcaggtgatccacccgcctcggccccccaaagtgctgggattacaggca

SEQ ID NO: 185757 - DNA, 479 bp, Human
gtagaaaagtagacaatttaaaaaaaggataaattacacttaaatttcactgagtctaggctcttcaaatgtaggttagtattaatttatgtggataaaatttttatttatgacattgaactacatacaacatgtataaaatggagggaaggcaggaaacatcccattgagaatttctagtcatatatatatattcatctatatattcatatgtatattcatatgtatattcatatatatattcatatgtatattcatatgtatattcatatatatattcatatgtatattcatatatatsatatatatcatatatacatatgatatatacatgatatatatgatatatatgatatattcatgatatatcatatattcatatatatcatatatactcatatatatcatatattcatatatatcatatatattcggatatatatcatatatattcatatatatatcatatatattcatat

SEQ ID NO: 185758 - DNA, 463 bp, Human
tttaaaaaaaggataaattacacttaaatttcactgagtctaggctcttcaaatgtaggttagtattaatttatgtggataaaatttttatttatgacattgaactacatacaacatgtataaaatggagggaaggcaggaaacatcccattgagaatttctagtcatatatatatattcatctatatattcatatgtatattcatatgtatattcatatatatattcatatgtatattcatatgtatattcatatatatattcatatgtatattcatatatatgatatatatcatatatrcatatgatatatacatgatatatatgatatatatgatatattcatgatatatcatatattcatatatatcatatatactcatatatatcatatattcatatatatcatatatattcggatatatatcatatatattcatatatatatcatatatattcatat

SEQ ID NO: 185759 - DNA, 462 bp, Human
ttaaaaaaaggataaattacacttaaatttcactgagtctaggctcttcaaatgtaggttagtattaatttatgtggataaaatttttatttatgacattgaactacatacaacatgtataaaatggagggaaggcaggaaacatcccattgagaatttctagtcatatatatatattcatctatatattcatatgtatattcatatgtatattcatatatatattcatatgtatattcatatgtatattcatatatatattcatatgtatattcatatatatgatatatatcatatatayatatgatatatacatgatatatatgatatatatgatatattcatgatatatcatatattcatatatatcatatatactcatatatatcatatattcatatatatcatatatattcggatatatatcatatatattcatatatatatcatatatattcatat

SEQ ID NO: 185760 - DNA, 457 bp, Human
aaaaggataaattacacttaaatttcactgagtctaggctcttcaaatgtaggttagtattaatttatgtggataaaatttttatttatgacattgaactacatacaacatgtataaaatggagggaaggcaggaaacatcccattgagaatttctagtcatatatatatattcatctatatattcatatgtatattcatatgtatattcatatatatattcatatgtatattcatatgtatattcatatatatattcatatgtatattcatatatatgatatatatcatatatacatatsatatatacatgatatatatgatatatatgatatattcatgatatatcatatattcatatatatcatatatactcatatatatcatatattcatatatatcatatatattcggatatatatcatatatattcatatatatatcatatatattcatat

SEQ ID NO: 185761 - DNA, 437 bp, Human
aatttcactgagtctaggctcttcaaatgtaggttagtattaatttatgtggataaaatttttatttatgacattgaactacatacaacatgtataaaatggagggaaggcaggaaacatcccattgagaatttctagtcatatatatatattcatctatatattcatatgtatattcatatgtatattcatatatatattcatatgtatattcatatgtatattcatatatatattcatatgtatattcatatatatgatatatatcatatatacatatgatatatacatgatatatatsatatatatgatatattcatgatatatcatatattcatatatatcatatatactcatatatatcatatattcatatatatcatatatattcggatatatatcatatatattcatatatatatcatatatattcatat

SEQ ID NO: 185762 - DNA, 601 bp, Human; identical to SEQ ID NO: 23427

SEQ ID NO: 185763 - DNA, 601 bp, Human; identical to SEQ ID NO: 23428

SEQ ID NO: 185764 - DNA, 601 bp, Human; identical to SEQ ID NO: 23429

SEQ ID NO: 185765 - DNA, 601 bp, Human
ggaacattcaagattttctcttttagctatttgaaaatattcaataaattattgttaaccatagtcaccctacagtgctattgaacagaagagcttatttattctttatagctgtaattttgtatctgttaaccaacttctccctatccccactcccacccttcccagccccagtaaccattattctactctctacttctatgagattaactttttaaacttctacatataaaggagaacatgcagtatttatccttctgtgcctggcttatttcacttacaacaatgtcattctgactcrtccatgttgctgcaaatgatgggattttactcttttttatggcttaatgtcattccattgtgtgtatgtgtgtgtgtgtgtgtgtgtgtgtgtgtgtgataaaacattttctttatccatttattaattgatagacacccattttgattccatgtattagcgattgtgagtagtgctgtaataaacacaggctttcagttatcttttcaccatacttatttcctttcctttggatacatatccccagtgggatttctggatcacatggtagttccatttttagttttttgaggcatttcc

SEQ ID NO: 185766 - DNA, 601 bp, Human
tgctgagcaaggcaaagattcaatttgcaaggaaagaattaaataatattatattgttaactattgttctactacagttttttcttttaaaaaacaaaaattcttttcacattgatttaatcaggtttagcttagtattgtctaggtaatgaagcatcaaaaatattttgcaaaaagccagaagttttggcaaaacttaatatgtatttttatttgcctattttcttatctactatgatggtttattaatatgatttactactttttctttttttataaaggtgatggtcacctctcatgraataatgcagttttaagtactactgcttgtatttaattatctagttgtgatcagcattctatatcagaacacctaatcaagcgattttaaccatgctctttaacactaaactctgtataacattatttgaagtaataattaatacttttctttcatttagactcaattgtaataattttctgaattttttaattcccttttgttagcaaatgtagttagcaacctaattccttagcaactgcattactttctcagttctttaagacccttgttaataccctcacccatttcagagctgaa

SEQ ID NO: 185767 - DNA, 601 bp, Human
gattcactttgacaacattagtaattaacgcaccccttaaaagtaatctcctaataagcatttctgtattttagggtgcagttggtaataaaggtgaatttggtgctcctggaattcctggggaaaagatatgatggtttactctttgatcaaaatttatggttattttataaagctgtatcagataggataggaaaatatacagaacaagtcctatagtttagaggtaatcaaactgtggccctatagtagggctgccagaaactctcactgtaggattttgtacataaagttttactgsaacacagccacactcatttgtttttgtattacctaaggctgcctttgtgcttcatggccaagttaagtaattgtggcagagactgtatggcccacaaaatctaaaatatttactctctggccctttgttgaaaaagcttgctgatccctgctccggaacattggctgctattcttttagccccagggcttctcaaattcaccattttatatataatatggtgtcttaatatgtatttcactgcagacaaaaattaggcagtttatgtaaacattttataatatagactataagacatact

SEQ ID NO: 185768 - DNA, 601 bp, Human
gagctttagtaacatgctcctccaaagaactaaatggtagtagtgctttctggggtccgtgatagctgctctggaaacgtttctgcttttattagtcagagtctaaaatgtaaaatagaacaaactgtactccctttgactagttttgttacctcttgcttatcttcttttttgtatatcccagatagagctaaacataatagttagaatgacataaaatattatatattacaaagatgctgtagacaactacctcttcaaaaatatttttctttcagaacaagggattcctaataagcaaggagttttgcatgggccaggctgcctcttcctgtgcctagtatctttctctttaacaagatgaacttcctttgtgcccccacttttttttttttttttttttttttgagacggagtctcgctctgtctcccaggctggagtgcagtggcgcgatcttggctcactgcaagctctgcctccgttcacgccattctcctgcctcagcctcccgaggagctgggactacaggtgcccgccaccacagccggctaatttttttttgtatttttttagtagagatggggtttcaccatgttagcc

SEQ ID NO: 185769 - DNA, 601 bp, Human
ctcttcctgtgcctagtatctttctctttaacaagatgaacttcctttgtgcccccacttttttttttttttttttttttttgagacggagtctcgctctgtctcccaggctggagtgcagtggcgcgatcttggctcactgcaagctctgcctccgttcacgccattctcctgcctcagcctcccgaggagctgggactacaggtgcccgccaccacagccggctaatttttttttgtatttttttagtagagatggggtttcaccatgttagccaggatggtctcgatctcctgacctygtgatccacccgcctcggcctcccaaagtgctgggattacaggcgtgagccaccacacccggccagggctgctttcttcttctgggaagaagcatggttatctgtgacaagcattactaaaaacacagagaccattatattccagtttcttggagggacggggagccacttcaggtggggccagctgtcatgataccatccagataatcccgccgcaggagagagcattattgatgtaatattagatgcccaccaaagccaagcatatcatttctgtgctctggagatgttttactggtt

SEQ ID NO: 185770 - DNA, 601 bp, Human
aattttttaaagtttatatgaacaaataaataactaaaaatagtcaaaaattttttgagaaagagaaatgtagtaatttagaaatttagggtgaacttgctttaccagacatcataacattctataatgtcatagtaacaaaataaatattgcatcatgtagaataaagatagatagactaaacctgagaatctagaaactggcctcagaagttatgtgaagttaatttaataacttttgtatttttattcagttattcagttgaaaggatgggttattccacaggtgcattggcactacygagtctatccacgaaaaactattttataccctatataaaaataaatgccagatagatgaaggacttatataaaaatcaaaacaaagcaataaatactttacatttgtgtaatccaggattaagtgtatatctaaccaagatttgaaacccagggactgtaaagtaaaagatagacatattagacatataaaaattaaatgtttcagtggtaaagtcataatcgaaatcaagtaggaaataattgttctgataaaatataattaataggtgaccagttaacatttgtacgttccaaagagt

SEQ ID NO: 185771 - DNA, 601 bp, Human
agctccattactctccaaaaagtacaatgccggggttctactcaaaaagagtcagtgcctcctcaatggctaaaagagcatgtccagacatccctaacttgcccttcgtggtttctacaacctgattctgcctgcctttccaatttagtttcatagaattttcctttttcggaatcctgtgctttacctaaagcaagtaacttgctaatccatatatttgtgccttttcttttacttttcccttgttctagaataacgtccctctatttcttttgatgtagatcaagcttgtcccaaccayggcctagaacagctttgaatgtgactcaacacaaattcgtaaactaacataatgagagttttttacttttttttttttttttgctcatcagctattgttagtgttagtgtattttatgtgtggcccaagataattcttcttccaatgtggcccagggaaggcaaaagattggacaccactgatctagatcctacctaaaacatggaaacttgctcaatagccacagaattagactaaaatttaagagccaatttctagaacagaatggtctaggttcaaaccctggctctcccactttac

SEQ ID NO: 185772 - DNA, 601 bp, Human
aatgctagacttcaattgtgaatgagtaatttttgccttcatttctagagctttatcttgttaagaaaattctcattgcatatcaaaaagcttaataatgaatgtgtacaaatgatgtatctctttatttgtgagcatgtgaagtacccacttataaagactctggtcctaggcataataaaaaattgttagtatggacaatttcaaataaacacaaaagtgtgcagaataaaatattgaacacctgtatatacttcagctgtcttcaattcacagccaatcttgtttcacttagactccrtcttgtattattttgaggcaatcccagtcagcatatgtttcagctattaacagttcagtctgtatctgtaaatgataaggcttttgtttttacataatcattatttcattataacacttaaaatttttaaacataactttttaatatcattaagtagtcatttggtgttcaaatttccaatagtatcataaaatcataattttcgttaacaatttgctgtagtcaggatccaaataagataggcacattctagttggttgctgtgcttttgatggtctcttgatctataattttcctccc

SEQ ID NO: 185773 - DNA, 601 bp, Human
ctgtcattttgtttgttttattacattatttgttaaagaatcggggttgtttgtcctgaagaatcttccatagcctggatttgccaactgcagtttcatggtgtactttaatatgttcctctctcctctgtgtttcctttaaagggtggttagatcagtttaggtgtgatgtttttagcaagactacttcataaattgtatggtggtgtgtgccaagagccacataatgtctgaaaatctttctttttgtgatgattgcagccattgatcatcaatatctaggccaattaattcattcagkgtcacaaaatggtgatttcttaaaaggatttattcaattttaactttttcttcctttttctgacttctattttaggtttggggggtacatggcaggtttgttacatgagtaaattgtgtgtcacaggggtttggtgtacagattattttgtgacccaggtaatcagcctaatacctgatagatagttttgttattctgatcctcctcccactctctatcctcaagtagaccttggtgtctgttattcccttttttgggtctatgtgtactcagtgtttggctcccactaataagtgagaa

SEQ ID NO: 185774 - DNA, 601 bp, Human
tccagtttcaatcttctgcatatggctagccagttatgccagcatcatttattgaatgagtcctttccccattgcttgttttcgtaagccttgtcgaaaatcagatggttgtaggtatgcatctttatttctgggttctctaacctgttccgttggtctatgtgcttgtttttgtaccagtgccatactgaacttgtagtatagtttgaagtcaggaagtgtgatgcctccaactttgttctttttgcctaggattgctttggctaccaaggctcttttttggttccatatgaattttagratgtttttctctaattctgtgaaaaatgttgttagtagtttcattttgcacttgtatacaagaacttaaagtaaaatttaaaaaaagaaaaaaaaatgttgttagtagtttgatagaaatagcattgaatctataaattgctttgggtaatatggctattttaacaatattgattttttctattcatgagcgtggaatgtttttccatttgtctgtgtcatctctaatttctttcagtagtgtttggtaattctcattgtagagatctttcacttccctggttggccctattcccaggta

SEQ ID NO: 185775 - DNA, 601 bp, Human
agccaggcttggtgtctcatgcctgcagttctagcactttgggaggccaaggtgggcggatcacctgagatcaggagttcgagaccagcctgaccaatggtgaaaccccatctctaataaaaattttaaaaaaactaaccgagcatgatggtgcatacctgtaatcccagcaactcaggaggctgcagcaggagaattgcatgaaccgggaagtggacgttgcagtaagccgagatcactccactgcactctattctgggtgacagaacgagactccctctcaaaaaaaaaaaaaaaaaaagacagaaaaaagaaatttcattcattagaaagtaattcatcattcctacctcctctcacaccttagttccctcattttattgtgaaaatattcaagcatatacagaaagattgaaagaattgtacagtgaacactcatatattcatcactattctacaatattttgctgtatttgttttatcacatccatacatctatccatctctttgttatgtacttcaaagttgcagacatgagtacgtttcacttctaaaatgttaacatgcataacattaattagagtttatgtttatctttttt

SEQ ID NO: 185776 - DNA, 601 bp, Human
gcaataaacatacgtgtacatgtgtctttatagcagaatgatttatattcctttgggtatatacccagtaatgggattgctgggtcaagtggtatttcttgttctagatccttgaggaaatgccacaccatcttccacaatggttgaactaatttacattcccaccaacagtgtaaaagcattcctatttctccacagcctcaccagcatctgatgtttcttgactttttaataattgccattctgactggcatgagatagtatctcattgtggttttgatttgcatttctctaatgatcrgtgatgttgagcttttttcgtatgtttgttgcccacataaacgtcttcttttgagaagtgtctgttcatatcctttgcccactttttgatggggttgtttgctttttttcttgtatatttgtttaagttcattgtaaattctggatattagacctttgtcacatgggtagattgaaaaaattttctcccaactataggttgcctgttcactctgatgatagtttctctggctgtgcagaagctctttagtataattatatcccatttgttaattttggcttttgttgcaattgcttttgg

SEQ ID NO: 185777 - DNA, 601 bp, Human
gaaactggtgaattaataaataaaatatggtgtacccacataaatgatactactcaaaaagaaacaaactacttagccatgcaacatgggtaaactcaaaagcataatgttgaatcaattaagctagacaaaaaaggctacatattgtataattctatttatatgaaatttctagaaaaaagcaaaactatagagacaaaaactatgtcagtagttttctgggactacaagagtgagaagcagttgactacaaatgggcacaaggaaacttttttaggtgatggaagtattttagtcttargttgtggtgatgggtgcagacctatataaatttactaaaactattgcaccctacatgtacagtgtatcagtattatggcaagtaaatcataccttaataaaactgttagctaaacaataaaaaagatatctatgctggaagtaggaacatgagactcattagcatatagatgatcattgtagctgtaaaagtagagaaaacatctagggaaagtttgttgaaagggaaaacataagaagctgggacagatccctgtggagcagcaacacttagaggatctagcaaaaatgaaaatgagta

SEQ ID NO: 185778 - DNA, 601 bp, Human
cttataataacttattttgtgccagctttctcacaaaatgggccagctcactttggaaagtgtaaactttaatttaaagggtagtatgtagcaattcagtctttctcaatgtggcactcttggcattttggcaagacagttctttttcaagtcagactgtcttgcaagagcagaatgtttagcatccttgaagctcaccaacctaatctaaatgccagtagcagcccctagtcattgggacaagaaaaaatgtgctgatatttttctaagtgtatcttaactgtgtgtgtgtgtgtgtgtttttgtatgtgtgtgcatgcctaaacttttgtttgatgtctgtggtattactaaacaaatgcatgctcatatgtccattctagtttaaataatgcatacaaaacatatattaaaattttcaaaaatttgaattgctagaaaatttaaccttgaaaatatatgaccttgtctttacacacaatctagtgtataattaaataattttgattgtggcctaatacaagatatatttaacaaaggtatcttagaatagacttgagagagaataatataaagttgtaattgtgatctttaaagccag

SEQ ID NO: 185779 - DNA, 601 bp, Human
gcagacgttcaataatatttgttgagtaaatggatactcaaggtttttatcagtcatttctttttttgtgtttgtcttttctctgcatagttttacacaagcaaaaagagaaaacctttttttaataaatttctctgctcagtgaatgggataacttcctagccagttacttaagtcaaatgcaactcagcctggagactttccttcttcttctccacttctggcatatctgccagtcttgcttccagcatgtgccaactctgaccacttctcatcatctccactggcacaagcctgtccyagccatcctgctctctttcctggaaaagctgtcatagccccttttatgctcccactcttgctgcccataatttgtgttccacgttgctgccaaagtggtttgtggggatttttgtaaacatattcacatcatgtcattttcctgcttaaaacacttaagtggcttcccattgcatgtagaacaaaacccatcttcctcatcatggcctgcaattacttatgtaccatgacccctggcaaaccttgacttaaccccctactccttacctgtgtgctcatgacactccttttatcttagtga

SEQ ID NO: 185780 - DNA, 601 bp, Human
catagtgatcaaatcagggtgtttaggttgtccattttccaagtgcaatacattttttaaaagtatgcttatcctactctgctatcaaacattgaatttattccttctaccttactgtatgcttgtatctttttatccacttcttttcatcctcccttgccccctcactcaccctttccagtctttgttatctatttttacactttctacctccatgtgttcaaattttttttgctcccacatgtaagaaagaacatggaatatttgtctttttgtgcctggcttacttcacttaatatamtgactttcagttccatccatgttgctgcaaatgacaggattttgttttcttatggcttaatagtactccgttgtgtatatataacaccttttctttatccattcatctgttgatggacacagaatgattccatatctttgctaggatccttctgaaacaacaaatgtcaccaccacacaaggaccatttctgacaccccccttgaagtagcaactctctcctctttcacttttatcacattcagcctgttgacctgtttattgtcagccactcacctcttattacatgagttccttgagg

SEQ ID NO: 185781 - DNA, 601 bp, Human
ggaattgcaataagggagacagatcaggttcaactctaactacaacaaggacaggtggggatttatagccaatgagtagagggagggatgtcactggatagaaaattactaagaggagacatcaagggtagggtgattcttaccaaactgatctaagaagattcttgctgaagacaggccaaagacttagacatcaagttagaggatgaagaacttgatcttctcaaaagtaaggaatggagaagagattttaagggtgagagattctctctaaacatacttagcaagattcttgctatamctgagctgggaagaccaaagacaggatgggggccatggtccaggtctagctgagaagagggctcagagaaccatgactaaaagtttggtgatggagagaatcttcattaatttcttgttcttttctgtatctctaaagtcgtactaatcaatagaaatataataagagctacaaattcaagatgaaggcaaatatattatttttttctagtaaccaaattaagcaaaataaaagggaacaggagaaaatacttttaataatatgttttatttaatgcaatatatccaactgttatcattt

SEQ ID NO: 185782 - DNA, 601 bp, Human; identical to SEQ ID NO: 23430

SEQ ID NO: 185783 - DNA, 601 bp, Human; identical to SEQ ID NO: 23431

SEQ ID NO: 185784 - DNA, 601 bp, Human
gagtacatgtagtcaaacctccacattttaaagatggggcatctgcccacaacagtgaaatatctgacccaaggtcatacaggtagttacaattaaagtctggaatcagtacctaccctgagcaatttcctctatcctccatatggctcataattttgtctcctaaatgtttgattatgcactcttaacatcaggtttaatgtaaatggaatcagatacagtcctacttgctttaaaaactgtaaaaggacaaaacaaactctaatcacccagtgaataaaaacagctacctatttaaacyggtaattacattctcccaacactttccaaaatcattgttattttcctctatgatttgattctaaaatttgcagatgataaaattgcaatattttagtgacagatttatgagaaaagtttatagtgtgcacataatgagattgttctcaatcaaatggtacatcatgtattaagcactttataataaatatatgattctcttatattcagatacaatttactattacagacttttttcataggtgattaaagattcttatttaacttaaataagactctaagcctaatggaaaagaggaca

SEQ ID NO: 185785 - DNA, 601 bp, Human
gtagtcaaacctccacattttaaagatggggcatctgcccacaacagtgaaatatctgacccaaggtcatacaggtagttacaattaaagtctggaatcagtacctaccctgagcaatttcctctatcctccatatggctcataattttgtctcctaaatgtttgattatgcactcttaacatcaggtttaatgtaaatggaatcagatacagtcctacttgctttaaaaactgtaaaaggacaaaacaaactctaatcacccagtgaataaaaacagctacctatttaaactggtaattrcattctcccaacactttccaaaatcattgttattttcctctatgatttgattctaaaatttgcagatgataaaattgcaatattttagtgacagatttatgagaaaagtttatagtgtgcacataatgagattgttctcaatcaaatggtacatcatgtattaagcactttataataaatatatgattctcttatattcagatacaatttactattacagacttttttcataggtgattaaagattcttatttaacttaaataagactctaagcctaatggaaaagaggacagttttgtt

SEQ ID NO: 185786 - DNA, 601 bp, Human
cactttccaaaatcattgttattttcctctatgatttgattctaaaatttgcagatgataaaattgcaatattttagtgacagatttatgagaaaagtttatagtgtgcacataatgagattgttctcaatcaaatggtacatcatgtattaagcactttataataaatatatgattctcttatattcagatacaatttactattacagacttttttcataggtgattaaagattcttatttaacttaaataagactctaagcctaatggaaaagaggacagttttgttttgttttttttwaaaaagatcttctatagcctgaagtcttttgaattttatgttgatgttacctagtgagataaattaagcatttaaatcagtagtattcgaagacctattctgattatagaaggtcagatttttaaaagtattctagtaatctgaatggagcccttcccataggtagaacataggaatctcaaaaactgtgtgattttgataatatttatatttatctttgtacttaaaaatcccattatgaaaaatacattaataatgtcttacacaaataattgttacaactcccacataaacaaatgt

SEQ ID NO: 185787 - DNA, 601 bp, Human
gggattacaggcttgagccactgtgcccagccttacactttgtagaattaaaaaaaaaaaattatttagcagtgatttagttaaacctgctctttttacttaggacagatgcctgtttctctttaactaagttacatgcagtcatttagttaaacctgctcattttatgtaagacacatgcctgtttttcttcaactaagttatatattcaactactcagttatctgatttcattgtcattttcaactcatgttggaagactgatatgcaatctacatatattatttcgcctgaaatacaattttggcttctcaatcagaaaattgtattggattacatatattttgtggatgtttaatagcagctagcttctttctgccaaggaacaccttgaagatacctctctgcaccaattcatctgtcaagcacttagagattacaagctaatttcatacttgtctaaaaatacgacaaggaaaaaacactatgaaatgaaatgttttatttcataaagtaaaatattcatattattggggtattactattttgtatgcttgacattactttctttattaatataaattatcaactcttccctaca

SEQ ID NO: 185788 - DNA, 601 bp, Human
caacttacaatacactaaatatttaattgatcttataatacaggttggtacattattagttgaaataatttataatagtctttgaggaagcccaaatgactaactgcgttatatttggattaaatgaggcagtgatatattggagtcaataaacagagttcatccataattgttctcaaaactagctccacgctaaaatctactgaagagttaaaaaacttaaccaatattggggctccacccccagaaattccaattcaatcaacctgatgtgggaccagtatattttaaaagctccccragtggatctaaatatgcagcaagagttgagaaccattatttatgggaactagaatggaaaaagctttcttcctactcaaaaaaattatatcagattgttgaagaagtccaacttccatttgaaatccaacttaatacatagcgataaagaactatctctttccgttagggaggcatactagtaaaatgaagttaagattgaaccctgcttcattaaatggagagaattagggctaggaagatacctttaattacaaccttcatctaaatgtccatgtactcctgtggcttgggtgccttt

SEQ ID NO: 185789 - DNA, 601 bp, Human
gcctctggagtagctgggactacaggcgcccaccactatgcctggctaatttttttgtacttttagtagagacagggtttcaccatgttagccaggatggtctcgatctcctgacctcgtgatctgcccgtctcggcctcccaaagtgctgggattacaggcgtgagccaccgcgcccggccacaaaatgtatttcttaaataataagtcttgaaagtcaaaattactccttcacccatgggctgaagaatggatattgtgttagcaggcatgaaaacgacattcgtctccttgtacatcrccatcagagcccttgggttaccagatgcgttgtcaatgagcaggaatattttgaaagaaatatttttttctaagcagtggtatcaacagtgggcttcttcagtaaaccatgctataagcagatgtgctgtcatccaggctttgtcattccgcttatagagcacaggcagggtaaatgtagcataactcttaagggccctaggattttcagaatgaggattggctttaccttaaagtcacaaactgtattatcccctaactagagagttagtctttcctgtgaagctttgaagtcaggcat

SEQ ID NO: 185790 - DNA, 601 bp, Human
gatggcatcttaactgctttgttgacattgaaaactcgttgcgtggtgtggttaccttcattgaagatcttggataacttgctgcagcttctagatcagcacttaatgcttcactttgtacttttatattctggagacggcttctttccttaaacatcatgaaccaacttctgctagcttcaaacttttcttctgcagcttcctcacctctctcagccttcacagaattaagaggcaagggcttgctctggattaggctttgatttaagggaatgttgtggtttaagggaatttgtggctrtttgggtcttttatccagatctttaagtctttcttcatatcagcaatatggctgttttgctttcttatcatttgtgtattcactatagtagcacatttaatttccttcaagaagtttttctttgcattcacaagttggttgtttgtctggagggacctggcttttgcattcacaactcggctgtttggctggagggacctagcttttggtgtatctcagctttcagtacactttcctcactaagtttaatcatttttagcttttaattgaaaatgagagatgcgcaactcttcctttcat

SEQ ID NO: 185791 - DNA, 601 bp, Human
tgtgtattcactatagtagcacatttaatttccttcaagaagtttttctttgcattcacaagttggttgtttgtctggagggacctggcttttgcattcacaactcggctgtttggctggagggacctagcttttggtgtatctcagctttcagtacactttcctcactaagtttaatcatttttagcttttaattgaaaatgagagatgcgcaactcttcctttcattcgaacacttgaggccattgtatggttattaattgacctaatttcaatattgttgttccttaggaaatagggwtgcccaagtagagggagagagacagagaaatggctagtcagtggagcagtcagaacatacattctctctctcttccctttctgaaatgccagtggcagatatgttagatttttgataatgtccctcttgtccataaaactctgttcatttttttcccatctaattccatcttcttgggaatggatcatttccaataagcccttatcaatcttactcttgctttgttaatttccattctgctgttaagactatcatgtgaattttttagtatagatactatatttttaagctagtgaagtt

SEQ ID NO: 185792 - DNA, 601 bp, Human
attccatacaatggcctacaaagtcttacaggattcaactctcattgcatttctgacttcatctcattttcttctctttctttctgattttactccacaacaaagtaatttttccagaaaattatccaatattcaatttttttttaatgcagagtgctggccaattagaataaatggattgttctgattcagtgcactggtgctgtttgtattttcaggcttacagtgaagaatgaatgactattaagttttaattcctgtgatttgtctaatgattatgatacaaagtttaaattaaaaagtctttaatctatagttgtagattttaccatgtcttgccttattcattttttcatttctcagcaacttgttaaactcatagatggtaaaatttagcattctaatcataaaaatgtgaaataacttgctataaatttgagacttatggtttcaacagcacaaatgaagccaaatacagtcaaataatgcagtgattcagctgaaattctctaagcaactgggttattaacaacaaagaaaaattcccttataaatatgtttttcatatatatgtaccaactttttgaaattccacgtttta

SEQ ID NO: 185793 - DNA, 601 bp, Human
ggtgccacatattcagtgggtttgcatcacagcaaagtagggaaggcaaatttttaaaaaatggattgcaggcaaacttgccctttgccaaaagggagactttatctttaacattctaaacagtaagcaaatctatccttgctttgcggcataaacatcctttaaaagatagcccagaacaaaagggtggttagtacctccctcgtaagacatgcagaagcacaaaagcctcatggaaagacccattgtctctcaacaataccatttttcatttctatactgtcttggtgtctggcaaatkttttatgagtataccactccattaacagctctgattaatattatcaatagagactgtgaccaaaactattcaatttgtctcatatagcatttaattaaaggctactgttaatagaacgccaagcaagtagatgaggccagcctgcactattgatctcaaccctgtcccccaggattgcaaactcaaacagccgaatagatcccataaatcatccaagtctatcttagaaagccagatgatttgctccctacgtttctgaattggcctttctgcttgatttgaggcattaattcaggaaca

SEQ ID NO: 185794 - DNA, 601 bp, Human
cctccctcgtaagacatgcagaagcacaaaagcctcatggaaagacccattgtctctcaacaataccatttttcatttctatactgtcttggtgtctggcaaattttttatgagtataccactccattaacagctctgattaatattatcaatagagactgtgaccaaaactattcaatttgtctcatatagcatttaattaaaggctactgttaatagaacgccaagcaagtagatgaggccagcctgcactattgatctcaaccctgtcccccaggattgcaaactcaaacagccgaakagatcccataaatcatccaagtctatcttagaaagccagatgatttgctccctacgtttctgaattggcctttctgcttgatttgaggcattaattcaggaacatcaacaaagacaaggacattttttagaaaactgcaacagactcagtgtgtctccgactttggcccaagtgggcaaccataaggatactgagctaacagtgtactaaaccaagtagtctttatctttttttatttaggaccatgtcaaggaataagaatatccagctggcagagccagaattaagtttgaatcctct

SEQ ID NO: 185795 - DNA, 601 bp, Human
aagtttgaatcctctagattcccttttggctaggtttctaccctacaggtgtaaagatagttcagaacctagagcagttagtgcctcactcacaagataaatagaaatgcaaaagactcagagcattgttgccaacaaccagctcttgggcattgcatttgtttatgaacaaatattagcaaatgttgctcttttgtttaccacaccatggctaactataccgctgactcattcagcttacaatcagctctagtcccggagtatctttttttctggtgtttttctattcttacttctcttyagtctatactgttgatttttcattccatttcttgtagaatgctgtcctatttcacagccacttcttagtttcctatataatctattctggaaagtttaataccttcatgtatcaaaaatgtcaagggtcactctgtgtcttcactctgataatattgacctgaatccccagtaatggattaagataaagcacattcaaatatatcttattttctaaagatttatttggaagtgcaagtagaatatattagaagtagatagagtttgggggtcagacatacttgctttaagagctcagctc

SEQ ID NO: 185796 - DNA, 601 bp, Human
aagacttgttcaatttgtaacatcattctgcctgattctgtcaccaataagtacaaattgagtctaatgacaaaatgataaaaagatattttggccaggtgcagtggctcacgccttaatcccagcactttggaaggccgaggcaggtggattgcctgagatcaggagttcgagaccagcctggttaacctggcaaaactccgtctctactaaaaacacaaaatttagctgtgtgtgatggtgggcatctgtaatcccagctactcgggaggctgaggcaggagaatcacttgaacccagraggcggaggttgcagtgagctggaattgcgccactgtactccagactgggtgacaagagcgaaactcctctcaaaaacaaacaaacaaaaaagatatttcacatgatatgaatagccattttttgtcatccaaattattaacaaatcactgcaatttcagaaaagcttctgttaacagtaatgacaacttatcatctttgtactttagaataagttgccaggtatgaaaattagggcaattccttactatttcaagtgctaaatttgaatctgtatgtaataagtaaactttgagtatta

SEQ ID NO: 185797 - DNA, 601 bp, Human
tccagactgggtgacaagagcgaaactcctctcaaaaacaaacaaacaaaaaagatatttcacatgatatgaatagccattttttgtcatccaaattattaacaaatcactgcaatttcagaaaagcttctgttaacagtaatgacaacttatcatctttgtactttagaataagttgccaggtatgaaaattagggcaattccttactatttcaagtgctaaatttgaatctgtatgtaataagtaaactttgagtattagcttatttgccttaacttgtttaatgttttaaataaaatkgtagtacttttcaagtaaattcatttacaggattaaagaatcaaacagtactgttaaaggcttataataaaaaataccatttcaataaatgcattggggacaactacatagcatttgggaaaacacaaatttgggtttgtacatgactactgtgacaatgtaaatatcagatggatcaagattttaaaggtgaaaactaaaccacaaaagtcctaaagaaaacataagaattttaaaaataattaagcataacttttaaaatatattttaaactggaggtataaatagaaaaaagatagt

SEQ ID NO: 185798 - DNA, 601 bp, Human
cacattttttggcgtggcctggtggctcatgcttgtaatcccagcaccttggggggctgaggtgggtggaacacctgagatcaggagttcaggaccaacctggccaacatggggaaacctcatctctactaaaaatacaaaaatcagccaagtgtggtggtgggttcctataatcccagctatgcaggaggctgaggcaggagaatcacttgaacttgggaggcagaagttgcactgagccaagatcgtgccactgcactccagcctgggagacagagcaaaactctgtattaaaaaaaawaaaaaaataaataaaaattcacattttaatgactgtaaatattgtcatgtgcagagctaagtggtgtaccttttctttcttgaatagtttgtcgtttgtttcggtttgttttttttctggcatttctaattctttctactttccctgttattgccttccatatttttcaaattttctcattgagtttcttgttttctgagagtatcattcagacctgctattccatctgttgtagggagctttctaagccatctgcagaattcccattctgtgactacctttatttttttctctgagttg

SEQ ID NO: 185799 - DNA, 601 bp, Human
ttttttggcgtggcctggtggctcatgcttgtaatcccagcaccttggggggctgaggtgggtggaacacctgagatcaggagttcaggaccaacctggccaacatggggaaacctcatctctactaaaaatacaaaaatcagccaagtgtggtggtgggttcctataatcccagctatgcaggaggctgaggcaggagaatcacttgaacttgggaggcagaagttgcactgagccaagatcgtgccactgcactccagcctgggagacagagcaaaactctgtattaaaaaaaaaaaawaaataaataaaaattcacattttaatgactgtaaatattgtcatgtgcagagctaagtggtgtaccttttctttcttgaatagtttgtcgtttgtttcggtttgttttttttctggcatttctaattctttctactttccctgttattgccttccatatttttcaaattttctcattgagtttcttgttttctgagagtatcattcagacctgctattccatctgttgtagggagctttctaagccatctgcagaattcccattctgtgactacctttatttttttctctgagttgattc

SEQ ID NO: 185800 - DNA, 601 bp, Human
ttggcgtggcctggtggctcatgcttgtaatcccagcaccttggggggctgaggtgggtggaacacctgagatcaggagttcaggaccaacctggccaacatggggaaacctcatctctactaaaaatacaaaaatcagccaagtgtggtggtgggttcctataatcccagctatgcaggaggctgaggcaggagaatcacttgaacttgggaggcagaagttgcactgagccaagatcgtgccactgcactccagcctgggagacagagcaaaactctgtattaaaaaaaaaaaaaaaataaataaaaattcacattttaatgactgtaaatattgtcatgtgcagagctaagtggtgtaccttttctttcttgaatagtttgtcgtttgtttcggtttgttttttttctggcatttctaattctttctactttccctgttattgccttccatatttttcaaattttctcattgagtttcttgttttctgagagtatcattcagacctgctattccatctgttgtagggagctttctaagccatctgcagaattcccattctgtgactacctttatttttttctctgagttgattccact

SEQ ID NO: 185801 - DNA, 601 bp, Human
cgtggcctggtggctcatgcttgtaatcccagcaccttggggggctgaggtgggtggaacacctgagatcaggagttcaggaccaacctggccaacatggggaaacctcatctctactaaaaatacaaaaatcagccaagtgtggtggtgggttcctataatcccagctatgcaggaggctgaggcaggagaatcacttgaacttgggaggcagaagttgcactgagccaagatcgtgccactgcactccagcctgggagacagagcaaaactctgtattaaaaaaaaaaaaaaaataaataaaaattcacattttaatgactgtaaatattgtcatgtgcagagctaagtggtgtaccttttctttcttgaatagtttgtcgtttgtttcggtttgttttttttctggcatttctaattctttctactttccctgttattgccttccatatttttcaaattttctcattgagtttcttgttttctgagagtatcattcagacctgctattccatctgttgtagggagctttctaagccatctgcagaattcccattctgtgactacctttatttttttctctgagttgattccactgccg

SEQ ID NO: 185802 - DNA, 601 bp, Human
atggtttgtatagatactttaatctcttctgttcatgttgttttttcagaaaataagtacttaatcctaatcaatgtgagataaattaaggaacgcaggttatatttcttcttttaatgaagggcaaactcctccagatgtaagcatagcatctatttgcagtactgccacataagaagtaaaaatagcttggattattttggtatcaagtaggatttgtagatgaagaatattatctaaattggattttccatagctatggcagttaatattctaactgctgcagaagtaccaagagaartgcaaagaatcagaatcttagcagtcattcatccattcgacacctactaactgcaaggcacactgctggataatatgcagtatggaaagtgaggacatacacaacttaaaaaatggaaagtctcataataggagcaaaaattattgttagaagagtgcttatgagaagtacagatatcacaacatcattccagattcacagactctatgttctattattcaattaaaaatgtttttagctttattggcttaaacaatagcgacagagaacaagttatttcaggacctatataataaaaag

SEQ ID NO: 185803 - DNA, 601 bp, Human
gatctaggttgcgtgctgcttatgagaatctactgcctgatgatctgtcactgtctcccatcacccctagaagggaccgtctagttgcaggaaaacaagctcaggactctcactgattccacattacggtgagtgtataattatttcattatatattacagtgtaataataatagaaataaagtgcacaaaaaaatataatgtgcttgaatcatcctgaaaccatgcccccatcagggttcatggaaaaattgtcttccacaaaacttgtccttggtgctgaaaaggttggggaccgatgmtctagagctcacagtcaactaaaaggataaatgaagcacacacataatgacctttacaaaaccagaataaggaagaactgtgggagggattctgagacaaatgctgagctctatccaagttcaatttacataaactggaggttaagtatgtctgtaattttcataataagtgatcgataaatccactgtttgactttactaaatgggaggaacagtgtcctggatcattataaataatcctcccagaattttaatttgttagtttgggaatagatattatttttctacagttgattgatc

SEQ ID NO: 185804 - DNA, 601 bp, Human
tgctgcttatgagaatctactgcctgatgatctgtcactgtctcccatcacccctagaagggaccgtctagttgcaggaaaacaagctcaggactctcactgattccacattacggtgagtgtataattatttcattatatattacagtgtaataataatagaaataaagtgcacaaaaaaatataatgtgcttgaatcatcctgaaaccatgcccccatcagggttcatggaaaaattgtcttccacaaaacttgtccttggtgctgaaaaggttggggaccgatgctctagagctcacrgtcaactaaaaggataaatgaagcacacacataatgacctttacaaaaccagaataaggaagaactgtgggagggattctgagacaaatgctgagctctatccaagttcaatttacataaactggaggttaagtatgtctgtaattttcataataagtgatcgataaatccactgtttgactttactaaatgggaggaacagtgtcctggatcattataaataatcctcccagaattttaatttgttagtttgggaatagatattatttttctacagttgattgatctgtgttttactaa

SEQ ID NO: 185805 - DNA, 601 bp, Human
agttgcaggaaaacaagctcaggactctcactgattccacattacggtgagtgtataattatttcattatatattacagtgtaataataatagaaataaagtgcacaaaaaaatataatgtgcttgaatcatcctgaaaccatgcccccatcagggttcatggaaaaattgtcttccacaaaacttgtccttggtgctgaaaaggttggggaccgatgctctagagctcacagtcaactaaaaggataaatgaagcacacacataatgacctttacaaaaccagaataaggaagaactgtkggagggattctgagacaaatgctgagctctatccaagttcaatttacataaactggaggttaagtatgtctgtaattttcataataagtgatcgataaatccactgtttgactttactaaatgggaggaacagtgtcctggatcattataaataatcctcccagaattttaatttgttagtttgggaatagatattatttttctacagttgattgatctgtgttttactaatgataatattaaaattatttttgctttgtcaatttcaactaatgttcaatactcttctcaaaatgttct

SEQ ID NO: 185806 - DNA, 601 bp, Human
gtcctggatcattataaataatcctcccagaattttaatttgttagtttgggaatagatattatttttctacagttgattgatctgtgttttactaatgataatattaaaattatttttgctttgtcaatttcaactaatgttcaatactcttctcaaaatgttctgaagattaggagagcatggctagaattacaaattggtcttggatcattcaaagagtgaatgattcatcaaggattaaaaaagaatttcctcaacttctaatcaaacccatagctgggtcctagacttagcaaaastgtggaggaggagatcagagtcatggtaacatctaggaggcccgtaagtgatttatgtatgtgagtttgtaccatatcttagtacttgagtctcgcatacaaaagattatcataaatattttttgcgtttgttaaatacattccaaatcaaatattatatccttgcattaggtagactttgctacataatttctttaaatagtaaagggagtagatttttgattatatgtgtctcagaattaagtgaactccctgatgtgtatgttttagtaactcatgtttaaaaacactgaatgagct

SEQ ID NO: 185807 - DNA, 601 bp, Human
aaattagatggtgaaattaagcatgtatgacattcatgaaaatttagtaataaaataatttacagacaggcaaatgctgagagattttgtcaccaccaggcctgccctacaagagctcctgaaggaagcactaaacatggaaaggaacaactggtaacggccactgcaaaaacatgccaaattgtaaagaccatcaagtctaggaagaaactgcatcaactaacgagcaaaataaccagctaacatcataatgacaggatcaaattcacacgtaacaatattaaccttaaatgtaaatggsctaaatgctccaattaaaagacacagactggcaaattggataaagagtcaagacccatcagtgtgctgtattcaggaaacctatctcatctgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcaccc

SEQ ID NO: 185808 - DNA, 601 bp, Human
atttcttctggaataaggggaataaatttacatttatttgcatttgtattatcagatttttcatttatttcaaaccatttaaggcatttaatagatgatgggtgaattataaatatttggaaaactttttgaaaattactgcctttatccaaaaacttttattggagtggatgagttccccatgtgaattgtcatttggccagtaacaggcacataccgtgatgaataaaatatagattctgttatagattagagcctggtgagagtaacaaatcattacatgaataatcacttaaatgarttagtggtaagtacttgagagaaaaagtgcaaggcactaggagactgaaacaaggcattgtctccaagtggtacatcagggaagatcaagcctggttttcttaagatcagtttggctgtgatgtgaatggatggaggaatgtgtagcttcaactaggaagctcttacagatgagcaagaatatgggagcagcaggagtggagagaaatggatgaatccaaacgtatcttgtagataaagccaacaagattttgtaactgtatgtgagagagaagtttaagagagttgaatgtggagaatg

SEQ ID NO: 185809 - DNA, 601 bp, Human
tacttgaatgggaaacaaatgaattttaaaaatgagcgttcttacatatttacatttaggtccaactgagtgccaccatttcttctcagctcaatagttaaggagtactcagctctttcagacatataaatgtatttgtacatgtatgcctgtgtatatacatatgtgtgtatacatacagatgcacattctgaaagctaagaccaataatttttctatttcactaaagtttgcagtagaaaacaatagtgagaaaaatctaggaatttaaaatcatttttatttacccaatgttaaaaamctcttgtattttaattgagtggttgaccaagaaggtattgactatcattaaggctatttaaatgaaacataaaatatgtgaagttttatgtactttattcctagacataatgactttaattaaagcagaacatttaattttaaacaaatcattaacttgttggttttcatcaatgattaaatacgtagtagctactactctaccaatatctcacaattatggtgagtttcaaacatgggtgtcacatttaaacatgctttgaaaaatatcaaacattatagaaacatgttaatattgcta

SEQ ID NO: 185810 - DNA, 601 bp, Human
cagactttggggccagattgcctgaattttatttatttatttatttatttatttatttatttatttattattgagagagagttttgctcttgttgcccaggctgcagtgcagtggtgcagtcttggctcactacaacctccacctccccagttcaagtgattctcctgcctcaccctcccaagtagctgggattacaggcatgcaccaccatgcttggtgaatttttgtatttttagtagagatggggtttcaccatgttggtcaggctggtctcaaactcctgacctcaggtgatccacsctccttggcctaccaaagttctgggattacaggcctgagccacagcgcctggcccagattgcctgaatttaaatcccagctttactgcttatgagctttgtgatcttgtgtgaattcctcagccactctgcacctcacatgcctcttttagaaaatggagatgctaataacgcctaccccacagggctgtgatgaggagtaatgccatgtcggtgttagcctagtgatctcaagatgtttatagaagggaatgtaggtatacagcttcagaatattagtacttgattaaggagaatgtct

SEQ ID NO: 185811 - DNA, 601 bp, Human
tatttattattgagagagagttttgctcttgttgcccaggctgcagtgcagtggtgcagtcttggctcactacaacctccacctccccagttcaagtgattctcctgcctcaccctcccaagtagctgggattacaggcatgcaccaccatgcttggtgaatttttgtatttttagtagagatggggtttcaccatgttggtcaggctggtctcaaactcctgacctcaggtgatccaccctccttggcctaccaaagttctgggattacaggcctgagccacagcgcctggcccagattkcctgaatttaaatcccagctttactgcttatgagctttgtgatcttgtgtgaattcctcagccactctgcacctcacatgcctcttttagaaaatggagatgctaataacgcctaccccacagggctgtgatgaggagtaatgccatgtcggtgttagcctagtgatctcaagatgtttatagaagggaatgtaggtatacagcttcagaatattagtacttgattaaggagaatgtctaattgatcaagaaaaaatatttaagataaaatgacttttttcactactactctgttgaatc

SEQ ID NO: 185812 - DNA, 601 bp, Human
cctcaccctcccaagtagctgggattacaggcatgcaccaccatgcttggtgaatttttgtatttttagtagagatggggtttcaccatgttggtcaggctggtctcaaactcctgacctcaggtgatccaccctccttggcctaccaaagttctgggattacaggcctgagccacagcgcctggcccagattgcctgaatttaaatcccagctttactgcttatgagctttgtgatcttgtgtgaattcctcagccactctgcacctcacatgcctcttttagaaaatggagatgctaayaacgcctaccccacagggctgtgatgaggagtaatgccatgtcggtgttagcctagtgatctcaagatgtttatagaagggaatgtaggtatacagcttcagaatattagtacttgattaaggagaatgtctaattgatcaagaaaaaatatttaagataaaatgacttttttcactactactctgttgaatctattttatttaaattttacctgaatcttactttacctagatgtccatgcccattttctaatgccccagaagcttgaggcccagtgttgatctaacttgataataaaa

SEQ ID NO: 185813 - DNA, 601 bp, Human
cttattccaagttaccaacttcacagctacaaagtgatctcattgttccaatgaaatgatttcagggtctggtagaaaccactaacaattgtctgcagttgcacatccttacacaggcttgaattttagagaggagtcttatagagaaaagaatggataattatgaatttataggaagtaattttgttagtttcacattataacaggtgatatgattgtcttcttatctttatgtgtcaaaactgacaatgacctttaaaatgcacgatgagtgtttcataattctgctctcactaaaackatgactggtgtccttccaccaggaatttgtattactagcaagaaaaagtcaaaaattactttaaataatagttttaactctggtcgtaggtagaaaaaaagcatcttttttgcttggattcatctataaatataaacgtataccttaaaaataacacgttaaatgttctgtattctacaactattggttcatgcttattacttgttagaaaattcttggcatacagataacatcgtattttatttacttgctatgacatttcttcagaatgtctccatgaggattatcttgggagtttgc

SEQ ID NO: 185814 - DNA, 601 bp, Human
ttatagagaaaagaatggataattatgaatttataggaagtaattttgttagtttcacattataacaggtgatatgattgtcttcttatctttatgtgtcaaaactgacaatgacctttaaaatgcacgatgagtgtttcataattctgctctcactaaaacgatgactggtgtccttccaccaggaatttgtattactagcaagaaaaagtcaaaaattactttaaataatagttttaactctggtcgtaggtagaaaaaaagcatcttttttgcttggattcatctataaatataaacrtataccttaaaaataacacgttaaatgttctgtattctacaactattggttcatgcttattacttgttagaaaattcttggcatacagataacatcgtattttatttacttgctatgacatttcttcagaatgtctccatgaggattatcttgggagtttgcaagagataccatccttaattctgtctgacatttctagatgaataacagggaaattgggtaccctattcaggtccaagcaacaagtgcagagctttctccaacacattgtttgaatttacaaaaccaaatatgaaactc

SEQ ID NO: 185815 - DNA, 601 bp, Human
ctaactgttctgcataatatacacccattgtctattttgtggtatcacactgaaacccagatttgcatgttttaaaatagggatattgagaatttaaccaaatcactaacttttaaaaaagttacttaaaaatcactaacttaatttttctaattaaagccacacactagaagggacaaatataggtaggtacagctgatccctttatggtctccacacattgtgatgagcacacattctgtccctataacctgcaccaacatttgggaaccagcaatgcctggccagtgagggaccaggrggagagtcagaactgctctttttttctcaggagagcaattggatcaatttgtgacttcagccaaatcactcaagactctagtctaaatttatctgttttatcataacttagccctcaggtatattatgggattaagccggaagcactttaaatgcactctggtgacaggtgttctatgaaggagtcttataaatattacctacttagccacagaaacacttaaagagaatggaaaaggagaaggcacattctgccaaagtggcgatatgctaatacacctgcatcaggatctttattcag

SEQ ID NO: 185816 - DNA, 601 bp, Human
aaggcacattctgccaaagtggcgatatgctaatacacctgcatcaggatctttattcagaacattacactgaacacgttagtaactatttcatatgtttaccattggaaatgtcaagtagaaagttatttatccatttgggatggagcgaatatatgtgtggatggctgccaaaaccaagaattaatcacaagttattaatcaatttggaaaatataaacagataaattttcagaaatgcaaaacattcggagcatgaaacatttttatggcctaatgactttgaaagccagcaaattaygtttccaataaataagccctcaactttgtaaaactctatagtattttgagttaccttaggtaatggcacataattctcaaagcaactttaattttatagcacttttgtttttcttatacattatattttaattatcaagagagaagctattgcaaagtaaatgtgatgccataattctttaaaaagttgaaaatttatcttttatatgatgtacgtagattgtactgtgtttttatttctaaatttcttggaatggtagtattgagagtcgctcttgaattcttcagaaataccttagaa

SEQ ID NO: 185817 - DNA, 601 bp, Human
aaggactgttgtttgtatttcttatgtgagagatgttaacaatgtgtctatgcaaccgtgagaaagatgactgcagagtatctacaagtatatttaataccttgaatgtgcataaaattcaataatgtaaacacaatttatgtgcattcaatatttttattcattaataatgccactttaagaaaatcagtcttagaacatacaatgaaaagagcaagatatcattggaaaaaatctacaccttttgttctgccatattgaaggccgttgcttcacactctccattggccatgtgttttawgcagtcttccaaatcttttgcagaaacatttccatagctttgtgcatttattcaatcatgtttatagtttatttgtcttcgaaagtatttgagggtcttataaatgcaatcaaataaaaatctctacactgagagaaaaagacaagagctaatgaatagagagtaggaaagagaagaaaataagcaaaaacacctatactgagtgaggcaactgcatttgaacaaaaagcctctctgaaagatctgagggcctatttatttactcaagaaacatttgagtgcctgttttgtgtgacatac

SEQ ID NO: 185818 - DNA, 601 bp, Human
aactttgataatattaacctcacaggccgggttcagtggctcacacctgtaatcccagcactttgggaggccgaggcgggcaggtaacttgaggtcaggagttcgataccagcctggccaacatggtgaaactctgtctctactaaaaatacaaaaattagctgggcatggtggtgtgcacctctaatctcagctatgtgggaggctgaggcaggagaatctcttaatcccaggagacagaggcttcagtgagccgagctcacatcactgcactccagtgtgggcgacaaaggagactctrtctcaaagaaaagaaaactattcttgtagtctaatcaataagtaataaagggcatgattataaaaaccagtgaaatggctgatgggagtgacatcaaggagattgaatgaacacagaacaggcaaaggacttaagtttcagaagtgattgctgacgtatcaagtctgaaatgatagtgcctttaaatgaagtagaaaacacttgaagaaaacattcttttagaagagatgagtcagtttgaagcctacagcattagggctacggaaagaatctgcaatcaaaagccccttaagatgtgag

SEQ ID NO: 185819 - DNA, 601 bp, Human
aatactcaactacgattacaaactgaagcaaagaagtctgtaaatagggagaaactgaagatgcaagcacaacaaacaataataaattatccagacataccggaagaggccaaaagggaaggcacaggtataaacatgggtcagcatctttaccttgaggacacaggaaaaggaaaggaggggcatggacactcactttgaggacaaagtagaaataaaggcttattgcatattcacattgcatatgcatattcttctcatatagaaagaattttttagtgtagatatgatttagtaaaayatttgctgtttataagaggcattaatcacaagattgttttcaggccaatagatacacctactactttcttccctcatgaacagcgagcccaacttaggtaaaagtagagagaaatatagaagtagaggaagtcaaactaaacgatggtgaaaggggcaggccttgggataagaaaaagtctattattgcaatttcagtttaatttcagttttgctaggtttttcaagctgctggggaaaatgtgggcatttcattttatcccttttatctaagactcctttcctttgtaaattaccagtg

SEQ ID NO: 185820 - DNA, 601 bp, Human
tcaaatggtataaaatttctgaagcatgctaattatgtatcgtttccaagcgaggaaatgccaagggactggcttaccatatgaagagtcctgcctgtgttttatcagtaagtccttgtggttatggtgatacatttttgtatactctactggtaacttactatgggcttaaaaacctttttcactgggagcttatgcaagtgaatgtggtgtgtttctttgcagctgttgccatagaaataaagaccttttcaaagtaaaatgaggatggcataagaattacaaattcaaaagaagttaygcttctaatttaatatcaaaaatggtgcactattccctttctttttaattttgtcaaaattgcatgacctgagtgcgtctaatatacttttattagataatttctagtatcagaaaagctaaagccgaaaaaatggaatagatgaattccccacagcattcagtaggatgggctttaatctttaatcttttattcttaagacttataatatttctaattgtcttctgcatgctctacctccatactactttctatcttattttccatttaaatctaattacctataatgggctttcttaa

SEQ ID NO: 185821 - DNA, 601 bp, Human
ttaactttaataaataatttatagggtgatttgctttaactgactactgatgaagaattgaagattaattttcaaaatacagcatcacttgctccatttttaaataaaagttgtaaataatattctgagagtctaaaattacttcaaaatttcttcttccatttccttcaaaatatctttgttaaaatgatttctatcttaatgtcattaaaacaaaataatgaagcacttttttaattaattaattaatttctgagacagagtctcactctgtcttccccaggctggagtgcagtggtgygatcttggctcactgcaacctccacctcccgggttcaagcgattctcctgtctcagcctcccaagtagctgggactagaggtgtgtgccaccacacctggctaattttgtatttttagtagagacgggtttcaccatgttggcctggccggtctcgaactcctgacctcaggtgatccatctgccttggcctcccaaagtgctgggattacaggtgtgagccaccacgcccagccaatgaagcacttagataaaagttatcctctaaaacaatgatccccaaccttttttggcaccaggg

SEQ ID NO: 185822 - DNA, 601 bp, Human
ttaataaataatttatagggtgatttgctttaactgactactgatgaagaattgaagattaattttcaaaatacagcatcacttgctccatttttaaataaaagttgtaaataatattctgagagtctaaaattacttcaaaatttcttcttccatttccttcaaaatatctttgttaaaatgatttctatcttaatgtcattaaaacaaaataatgaagcacttttttaattaattaattaatttctgagacagagtctcactctgtcttccccaggctggagtgcagtggtgcgatctyggctcactgcaacctccacctcccgggttcaagcgattctcctgtctcagcctcccaagtagctgggactagaggtgtgtgccaccacacctggctaattttgtatttttagtagagacgggtttcaccatgttggcctggccggtctcgaactcctgacctcaggtgatccatctgccttggcctcccaaagtgctgggattacaggtgtgagccaccacgcccagccaatgaagcacttagataaaagttatcctctaaaacaatgatccccaaccttttttggcaccagggatgggt

SEQ ID NO: 185823 - DNA, 601 bp, Human
tgtgagccaccacgcccagccaatgaagcacttagataaaagttatcctctaaaacaatgatccccaaccttttttggcaccagggatgggttttctggaagatttttcaaggactggggttgaagatagggtttcagggtgaaactgttccacctcaatcatcaggtctagtttgattctcataaggagcgtgtagcctagattcttcgccatgagtggttcacaatagggttcatactcctatgagaatctaatgcccccactgatgtgacaggaggcagagttcatgcggtaatgctsgcccgccactcacctcctgctgtgcagcccggttcctaacagtccacagaccggtaccagcctggggcctgggggttggggacccctgccctataagaaatgtcaattcaacttgaagtagatatgttaacaagcaaaaagcaggatcatgtcttacattaaaaactatataatagtgtttatttcttcaaagagtgcatataggtactttgtatgggaaatcactatttcactcatgattttttgtttcattgtaattacaaaatgataaaaagttaatgagtgccatagggaatcttt

SEQ ID NO: 185824 - DNA, 601 bp, Human
gctatgcaacatatgttaccaggacttagaacccaggcagccatattctatataaagcaaggataacatgtttcactgtctgttctgttttattcctggctacctggactagttctgctggagtccatatgcagggcaagacaaccagtagggctaaaactgattatataaatagaatttctgaaaaagtattataagaggaaagagcagtttcctccctcaactctttcaaccttttttccccccggaaaaaagataaaatgaagttaatggacaatttgtgaagaatagtccaacttayctttttaaaattggaagatcccttttacacaaagatttaaacagataatctattatatgaccacttatagctaaaacaccctcaagtttaacaaaaaggacagttatttgatagatttaggtatgtggacagccaaacaagcagaaaccatttaagataagataatccaggtaacggttggtgaagataactaactttaggatcgagtttagacttaatgttgactggcacgaggatgctgagatttaaagaagttaatatgacttgttcagagtcacaaagccagaaattggtagtcat

SEQ ID NO: 185825 - DNA, 601 bp, Human
taaggagggctgtttgttgtttgattagtttatgcctctgatgtatatctggttccttgaaatttttattaataaaatgtaaccctctgtataacctcaccaaagtaaaatctcaaaaggcattaattctggagtcttgcaaactcctgggtgagccctgcctgtgtgacccagggaatactacttagcctctctgagtctcagttcttcagttatacaaccgaaataatactaatggtacctaacccgaagttgatgattagaaaaatatatgtgtaaagtagccaatacagggcctatyacatgctaggtattcaataattgctaattattatatcatagttataatattaatttctaagtatttgaacataataaaatcctctagcactaaaaccatggaaaagatttagtgtttcttttggaatccgaagacttttctggatttgttgctagcacagttgcccaggaagaagtgtgactagccagtgggtgtttgggggtgaaatccagcctgtgccctgctaactactaacactgtacctcagtgtagagctgcagctaatagggaaagcactgtatctgctaaatggagctctgt

SEQ ID NO: 185826 - DNA, 601 bp, Human
gggggtgaaatccagcctgtgccctgctaactactaacactgtacctcagtgtagagctgcagctaatagggaaagcactgtatctgctaaatggagctctgtctcctgagtcattaagccagttagcactgtcctacagaagcttggaagtgccagttagtagacttttccatttagtaaagtgctgaataaataaacttttactacaactggtttctttaaagtgtttgtacttctaatgatattctagaacagttttgaatttttttctctttgtcatcacatagatgcttgtaaaaycagccgaatatcaggaataaactatttataacataggttgacatggtactatttgaaatgttttgtggactgcagatgtttcataaggattctttattctttttccttccattccttgatgttatggaatatgtcagaaggcttttttaaggtcaccatatatctaacctcttgaaaacgtatactcttatttcaaagctctaagaaactggtacctggatcactagacccaaatttaacttcagcttgctcagtttacatcttaaactccatttaaaaattgttattgtgctattagag

SEQ ID NO: 185827 - DNA, 601 bp, Human
gcactgtatctgctaaatggagctctgtctcctgagtcattaagccagttagcactgtcctacagaagcttggaagtgccagttagtagacttttccatttagtaaagtgctgaataaataaacttttactacaactggtttctttaaagtgtttgtacttctaatgatattctagaacagttttgaatttttttctctttgtcatcacatagatgcttgtaaaaccagccgaatatcaggaataaactatttataacataggttgacatggtactatttgaaatgttttgtggactgcaratgtttcataaggattctttattctttttccttccattccttgatgttatggaatatgtcagaaggcttttttaaggtcaccatatatctaacctcttgaaaacgtatactcttatttcaaagctctaagaaactggtacctggatcactagacccaaatttaacttcagcttgctcagtttacatcttaaactccatttaaaaattgttattgtgctattagagaaaagtcccatatgatacccaatttgtattttgaaattcagctggataaattgaaatgctgaaagtgagttatgc

SEQ ID NO: 185828 - DNA, 601 bp, Human
gaataaataaacttttactacaactggtttctttaaagtgtttgtacttctaatgatattctagaacagttttgaatttttttctctttgtcatcacatagatgcttgtaaaaccagccgaatatcaggaataaactatttataacataggttgacatggtactatttgaaatgttttgtggactgcagatgtttcataaggattctttattctttttccttccattccttgatgttatggaatatgtcagaaggcttttttaaggtcaccatatatctaacctcttgaaaacgtatactsttatttcaaagctctaagaaactggtacctggatcactagacccaaatttaacttcagcttgctcagtttacatcttaaactccatttaaaaattgttattgtgctattagagaaaagtcccatatgatacccaatttgtattttgaaattcagctggataaattgaaatgctgaaagtgagttatgctattgcaacactcaccatatattaataactgaactgatatttgcgggataaggtttttctatcagagaaaaataaaatgatgttaaactgctagattccttggatggttagt

SEQ ID NO: 185829 - DNA, 601 bp, Human
gtttcataaggattctttattctttttccttccattccttgatgttatggaatatgtcagaaggcttttttaaggtcaccatatatctaacctcttgaaaacgtatactcttatttcaaagctctaagaaactggtacctggatcactagacccaaatttaacttcagcttgctcagtttacatcttaaactccatttaaaaattgttattgtgctattagagaaaagtcccatatgatacccaatttgtattttgaaattcagctggataaattgaaatgctgaaagtgagttatgctaytgcaacactcaccatatattaataactgaactgatatttgcgggataaggtttttctatcagagaaaaataaaatgatgttaaactgctagattccttggatggttagttcttttctggggtgaaagacttgagcaacactagaccccagtatacacaacctcaaaaactaattgaggctttgccctataatataataaatggccctatacttttcgtatttctatattttactactctagaaatatttccatttggaaatgttacctatccacaacagaattcagcattcacagcagtt

SEQ ID NO: 185830 - DNA, 601 bp, Human
tggaaatgttacctatccacaacagaattcagcattcacagcagttaaatataacaaactatacacacccctgccccacccccctgacacacacacaccaaggataaatcttaaaaacaataatattgaatacaagaaaaaatacataagtacatatatttcttttttaagagtacatgaaacagaaagataatgtaaactcgtgagagtagttatcccaagaggaaggtgagggaaaaaggactacagatggtcaaaaagtatttccatttaatctatgatattttgttgattaaaaaaytcttgaagaaaatatctcaaactgttactagttgttaatgctgtgctgtgggaaaataatcatttgttatgttactctttttacatatctgcattttaaaactatctcaacaaaataatttcaaattttttacaaaggttttatctcatgttatctacagcaaaaacaaaaataaaaacaaaaacatcaccagatcttaaagaactttcaaggcataattagtttcatggttttgatgtcgatgctcatctcaaagtatagtaatgaatgcgatcacactttttctcattagtacaaact

SEQ ID NO: 185831 - DNA, 601 bp, Human
ttcaaggcataattagtttcatggttttgatgtcgatgctcatctcaaagtatagtaatgaatgcgatcacactttttctcattagtacaaactcctcatttgtctagtacctttcaaaaagttacgtttacttccattttcattgttagctcagtccaaaaacaagaacaaatatttattgagcacctattgtttgccagaaactgctgtaggcagaggataaaccaatggacacaatagactgggaatcagcagactacagcccttgggccaaatctggtgtaccatgtgtttttttttaaataaagttttattggaacacattcatgcccatttgcttacatattgcctttgggtgcttacaatagcagagttgagtagttgtgacaaagactatatgtctcacaaagcctaaaatatttactttaaatatttcttacttttcacaggaaaagtttagtaacacctaaaatagtcaaaaacctctgccctcatggaacttacattctattatggagacagatggccacaaaataaataagttttagtgtggttgatggtgatacatgcaaccaagattaagaaagcagaggaagggga

SEQ ID NO: 185832 - DNA, 601 bp, Human
gtatggctagaatggtgaaggaagatgagaggaggtcagagagtccacacggaaaggcagagcacagccttgcaggtcattcattataaggagttcagcttttactctgagtaagggccctcatttgtctgttgtaaaatctagactgttcatttcatttagaaacagaggccaaagctatagatactgactccttaggtcaaatgctattcaagtctgaaaacttcaattctaacctcgccagcaatggtaaggatcgccacactgccagttcttaccagtgctaccaggggaagaaagmaagaaaactggtgactatatgttgccacaatttgaaaaacatttctgtgacacatctatcccataagttatccatgatgacacactagtgtcggcactagagagcacatgctatgtaaggttttatttcaggccagtaggttggcctcaataacattaaatttcaaactgaggatttggggtatatttttcttagatatttgccaagaatgtaattgatcactggctctacatctgaatgtgttcagccaccttctacgtgcccctaggcagtttaattcctctgggaatgcttgggaac

SEQ ID NO: 185833 - DNA, 601 bp, Human
gcaagaaaactggtgactatatgttgccacaatttgaaaaacatttctgtgacacatctatcccataagttatccatgatgacacactagtgtcggcactagagagcacatgctatgtaaggttttatttcaggccagtaggttggcctcaataacattaaatttcaaactgaggatttggggtatatttttcttagatatttgccaagaatgtaattgatcactggctctacatctgaatgtgttcagccaccttctacgtgcccctaggcagtttaattcctctgggaatgcttgggamcttctgcacagaagaatgggtagacctttcacagagagttcattccgtggcagctaccatacctgccctccagaatttatagtctaatcatgaggaaaagatcatagaaagcccctttcaaatgtatatatttctcttaaatacctctcagatcttcatatattctagcccactatctttaggcaggtatgtttttattccttttttttccctaaggtagaaattgctcaggctgagagattatgtgactttttcagattcacttaattaataaatgaaagaggatgtactagtggtcag

SEQ ID NO: 185834 - DNA, 601 bp, Human
tggcctcaataacattaaatttcaaactgaggatttggggtatatttttcttagatatttgccaagaatgtaattgatcactggctctacatctgaatgtgttcagccaccttctacgtgcccctaggcagtttaattcctctgggaatgcttgggaacttctgcacagaagaatgggtagacctttcacagagagttcattccgtggcagctaccatacctgccctccagaatttatagtctaatcatgaggaaaagatcatagaaagcccctttcaaatgtatatatttctcttaaatrcctctcagatcttcatatattctagcccactatctttaggcaggtatgtttttattccttttttttccctaaggtagaaattgctcaggctgagagattatgtgactttttcagattcacttaattaataaatgaaagaggatgtactagtggtcaggtatctggcttctcatacaatgcacattttttttctatcctgttttttaagtcaatgatcaatttgtgtcataaatatatgagttagaatctgtatcacctcaatataatatacacccttctaaaatataaagcatgactatg

SEQ ID NO: 185835 - DNA, 601 bp, Human
ttctcccttgagtacaagttcattaaattattaatatccttttataagtcttgtaggactacttacacaatgcagctttctctgttttcaaaactatagtttataatgaaggatgaaatagatctcacttccttatactgtatatctttttttccagtcaaaaacaatgggctgggtaaatatcagagaataatagatactatattcagttacataaaatgttaatgtaagattaaaaatattttttagcctgggcaacatagagacacccatctctacaaaaaaattaacaatttgctargtatggtggcacatacctgtagtcccagctacttgggaggctgaggcaggaggatacttaagcccacgaggttgaggctgctgtgagcaatgatcacaccactttacttcagcctgggtgacagagcaagactcttatctcaaaaaaaaaaaagatttgcacatggaaatggaaatggaaatgttatacggtcagctgtttgtatctgtgggttttacatccgtggattcaaccaaccatggattgaaaatatttgaaaagaaaatatggttacatcttactgaacatgtacagacattt

SEQ ID NO: 185836 - DNA, 601 bp, Human
aaattattaatatccttttataagtcttgtaggactacttacacaatgcagctttctctgttttcaaaactatagtttataatgaaggatgaaatagatctcacttccttatactgtatatctttttttccagtcaaaaacaatgggctgggtaaatatcagagaataatagatactatattcagttacataaaatgttaatgtaagattaaaaatattttttagcctgggcaacatagagacacccatctctacaaaaaaattaacaatttgctaagtatggtggcacatacctgtagtyccagctacttgggaggctgaggcaggaggatacttaagcccacgaggttgaggctgctgtgagcaatgatcacaccactttacttcagcctgggtgacagagcaagactcttatctcaaaaaaaaaaaagatttgcacatggaaatggaaatggaaatgttatacggtcagctgtttgtatctgtgggttttacatccgtggattcaaccaaccatggattgaaaatatttgaaaagaaaatatggttacatcttactgaacatgtacagacatttttttggtcattattccccaaacat

SEQ ID NO: 185837 - DNA, 601 bp, Human
caaaactatagtttataatgaaggatgaaatagatctcacttccttatactgtatatctttttttccagtcaaaaacaatgggctgggtaaatatcagagaataatagatactatattcagttacataaaatgttaatgtaagattaaaaatattttttagcctgggcaacatagagacacccatctctacaaaaaaattaacaatttgctaagtatggtggcacatacctgtagtcccagctacttgggaggctgaggcaggaggatacttaagcccacgaggttgaggctgctgtgagmaatgatcacaccactttacttcagcctgggtgacagagcaagactcttatctcaaaaaaaaaaaagatttgcacatggaaatggaaatggaaatgttatacggtcagctgtttgtatctgtgggttttacatccgtggattcaaccaaccatggattgaaaatatttgaaaagaaaatatggttacatcttactgaacatgtacagacatttttttggtcattattccccaaacattacaatataacaactatttacatggcattttcattgtacgtattataagtaatctaaagatgat

SEQ ID NO: 185838 - DNA, 601 bp, Human
cagagcactcaccataatctacaaggcccagcctaatctggcctgcctgccacccaaccacacacttgctcttctctagcaacctgtgtttctttctattccttgaagaatttgttcttgctgttccctctactggacagctttccctggatgcacctggatgctctttctcagaccttgcatgatccttggactcactttgttcacatttctgctgagggcttccctgatttttctatctaaaacagcacaccttcctgtataactctgtactgccttaccctgctttatttttctgtayttcctatcactatccaaaattcgtatctttatttatttagttcttagagatgcaataagtatagcctagtggtaatggtcagagatgatacagccaagttgcctggattcgagtcttaactctggtgtttactggccccataaccttgggcaagttatgttgtcactaatttgcctcacccttaaaatgggaatacctcaaatatattttgaggattaaatgaataaatatgtgtaagtttctttgaatgatatttggcatctattactattattgtccccactggtatataagctctat

SEQ ID NO: 185839 - DNA, 601 bp, Human
ctgagggcttccctgatttttctatctaaaacagcacaccttcctgtataactctgtactgccttaccctgctttatttttctgtatttcctatcactatccaaaattcgtatctttatttatttagttcttagagatgcaataagtatagcctagtggtaatggtcagagatgatacagccaagttgcctggattcgagtcttaactctggtgtttactggccccataaccttgggcaagttatgttgtcactaatttgcctcacccttaaaatgggaatacctcaaatatattttgagkattaaatgaataaatatgtgtaagtttctttgaatgatatttggcatctattactattattgtccccactggtatataagctctattgagacagaattcaaggtatttccagagcatggtaaagcatctaacccacaatagggacttcgtaaatacttcttaaattaatttatgaacaattctgggcacatgccagctgaaagtggggaaaatatcttataaaaacacagcgaaaagccagcaggtgaacaaataaagagtttaaaagtcataatggaaattttatgtagttgagaaagc

SEQ ID NO: 185840 - DNA, 601 bp, Human
tattattgtccccactggtatataagctctattgagacagaattcaaggtatttccagagcatggtaaagcatctaacccacaatagggacttcgtaaatacttcttaaattaatttatgaacaattctgggcacatgccagctgaaagtggggaaaatatcttataaaaacacagcgaaaagccagcaggtgaacaaataaagagtttaaaagtcataatggaaattttatgtagttgagaaagctgagttggttatgtgagttttgtaaatgtaaatgcatatgtactagatgtagcargaatgaggggaacaagatgtatttagggtttctgcctttaggatacttccctagaggtgaacagagaaaaagtcaaagaacataaaaagaatctggcgactgaccaacaattgctgccggcaggaccaactgggtcaccagctttcccaggaaaccctaaccttactttgggaaatgttggatctgatgggagctgagggaaggtaaattgtaaagcacagacttcaaattacttttacccagttacagcttcaggtgacattggatgttaagtttaaggaagcgaaaagtagtattcaa

SEQ ID NO: 185841 - DNA, 601 bp, Human
attaatttatgaacaattctgggcacatgccagctgaaagtggggaaaatatcttataaaaacacagcgaaaagccagcaggtgaacaaataaagagtttaaaagtcataatggaaattttatgtagttgagaaagctgagttggttatgtgagttttgtaaatgtaaatgcatatgtactagatgtagcaagaatgaggggaacaagatgtatttagggtttctgcctttaggatacttccctagaggtgaacagagaaaaagtcaaagaacataaaaagaatctggcgactgaccaacgattgctgccggcaggaccaactgggtcaccagctttcccaggaaaccctaaccttactttgggaaatgttggatctgatgggagctgagggaaggtaaattgtaaagcacagacttcaaattacttttacccagttacagcttcaggtgacattggatgttaagtttaaggaagcgaaaagtagtattcaaataaagaaaaatactctcggttttgtacaatagtatgtcccaagtgttcagtttttaaaggtcatcgatacattttccaaatatttaaatcaatcatgcaagaaaaaga

SEQ ID NO: 185842 - DNA, 601 bp, Human
ttaatttatgaacaattctgggcacatgccagctgaaagtggggaaaatatcttataaaaacacagcgaaaagccagcaggtgaacaaataaagagtttaaaagtcataatggaaattttatgtagttgagaaagctgagttggttatgtgagttttgtaaatgtaaatgcatatgtactagatgtagcaagaatgaggggaacaagatgtatttagggtttctgcctttaggatacttccctagaggtgaacagagaaaaagtcaaagaacataaaaagaatctggcgactgaccaacarttgctgccggcaggaccaactgggtcaccagctttcccaggaaaccctaaccttactttgggaaatgttggatctgatgggagctgagggaaggtaaattgtaaagcacagacttcaaattacttttacccagttacagcttcaggtgacattggatgttaagtttaaggaagcgaaaagtagtattcaaataaagaaaaatactctcggttttgtacaatagtatgtcccaagtgttcagtttttaaaggtcatcgatacattttccaaatatttaaatcaatcatgcaagaaaaagaa

SEQ ID NO: 185843 - DNA, 601 bp, Human
aagtggtgagctgggaaatgccgtctgaacacacttgatctaaagcctggggataagtatcagaagagaagagaaccgaagagcgcacacacgtctaagacaggttaccgcaggtgcatccagggaaagctgtccctgtttgaggacttttcaggggatataatgtcccaggttgttgctgaggttatgtaaatgactttttctacccacattttcctcctatccccatgatccctccactccagagggaaactggagtgctgaggtcatctataaccaaatgaacaagtctgtctaaatrcctgttgcaaataattgtcccttctcttccaccatgaaggcaagctctaggtcttaatcatcttaatatattttccccaacacagcaggtaaaacagacagtaaatttctgccaaataaaacttactcacatctttttgatagggtttttttctgaaatcagcacttaagtatcaaaatgcaatttaatccattaaattcacttcaattaatagagaattacataaggaaaatttttccatttcaaaattgggtgacctttatagttccacctcactgatcctctagagttctcttcatt

SEQ ID NO: 185844 - DNA, 601 bp, Human
ttctaccccttgagtatatcttttagattatgtaactcagaaatactgaaactatgtcctgtcactttaccttaattgaaatcaagatatccaaatattactaatgattatttgttccaatgctcactggtgatgctgagcttgttcctgtttcacgggcttagcctctgacctgtctgaagtttgtagatgaacttcactacactgtttttattttaacatttctattaaataagacttatcattttatatgcattatttgtccctctgcatgtcaattttgttgactctaaacctacaracataacagttcccataataaaagtgaaggagaaaagtcttcattcatgaggcattgtgaaagtggaatgttttagagatgtggaagcctggcagcataattctcagacaggaaggcaatgtatataaaggccaaattccccttctccagtatgggagtgtgctgcctgtgaacatccaaatatggaggaaagaacgttttcacaatgagctttcagcttccaccagcttcatgtggcaccaagatgttaaaatacatcacagtatattcaggaaattgtttagccataccctaccactg

SEQ ID NO: 185845 - DNA, 601 bp, Human
ttctttacatcaggcataaatcttatttcctttcatgaagttaaaaaagaaaactaaacttcccagatagtctgtaatgttttcctgtgtaattaacacctcattcacagttgtgtgtgccagtcaaggccctgtctcctctttcctaacatttccttaataccttgttcaggctgagctgatgcctaacagtgtgcaaaatacacatatggaaacaggggaatgttagagagaagtcagctgaattaccgtgacctgccagtttaaagagagtacttagacacaggtttcattttgtggktttggggtctgtgtgccatcccttaagtccaattactgctgtaacctcatcttcttcatcatcatcctcatcaacaataaaaaccatctgtcaaatgaataccaatagtccattatttgcattcttctcttcttaatgcttctaagagggccaaatgtttataaatcaagtgtctaatttaagatacacgttctctgacactgcaagtcatcctggaagcattaggttatttttactgttgaaaatttgtagatgtcattgatttaaatagccttgtatctttttttcttgctgttaata

SEQ ID NO: 185846 - DNA, 601 bp, Human
ctgttaatagtgaccctctgtgtccttgtgcacagaaaatgcaagtggaatcaagctttagatcattcaaataaaatcattccattgtgggaatctcctggcttcatttttaaaagttatattgaaatttaacatacattaagaaaaatgtgaatgtcataagggtacagcttgatgcttttttataaaatggacatacttatgcaaccaccacatagtccaagcaacagaacatcatcaccccaagaaactcctctcatgctttctttcagtcactttccactctcacatgggtaacccrttataacttctaataggatagattaggtttgcccattttgttctttgtatgatttgatcaacattatgtttatgagaaacatttatattgttgcatgtagttcaatttcattcattttcattgctatcaaatatatacttttccattgtatgaataaaccacattttttttatttctacctctaatgggtatcttgattgttattttagattttttaaaaaactcatatccacagttaaaaggtgattacacttttctaaaggatgcacactacatattttggaggttttcctagagaca

SEQ ID NO: 185847 - DNA, 601 bp, Human
acacttttctaaaggatgcacactacatattttggaggttttcctagagacattatctaacatttttatataaaaatggagaattggagagagggtagtagaagggcaatgaggaaaggaactaatatttattagaactaccatgtactggacattttggtaaaaatagttgttttcttttgaattgtggtaaaaaatatataacataaaatgtaccatccttaccacttttaagtatacacttcagtagtgtcaagtatattcacattgttgtgaaacagatctccagaacattttcatygtgcaaaactgaaactctataaacattaaacaactccttttttttcctcttccttttcttcagtcactggtaacccccattctattttctgtcctatgaatttggcttctttagatacttcatataaatggaatcatagagtatttggttttctgtgactggtttatttcacttagtataatgtcctcaaggttcctccatgttgttgcatgtgacaggattttcttcccttttaaggctgaaaatattccattgtatgtttgtacaacattttatttatccattcatccattggttgac

SEQ ID NO: 185848 - DNA, 601 bp, Human
gaataatactgctatgaacatgggtatgcaaatatcttttcttaaaactgtttccaattgttggagtatataaccagaaatgggattgctagatcatacggtaactctatttttttttttttttgagagagggtctcactctgtcacccaggcatgagtgcagtggtgccttctcagcttactgcgccctccacctcctgggctggagtgatcctcccacctcagcctcctcagtagttgggactacaggcatatgccatatgccaccatgcccagctaatttttgtatttttttttttttagaaacggggttttgccatggtgcccaggctggtctcaaacttctggcctcaggcaatccaccctcctcggcctcccaaagtgctaggattacaattttacaatcccatcaaccttgcacaagtgttccaatttctccatgtcctcaccaacacttgttttcagatttgttgatagtagccatcctactgggtgtatgcagtaggaattttaccagtgatctttttattcctttaacaaagttgttgcaaagtataagtaccattttacatcaatgaaatcttagcacaaaaggattcta

SEQ ID NO: 185849 - DNA, 601 bp, Human
tgggctggagtgatcctcccacctcagcctcctcagtagttgggactacaggcatatgccatatgccaccatgcccagctaatttttgtatttttttttttttagaaacggggttttgccatggtgcccaggctggtctcaaacttctggcctcaggcaatccaccctcctcggcctcccaaagtgctaggattacaattttacaatcccatcaaccttgcacaagtgttccaatttctccatgtcctcaccaacacttgttttcagatttgttgatagtagccatcctactgggtgtatrcagtaggaattttaccagtgatctttttattcctttaacaaagttgttgcaaagtataagtaccattttacatcaatgaaatcttagcacaaaaggattctataagagaaaaaatggggcacagggattttccagtccaggtgctcttgaacttgacaatgagcattttattctcaaagttccacataatcacaaaacaaattgaattcttttgttctgagctgcaagatataaggtgctctacaggattgcctgactttaaatatgaaataacagctttagttttagagtagtggttct

SEQ ID NO: 185850 - DNA, 601 bp, Human
tggccaagaccaaagagtgttgttagctcttaggtaggcttttgcctttccctaatgcttttaagtagaagatagatgatccttcagaggaacaggagacagtgcggctgtattcggtgcagcttggggccttgaaggagggaaacaagacaagggagttaattcctaggggtccttggagagaagaacaatgatgtctgggagtaggcatggactattgtgttgatagaaattgcagcccctaagaaaggtgccatggctcacacctgtaatcccaacactttgggaggaggccagagcyggagaatcacttcagtccaggagttcgagaccagcctgggcaacatagtgagaccctgtctctaaaaaaaaaaaaaaaaaaaaaaaaaattgagaaaaaaagagattgtgccctgcctggacccatagctctgttatgctctaaagcttccacccacatttctcatccatccacccctctcctctatcctccacaagtcactgatacttgagacttaagtctcaagagtttttcctaaggtgaatcttgtttctagtacagattgagcatccctaatctgaaaattcgaaatctgaaatg

SEQ ID NO: 185851 - DNA, 601 bp, Human
gaacaggagacagtgcggctgtattcggtgcagcttggggccttgaaggagggaaacaagacaagggagttaattcctaggggtccttggagagaagaacaatgatgtctgggagtaggcatggactattgtgttgatagaaattgcagcccctaagaaaggtgccatggctcacacctgtaatcccaacactttgggaggaggccagagccggagaatcacttcagtccaggagttcgagaccagcctgggcaacatagtgagaccctgtctctaaaaaaaaaaaaaaaaaaaaaaaaaattgagaaaaaaagagattgtgccctgcctggacccatagctctgttatgctctaaagcttccacccacatttctcatccatccacccctctcctctatcctccacaagtcactgatacttgagacttaagtctcaagagtttttcctaaggtgaatcttgtttctagtacagattgagcatccctaatctgaaaattcgaaatctgaaatgctccaaaatccaaaactttttgagcaacaacatggcaccacaagtggaaaattctacacctgacctcacatgacaggttgcagccaaaa

SEQ ID NO: 185852 - DNA, 601 bp, Human
ttacctgcatgtccactcggcaaaatcagccttctctctgccctcttccagcatgcacactgacactctgacactctgacaatggcaaggctggctgaaatcagcagtgaagtgcaggaatctggatgcttgccctcaccatatcctgaatcttggatgctttttactcctcatcttaacacatgccaatgttatgttacaatatctgacatttggtttgtttcaacattaactctgcgataaaagttaatcaacagtcagcttcattttccccgcttcctgcccaaatcaatatacatgwctcctttgaagaaaggggaatgtaaactaaagttgatcctatggttttaacttacctcaacctaatgtatgcttaaggaaagaaccaatcacttacctagataccattgatttagtttctttgtgttgttgtgaattaataaattacagtgtttccactttctaagtaaactttttatcattgattagtcctcagaggcgaatttacttatatttactaaaagaccaaatatactgattttcagaaaatgtaaactgcaagactagaacatggtgtacatgtgtataacttgttttaagt

SEQ ID NO: 185853 - DNA, 601 bp, Human
ctgtcttcaatattcccatttaatattgtttgatattaaaatataatggagtcacagtatttatcatctattcttctttggtttcaagggaagacgagggaaaacaggacctcccggaaaaccaggacccccaggaccacctgtgagtaagcaatacaatgactgtccctttaaagagtctgtctttatgtctgtgtgtttacctaaggattattttactcccctgtagataatgatttcctttattctactgtttagaatgactggtttcagcatttggatgagtagttcatactctctrtattcctaactccatcatcaccacaaaccaagagatgagggaggctggtaattgtccatacacctcacccacttctttattacacaaatggcaataacagtagtgtctgcttgaacatcccaagccaagtgtccagatagatgaatcctgttctgaacctacctgaacaccatcttctagatttcttaacatccaggctgttagaaaatcagacatctggggaagcatatccacttttcttgatatgaaactattttgttagtataatttcatgatttggtaaaaagtgctataaagatc

SEQ ID NO: 185854 - DNA, 601 bp, Human
agcttatctggatcctttaccccaagcttctagaaaaaaaaaatattcaatttcttgtagttctggtaactctgcagcctatgagagtctggtttgtgtccaagctgctccactgacactgcactctctgtggtcaccaacaatctctgcattgcagattccctgagcacttttcaggcttcttcttactttactgctacacagaaatgtatactattgactgctctctccttgaaactccctattctgttggtttagcaacattgggtttttttctcctatgcctggggccatctttttstctccattaacagcttttcttctaccccctacatgttggatggattaatgaatgccagttttttatttcaacccagacattgttgctgagtcccaggctggtacattcctttattttttagtatctccacttggaagtctcctagctaccacaaaagtataatgtccaaaactaatctctaaaaataatcctagatttttttgttcttcatcctcttcatctaaacagtctctaaatcatatcagttctacatcccagtagcccacaaatcctctccgtcttcactgtcaacggccttag

SEQ ID NO: 185855 - DNA, 601 bp, Human
acattgggtttttttctcctatgcctggggccatctttttgtctccattaacagcttttcttctaccccctacatgttggatggattaatgaatgccagttttttatttcaacccagacattgttgctgagtcccaggctggtacattcctttattttttagtatctccacttggaagtctcctagctaccacaaaagtataatgtccaaaactaatctctaaaaataatcctagatttttttgttcttcatcctcttcatctaaacagtctctaaatcatatcagttctacatcccagtrgcccacaaatcctctccgtcttcactgtcaacggccttagtttagacctctgtcaatttgaacctatatttttgaagtcatctgagagctggtctcattgcctctaccttctccaagtggagcaaaacctctaaatcatgacagcatctaggtgggcttggatggcttaaaattctctaaaagcttaaaactatttgattttaaattcctcaatcgcttcttttttcttcaagaaagatggattccacatcctctacatgccattctgggcccttcatggtttgccttttacctgccttg

SEQ ID NO: 185856 - DNA, 601 bp, Human
agagggcctcaacccagtaccctaggaatctcttaggatgtgctcacctgccaaaaatgaacatgattgctgtcctgtcattgatttcatttcactttagccattctagtggattgtcctattaacaatgcattggtgccaattgatatttgttatataaaagcacattgggggaatgagggggtgaggaagcatgagctgggtgtctgcattagtccattctcatactgctatgaagaactacctgagactgggtaacttataaagaaaagaggcttaattgactcacagttccacaggwtgttcaggaggcatggctgggaaggtctcaggaaacttacagtcatggcagaagggagaaggggaagcaagcacatcttcacatggcagcaggaaagagcgagtgtgaagcgggaagtgcacttttaagcaacctaatctcgtgagaactcactcacaagacagcactagggggatagtgctaaaccattagaaaccaccctcttgacccaatcacctcccaccaggttcctcccccagcactgaagactacaatttaacatgagatttggttggggacgcagagccaaaccatatcagt

SEQ ID NO: 185857 - DNA, 601 bp, Human
gtaccctaggaatctcttaggatgtgctcacctgccaaaaatgaacatgattgctgtcctgtcattgatttcatttcactttagccattctagtggattgtcctattaacaatgcattggtgccaattgatatttgttatataaaagcacattgggggaatgagggggtgaggaagcatgagctgggtgtctgcattagtccattctcatactgctatgaagaactacctgagactgggtaacttataaagaaaagaggcttaattgactcacagttccacaggttgttcaggaggcatgrctgggaaggtctcaggaaacttacagtcatggcagaagggagaaggggaagcaagcacatcttcacatggcagcaggaaagagcgagtgtgaagcgggaagtgcacttttaagcaacctaatctcgtgagaactcactcacaagacagcactagggggatagtgctaaaccattagaaaccaccctcttgacccaatcacctcccaccaggttcctcccccagcactgaagactacaatttaacatgagatttggttggggacgcagagccaaaccatatcagtatgctagaatctagtc

SEQ ID NO: 185858 - DNA, 601 bp, Human
cttaggatttcccagggagctatttgtattttattacaatttacaaatagcttaagagatgttcccccttaattgtggacatttttagatcaaaacattattgtttttcatttatatttcttttccaacattgaaccctttatgacatgcatcttactttatagcaagaaggaagtcaagaagagaacaagagacgggttggtaggatctacagtttttctaattgttactggagttagtatatacctcgccccagtggccagtatgtgagaatcctgaagcatgtgttagaatatcttaygaaaatgtgaaatgtattttttaaaaaattttaattttgtctcttgtcaaacagtaattaaatactatgtaatatccctcaaataagtgaatattttatatcatttaaacattatgtttgagcaattagtctttaggaaagttggagggagactttattctagtcagcatgattgtctgcaaagaacaaaggaataggaattaccaggaggcatgatttttttatttttttaataacagcatactttataagaaaatgttcttccctttgggggtttaagatgtttctgaaatcaaacat

SEQ ID NO: 185859 - DNA, 601 bp, Human
ttaataacagcatactttataagaaaatgttcttccctttgggggtttaagatgtttctgaaatcaaacatagtgttgttattcgggggagtgtcagtgaagactttaaaaatcttgaattgaagggactctaagtccccaatggcctgaagcaattcaaataaagtgttttaaccagtccttctacttgattatttgttctgaagccaaattagtatattctcagtttcttacaaaatgtttgtaccaaaaggacaacttgtttaccaaaataatttctgacaaatagctaagtgtgtgagtgtgtgtgtgtgtgtgtgtgtgtgtgtgtgtgtgtaagaggacaacgttttgtcccctgagacattatatctcctagggaaaaaagatttctaataacggaaaatttactaacactagttttattaaactaacattattaaattatctttgtgaatcagtgtttcatggaaagtcatgtatatcactccaatttagcttaactattattcaatagcaactttttgtgtctttaggacttatttgaaatttatacacatgcaatatgcatataatgaaactattcttaatcagagtgctt

SEQ ID NO: 185860 - DNA, 601 bp, Human
aagactttaaaaatcttgaattgaagggactctaagtccccaatggcctgaagcaattcaaataaagtgttttaaccagtccttctacttgattatttgttctgaagccaaattagtatattctcagtttcttacaaaatgtttgtaccaaaaggacaacttgtttaccaaaataatttctgacaaatagctaagtgtgtgcgtgtgtgtgtgtgtgtgtgtgtgtgtgtgtgtgtgtaagaggacaacgttttgtcccctgagacattatatctcctagggaaaaaagatttctaataayggaaaatttactaacactagttttattaaactaacattattaaattatctttgtgaatcagtgtttcatggaaagtcatgtatatcactccaatttagcttaactattattcaatagcaactttttgtgtctttaggacttatttgaaatttatacacatgcaatatgcatataatgaaactattcttaatcagagtgcttgtcattgaacagtgactaacctggttaacagagctagctacaatgtatttttgtaaagtatttgtccaattccttgttaaaaaccagagctgatcttac

SEQ ID NO: 185861 - DNA, 601 bp, Human
aaaaagctcccaaagtgtcccatgtaacttctgctatcttgtcctaagcgaatattcttcattggagggaaactattacatagagatctcttggatttatttcaatacataaagattacgactgagaacagtttttcagtatgagagggctaagcatctccctcgggaaggaaatagcactaactcctgaggaaacaggttcagaggaaagagggatgaagcagaccaggagaatgtattaccatcacgagctctgcattaagtactgtatttccagtgtcttagggaatccttacaactrtcttgaaaagtagaaattatcttcattttataatggggtaaatgatacttggaaatgtcaagtaacttacccaagatgacacaagcagtgaagacagaactgaaacacaggaactgatccctaaacctttattctgccagacttcaggtgtgaaagacaagcttctagtttacagttcaactaagattattcttcctcaaacatcatacctagaacaatgtttgagttttccgttgcaatcaatggcactatcctgactccagacagcgagatggtataggatagcataggatggcggtg

SEQ ID NO: 185862 - DNA, 601 bp, Human
gttattattctgaacacccattcacactgtagagagaagagattgtcttcaatcagtaattaaaccaacacttcttttctctctttacagttctccaaaaatctagttaacagaaatttgaatgtctatcaatgaattgctgaaataaaagatcactttgcatatgtcacacttattctagatacgtcatgaagagatccaaaagttattcccaattaggtaacaataacaaccaggtctaaagagtcagtgatgttttttctcccgagatttacagcctcttccttgcttgtggggcttsttcctttaccatctgagctgttgcattttattagttgtgatgttctctaagtctcaactgtccttcctcacactccaataaaagcttgtcttttttaaaaaccttccagttatctgagtagcataagcagtggaaagtaatagacttatgttatgataatgagacttggaaagtctcaagacttggaatgcctttgtttatttcaaagtattctggttttcagttcctttagaaaagagaggaaagcagctggaaatgaggcggagcaggagagaaagtaggagaatttaactaatgagc

SEQ ID NO: 185863 - DNA, 601 bp, Human
cttgagaaggagctggccatgtaagggccagagcaagaactttccaaacagaaatatcaggacttgcaaagagcttcaggtggggaaaagcttgatgtattcaataaacataaaggagctaagaaaagaatagtgccagaaaagatttgggagctgaatggcttcatcatatagggccttataagaatggaaaagaagggttggggggcaagtggagagatacacgtagccatgaaataaccagttacatctccgttttgtaagtgtgtgtgtgtgtgtgtgtgtgtgtgtgtgtgtgtgtatctgcagcggtttgatttttttatgtgatgaaattactgttcctactgattcaaataaattattctgaaggtaatattgtttttagcccattatctttagtctttgagtggacggggaataggcttgtttgctgaaagaaaacaaaattgacaaaggtttgattgtagcccatttaatttcagtcttgtctgaatccactggatatcactttggtcattagagatggagaatttcatcacatctaagtcttttctttttccccacagctaaatctgatgtttcctttctgataggctat

SEQ ID NO: 185864 - DNA, 601 bp, Human
agtaggacattattagtcactttctgacttcctgtgttttttactaatagtggtaacattatggtggaaaaaatattatatttgtacagccactgactgcttgtttcatcttgtattatgttcttgaaaccaactattaagacatctggactgacatgtgttatttacagcaacgatgagacagactatttgaaatccttgatctgtggtcaccaaacttgtaattagttgtgatggtgcctggattcaacatcatttctttgtgttgggtaaacattaagatttgagaagtcaaaggccmgtcagatttattagaaccttaattttcagaacgggatatttgtttcctaaataatcttatagtttgcatttgatgatatagtttccaagaggatctccatactgtatgtaattttactgctgtatatctttgtgaggtaggcaagaaaagattattttcatttaataagaatattctaggtcctgatgaataaggagctcagctcaatttttgcagtcagttttctctgcacatcagtaactatagcttagtatgatcaaagtaaagactgaaggaaattatataactagagaagcaaca

SEQ ID NO: 185865 - DNA, 601 bp, Human
acatcacacatttgagttgaaagtgaggaccacaatcacccaattattccagagctgcccagaatgtccccagctattcaaattgtgcacatgctcttggcctctatgtaacttggcagtgtataagctagtgccaccagcctggttatcttaagtcccagcagtgtgccttgaaacttgcattttcttaactcaggaagagttgtcattctaccaacacttttaaagagaatgaatgttatcacctaattacagtaaatggaaactcaaagcattcataggtgtgggctgcctgtggggyccatgtaagccatctttcctccagattttggtggcatattgaaaaattcctgaggtcaaacaaggggatggaggcacagttgttcctaaggtatggtttttgttggtggtgatcttttgaggacaccactggatacaaataatttgtttcacacattcccctccttgctagttttcatgcccctgtggcttttatcaccttgtactgggtcattgatgttgcatctgtgggtggcaaggcactctaaagattcctgctgctccttatattgcaggacactgacaaataatatttttcctt

SEQ ID NO: 185866 - DNA, 601 bp, Human
tttctgccttagaaaacaaagtgttaaaaaatctacaagcttcctagcataatttagaaaatctgcttttatgaaatgggttaattatgcccattgaatgcattcactgtcacagtctcatcctcccacttctgttccaaaatgacaagtgaaaccagggactgtgcaattttggaagacaatcagatcacatattgagtattttgcttattcatacaaccataaacggcctatgcttgagttccctcaattacacagctcagtatgcaggccagaagcagacaagcccagctcaagtgarcactttcctggaatacacgggggaacgagtttgaaaaatgtccaaagtggcagatgtgaaaaattctcattcaacatccagagctgcctttgctgcaatccttcacctgttaatcgcactgcctctgaacttgtgaaccagggatgctagcgatatcttagactgagacacttaggagctatagatctttcaaggtatggtgccagtatatgccaaggtgggggaaaagctagcgagacaagacaagatcatggatcacagcactgctcagaattttcagacattcaccaagaataagca

SEQ ID NO: 185867 - DNA, 601 bp, Human
ataaatgcttaaaccattgtactgtatcacttaaattcttcagactcctgcaatgctaatacacaatctctcctccacaacagaatacaatggcactattgtagtcttaagtgaaggatatttcattttccctgagtgagacaactttcccacaactgttatccactgcaatttcatgctccttggagtttctgtgcaccaaaatcatccccaagcaatatactctcttgattagctagtattttattccacctcctttgactatatttattttttcttttcttccaccatcttataagcrcgaaggctccttgcccttcatttggcattattgaaacctcaaaagttatttaagatgctggttgagattgttaacttccttccttttccatctcagcctaactctgatctttctttctcctgctctctttctagtagaagccctccatgattttgaacttccttgtgtctctgtgttgttcctctctcttatccttacccctctcccattctggtcactttcctcttgactcttcttgtcatccaagtctttcttttttttttttttttttttttttggagatggagtcttgctctgtca

SEQ ID NO: 185868 - DNA, 601 bp, Human
aaatcatccccaagcaatatactctcttgattagctagtattttattccacctcctttgactatatttattttttcttttcttccaccatcttataagcgcgaaggctccttgcccttcatttggcattattgaaacctcaaaagttatttaagatgctggttgagattgttaacttccttccttttccatctcagcctaactctgatctttctttctcctgctctctttctagtagaagccctccatgattttgaacttccttgtgtctctgtgttgttcctctctcttatccttacccytctcccattctggtcactttcctcttgactcttcttgtcatccaagtctttcttttttttttttttttttttttttggagatggagtcttgctctgtcactcaggctggagtgtagtggcgtgatctcagctaactgcaacctctgccttctgggttcaagcaattctcctgcctcagcttcccaagtagctgggactacaggtgcacgctaacatgccctgctaattttttgtattttagtagagacagagtttcaccatgttgcccaagctggtctcgaactcctgagctcaagcaat

SEQ ID NO: 185869 - DNA, 601 bp, Human
ttgtcatccaagtctttcttttttttttttttttttttttttggagatggagtcttgctctgtcactcaggctggagtgtagtggcgtgatctcagctaactgcaacctctgccttctgggttcaagcaattctcctgcctcagcttcccaagtagctgggactacaggtgcacgctaacatgccctgctaattttttgtattttagtagagacagagtttcaccatgttgcccaagctggtctcgaactcctgagctcaagcaatctgcccgtcttggcctcccaaagtgctagcattgygggtgttagccactgtgcccagccctttcaaaaggcatgtctacaccaagtctcagaccattcttttcttggcccttagtgattgtatacctcattaatcctgtgatctttcaccacacgatgccctgctcgattgtttaaaaaccagctttaagatgattggtattttattttcccatcatccttctcactgtgaggtggtttaggggaaagagttaaaagatcaaggcagtggggtcagacagacctgagttgaaacctagctcttgtctactatttatatgaccttgagtcagatat

SEQ ID NO: 185870 - DNA, 601 bp, Human
gtatacctcattaatcctgtgatctttcaccacacgatgccctgctcgattgtttaaaaaccagctttaagatgattggtattttattttcccatcatccttctcactgtgaggtggtttaggggaaagagttaaaagatcaaggcagtggggtcagacagacctgagttgaaacctagctcttgtctactatttatatgaccttgagtcagatatttagtcttttgttatgtgtaaaataaggaaacaccacctcactgggctgctgtaagagctaaatgcaataatgcatgtacctcayacagttgtcactttcaaagggtaactattgttatttattaatatttttgttatcattatcctcatttaatcattatttgccatcttctcattatttttgtctttctttcccaggatttaggaactgacatttccaaagcaaaagggttgatattttttctcttttattatcacctgcatgtaaatttttcttctatctgcttggctcccctccttcctattttcctctgttaaagtctttatagagaaacttcatccatctaagaatgttggcctaaatatatgcatatacatattcatc

SEQ ID NO: 185871 - DNA, 601 bp, Human
aagaataatataaatactcactgaatctgctcttggctttaggaatcacattttatagttcaagagtttctagcagttgttgttttttttgttttgttttttggtgttttgtttttttttttttttttggtggggagaaggtgttggtatccctttagtcactaaaaattctcaacagaagcattctcagaaaaaaaatccattacaattataactgcttaatttatgtaattaaaccccaagagacactgaaaaaaatttcattttgagtaaatattaagacagagaaaaggatgtgtgwcttttttaaaaaaagaaattgagtcccccaatattttctatctaaagaacattattgattttttcccccagaattactttacaacttatatgttgtaattctggtccaaaaatccatccatgagctcttttctacttaactggagctcactataactatgctttcaattaactagccacattcttaggttaatctaaatctgttggtcttgtcttttataaatttggaagaagcaagccctttgctctgtttgataccatttctaactaaaaccaaaaccaacaaacaaaaaaatggctt

SEQ ID NO: 185872 - DNA, 601 bp, Human
ctcttggctttaggaatcacattttatagttcaagagtttctagcagttgttgttttttttgttttgttttttggtgttttgtttttttttttttttttggtggggagaaggtgttggtatccctttagtcactaaaaattctcaacagaagcattctcagaaaaaaaatccattacaattataactgcttaatttatgtaattaaaccccaagagacactgaaaaaaatttcattttgagtaaatattaagacagagaaaaggatgtgtgtcttttttaaaaaaagaaattgagtccccmaatattttctatctaaagaacattattgattttttcccccagaattactttacaacttatatgttgtaattctggtccaaaaatccatccatgagctcttttctacttaactggagctcactataactatgctttcaattaactagccacattcttaggttaatctaaatctgttggtcttgtcttttataaatttggaagaagcaagccctttgctctgtttgataccatttctaactaaaaccaaaaccaacaaacaaaaaaatggctttctccacagactttttcttataaaagcaa

SEQ ID NO: 185873 - DNA, 601 bp, Human
aagaggcctctctcaactacacggtatgactacagctaaaggtaatgtgttcactttcccgcctcctgcaccaagcactgtgaagtacctggcagaagtgctacgtagaagttttgttgattttttttcaatttcagtaaagtaaatagaacatagaagagtgatcacccagtattctctagggtacacacatcatcatgataagaaaattactgcaaaagtgatttttggctgagtttgcctttaagttaagatagtagagtagacgagaactggctttgggcccaatgctaatgttaartattagccctgccacttaccagtggtgtgaccttggaccagttaaacatttccaaccctcattttctttatctttgaatcagagagaatgatgggacattcctcctgtcattgtaaggactaaattagttaattcctgctgtaatgcctagcacataataagcactatataaatgtttgctattggccgggcccgctggctcacgcctgtaataccagcactttgggaagccaaggcaggtggatcacttgaggtcaggagttcaagaccagcctggccaacatggcgaaaccctacctc

SEQ ID NO: 185874 - DNA, 601 bp, Human; identical to SEQ ID NO: 23432

SEQ ID NO: 185875 - DNA, 601 bp, Human; identical to SEQ ID NO: 23433

SEQ ID NO: 185876 - DNA, 601 bp, Human; identical to SEQ ID NO: 23434

SEQ ID NO: 185877 - DNA, 601 bp, Human; identical to SEQ ID NO: 23435

SEQ ID NO: 185878 - DNA, 601 bp, Human; identical to SEQ ID NO: 23436

SEQ ID NO: 185879 - DNA, 601 bp, Human; identical to SEQ ID NO: 23437

SEQ ID NO: 185880 - DNA, 601 bp, Human; identical to SEQ ID NO: 23438

SEQ ID NO: 185881 - DNA, 601 bp, Human; identical to SEQ ID NO: 23439

SEQ ID NO: 185882 - DNA, 601 bp, Human; identical to SEQ ID NO: 23440

SEQ ID NO: 185883 - DNA, 601 bp, Human; identical to SEQ ID NO: 23441

SEQ ID NO: 185884 - DNA, 601 bp, Human; identical to SEQ ID NO: 23442

SEQ ID NO: 185885 - DNA, 601 bp, Human; identical to SEQ ID NO: 23443

SEQ ID NO: 185886 - DNA, 601 bp, Human; identical to SEQ ID NO: 23444

SEQ ID NO: 185887 - DNA, 601 bp, Human; identical to SEQ ID NO: 23445

SEQ ID NO: 185888 - DNA, 601 bp, Human; identical to SEQ ID NO: 23446

SEQ ID NO: 185889 - DNA, 601 bp, Human; identical to SEQ ID NO: 23447

SEQ ID NO: 185890 - DNA, 601 bp, Human; identical to SEQ ID NO: 23448

SEQ ID NO: 185891 - DNA, 601 bp, Human; identical to SEQ ID NO: 23449

SEQ ID NO: 185892 - DNA, 601 bp, Human; identical to SEQ ID NO: 23450

SEQ ID NO: 185893 - DNA, 601 bp, Human; identical to SEQ ID NO: 23451

SEQ ID NO: 185894 - DNA, 601 bp, Human; identical to SEQ ID NO: 23452

SEQ ID NO: 185895 - DNA, 601 bp, Human; identical to SEQ ID NO: 23453

SEQ ID NO: 185896 - DNA, 601 bp, Human; identical to SEQ ID NO: 23454

SEQ ID NO: 185897 - DNA, 601 bp, Human; identical to SEQ ID NO: 23455

SEQ ID NO: 185898 - DNA, 601 bp, Human; identical to SEQ ID NO: 23456

SEQ ID NO: 185899 - DNA, 601 bp, Human; identical to SEQ ID NO: 23457

SEQ ID NO: 185900 - DNA, 601 bp, Human; identical to SEQ ID NO: 23458

SEQ ID NO: 185901 - DNA, 601 bp, Human; identical to SEQ ID NO: 23459

SEQ ID NO: 185902 - DNA, 601 bp, Human; identical to SEQ ID NO: 23460

SEQ ID NO: 185903 - DNA, 601 bp, Human; identical to SEQ ID NO: 23461

SEQ ID NO: 185904 - DNA, 601 bp, Human; identical to SEQ ID NO: 23462

SEQ ID NO: 185905 - DNA, 601 bp, Human; identical to SEQ ID NO: 23463

SEQ ID NO: 185906 - DNA, 601 bp, Human; identical to SEQ ID NO: 23464

SEQ ID NO: 185907 - DNA, 601 bp, Human; identical to SEQ ID NO: 23465

SEQ ID NO: 185908 - DNA, 601 bp, Human; identical to SEQ ID NO: 23466

SEQ ID NO: 185909 - DNA, 601 bp, Human; identical to SEQ ID NO: 23467

SEQ ID NO: 185910 - DNA, 601 bp, Human; identical to SEQ ID NO: 23468

SEQ ID NO: 185911 - DNA, 601 bp, Human; identical to SEQ ID NO: 23469

SEQ ID NO: 185912 - DNA, 601 bp, Human; identical to SEQ ID NO: 23470

SEQ ID NO: 185913 - DNA, 601 bp, Human; identical to SEQ ID NO: 23471

SEQ ID NO: 185914 - DNA, 601 bp, Human; identical to SEQ ID NO: 23472

SEQ ID NO: 185915 - DNA, 601 bp, Human; identical to SEQ ID NO: 23473

SEQ ID NO: 185916 - DNA, 601 bp, Human; identical to SEQ ID NO: 23474

SEQ ID NO: 185917 - DNA, 601 bp, Human; identical to SEQ ID NO: 23475

SEQ ID NO: 185918 - DNA, 601 bp, Human; identical to SEQ ID NO: 23476

SEQ ID NO: 185919 - DNA, 601 bp, Human; identical to SEQ ID NO: 23477

SEQ ID NO: 185920 - DNA, 601 bp, Human; identical to SEQ ID NO: 23478

SEQ ID NO: 185921 - DNA, 601 bp, Human; identical to SEQ ID NO: 23479

SEQ ID NO: 185922 - DNA, 601 bp, Human; identical to SEQ ID NO: 23480

SEQ ID NO: 185923 - DNA, 601 bp, Human; identical to SEQ ID NO: 23481

SEQ ID NO: 185924 - DNA, 601 bp, Human; identical to SEQ ID NO: 23482

SEQ ID NO: 185925 - DNA, 601 bp, Human; identical to SEQ ID NO: 23483

SEQ ID NO: 185926 - DNA, 601 bp, Human; identical to SEQ ID NO: 23484

SEQ ID NO: 185927 - DNA, 601 bp, Human; identical to SEQ ID NO: 23485

SEQ ID NO: 185928 - DNA, 601 bp, Human; identical to SEQ ID NO: 23486

SEQ ID NO: 185929 - DNA, 601 bp, Human; identical to SEQ ID NO: 23487

SEQ ID NO: 185930 - DNA, 601 bp, Human; identical to SEQ ID NO: 23488

SEQ ID NO: 185931 - DNA, 601 bp, Human; identical to SEQ ID NO: 23489

SEQ ID NO: 185932 - DNA, 601 bp, Human; identical to SEQ ID NO: 23490

SEQ ID NO: 185933 - DNA, 601 bp, Human; identical to SEQ ID NO: 23491

SEQ ID NO: 185934 - DNA, 601 bp, Human; identical to SEQ ID NO: 23492

SEQ ID NO: 185935 - DNA, 601 bp, Human; identical to SEQ ID NO: 23493

SEQ ID NO: 185936 - DNA, 601 bp, Human; identical to SEQ ID NO: 23494

SEQ ID NO: 185937 - DNA, 601 bp, Human; identical to SEQ ID NO: 23495

SEQ ID NO: 185938 - DNA, 601 bp, Human; identical to SEQ ID NO: 23496

SEQ ID NO: 185939 - DNA, 601 bp, Human; identical to SEQ ID NO: 23497

SEQ ID NO: 185940 - DNA, 601 bp, Human; identical to SEQ ID NO: 23498

SEQ ID NO: 185941 - DNA, 601 bp, Human; identical to SEQ ID NO: 23499

SEQ ID NO: 185942 - DNA, 601 bp, Human; identical to SEQ ID NO: 23500

SEQ ID NO: 185943 - DNA, 601 bp, Human; identical to SEQ ID NO: 23501

SEQ ID NO: 185944 - DNA, 601 bp, Human; identical to SEQ ID NO: 23502

SEQ ID NO: 185945 - DNA, 601 bp, Human; identical to SEQ ID NO: 23503

SEQ ID NO: 185946 - DNA, 601 bp, Human; identical to SEQ ID NO: 23504

SEQ ID NO: 185947 - DNA, 601 bp, Human; identical to SEQ ID NO: 23505

SEQ ID NO: 185948 - DNA, 601 bp, Human; identical to SEQ ID NO: 23506

SEQ ID NO: 185949 - DNA, 601 bp, Human; identical to SEQ ID NO: 23507

SEQ ID NO: 185950 - DNA, 601 bp, Human; identical to SEQ ID NO: 23508

SEQ ID NO: 185951 - DNA, 601 bp, Human; identical to SEQ ID NO: 23509

SEQ ID NO: 185952 - DNA, 601 bp, Human; identical to SEQ ID NO: 23510

SEQ ID NO: 185953 - DNA, 601 bp, Human; identical to SEQ ID NO: 23511

SEQ ID NO: 185954 - DNA, 601 bp, Human; identical to SEQ ID NO: 23512

SEQ ID NO: 185955 - DNA, 601 bp, Human; identical to SEQ ID NO: 23513

SEQ ID NO: 185956 - DNA, 601 bp, Human; identical to SEQ ID NO: 23514

SEQ ID NO: 185957 - DNA, 601 bp, Human; identical to SEQ ID NO: 23515

SEQ ID NO: 185958 - DNA, 601 bp, Human; identical to SEQ ID NO: 23516

SEQ ID NO: 185959 - DNA, 601 bp, Human; identical to SEQ ID NO: 23517

SEQ ID NO: 185960 - DNA, 601 bp, Human; identical to SEQ ID NO: 23518

SEQ ID NO: 185961 - DNA, 601 bp, Human; identical to SEQ ID NO: 23519

SEQ ID NO: 185962 - DNA, 601 bp, Human; identical to SEQ ID NO: 23520

SEQ ID NO: 185963 - DNA, 601 bp, Human
ttttcagtgttcagcattcagaagctgcaattagttttcaatgttgttggtttttttgtttgtttcggtaaagagtgttcatatacagtaaacagaagcataaacgataaattataacaacacacatacacacaccccttgtaaaatcacctcagtcaagataatgaatgtatccaacactcaaatgattttcctttttaacctctccattttgcccctgccatcccattcttcccatctcaagcaaccactttgtgctttctgccaattagaatatttccattttctataattttaatactaatacaatcacacgatatccaccattcctgtctttttttttccactcacaataatgaatttgcattcaacatgatagctgtaggctgtctgcagatgccttttatcaggttttctttcattattagttgtgctgatgtttatcaggaaaatctattttgtcaaatgttttcttacatctactgaagtcatcatataagtttcctttttagtttgtttaatgtaagtatattaattgatttaaaccaactaagctttcctaaaatatattctcctttgtcatcaggtattgtctttaaca

SEQ ID NO: 185964 - DNA, 601 bp, Human
aggtgactttctcttaacttccagctgggggcttgagcatttgatgtaggggaattgctatggcctcacttggtgtttcgggcgactttttcttaatttccagctgggggtgaggggcccaggaagcttagtgccttctgcatgttctcttcctggttctgcagccttttgggaaagaaagttctggttgagggggtcacctagggactctgggtggggacgggggttagggggctggagcttttgtcaggtggggtgggtccccgcctccctcctgtgcctggggtggtcagggacatgsagggcaaggcgggggcgcaggcagacctctgcgatgcctcctccggtgcctgcaggagcgtcttttgcgccttctgcaggagcgatgctgccgcctgtggatccggtgcagcctccttcgagagcagtgtctgcgcctatagtgagactggccatgggtcctctcgtagacctcgacgtgctccgggctcagcccttgctcctcttggccgtggtgtccttgctcttgcccatgcaactgctgcctgtacacctcgtgcgagcgttcgctcaggctcctcacgcggtatcggaccatggt

SEQ ID NO: 185965 - DNA, 601 bp, Human
cttctcggcggcaactcagggcttgagcatttgatgtaggggagttgctatggcctcactcggtgtttcttgggcaggtgactttctcttaacttccagctgggggcttgagcatttgatgtaggggaattgctatggcctcacttggtgtttcgggcgactttttcttaatttccagctgggggtgaggggcccaggaagcttagtgccttctgcatgttctcttcctggttctgcagccttttgggaaagaaagttctggttgagggggtcacctagggactctgggtggggacggggkttagggggctggagcttttgtcaggtggggtgggtccccgcctccctcctgtgcctggggtggtcagggacatggagggcaaggcgggggcgcaggcagacctctgcgatgcctcctccggtgcctgcaggagcgtcttttgcgccttctgcaggagcgatgctgccgcctgtggatccggtgcagcctccttcgagagcagtgtctgcgcctatagtgagactggccatgggtcctctcgtagacctcgacgtgctccgggctcagcccttgctcctcttggccgtggtgtccttgctc

SEQ ID NO: 185966 - DNA, 601 bp, Human
aactgtctttcatgtcccccccaccgacatctttctcccgttgcatgcccaggccctctccccctctgctcatccccgagccctcctccccactgagcctcccctctcaagaacaaggagagaagagtgggatgacttttcaacatttattgacaggcggcattgttccttagcaggctcctgatttttattggatggtggcattttcaagatgtggcaagaggatcttgaagtctggtaacattctcaggcaggagtttggtggatgtgctattttgtgcaattagtgtcttctacatckcggtctgtacctggggcggcagcaccctggtgagaccaagaaaagtggtgagaggaaggctgggccctgagagctcccagcctcagccccagcccaccctcagctgggcccacttactcatggctctcctccgtgtctggcagctccgcctccttcgtctgcgacttctttgtctctggcggtaatatctgctccggctctggctgcgacagcatctgtacctggccatggtgcaggatgggcttggcctgaatgctcagagcagggcaccaccttggctgagccagccaacctgtgagc

SEQ ID NO: 185967 - DNA, 601 bp, Human
ctggggtcccagggctatctgaggctggagagggaaggcctcaggggttaccatggtgacctgcttcaggcttcctgctgagccatgtcaatccctttatttttcagaaaagggctttgtctgggggtggccccagacagaaaagcttggcttggtcctagggtggggggaagtaaggtggaggataaagagtttcacttcgggatatctcttcctcctcttcccttactcctactcctaatctggtaagaggggagaactgtagggtccccctttaaagtatgactagtgttctacctarctttggccttcactctcactggctatacacccatcccttatggcccgttaccactctcttgagcttctgacaggtcaagacgaggtttgcccagtggtcgggaagatgctaaggttaccagtatgggggatcagggtcagggaaggcgggtctcatcaggctccgctcccttctgcacttcaggggaaggtgagtttccctctgccagctgccatgcaaatgaactaatgaatatttatgaagtctgttcactgaggttgaagagactctgaggggttttgggggcaatagttctctctt

SEQ ID NO: 185968 - DNA, 601 bp, Human
ccctcagatgaggacacaggtttggcattgcaaaggcatttgcccagagttcccagtaggccggtattgcttgtagtacctttggtgtaatgggccctcaggaaatggaaccactcttttctcagatgattgtggtagcctgtgaactggtgcatgacactgtcagcttcattctctttaagcactgcctgaagccttccattgtccttcctgctctgagagcctgtctccaatgggatgaaacccaccctgcttgctgtgacccttgaagcctttcagtctggccccaggtgaacttttccacctcttcttctgtttctctcttctcactcccagccaagctggaccaatcactggcctgggctttgtgttgtagccactgctgtctactgtctcagtgtgttgacttcttattcctcacctaagacccactttcatcctgcctttcctgtggatacatctctgaccatcctggtcagatgagctatctctttcttctccctgcctccagcccttgctgcttgaatcatcatcctcacacatacctacagatagcctggtgttgtctatcactcgagtatgggttatttacttttctgac

SEQ ID NO: 185969 - DNA, 601 bp, Human
atgggccctcaggaaatggaaccactcttttctcagatgattgtggtagcctgtgaactggtgcatgacactgtcagcttcattctctttaagcactgcctgaagccttccattgtccttcctgctctgagagcctgtctccaatgggatgaaacccaccctgcttgctgtgacccttgaagcctttcagtctggccccaggtgaacttttccacctcttcttctgtttctctcttctcactcccagccaagctggaccaatcactggcctgggctttgtgttgtagccactgctgtctaytgtctcagtgtgttgacttcttattcctcacctaagacccactttcatcctgcctttcctgtggatacatctctgaccatcctggtcagatgagctatctctttcttctccctgcctccagcccttgctgcttgaatcatcatcctcacacatacctacagatagcctggtgttgtctatcactcgagtatgggttatttacttttctgacccaaactggacagtaaagtccttgacgatggagccatatcttctcttcctgtttcccctccaaaatatgagagtgagctcataggtact

SEQ ID NO: 185970 - DNA, 601 bp, Human
tgagacttagacatattaaggacattatcacaccattgatctagttaataacaattacaaaggaaacatcttaaaatacaatgcttgttcctgattaacgggtacattatgctttgattttaaaaaattgttttgaactttaaatatagctcttgtttgggggcataactataactcataatgtataatctttaaaagtactcacttcactagattatattgtaataaatatagataaattttactagtgtagactctcaacttactgtcgtataaacatgaaatcgtttttatcataagygtcctattatatcaacctcattttcccacttggtgacaggattctttgagcacaactcagcccttttacattttcttttcatttatttttagcaattaaaactatctttcagttatttaagacttggtccatttatttaaaaatttcagtctcatattcaatttatatctccatttacctttctacctcagttcccattccaagttaggttggtagcggagaagaggtgtggtctagctctcacaaactcccctccaccccttcttgatgcattaactcctctgatgttgggatgtggga

SEQ ID NO: 185971 - DNA, 601 bp, Human
tcaactttgaatctgggacattaacatctggtaataccaaccatagaccttagttgcaaattgttgtactaggcacctaaaactgctctgcctcatagcatatatgttactggtatgtgtgtgtatatcaatagagttgatgaaaaatgaagttaagtgggaatgtattacatttttatgacttgaattatttgacatgtcaaggaaaaactatttaataataatatttttttaaatgattatccctgttgctgaagtttcattttaggtttacattaagcaaatcctatgtactgaatgyatgtaactgaaggagaagcgtttagaagcctgagattgatattcttgttactggttcacttttgataatcatggaaaatgtaaaccaagacatggaataataattataatagacaaaacatatagtgcttgctgtgtcttacgcacaagttaaccctcagcaacaaccctatgaggtaattaatagtagcattttcattttactggtgagggtactgaggttcattaatgatcctgtctagttgggaaaatagacattggacaaagaatttataactgtgttggttattgggcatggaat

SEQ ID NO: 185972 - DNA, 601 bp, Human
ggatgatgatgatgatgatgatgatgatgatgatgatgatgatacttgtagtaataacagaagtagtaatacaggttgagcatcccaaatcagaaagtccaaaatctgaaactttttgagggcctacatgatgctcaaaggaaatgctctttggagcattttggatgtttggatttgggatgctcaatcagtaatgcacatattccaaatccatcctatcctttaggaagattcaaaaaaatccaaaacactcctgttcccaagcatttcagataagtggtactcagcctatagcaagaaygatagctgtaatggggcaggctctgagcaaaagttttttatttaatcctaataaaaacctgatgacatagtactattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaaga

SEQ ID NO: 185973 - DNA, 601 bp, Human
tattattatcctattttccttttgaaaaatctgagccaaagaaagaagtgagaaattcagaatttatttgggtgttttcttagtatttgcaagagttacagtccttgagataggggaaaaatgtgagaagaattaaaattctatcatgtaaggtattaaagttaaattagttaagattgtaaaggatagaatggattgtcattgaaggttctttagagttagaaagatagtaaaatgacagagctggaaatgcaaaatccaatgagggtgtgagaaaaattaggtatatattaggttggarattgccacctcagatgatgtgttaagagttagatgatggtttatcttgaacccaggaggaccaagtgcctctaaggcaggggtccccagccctggtccatggcctgttaggaaccaggatgcacagcgggaggtaagcagcaagcgagccagcattactgcctgagctctgcctcctgttagatcagtggggacattagattctcataggagtgtgaactttattgtgaactgcacatgcaaggtctaatccctgatgatctgaggtggaacagtttcattgagaagccatctctctccc

SEQ ID NO: 185974 - DNA, 601 bp, Human
agaatttgtgattctgtgtggctgagaatttgcatttctaacaagttcttaagtaatgctgatgctgctggtctggcaaccacacttttcttagtgggtaagtcttttatccatgggaaggttagaagtaaatatagaaatgatgaaatttattaaatgcttatattaatagttttgttttaagtctaggaataatcagtgtatttggtctttaaggtatttgttctgtttcatagaattaggcctataaaagtggccaacaaattagtcttaagagtataatttaaaatgcatacttgcrtaattgttttttgacttgggattttaagttgaaaggtgcaacaatttggctaaacttagaaaccactggaatgtttaagaacttaacatttattatatttaaaacttagtatagggtttttaatatttttctcaggaggtttacttgttagaagcaatgtgtttaaaatagaatatagtaaatttataaatgcagtttagtatagtaagtcctcctttgacatcatcaataggtttgtggaagttgcaccttttaagcaaaatgatgtgtaaagaaaccaattttaccataagctaattg

SEQ ID NO: 185975 - DNA, 601 bp, Human
tgagttggtcagctatttaaagcaccttagaaagtgttaaaatttgctagattataaatagaatgcactttttatggtagaagacaagggaaagtaggtttttatatttttaacttcaagaaatctaacattaaaagtaaagtgactgcagatagtgtttttctgtgtgtgaaggcttatttcatggccactaggaaacttacattaggagactctttataaatgttgttcaataggtgatactagtacaaaaaggaatgtgttttagggtcaaatacatacattagagaaaggacaaaamttggcttttattttctagcagtaaatggaaagaaggaaatgtaatcagccataaatcacagtgtccctaggataaagataaacctgttgcttaggcagccaggagaaacacagttattccttatagtgagaatataacaaaaaaaaaactcatggaactctgtaataaagcaaaacaaaccaaaaagcttatttttatggtaagtacagacttcagtttcaaaaatctatttttaatttttttaaacccattaaatctttaatgtagttcaatggtgtagctctaaactgcaagttagta

SEQ ID NO: 185976 - DNA, 601 bp, Human
tcctccttgattctggagtttttgatacaattggcataatttcagtcttatagcactgagtaatgtttcagtagagaagtctcatgcaagccagccagattcttttccatttcccctagtagatgatttgctttttatgcatgaattgttgaataattttttaagctcccaagcataataatttaactaagagtagaaatgggaatagcctgactcatgtgcccacatgtgtctatgtggaataatcttttaggaattacacctttcttctggaatacatgttgatggagcagccactatrtggaagatctctggttttgagatagaaaagagagctaagaagtacaattttggctccaaacacttccacctggaagacatatatggttcattgggcaaagcaagttggccatgtctgacatcaataggatggtgaggtatattttatattcctcaacaggaaggaatacaggcttagtaacaataatatagtctatcaccatgactaatttagaaaccattatattagtttgacagatttgaaaactgctggtgttaactgtcacaaatatgaagttatgtagggaagcccatttcttct

SEQ ID NO: 185977 - DNA, 601 bp, Human
tgatgatttccagactttctacagcatacctttccatttctttaccaaaatgatttttttaaaggttttatactgctctgttaattctctgcttgaaagtccttcaggagttctgagtctagtaatagcaagctaggtaattcagactatcctgctgagaacaatttaaaaagctggacacaaagcaaacattttattaagggtatcagaaagctaagtggtatgggtaggataggatctgaatgaggacaaaggtctaaggagggagaactccaatttgattgctttttaccccaggggwagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctctctgg

SEQ ID NO: 185978 - DNA, 601 bp, Human
aggggaagtgttgattcctgaaacaggaactgagagaccaaaaggtgcatttgacaggctgtgggtataatggaaccgggccagagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctytctggagaattaccagtttctacatgtaaaaatgttttgtcagacgattttgcaaattttatgttctgcacacaaaataggcacatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaatt

SEQ ID NO: 185979 - DNA, 601 bp, Human
gagtgcaaggcctgtcacaggggatgggtggccctagtgatctcttctcactttggaccccaaaatgttgtacattagggagaaagataaactgaagtagctaggcctccctaggaagatacttcaacttcaaattatcaaaatttctgtaacttaattaataagatctggtattactagtgtcctcaggcacttgacagaagcaaacattaattctctctggagaattaccagtttctacatgtaaaaatgttttgtcagacgattttgcaaattttatgttctgcacacaaaataggcwcatgacaagatatgtgacacaatagagaatagaaacaggcccacggtaactctagatattctagttatcagatttaaaatagctatgttgagaattttgacctgattaagaattttgtagaaagttacaaactatgagaaagaaaaatggatattctagaagtgaaaaatacaacccctctaattaggacctttgtagatggatttagcagcaaattagacaccgcagaggaaagaattccctaactgaaaggtaagtcaaaagggaatgttcagagtaaacaggaaagaggaaaatata

SEQ ID NO: 185980 - DNA, 601 bp, Human
aggaaaatataggagaaggtaagttcaatacaagatacagtgagaagttctaatatgtatgtacatatacatatgaatcctgaaagtagatgagagatagaatgggcaaaagcattatttaaagagagaatggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggygacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttccca

SEQ ID NO: 185981 - DNA, 601 bp, Human
atggctggccaacatggggaaaccctgtctctactaaaaatataaaaatcaggcgtggtggtgcgtgcctgtagtcccagctatttgggaggctgaggcacaagaattgcttgaacctggcaggcagaggttatagtgagccaaaattgcacctctgcactccagcctgggcgacagagtgagactctgtctcaaaaaaaaaaaaaaaaaaagaatggctgaaaacgtccaaactaaagaaaaactttaattcagattcaagcatccctatcaacctctagtggaaaccacaccaaaggcaaaaaaaaaaaaaaggaaaaaatagtgtttctaccttcaatcatacagcattaagatggacattgatttctcaacagacacagtaaaaactaaaaaactgggaacctatagatttaaaatgttaaaagaaagtacctgccacctagaattctgtgacctgtgaaatttcccagagatacaataataatcataaatatgagagcaaaactaaatcaaccttgactatcttaaaaataatgttttttaaatacgcatgtattcagcgtgtaaaactgtttcatatatcttggcagtggcagac

SEQ ID NO: 185982 - DNA, 601 bp, Human
aataaggctgtgaggagtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaacyctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagaaaagaaaaagaaaagaaagagagaaaggaaggaagggaaagaaagaagaaataaacaaaaaggacctgcttagat

SEQ ID NO: 185983 - DNA, 601 bp, Human
gtcagtaattcagactttttatctctgggatgaccactaaaagaattgtttaaaaaaatgtgtaactttcagatatgtggggaaaaaccggagttaataaatactgaatccaaggaaggcaacaaaggagagaagtctaaaagaacaggtagacagatagaaaatagaacaaatagtgctgggcacagtggctcatgcctgtaattccaacactttgggaggccaaagtgagtggatcgcttgaggtcaggagtttgagaccagcctgaccaatatagtgaaactctgtctctactaaaartgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagaaaagaaaaagaaaagaaagagagaaaggaaggaagggaaagaaagaagaaataaacaaaaaggacctgcttagatacacaccagaaacata

SEQ ID NO: 185984 - DNA, 601 bp, Human
acactttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccct

SEQ ID NO: 185985 - DNA, 601 bp, Human
actttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagaaragaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcc

SEQ ID NO: 185986 - DNA, 601 bp, Human
ttgggaggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgc

SEQ ID NO: 185987 - DNA, 601 bp, Human
ggccaaagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccacctt

SEQ ID NO: 185988 - DNA, 601 bp, Human
aagtgagtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaa

SEQ ID NO: 185989 - DNA, 601 bp, Human
agtggatcgcttgaggtcaggagtttgagaccagcctgaccaatatagtgaaactctgtctctactaaaaatgaaaaaaaaaaaaaaattagctggggttggtggcgtgtgcctgtagtcccagctactcaggaggcgaaggcaggagaattgcttcaacctgggaggttggggttgcagtgagccaagatcgtgccactgtactccagcctgggcaacaaagtgagactccatcaaagaaagaaagaaagagagagaaagaaagaaagagagagagagaaaagaaaaagaaaagaaagaragaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagttctgatggttttataagtgtttgataattcctcctgcctttattctccctcctgccaccttgtaaagaagg

SEQ ID NO: 185990 - DNA, 601 bp, Human
tccatcaaagaaagaaagaaagagagagaaagaaagaaagagagagagagaaaagaaaaagaaaagaaagagagaaaggaaggaagggaaagaaagaagaaataaacaaaaaggacctgcttagatacacaccagaaacataacgtcatatggttaggctttgtgtccccactcaaatctcatcttggattataatcccgataatccccacatatcaagggagaaaccaggtggagggaattggatcatgggggcagtttcccccatgctgttcttcttgtgatagtgaggtctcatgagwtctgatggttttataagtgtttgataattcctcctgcctttattctccctcctgccaccttgtaaagaaggtgccttgcttccccctttgctttctgctatgattgtaaatttcctgaggcctctccacccatgcagaactgtgagttagttaaacctctttcctttctaaattacccagtcttgggcaattctttatagcagtgtgagaacagactaatacagtaaattggaactacaaagtggggtactgctataaagatacccaaaaatgtggaagcgactttggaactgggtaaca

SEQ ID NO: 185991 - DNA, 601 bp, Human
gaggagaaattcaagccagctgcagatacttacttaagtaacgaggagacaaatgttaatcaccaagacaatgggtaaaatgtttccagggcatgtcagagaccttcgtggttgcccttcccatcacaggcctggagacttaggaagaaaaaaatggtttcatgggccagacccagggccttgctgttctgtgcagtttcaggacacagtgccctgaatcccagctgtggctaaaaagggccaacatacagcccaggccatttatttagaggatacaagtcctaagccttggcggtttacrtgcggtggtgtgcctgtgggtgcccagaactcatgaattgaggtttgggaacctctgtctagatttcagaggatgtatgcaaacacctggatgtccagacagaagtttgctgtaggggtggagccctcttggagaacctttgctagggcagtgcagaagtgaaatgtggggtcagagcccccacctagagtctctactggggccctgcccagtggagctgtgagaagaggcctaccttcctccagacctcagaatggtaaatccactgacagcttgcactgtgcacctggaaaagttgta

SEQ ID NO: 185992 - DNA, 601 bp, Human
tacaaaatttatacatcttataagtttccctcttaacactatcttagctgtgtcccagagattctggtatgttatatctttgttcttattagttgcaaagaacttcttgatttctgccttaatttcattatttacccaaaagtcattcaggagcagattattcagtttccatgtaattgtatagttttgagtgaatttcttagtctaatttttctaatttgattttgctgtggtccaagagactgtttgctatgattttagtccttttgcatttgttgaggagtgttttacttctgaataygtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatctgagtgctcctgtgttgtgtgcatatatatatctaggatagttagatcttacgaattgaacc

SEQ ID NO: 185993 - DNA, 601 bp, Human
gagactgtttgctatgattttagtccttttgcatttgttgaggagtgttttacttctgaatacgtgatcagttttagagtatgtgccatgtgacaatgtatattctgttgtttttgggtggagagttctgtagagattaggtccatttgctccagtgctgagttctggtcttaaatatctttgttaattttctgtctcagtgatctgtctaatattgtcagtggggtgttaaagtctctgagtattatcgtttgggagtataagtctctttgtaggtctctaagaacttgctttatgaatmtgagtgctcctgtgttgtgtgcatatatatatctaggatagttagatcttacgaattgaaccctttagcattatgtaatgcccttctttgtcttttttgatctttgttggtttaaagtcttagtttaaaactagatttaaatcctagttttgtcagaaactagaattgcaacctctgcttttttctgttttccatttgattggcggatttttctgcgtacctttattttgagcctatgtctgtcattgcatgtgagatggatctcttgaaggcagcatatcaatgttcttggtgtcttat

SEQ ID NO: 185994 - DNA, 601 bp, Human
attgcatgtgagatggatctcttgaaggcagcatatcaatgttcttggtgtcttatccagcttgccactccgtcttttcattgggacatttagcccacttacatttaaggttagtattgttatgtgtggattttatcctgtcatgatgttagctggttattttgcaggcttgtgtatgtgatggttttataatgtccctggtctgtgtacttcattgtgtttttgtagtgtctggtaatggtctttcctttccatattttagggttcttttaaggcagttctgatgctaaccagtactctyggcatttgctcttatggaaaggatcttatttctccttcccttatatagcttagtttggccagatgtgaaattctgggttggaattttttttaagaatgatgaatattggccctcaatctcttctggcttgtagggtttcagctgagaggtctgctgttagtctgatggacttccctttgtaggtgacctggcctttttctctagctgctctcaaatgttgtgattatttgattgtactttcatattgatggaagaaaacaaatagtttattttatgtgctttggtatttagatctgtgaa

SEQ ID NO: 185995 - DNA, 601 bp, Human
gtaaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttmatttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgt

SEQ ID NO: 185996 - DNA, 601 bp, Human
taaagagaatattttccatttgtttttcaaactttaaagtgtagaaagttagtacattagttttcttgccctgaactgcattctgtggtgagcttttgaaaattacagagcaattgcaaacttgcaaacatgtttaatgaattattgggatattatgaaacacagatcgaaaagctattaggcaaagtaaatacaaactaacggttactcctaaaatcaattaaggaagggtatattattagttaaaggtaatctgtaattgtatattgcattgcttgagaagtttaaattgcaagtttawtttgctattcaaagaaatcatttaaaaattatttaaaacataaattattcaaaaataaatcgaattttattttaatacattttcagttgtttaaaataaaaataaattctttaaaacttattttatcttaaaatagttttaatgtttgcattttctcattagagaagcaaatttaaatataaactattcagtgtagaagaattagaatactttgataagcaaaaataatattctttataaaaattctaccatattgcattgccaccaggaatgcagaagaatatctcatttcctactgtc

SEQ ID NO: 185997 - DNA, 601 bp, Human
tttaatcccatagagaagactatttttcattatgacttgtagaaaaattttttcctgtgagaactaatgttacaatttcttatttggaaaataatgatatatatcttgaaagatgtattttaaaaatatataatgtatcttaaaatgtgttggtattataatcaggttaaatctgttgaaataaattgtaatttagtttttaatgacttcctttctgttgacaattatgttttgcgttgacttgcaattattctattggttcatactagttaagttcctaaagcaagcaagtaggaagttyagttccttttttttgacagttgcttgatttttacagcagagcatcccagggagtaagctgtattactagtaaattagacatctgcccaaagagctctattcagtagtccttgacattactctgaaagaaagatgaatttaataggaattttgcctttttttcccagacactggccaaaagaagaccctagacaagaaagatggaagacgaatgtcttttcagaaacctaaagggactattgagtatactgtaagttatttgctttcgaaaaagctatttttctttgtaagagtcttcttt

SEQ ID NO: 185998 - DNA, 601 bp, Human
gcattgttaattgccttatttttaaaaatctgtatttcactttggataattgttttattttttagttgttgtttttttctttaaagagaaattttactgagatataaaggtagttatcctagaaaatttaatttaatatagatgatagtttactgagagagttcccatgggccaataatttttattaggttaggcttttaggaaaatttttagttctttagaaatgtgatcttcattatattcgcagcagtgctagtgatagttataatggcagatgggatacataaaagaaaagttgatrttaatcttccagtataaccttccacattaaatcatttgtatttatttatagctaactccctttagctctaaacattgagcttttttttttttttctgtattcttgaaatgaacttcaaatcttcctgcagtcagctggcttttcacatttctggttactctgggaaactgaagtgagaaatcagctttggtatatggtatgctgcatatttgattgaatgtaaagattgtttatttggataatgttaacgtgttgtaaagcacttttaactgagcttaattttgttattctgtgtttttc

SEQ ID NO: 185999 - DNA, 601 bp, Human
ggcctttttcatttatttgatggatatcttctttatataattatggcaatactatgctttagaatgcagtcacatgaaaggaatatattacatttgttgtcatcattgataagaataaaagtcaggttttaatggtaggtattacttaccaaatgacacaatacctttttgaacatagccatgccattttcccatgggacttacaaagagatgtactcataaggggcaatgacaaagtaactacgtagccttaggttaatttagcctgtgtttcaaaccctaaagcagaatgatgaaaatstaagctgtagcatcatgcctgactagaaacctgtggggtctcttcctgttcctcggctttaacctaaatctgcctgtctactggctttcttggaaggtataagatcaaagaaaacaaaatgttgaaagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagt

SEQ ID NO: 186000 - DNA, 601 bp, Human
aagttaagggagcaacaaggccaggcctcaacctgtgtgaaaatgtaccccttcttacttttgccatttgactgaaagagatggagaggataaagttatgtgaatgatcttttaatcctcagtgacttagctactgtcaaagatggaccaaaaaacttcctgtaatttggccagtgatatgagtaaattctttgtccctgggatagattaaaaaaaaaaaaaagaggtgagagattccttaaagaactaaaagtacacctaccatttgatccagcaatctcactactaggtatctaccccraggaaaagaagtcattatataaaaaagatacttgcacatgcgtatatagcagcataatttgcaattgcaaaaatagggaaccaccccaaatgcccatcaatcaacaagtggataaggaaaatgtggtatatatataccgtggaatactactcagtcataaaaaggaatgaaagaatggcatttgcagcaacctggatggaattggagactcttattctaagtgaagtaactcaggaatggaaaactaaacatcgcacgtactcacccataagtgggagctaagctatgaggatgcaaagg

SEQ ID NO: 186001 - DNA, 601 bp, Human
tacctaggattatattcattaccaggctccaggataatatttctatgactttctgcatatctcaagtgcctatatttctatatttctaattattgggttttatgtctcccatgctgtataaatcccttagaaataaggatattatgttttattagatatagtttacattttcattacactaattaaaataatgtctattagtattgttattatatgtttttcccagaaattgtcagtttatattaccagcaaccactgataaattttttgaatgtccagcttagtagtggtttactatgargctaaaaatatgttcctggctttgtcggcataaagactttcattggtaataattcgttttcacttaaaaatattgcattttgagaatttccatggaaaactattttttctttatttttcacttttttttgttcacatatggaggaagaaatatagaaggagatagaaccaaagtaatggtaaaaatcataaaaatagctaaaatgtagtattgcaacaggtataattctaagcactttaaaagtattatttatttcttatctcaaatttatgaggtaggcacttggcctgggtttctgtg

SEQ ID NO: 186002 - DNA, 601 bp, Human
aaagtagtttgaaaaggttaaatatcgcctgtgcttcaggaattgctttcacatatgacatcctttaacaattcacaaacataacctctcttttctctctgtgcatatatagaatatatattttttaacttaaaattaaaggcactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatrtaacttatatattaaatgtaagcttatgtattataataaaactataaatatcaataccactcaaatgtgtaaataacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattt

SEQ ID NO: 186003 - DNA, 601 bp, Human
cacaaacataacctctcttttctctctgtgcatatatagaatatatattttttaacttaaaattaaaggcactaatatctatcatatacaatattatatgttatatataaaacatgttttatctcttttatagaatatataaatcgtaattttttctaaattatgattttaacttcaatgcttttagacttcaatgttaatataaatatatacaacttatgtgatatataacttatatattaaatgtaagcttatgtattataataaaactataaatatcaataccactcaaatgtgtaartaacacataaatcatatatactacattcatattattacatataatttagctttgatgcttttaaacctattttaaataacaacttagtaaggaattgttttttaatatgtactttttaatagattatactgtaattatacctcggtcttatattcttagaacaaaattttatggttagtatctgaaaaattaaactttataataggacttagtgtttgcgaagattttaggaaacaaatattttatatagaagaaatccctgtatttttaacatcacaagaaatgggtaaattactagat

SEQ ID NO: 186004 - DNA, 601 bp, Human
tagatagatagatatagatgtttatatttctatatttttaaggaccttctctggtggctaaaacaaaattatgcagggaagcatcagcaagccatcaaatgagctgcaaaaccacctcattaataatcacagtttaaaaatagcattcaaaaccatctacatagagatactaatactttgaatagtgtacatttatgtaagttacggtgaggtctggtaattcctctgaacaactttgatcttttttgaaagtaatctccttttttgtgctttgctttgagcatttgctaatctcatattmtttttaaaagaattacattgacaaattggtattgctatagatactgagttcagactatcaggtaacctcagagatcatatattgttcaaaaaggcatatcttcattttaggtacgcatatgacatatatgtatatatatatacatatatatatatatatatatatacacacacatatatttatatttgtgtgtgactaatgcggttaactcagttttgggggaattgaggaatcacaaaatttgttgatagctttttgccagtttgcaggggaccctcttatagctctgcatcagctatt

SEQ ID NO: 186005 - DNA, 601 bp, Human
tcccagcacctgatggatattatattatatggtcttatcagagtcagtggtttaattcaggagcatctgagtgtgtgtgcacgtgtgtgtatgtgttgggtgtgggtacaagagatgtagtgttcactgttctccagattattttattttttaaatttatagatatgtgtatctccctattaaaaatcactataaatgtaagtttaacctgtgtttgtgatctttattgaatatgaaaatagtgccacttttgtcctataatttgtacgtaaaaatatttcgggctgacttccagaatgcrgtgaaatgaaacaacacttattggggaaagctattcatttgactttttaatagtgtgctcatttttattttgttttctgcttttttttttctttcctttaaaaaaaaaaaaaagaatcctgatgtccatccaacagaagcaactccctcatctactttcactggtattcgacctgcacgagttgtatcttcaacttctgaggaggaggaagcatttactgagaaatttcttaaaattaattgcaaatatattaccagtggcaaggtaaagaatgacactttagagaagacctttaatcat

SEQ ID NO: 186006 - DNA, 601 bp, Human
gctgccaggtactgtgtggagtgtgaacttctgtataactagtatagcacacaaataggaagatatctagtatttattgagtaccttctatatgccagagagtatttgaggtatcttaattattttatcaattcaaaacaatcttgtgaaataggcagtcatatttcttttccacagggaaaaacaaaacaggaagggttcataggaaaggttaataggtccaagatctctctataatggccagaattcaaacctagtcagaatcttttttttttttttttttttttgagatgaagtttcrctcttatcagccaggctggagtgcaatggcgtgatctcggctcactgcaacctctgcctcctgggttcaagcaattctcctgcctgagcctcctgagtagctgggattataggcactcgccaccacatctggctaactttttgtatttttagtagagacagggtttcaccatgttggtcaggctggtcttaaactcctaacctcaggtgatccacttgcctcggcctcccaaagtgctgggattacaggtgtgagccaccgcacccagcccagaatctattttgtctgcttcactttgtt

SEQ ID NO: 186007 - DNA, 601 bp, Human
gtaaagtaatagagttggaaaataaactccagattttgctcaaaaaatgtctataacatgatactgcctttagaattcacacatgagaactatttctttgaagtataattcataaatttatgagtatttgaaacacataataagcatttagtggtatgcattttgccctaaatattgttttaaatgttgtgttttcattttcatttactttaaaatattttctcttgatttcttctttgacccatttgagagtgttttatttttctagataactgtcttttactaatttctaattcgattgtgtgtgatcagagaacacactactatttgaaggctttatttagacctgttttatggtctagaatatcgtatgttttaataaatgtaatgtgtgcactgtaagagacacattatatttgtgttgggtggaatattccacaagtgtcaatcaaatcaaattgagtgatagtgtcctgtatttctgattttctgtctatcagttgttgatagaagaattttgaactatctcactgttattgtggatttatctgtttttgcctttcagttttatttatctgtttttgccatacattatatattt

SEQ ID NO: 186008 - DNA, 601 bp, Human
acctcttatttctacatgttataaacacaattcattgttattatttttgctttaaaaagttaatttaaaataatttttaaaataagggtaaagtctattatatttatccacttacttattccctacacttgtcattccttttttatagttgcagatttccatttgtatcatttttccttttatataaggacttctaaatttcttacagtgtaggtcagctagtgataaattctttcagtgtttatttgccttgaaaaagtctgtttttccttattttattaaatgttactatcatgtttakgtatattttcttttttttttttttctccgagacagagtctcactctgttgcccaggctggagtgcggtggcctgatctcagctcactgcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctacc

SEQ ID NO: 186009 - DNA, 601 bp, Human
gcaacttccgcctcccaggttcaagcaattctcctgcctcagcctcctgagtagctgggactacaggcacatgccaccacgtctggctaatttttgtatttttttagtagagagggggttttaccatgttggccaggctggtctcgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttttgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaat

SEQ ID NO: 186010 - DNA, 601 bp, Human
cgaactgctgacctcgtgatccgcctgcttcagcctcccaaagtgctggggttacaggcgtgagctaccgcacccggcacgtttatgtacattttcaaaattatatgtgtgtttataaaaaaggatccctaacttttaaattttatgccactttatctttttttggtccattgaattttttttaattaatatactttcatttttagagcagttttaaatggacggaagaattgagcagaaattagaattcatatttatactctccccctttccccagtttcccttattaacatcttgcttytgtgtgctatatttgtttcaatcaatgaagcagtattcaggcaccaaggaaagcccataagattctctcttgtacattctgtgggctataacaaatgtatagtgacatttatctatcattacagtattaccagattagtttcattgggctgaaaatcctctatgcaccacctgttcatccctccttccctttctttccctgaactcctgataattaatggtcgtcttactctctctgtagttttgcctttttttagagtgtcatatagttggaatcatagagtatgattgaatgaattca

SEQ ID NO: 186011 - DNA, 601 bp, Human
tggttatccgagaagttccgaggattctccttggatttcttagggaaccagttgggatccccagagaagagcccatcatcccaggctactgccaacccacccagattcctcagcgtccgctgcacacaggccatgttctttccttcccagaggtccacagtttggaagatgtcagtggtgttaatgccatagcgctcagctgcttgcaggaactgagagatcttctccatctgcttgaaggccatggtggaggcctggatcttctttactgggacctgccccttggggtacagtgcattawtgagctcacataacaccgtgccatccttgagccagttctggaagttctcgcgtccaggctgggaccggcccacatcctttcggcactgggtggtgatccactggatcaggatctgctccagatctgcatcatactgtttctcaatcttctgctgcacctcctggctcaggccataatgcaggtcccctgttggccattccaatgggtggcggtggctgcggggagcgttcaaacgggctggagagcggcacactcactcaaggcaatggctgcagctgccgagcttcttcttacatgctt

SEQ ID NO: 186012 - DNA, 601 bp, Human
cagtacaagcttttctctttgctaggatggattcccaattataatgattttatctcttagtatttgcagaaatattgtaatgtaagtggtaatttttcttttgcagatagactttattttttttactttattttctaatagaaataatttctctttagaagattagtcaggtaattgcacgtaaggaaatggaagttgttaatacaaaagaataatctgtgcttaaagtttctgaagttcatgtggattaagtagatactttaattgaaaacgtcttgctcataatagtcttaatataatsctgataatatgtaggagttatgaaatattttaaaaataatgagatgggagtgctttggtataagcttatgattttcaacttgatcaaatgaatttgagaatttactttttcaagacattttcatgaattttatgttgaagaaatgtttctcttggcaaactcttgatttatggagaatgatgtctaacagattaccgcagaaagccccagctgtatgggaactttgagtgtgtagcagagggaaagaaacttaaagaatatatcagtgtgtctttttagtaatagcacataagggagatt

SEQ ID NO: 186013 - DNA, 601 bp, Human
attatcctagacaatgtaaatgttctctacaatgtactttaccatctctcattgacttgagttggtatgtgacccaggaatacaaactgatgtgtatggatctcattaaaatattaattgaaagagaaataggctgtagtttatataaagttactccttatttaggtggtccacgtcctcaactaaaagaggtgctattcagagtttcatatggattccctctccctcaccaaactgcacacacacatatactcttctctccaatattgtgtgcattaactgtatgtgatcttgaacatcygcagtaactttttttcacttgtgattggatgaccattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaatt

SEQ ID NO: 186014 - DNA, 601 bp, Human
accattttctgtagatttactttttattttatcatttttaaaagcaatatctgccataacttaatttttatattcttaaagttgaaccaggtgaattcacagagctgaatatggacttgggaggaggatgtgatgccaaatcaatcaggatttgagtttttctttttctttggataagaagctatttagtttatttttaaaattctttctggctcttcatttttacagttacaggatatatagtggactgaaaatttgaaaatgaaattaaggaatgttgcacccttggagtgattatggwttgtgacttggatacagaggaattatatatagcataaagcatgaactagctggacttcaaatcctagctgtttaggacaagtttccaggtgtttctcaccattagtttctctatcagtaaaatggaaatggttttacccatctcagagctatgattgtgaagatcaaataagcaatatgcatataaagcatggtacatataaagtattcaataaatattcatgttagtatgatcagctgcctgtggaccctagtttgctcatttataaagtaagaaggttaaacttttaagatttgtatc

SEQ ID NO: 186015 - DNA, 601 bp, Human
ataccttaactatttttactagttttcttatagctgccttttattttgtcaataatgaaacgaaaatatatgcattattgagaagattattcttaatttgcacctgggatagttatgaattatcttagatttgtatttgtgtatgtggtcagagaaccagatatttgaaaagtaacctatagtgcccatttaattcagtgtttaccagcctttttattcagacacagcttccagtcttctaaattacccctgtgagcaatcactgttgggataattttcaaatttcccttggaagtgactkaagagctgtgatttgagagaggccacatgagcaaagagctgacattgctgtgggcaagacagcttttttttttttaattgattgatttatatgtttgcaatcttctctcccagtataaaatacagtgtaaagtacagggaagaaaacccacaacttgctcaaatataaagagttaactttggaatatactggtcagaggatttgtgtgatatgttaagatagctgtgagactacagtttggacacagcttttgaaagtaatatgcttgtccaaagtaatggccagaaagaaaaggaggaa

SEQ ID NO: 186016 - DNA, 601 bp, Human
gtattagcccacaggaatgatagctgttttaaaattaacccttgtggggcagagcaacttacaaaggaaaaaagggacaaattatttttgtttctgaggaagactaaatgaattggtagaatatctgtgacagaataaaatcctttgctcaaaagtctccactgtaccttccacccaacagatattattttgacttggtagactaatctttagagctgcagataattcctagaaggtgttagtatcctctgtattagttatatttgtagatcatcatccaaggccagtttcagcaaataargattattgggaggtggataatgggatgagacaaaggtaaaagagtgaaggattacattcaaagaagaggaaggatatatacatatatggagagagagagagagagagtcattggtgagattctgttgtcctccttttctttctttttctttttctttctttcttcttcttttttttttttttttttttttttttttttgagatggagtctcgctctatcacccaggctggaatgcaatagcacgatctgcaacatccacctcctgggttcaagcggttctcctgccttagccttccgagt

SEQ ID NO: 186017 - DNA, 601 bp, Human
taaagagtatagttgttagcctgaagattttctctatatacttttgcttgagttttattcagattggttttaagccttacatttgagccatatattttaatttaagctctatttgaatgtaaataagcactgtgtgtgtgtgtatatctatggaaatcagtttatttttactttattgggagatttaaaattttaattaaacatttctctgtgtttattttccatattccatcagtgagtaaattttagtttagaattacagctttacccagggtttatgtcatcaagttcccttcaagtrgattacttgcaaggaaatcttactttgatatttcctaaatattaagcaattgatataaaagtttgacttaattacttgatttatagaattacttggtctataaggttaattatttggtcatattgaataaatcagattttttatattctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaa

SEQ ID NO: 186018 - DNA, 601 bp, Human
aggaacctccgtactgttttccatagtggctgcaccattttaccttccctgcagcagtacacaagatttgggtcagtttttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaaycttctggaattcatcacccagagatgatcattgttaacattcaatatatctgtctttcttatagaacaaaatcatatgtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacat

SEQ ID NO: 186019 - DNA, 601 bp, Human
tttaaaataccgaattttcttttcatcatgcagttgagatatcctgaagacctaagggctgtgttcagtagatattaaaataattcatatattaatacttgaaccaagttctataaaagatttaatatttttcttctgtaatatttttttaattcaaaactaatgcatgttcagtaaagaacatttggcaaacataggaagattctagaaaatttataaaaatcttctggaattcatcacccagagatgatcattgttaacattcaatatatctgtctttcttatagaacaaaatcatatrtgttaatttgttatttacatcaaatcaagattatactatactgttgtatcctgcttttttatgtcatgaaccttttcctatgtgattacagttctttgaaaacatggctttaaaggccctaaaatttatttaaccatttgcttattaagacatccagttgttattaacgatctgtattgttaagacattttaaagaatgctgcccagcattcttcaaaacatcaaagacagaaaatgcatctgatagttatcttatattttgaagatctttgactgcatctttgactacatctgatagtt

SEQ ID NO: 186020 - DNA, 601 bp, Human
tctgggttcctaaattcacctatatattcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgggtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgca

SEQ ID NO: 186021 - DNA, 601 bp, Human
ttcagaccctcagtatactctatcagcacctctggttgaaagagttagaactaattcgttcttaattaactgtccaaacaggtggcagaatctaacatattattgactgttttattacaattttgtatacatgtaaaagcattagaaacttcattaaatttttgtctgaaacaaccatgttaagtatacctttaaaacttctacagttatttagatgtcattcaaaaagactgatagagaatatgtagaaaattatatatatattatgtgtgtgtatatatatatgattgctttagtatgsgtgttgaaaatgtaacaatgtttctgaaacttttactttttttcttaatgtccttagacataatttttattcattaacttggctcttttgttaagtttagtcatgttgtatctgtgactttacctttgaaggaaaaaaaatataaattaagaaaatgtactttagcaccactaaagtgaggttttattctgtaactatttgtcagaattttgaaggtaaagttaactaaactacctaaacttggtgtgtgagaattgaataaacactgtttgcatctcaattctaggttctgcactttta

SEQ ID NO: 186022 - DNA, 601 bp, Human; identical to SEQ ID NO: 38593

SEQ ID NO: 186023 - DNA, 601 bp, Human; identical to SEQ ID NO: 38594

SEQ ID NO: 186024 - DNA, 601 bp, Human
gaaatatattgctagccagaaatgtatacattgactggggaagtttgtatatgataaatttggtaaacttattgtttgcttttttctccctttccctatgtaagtgtcataaggcagggatttgtcaatttcatacactattatatcttcagaactaagaattgtataggcatatagttcattctcaatatttattaatggataaacttgggcgtagattaaaattaaggtataaagcttctaatctttcaagattgctctatttcctgaaataagttcttacatcagttgtagtaaatattttcataaagccatagattctggacattttaactaatagtccacagtctgtcatttacatttttttttgttctgtttaaacatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatct

SEQ ID NO: 186025 - DNA, 601 bp, Human
acatattcagtgaaagggaatttgttacctcaaagggcaatactttacattttaggacagctctgttagaaagttatttgttacaataagcttaaggaaacatatctttgtaaattggattcatttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtacccyaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcc

SEQ ID NO: 186026 - DNA, 601 bp, Human
ttatctttattctgtcttccaatgcaagtcaataacaacaagaaacattttctatttactgcgatagtgtgaaaatgtttgtcttcccttttaatcttgtttcagaattattttttccagtacttcaactgtttaactttatgaactctattcagatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaycagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacgatgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcag

SEQ ID NO: 186027 - DNA, 601 bp, Human
gatcttattcatatcagtaccctaaaatatgttaaaagagttcataaactatggcaccccaaattactaaaatgtacacttgggatagcaggaaaaattccgtaatatttttaaaaattttaatttccaaatatgaacattgaagaccagtcctattgaagacagacagaaacatatatttactaagaaaaagaaaatttagccaaattttaaggtggtcaggagtaaaagttcctaatgataaatcagttcctaagtatttggataaaggatctgagaaatactattcttactgctcacratgtgtaaaggactgaatttcctctttttgtagtgttactttgtatgccacatgataaagagtactttggtgtgggtcgggcgtggtggctcacgcctgtaatcccagcactttgggaggccgagacaggtggatcacgaggtcaggagatcgagaccatcctggctaacatggtgaaaccccgtctctactaaaaatacaaaaaattagccgggcgtggtggcgggcgcttcttgttgtagctactcgggaggctgaggcaggagaatggcgtgaacctgggaggtggagcgtgcagtg

SEQ ID NO: 186028 - DNA, 601 bp, Human
acttagcaatatgtattataaatactacaaaaacagaaagggcaagaaggagacttactgagctcattttatgtttgcctgacactgtatttataaatttggatgacttcgagaaacagaaaaccacactcagaatagcttaaacctgttgtttctcgaagtgtagttcccagaccatcagcagcagcagcacctgggaatttgttagaaatgcaaattctcagaccccatttgagtctgattaattagaaaccatttttggagcccagcattctggtataacaaatactccaggtgataytgatgccggctaaaacttgaaagccactgatttaggtctctaatgactagttctgtccagagatgagagccagcctcctcagaaacacatggctggaaggatacctgagcaaaatcaaggccacttcaggaaggagttgtaagggtggatattgaataggcaaccaacagaatagactatgccatgcttggtggtttttggttttgtttttaatatctcatttaaacctcattttggaacacacgtcatatttgttattttagaaaatgtagctggaagttatgacaagctttcaaaatg

SEQ ID NO: 186029 - DNA, 601 bp, Human
acatttattaaccagtatttatgtatgtcttatggtaagtgaaacatcttctgctctccagtcacaacctagttgaaaaaagtatacacatatattcaatgtagaatattttttcttaatttatttgactcaattgttttttatttttcatttaaagaaatttaatagcatagggggctttccagtgaaatttaatagcatagtggtcttccagtgaagaccagaaaacctgctagataaattctaagagagctgtaacactgactcagtagttgaaaagcatatatcttatgtatgcaarttatgaggcataatagtaaaatgaacatctgtgatgtaccactacccaatattagaactagaatatcactaatgtagctgcatctgtctgtgtgttttttctcatcttgtgtcaccctcatattggtaaccacctctctggattttttgttttattatccccctaactttttttaattataatagatttcattttttagatcagtattaggtttacagaaaaattgaatggaaggcatagagagtttccatatactctcttttccccaaaacacagttttccctgttattcacaaatgac

SEQ ID NO: 186030 - DNA, 601 bp, Human
tgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaactgccaaactgtctttcatctggctgtacccattttgcatggcatccacaacaaatgagaattcctgttctccacatccctgctgacatttgctgttgtcagctctttggattttagcttttatttaaatagatgtgtagtgatatctcartcattttaatttgcatttccctggtgacatatcatagtgagcatcctttcatagtcttattttccatttgtatatcttctttaatgagatgtttattcatatcttttgtccatattttaatcaggttgtttgatatcttactgttatgttttacataaacatagagatagaacagaccattgtctccttccttcctatctgtattccttcatatattttggataacagtcctttatcatttatatatgttgcagagattttctagtctgtagcttgtctttttcattctcttgacagtgt

SEQ ID NO: 186031 - DNA, 601 bp, Human
gtcttgaagttgagtagtgtcagtcttccaactttgttctttttcttcattgctatcttggctattctgtgtctttgcatataaactatttctataaattttagaatcaatttgcctgtatctacaaaatagcctggtagaattttgattgaaattgtattgaatccatacatcaagttgagaagaactgacagcttgacaatattgagtcttcctatctatgaatgtgggatatgtatttaaatcttttgttaatcacagttttctactttttttcacgtagatctctatgtattttgtyagaattatatgtatttcatttacattatgctaatataaatggtattctttttaactttcaaattccaagttttcattgctgatataaagaccattgacttttgcatattaatcttgcactctgaaagcctgccatgatcacttattccagtagagttttggttgattctttgggattttttataccaacaatcatgtcatctgctaacaaagacagttttatctctttcttccctatttatataactttaattttctttgaatttaatttatataactttgtcttattgcattagctagg

SEQ ID NO: 186032 - DNA, 601 bp, Human
tctttatccagttgagggagttcttctttattcctaacttcctgagcatttttattagtgttggattttgactagtgcattttttgtatctgttgataagatcacatgatttttcttctttaccatgttgatgtaatagattacatcaattgattttcaaggctgtaccagtcttgcgtaggtgggataagttctacttcgtcgttgtatataattctgtacatttgtacattgctcaattcagtttgctagtgttttgttgagaatttttgcatatatgttaatgagagataattgcctrtagtttttctttcttgtaaagtttttatttctattagagtaatgctgtcctcacagaattagttaagaagtattccctccgcttctgttttctggaagagattgtggagagtttgtataatttcttcgtaaatgtttggtagtattcatcagtgagtctatctgggccttgtgctttctgttttaggaggttattaattattgattaattatttaaatacatatctttctttctttttttgagttggagttttgctatgttccctgggctggtcttgaactcataggctcaagtgatcct

SEQ ID NO: 186033 - DNA, 601 bp, Human
gtgtttatctgtcatttatggctttcaaatttaatactgtgcaagagcctggtctaggcaattatagaagatagaaagttttcctttgaaagttaaaatgtaggaaagttgttaaattttagtcacaaataaatgatacagtaaaaaccataaagaaataaaacaggagagaggcaaaaagtggaaaaaaaaagtcatttaaagggctgaagcagacatacttagaaggtacttttgattagacatacttttgaaaatctaattttctactttctagagcttatttttcttattgccatargttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacgttatctttaatgttagcaaagtatgtgttttatatagtgttttctgtataaaaaactataatttctatttactaagttgaatctatatggaatagt

SEQ ID NO: 186034 - DNA, 601 bp, Human
ggctgaagcagacatacttagaaggtacttttgattagacatacttttgaaaatctaattttctactttctagagcttatttttcttattgccataggttttaaaatgtacttctatattgttttcttgctcttctctcctctgttgtttctgttatagatgggtatgtttgtcacctgtgcctagaagaaattcttccagcatggccattaggatataatgtttgagctcacctgatttggagggggtagttgaaactaccacttcctttgtaactgcaagaccgtttagttttcagacrttatctttaatgttagcaaagtatgtgttttatatagtgttttctgtataaaaaactataatttctatttactaagttgaatctatatggaatagtccataaaataaaccttacataccaactagttggatgtagtagtgaaaatcattcatggatatttcactctagtttgatatataaatctcttggattttcaacatagagtggggaagaaatcctaattacagttctcttcccattttaatttctcctcttttttttttttttttttttttttttgctgtttttctcaactgtcag

SEQ ID NO: 186035 - DNA, 601 bp, Human
actctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttctttcagcgatgaggagttttcattcatttaacrttggaagaatggtgttggttttgagattgaatcttttctaaacaaaatctgaaagatatggtactataggaaaactaataaaaaatttaatagcaaggcttaaatattttatttaaggctatttcatttatatcagcgtcacatcaaatatctcaataggataaactgttcttgaggcattcttggttggtattaggagtacattggaatagtacagtttagacacagaactggataaattacttaaaattctgtgaaataatctttgtgattttttttttagaaacaagaaagcaatgt

SEQ ID NO: 186036 - DNA, 601 bp, Human
aactcatttttaagttgtgtctattatactgtgtttctttcttcttaataagatatgctttcatggctctgctagacctgaattttttcttttaatgcttctaatgctgccttgggtttctttttctttttctttttacctttcacatcatcaaaataagggtgaaacatgatgatatgaaagaatgagtatttagcttcttgtcaaaaaacaatacacttatagaacatgtattggttgcaaatatatgctgctcaggtttgttaagaaacctgttaaaggaacaaaataatttagcaakaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaagcatgtattctttgtaatgcaacacat

SEQ ID NO: 186037 - DNA, 601 bp, Human
acctgttaaaggaacaaaataatttagcaagaatttcattcccatatagaatcacagttgctgagcgttgctgcattttagttatctgctccaatagaattctgcatattttccaatttaaaagtttcataatgtttcatttcttttattttctaatattattatgttttatatattaaaataaaattaatattaaaaagtaagcaccaatagaatatattgtgcagtagtaagctttatttttacttagttaacattcttatcgttttaagaataccagtgaaatcatttccaccaagcaaaagcatgtattctttgtaatgcaacacattaatctaatttaaaaaataaatttatgaacaaattaacagtaaaatttattgtttggtccaagtagatgaaaaaaattaaatgtttagaaagttataaaaagaaagcatttaaaaaaatggtaacgtttgtcagtgaaacaaatacatgcacaactcacagaaaatagttatttttttttattctactattctttacattaaaattttggcacccaggaagttttgttcattatttttgacaaattttgtgttagcatgaaagaattcta

SEQ ID NO: 186038 - DNA, 601 bp, Human; identical to SEQ ID NO: 38595

SEQ ID NO: 186039 - DNA, 601 bp, Human; identical to SEQ ID NO: 38596

SEQ ID NO: 186040 - DNA, 601 bp, Human; identical to SEQ ID NO: 38597

SEQ ID NO: 186041 - DNA, 601 bp, Human; identical to SEQ ID NO: 38598

SEQ ID NO: 186042 - DNA, 601 bp, Human; identical to SEQ ID NO: 38599

SEQ ID NO: 186043 - DNA, 601 bp, Human; identical to SEQ ID NO: 38600

SEQ ID NO: 186044 - DNA, 601 bp, Human; identical to SEQ ID NO: 38601

SEQ ID NO: 186045 - DNA, 601 bp, Human; identical to SEQ ID NO: 38602

SEQ ID NO: 186046 - DNA, 601 bp, Human; identical to SEQ ID NO: 38603

SEQ ID NO: 186047 - DNA, 601 bp, Human; identical to SEQ ID NO: 38604

SEQ ID NO: 186048 - DNA, 601 bp, Human; identical to SEQ ID NO: 38605

SEQ ID NO: 186049 - DNA, 601 bp, Human; identical to SEQ ID NO: 38606

SEQ ID NO: 186050 - DNA, 601 bp, Human; identical to SEQ ID NO: 38607

SEQ ID NO: 186051 - DNA, 601 bp, Human
caagaccacactgtgagtcaccaggaaaggaggaaccagtgacagccgtgacttcacaagttgcccaacaagagcttgggccgggcaagttaccctaatgattagcacaggtctcaagttctctttggtgggcagaaggccgtggtttgactgagctggaagctgagaggacacggcccctgcctccccactggaggcacaaaggggagattcccacttctcatcccctcgagtggcccaggctccctccaggccccaggggaagaatcggggctgtgtctgcggccgacctcacatcccrgtcaaacaatcccagcccacgttccttccaagatccctgccttccaaagcactttcacatctgctgttggctttgcacacaaataaccttccggccgctgctgtgccccatctcacagaggcagaaacggagccagcctcggagtgaacgtcagttacatttgcctggaaagtggattccagctcccttactcctcactcttgcggcatctccccagggtacccccagccatttgacagagaaggaaactgaggcccagagcaggacagggatttgcccagggtcccccagagaggtgga

SEQ ID NO: 186052 - DNA, 601 bp, Human
gtgggtctaggcaggacagtacaaggacactgaccctcagccaccccaggcagaggggcagccttggcccccgggcactgtgacttgcccaagaccacactgtgagtcaccaggaaaggaggaaccagtgacagccgtgacttcacaagttgcccaacaagagcttgggccgggcaagttaccctaatgattagcacaggtctcaagttctctttggtgggcagaaggccgtggtttgactgagctggaagctgagaggacacggcccctgcctccccactggaggcacaaaggggagatycccacttctcatcccctcgagtggcccaggctccctccaggccccaggggaagaatcggggctgtgtctgcggccgacctcacatcccggtcaaacaatcccagcccacgttccttccaagatccctgccttccaaagcactttcacatctgctgttggctttgcacacaaataaccttccggccgctgctgtgccccatctcacagaggcagaaacggagccagcctcggagtgaacgtcagttacatttgcctggaaagtggattccagctcccttactcctcactcttgcggcatct

SEQ ID NO: 186053 - DNA, 601 bp, Human
agggtgggtctaggcaggacagtacaaggacactgaccctcagccaccccaggcagaggggcagccttggcccccgggcactgtgacttgcccaagaccacactgtgagtcaccaggaaaggaggaaccagtgacagccgtgacttcacaagttgcccaacaagagcttgggccgggcaagttaccctaatgattagcacaggtctcaagttctctttggtgggcagaaggccgtggtttgactgagctggaagctgagaggacacggcccctgcctccccactggaggcacaaaggggasattcccacttctcatcccctcgagtggcccaggctccctccaggccccaggggaagaatcggggctgtgtctgcggccgacctcacatcccggtcaaacaatcccagcccacgttccttccaagatccctgccttccaaagcactttcacatctgctgttggctttgcacacaaataaccttccggccgctgctgtgccccatctcacagaggcagaaacggagccagcctcggagtgaacgtcagttacatttgcctggaaagtggattccagctcccttactcctcactcttgcggca

SEQ ID NO: 186054 - DNA, 601 bp, Human
cccggggtcaccgcaggccccatctgccccctgctgtcactcacatggcctgcccagaccctagaggcatcagagttggagacctctgagccagtcaacatcaccttacccctgactttataaaagggaaactgaggcccagagagaggcttgtctgagcccatacagccagttagtggcagggctggggtgaggacccagggacttgctacctgtgaggcgcccctgcatgccacactgtccttctaagaatgtgcatagtctcagagcttgaaggcctaaaatacagggtacagggacrctcaaagagtgatttgcttctctcagctcttgcattggcaggagctcggaaggacaacctctgagttcctcctcccaaaactagagtccttgaatctgacaacttgactccaaggatgctgacagcaggtgccatgtctgatgcacaacgaataataaagcactcacctgtgcgtcaggcgtggttctgcatgctttgtatgtatcaactccctgagcctcacaacaaaccctatcagatgggtatgataattcacatccccatttttttaaatgagaaaactgaggctcagagaggtta

SEQ ID NO: 186055 - DNA, 601 bp, Human
ctggggaagaggggtcaggaagaaagagatttctgggcaaaagtgtcttctgggggtgtccactttctaccatcgacttagaacgtgcttcaggttgacaaaaagccaggacccaagagacccaatttaagaaatttctctagactgggctcggtggctcatgcctgtaatcccagcgcgttgggaggccaaggcaggagaatcacttgaggccaagggtttgagaccagcctgggcaacatagtgggaccctgtctctacaaaaaaaaatatttaaaattagctggccatggtggcatgygcctgtgatcctagctactcaggaagctgaggtgggaggatctcttgaacccaggagttcaaggctgcagtgagctgtgatggcaccactgcattccagcctgggtgacagagcaagaccccatctcttaaaaacaaaaacaaaacaaaacaaatcaaaccacaaaagatgggcaagttactgaattttgaaaaaaagaatagattttttaaaaaaagaaagaaagtttgctgggttcccaaagtgtgcaagtttgggtgacccagagaatcctctacacaaacccactgacatcctgag

SEQ ID NO: 186056 - DNA, 601 bp, Human
caaggtgcccaagcaaagccctactcatccttaagactcagacctcctccaagaagctattccagaatcccaacctccagccctacatctgtgcccccatcatagccagcaatgtcatccattgtcctcgtcggtttttccttggcagactggcccctcaagggcagaggccgtgaatgagtcagggctgtatcccggcctggggctgggcacatgggtgaacttacctgcacgaggtcagggcaatagagactccttcttcaaatactatgatttgaatgctttaccttttttttttttwaaagagtctcactctgtcaggctagagcgcagtggcgcgatcttggctcactgcaacctccacctcccaggttcaagcaattctcctgcctcagcctcccgcgtagcttggactacaggctcccgccatcatgcccagctaattttttgtatttttagtaaagacagggttttgtcctgacctcaagtgatccacccgcctcaacctcccaaaatgctgggattacaggcatgagccaccgcacctggccgtactttttttttttttccaatttaaaagtagtatacttgagccacaaag

SEQ ID NO: 186057 - DNA, 601 bp, Human
tgacctcttttccaaggtgcccaagcaaagccctactcatccttaagactcagacctcctccaagaagctattccagaatcccaacctccagccctacatctgtgcccccatcatagccagcaatgtcatccattgtcctcgtcggtttttccttggcagactggcccctcaagggcagaggccgtgaatgagtcagggctgtatcccggcctggggctgggcacatgggtgaacttacctgcacgaggtcagggcaatagagactccttcttcaaatactatgatttgaatgctttacctttttttttttttaaagagtctcactctgtcaggctagagcgcagtggcgcgatcttggctcactgcaacctccacctcccaggttcaagcaattctcctgcctcagcctcccgcgtagcttggactacaggctcccgccatcatgcccagctaattttttgtatttttagtaaagacagggttttgtcctgacctcaagtgatccacccgcctcaacctcccaaaatgctgggattacaggcatgagccaccgcacctggccgtactttttttttttttccaatttaaaagtagtatact

SEQ ID NO: 186058 - DNA, 601 bp, Human
ctttcaacagaggagtggggccaggcactatggcccacgcctataatcccagcactttgggaggctgaggctggtggatcacttgaggtcaggagttcaagaccagcctggccaacatggtgaaaccccatctctcctaacgatacaaaacttagccgggcatgatggcacacacctgtgattccagctacttgggaggctgaggcacaagaatcacttgaacccgggaggcagaggttgcagtgagccaggatcacgccactgcactccagcctgggtgatagagcaagactcagtctcaaaaaaaaggggcggggggccttgtgttcttcttccacagcccacttcaggcactcacctgctagccctccacccggcttcgctagggtctcctccaaatgatcacttttgaggcagggaccactggccccatttacagatgaggaaggcaaggctcagataacaaaggtgcccgcctgctcaagtcacactgctggtaagtaatggagatgggcctgtgttcctttcaatcacaaatcactgcccccaaagtggagcagagaaaagagccccaggagttctaaggaggacaaatcaggag

SEQ ID NO: 186059 - DNA, 601 bp, Human
ttttccccacctggcagtttggacccatttttcaaccccaaacagatgaactttcaacagaggagtggggccaggcactatggcccacgcctataatcccagcactttgggaggctgaggctggtggatcacttgaggtcaggagttcaagaccagcctggccaacatggtgaaaccccatctctcctaacgatacaaaacttagccgggcatgatggcacacacctgtgattccagctacttgggaggctgaggcacaagaatcacttgaacccgggaggcagaggttgcagtgagccargatcacgccactgcactccagcctgggtgatagagcaagactcagtctcaaaaaaaaggggcggggggccttgtgttcttcttccacagcccacttcaggcactcacctgctagccctccacccggcttcgctagggtctcctccaaatgatcacttttgaggcagggaccactggccccatttacagatgaggaaggcaaggctcagataacaaaggtgcccgcctgctcaagtcacactgctggtaagtaatggagatgggcctgtgttcctttcaatcacaaatcactgcccccaaa

SEQ ID NO: 186060 - DNA, 601 bp, Human
tgctctaggctcaaaataaaagcctcacttcctggaggcctcggggccaggttggcaacagagaagtctcggccaggccaggctaggcccttcagccactctctgggtgggatgggccatgggggcctcctgcttttagaagctggggttcacacccctgaggtgaggagaacaactcagttctgacactgaggaggggctacaactcccaccctgcccccaccggcctcctcacccctccgtgaagcgcacagagctgcagtggcagagaacgtggcctctctgtccagcccaggggcaytggacataaaggtggcaagttctaacagattctcacccagggttttccccacctggcagtttggacccatttttcaaccccaaacagatgaactttcaacagaggagtggggccaggcactatggcccacgcctataatcccagcactttgggaggctgaggctggtggatcacttgaggtcaggagttcaagaccagcctggccaacatggtgaaaccccatctctcctaacgatacaaaacttagccgggcatgatggcacacacctgtgattccagctacttgggaggctgaggcac

SEQ ID NO: 186061 - DNA, 601 bp, Human
gtcctcacccgccgcctccacctcatcccctcctccctccactgggctctggggctcacagacctcagtgagaaccccagtgcagccgctgatcccctgtgggatcctggcctggccatgttacttcatctgtaacatttcctcatctgtagaagggagagaagaatccatccacctcctggagtgggtgtgagaagtaaatcattgaagacagtgattcagaaagatcaactgagcagcacaggtgcctgtgtgtggacacccagcacggagcctggtggccatggctgccttatttgtracagccccaagctggaatcaatccaaatgttattttgcaggaaaacaggcaaatgcattgtggtagattcatacaatggagtatacacagcaatggaaaaaatgagttagctacccgcaaccacacagacgaagctcccaaacataacgttgggagaaagaagtgctcacaaaagaacacgcgctgcagaatttcatttctacgtaattctacagatgtatgtattatagaactacatagacaggcagaagtcagtgggggcggggcagtggcgaggcgggggctctaggggcctctggg

SEQ ID NO: 186062 - DNA, 601 bp, Human
acaggtacaaggcttctctcccccaacaatgcgcaggcagacagcatgccctcacccacttgctccccaattacagcatcttttcacccactgtcccttcattctatgctggtgagatcatgaagataagagctcgggtgctggggtcagatggccccaggccccagccgagctctgcacccttgagccagccactaacctctctgggcctcggctcctcatctgaggaatggggataatcactgacctgcctcacaggattgctgaggtcaaatggaatcgtgtggtgcgcggagccggrcacacagcaggtgcaccataaacaagcacaattgggtggtggtttttgctacctctgggcattcactgactctcagtaaacactctctgagcacctaccgcctccaaactctgtctagaaaagccactgaccctggcgtgccggtgtcacagtctccagggaactcgatacatgaatggtgtgctcagagccatgacagaggacacgcatggggcttggggtccttgatgagggagagcgcattgctgtctaaaaaacttagggagaatttcaccaacaggaaacccatgagcgtggctt

SEQ ID NO: 186063 - DNA, 601 bp, Human
cagacacaggtctcaacttgtcttcctgccacattacatcctgtttaggggcgtggaaagggactgaacggaagagtgatgaagagctgggctccagaatcagatcaagaggattttgaatccaggtcactgtgtgaccttgggcaagtctcttaacctctctgagtttcctcatctggaaaattgcaatcactggatttagtgaagattaaattgcattatatttgcaaagcactgagctcagggactggcagggggtgcccagcaaacagaatctgcttttggctggggcaagcttacrtggttcggcagtagtaccaggagcacggtgcatgctctaactgccccctctacctgctaaagagtgagctggaaaggctttgtctcatcaggaaagttgagaacaccccaaaaagaaggcaggtgtggtgagggctgtggctgacactcacaggaaacagccctgagagaaaaaaactccttcctcagcccctaaaggccaggccgcagcccctctcctctcagtttcaccttgaacgagagaaagagaaagggaggcagatgacagctccgtccagcacagaacggggtgtcctgtgaa

SEQ ID NO: 186064 - DNA, 601 bp, Human
catggggaactcacaaccttatgtgtgtccatgtcctcacagcaagccctccacccttcccctatgacatacatacagttctccaggtaacctctgcccatataaagaacaagaaaactgtcccctcccctctagtcggtgccctatctctattaatatggccctaagtttacatcggctttctaggcagccctgcactggtaactcatgctcagctgacaggcaaccagccacccaccatctgtttcccccttgctgactgtgtgggttttttttttttttttttttttttttagctcaracacaggtctcaacttgtcttcctgccacattacatcctgtttaggggcgtggaaagggactgaacggaagagtgatgaagagctgggctccagaatcagatcaagaggattttgaatccaggtcactgtgtgaccttgggcaagtctcttaacctctctgagtttcctcatctggaaaattgcaatcactggatttagtgaagattaaattgcattatatttgcaaagcactgagctcagggactggcagggggtgcccagcaaacagaatctgcttttggctggggcaagcttacgtg

SEQ ID NO: 186065 - DNA, 601 bp, Human; identical to SEQ ID NO: 35203

SEQ ID NO: 186066 - DNA, 601 bp, Human; identical to SEQ ID NO: 35204

SEQ ID NO: 186067 - DNA, 601 bp, Human; identical to SEQ ID NO: 35205

SEQ ID NO: 186068 - DNA, 601 bp, Human; identical to SEQ ID NO: 35206

SEQ ID NO: 186069 - DNA, 601 bp, Human; identical to SEQ ID NO: 35207

SEQ ID NO: 186070 - DNA, 601 bp, Human; identical to SEQ ID NO: 35208

SEQ ID NO: 186071 - DNA, 601 bp, Human; identical to SEQ ID NO: 35209

SEQ ID NO: 186072 - DNA, 601 bp, Human; identical to SEQ ID NO: 35210

SEQ ID NO: 186073 - DNA, 601 bp, Human; identical to SEQ ID NO: 35211

SEQ ID NO: 186074 - DNA, 601 bp, Human; identical to SEQ ID NO: 35212

SEQ ID NO: 186075 - DNA, 601 bp, Human; identical to SEQ ID NO: 35213

SEQ ID NO: 186076 - DNA, 601 bp, Human; identical to SEQ ID NO: 35214

SEQ ID NO: 186077 - DNA, 601 bp, Human; identical to SEQ ID NO: 40199

SEQ ID NO: 186078 - DNA, 601 bp, Human; identical to SEQ ID NO: 40200

SEQ ID NO: 186079 - DNA, 601 bp, Human; identical to SEQ ID NO: 40201

SEQ ID NO: 186080 - DNA, 601 bp, Human; identical to SEQ ID NO: 40202

SEQ ID NO: 186081 - DNA, 601 bp, Human; identical to SEQ ID NO: 40203

SEQ ID NO: 186082 - DNA, 601 bp, Human; identical to SEQ ID NO: 40204

SEQ ID NO: 186083 - DNA, 601 bp, Human; identical to SEQ ID NO: 40205

SEQ ID NO: 186084 - DNA, 601 bp, Human; identical to SEQ ID NO: 40206

SEQ ID NO: 186085 - DNA, 601 bp, Human; identical to SEQ ID NO: 40207

SEQ ID NO: 186086 - DNA, 601 bp, Human; identical to SEQ ID NO: 40208

SEQ ID NO: 186087 - DNA, 601 bp, Human; identical to SEQ ID NO: 40209

SEQ ID NO: 186088 - DNA, 601 bp, Human; identical to SEQ ID NO: 40210

SEQ ID NO: 186089 - DNA, 601 bp, Human; identical to SEQ ID NO: 40211

SEQ ID NO: 186090 - DNA, 601 bp, Human; identical to SEQ ID NO: 40212

SEQ ID NO: 186091 - DNA, 601 bp, Human; identical to SEQ ID NO: 40213

SEQ ID NO: 186092 - DNA, 601 bp, Human; identical to SEQ ID NO: 40214

SEQ ID NO: 186093 - DNA, 601 bp, Human; identical to SEQ ID NO: 40215

SEQ ID NO: 186094 - DNA, 601 bp, Human; identical to SEQ ID NO: 40216

SEQ ID NO: 186095 - DNA, 601 bp, Human; identical to SEQ ID NO: 40217

SEQ ID NO: 186096 - DNA, 601 bp, Human
ccatatatgtctccatctgtgttttaaaatccttactttttccaacagtgtctgctgcacagagctttacatccccgggagcctctacccccaattcagcagcatatttggaatatgctgaatcctcccgctgaggtgacaacgaaaagtcagattcctctctctaaaataaagaccctttttcctctgattgaagccaagaaaaaggatcaagtgactgctcaggaaattttccaagacaagtaagtacttggtatagttgcatttaacattggggtacataagagttgtggtcattttrgagtggctctggaagtgtcacataggggtctatggaatttaaaaggtgagaggaagaagccttttgctatttggcccttatattgaaatattgatttcttatatctgtctgctgtgatcatattttatccttgctgttcactttggatttagagctaccttctgggctgatgactttttgatcagcatcagattcttggtgaattatatataatgtataattcagataagtttctgaatatctaaggctaaatgtcaccctttttaaagtaaagtactgagaatgagtgtgttgaagatc

SEQ ID NO: 186097 - DNA, 601 bp, Human
gatcacaccattacactccagcctaggcaacagagtgagactgtcttaaaaaaaaaagagagaaaaaaatttgggtgggaacacaaagcgtaaccgtatcaggtgagaactccgcagttttgtggcccatcttatctcaaaacatacctgtttttgcatgtacctcccttcttttcctgtctcagtgaaatagggtatttatttcatcctgcctaaagtgaattcctttacctgtgccctggatccttttttttcttgtttttttttttttaattttagtttttgagacagggtgtctctytgtcacccaggctggagtgcagtggcagggtcacagctcactgcagcctagacctcctgggctcaagtgatctcccaacttgaggatcctcagtagcctcctgagtaactcacgccggctaagttttttatattttgtcgagatagagtcttactttgttccctaggatggattcctttttctgcttcatctggtaccttaggccactaataatttcttctctctttctgtatttttagcttctccctcgctaccactaactcctttcttctctcatgttaaatttctttcatttaacac

SEQ ID NO: 186098 - DNA, 601 bp, Human
cacttgacactgtcagttattcctgctttcttgagactcatgtatctgtcttaacttcagcttctccaaatttttctttttcaatctttggcagctccctctcagattcctgtgggggctgcttttgtgtgtttttgtgttgatattctgtaggatttgtcctcagaaacagcaaacatttattgaaccttatgctgaagataatgggaagccattaaagcaagggtttttaatcagggttccaaagattgatatcaaggaatctgtgaactacctgaaattacattcagacttcaaaacytaatatgttaagtgctttacatgatgctaagtgctttacacacattatctgtttggacccacgttgccatcctatgaagtagattcttctgttgacccccaacttaaagctcaggagactcaggattagagaagatgagaaacttgcccaagattgtagttggtaagtgttggagtaaggatttaagtgtaggcagtctgactccagagcttgtacttcaaactgtaatgccactttgccttagcaatgcatgtcccaagacctcttttttatttcagagcctcaaaaactactaaatac

SEQ ID NO: 186099 - DNA, 601 bp, Human
cagcagtgggtgccgcaaatgctgggctcggtgcccactggaaggaaaatggaagaagggcttttgaatatcttttcgcctttctggggagagtttcgagagatttattccccgtgatgacagaggaacagagaaggggtcgtgaaggatcctgcccaggcgaccgtccccacagttcagcagggatcagccgagagcagtgtgcccagcaacaaagccaccagactgaggacagacagcacgcacgctgcctagagaaaaccattttctttcctcacgttttttaatgctcctaattaaygtgttttctagctccttctctcactacgtcccagcttttgcaccttatgctttaacccaatacaactattttcttttttttttgttttttttttgttgttgttttttgagacggagtgtcactctgtcacccaggctggagtgcagtggcgccattgtggctcactgcaagctctgcctcccgggttcacgccattctcctgcctcagcctttcgagtagctgggactacaggtgcccgccaccatgcccggctaatgttttgtacttttaatagaggtggggtttcaccgtgttagcca

SEQ ID NO: 186100 - DNA, 601 bp, Human
ctggggagagtttcgagagatttattccccgtgatgacagaggaacagagaaggggtcgtgaaggatcctgcccaggcgaccgtccccacagttcagcagggatcagccgagagcagtgtgcccagcaacaaagccaccagactgaggacagacagcacgcacgctgcctagagaaaaccattttctttcctcacgttttttaatgctcctaattaatgtgttttctagctccttctctcactacgtcccagcttttgcaccttatgctttaacccaatacaactattttctttttttttygttttttttttgttgttgttttttgagacggagtgtcactctgtcacccaggctggagtgcagtggcgccattgtggctcactgcaagctctgcctcccgggttcacgccattctcctgcctcagcctttcgagtagctgggactacaggtgcccgccaccatgcccggctaatgttttgtacttttaatagaggtggggtttcaccgtgttagccaggatgatctcgatctcctgacctcgtgatccgcctgcctcagcctcccgaagtgctgggattacaggcatgagccaccacgcc

SEQ ID NO: 186101 - DNA, 601 bp, Human
gatagagaaaacgggttgttagacacaaaggtcttctgtgtacatggaaagctaatagctgtcaattctgagacaggaactagaaaataatatctgaagagtaaatggatttcttacttaaatgttaaatttccattatctgtgcttgcagtttcatcttttccaaggaccttatgatgtgattgcttaattctgattctcatactgctgtgaaacaaagccagggctgcctcaagttaggcccttaggagcccggtggctaggaaagggaggcagcttgtttgtagaaggactacatgtagctattgtttttcttttctttttcttcttcattatttttcttttcttcttcttcttttttcttttttttttttggtgcttggaaaataagtttcacaatagcaatctggttttgtattgtttgttctaagagaaattttttttttcttttctagccatgaagatggacctacagctaaaaaattaaagactgagcaagggggagcccacttcagcgtctccagtctggctgaaggcagtgtcacctctgtaagctaagcttttcaagtgcgcttccccctttgcaggaaggttggggctt

SEQ ID NO: 186102 - DNA, 601 bp, Human
caggaactagaaaataatatctgaagagtaaatggatttcttacttaaatgttaaatttccattatctgtgcttgcagtttcatcttttccaaggaccttatgatgtgattgcttaattctgattctcatactgctgtgaaacaaagccagggctgcctcaagttaggcccttaggagcccggtggctaggaaagggaggcagcttgtttgtagaaggactacatgtagctattgtttttcttttctttttcttcttcattatttttcttttcttcttcttcttttttcttttttttttttggtgcttggaaaataagtttcacaatagcaatctggttttgtattgtttgttctaagagaaattttttttttcttttctagccatgaagatggacctacagctaaaaaattaaagactgagcaagggggagcccacttcagcgtctccagtctggctgaaggcagtgtcacctctgtaagctaagcttttcaagtgcgcttccccctttgcaggaaggttggggcttgagggagagtgcatcaatttttgttagtccgttcttaccactttcaagttaagatcatgatcactttctctgg

SEQ ID NO: 186103 - DNA, 601 bp, Human; identical to SEQ ID NO: 40218

SEQ ID NO: 186104 - DNA, 601 bp, Human; identical to SEQ ID NO: 40219

SEQ ID NO: 186105 - DNA, 601 bp, Human; identical to SEQ ID NO: 40220

SEQ ID NO: 186106 - DNA, 601 bp, Human; identical to SEQ ID NO: 40221

SEQ ID NO: 186107 - DNA, 601 bp, Human
aatgaagaaaatgttagagctttaacagcttttgccagaattttctgagaggattgctttacttgggaaaataactttgataagtgcttagggtagagaatgagtctccatccccagacttggttggctagtccagaggcttcggaggaaaggaagctcctcagcatcatagaagtagaaaaactggagctggtttaggagaggaggggcttagaagaagaggggagaggcagggagacaaagtgggtgaatttacgcacagtcacggccttctacaatacgtttcaaactcatgaccacraattactcagtgtcagtacaactctggaaatgccaggtttaagtgctgtatttggggaaactggcagtttggtatctggcattatttcatgcagagcagagaaagcacctgagcacacaggaggccagagtctgaaaagaccaggagagagtcagttactgagaatctactcacatcttaggaaaatatgtcttacccctggccatgggattggggattcagagcagtcttgtgaaaatagcaagggcaagcggaccctagatagcatgtaagttaacaattagtattattatctccatt

SEQ ID NO: 186108 - DNA, 601 bp, Human
tttccctacatacactattcataagcacatcattgccatcatctgggatttgttacctgtcgttgtgggtttcagagtctccagaggctctttacattgagtttatccacttgtttggatatcttccacccagctaatcaacagagttgctaaggaggaatgccatgattttcagctccttgcgctttcccaacttaggaagaatgctaaaataaaataaaataataaaatgtcaaaagatagacagcaggttcaagaaggaaaagccacattacttctttcctccggacaattcctgcgygattatgtctgaatttataaattcccactgagtatgggagataatgtaaaatagcttgaatgttcttggtgtgtcaaaaacaggttttgtgaggatcttaagagccagaaaggatggatatatggggacagataaaaggatggaatgtaacttaactttataatgagacgattctctttcagggaccttgtttttgccactgagattgtagtttctgtattaggcttgtgtgtagtgacagggtggcagagctccatgttaccaaattgaattcacttgagcctgactggtttaaaaaaa

SEQ ID NO: 186109 - DNA, 601 bp, Human
tttcagctccttgcgctttcccaacttaggaagaatgctaaaataaaataaaataataaaatgtcaaaagatagacagcaggttcaagaaggaaaagccacattacttctttcctccggacaattcctgcgcgattatgtctgaatttataaattcccactgagtatgggagataatgtaaaatagcttgaatgttcttggtgtgtcaaaaacaggttttgtgaggatcttaagagccagaaaggatggatatatggggacagataaaaggatggaatgtaacttaactttataatgagaygattctctttcagggaccttgtttttgccactgagattgtagtttctgtattaggcttgtgtgtagtgacagggtggcagagctccatgttaccaaattgaattcacttgagcctgactggtttaaaaaaagtctgtcaagagaagacctaagtagaaataatacagaccccaaacagccttaacatttgactcatgtacaagagagcagtaatatgtacttgtccatttgattagaaggtgatcacttcatttttttcccctttcactttgtttggattacgtctcatcctagagtctt

SEQ ID NO: 186110 - DNA, 601 bp, Human
ggagtcaagccctaaacagtgaaccttcgagaattgtgatctagcagaaatctctctcgtgtgtgtgtgtgggtttgtgtgtgtgtgtgtgtgtgtgtgtgtgtgtgtgtgtgtgtgattttttttaattgatcctgattcatgtaatcttgggtatgaattatataatgaattatactctgcccagatagataagaagataaaaatatggcgtttttctacacagcgctggtaaatttaagaaaaataagctctttcaaataccttgagcatcttaaagatgctaaatacaaacagtcastaaaattttaaacatctttagccctataaaagtttttttcttaaagaatttgacatacttttttagtcctttctccaaatagcattgatacatctaatcatgagaaaattcatgattaaggattccagaggtttagtctgtactttgtatttttattaaatatctcacttgtttttcactggttttctttttgactcattttaaattattaaacctcagaacctgacaatccaggcttattttatgcctcatttatcaggacaagtggtctcattgtaacacaaaaatcagtgtgtttgg

SEQ ID NO: 186111 - DNA, 601 bp, Human
tttttcttaaagaatttgacatacttttttagtcctttctccaaatagcattgatacatctaatcatgagaaaattcatgattaaggattccagaggtttagtctgtactttgtatttttattaaatatctcacttgtttttcactggttttctttttgactcattttaaattattaaacctcagaacctgacaatccaggcttattttatgcctcatttatcaggacaagtggtctcattgtaacacaaaaatcagtgtgtttggaattgtagagaatacttgctgaaagggtgtgttayctgacatcgtaattatgcaccattggcctttaaggtgttgttcatctttcatgtgggcggactgaggcccagagtagttaggatgacttttcacagataattgcaaatatgtgaaagactctggatcaaattccagagagccaattcttggcctctgtggcttaaacctttttactggttgtgtatatttcattggatggcacagcaccaccctgaagtttacatcttaatataatgaaactcagcagccaaataatttagatgaaatcattgaaatagagatgaaaagaaaaaataaaa

SEQ ID NO: 186112 - DNA, 601 bp, Human
tctagtttacatttctcagtgagcacctgaatttcttcctgagagctttttaaaaagtccttatgaaatatatgacagtgttcctgttttctcccagtgttttgttttctcatgctacataggaaagttgcttcccttaaatgtgctgagtaatttttctctttttatattaaaaatggaaagaataatttcccatctggctgaaaatggaattcatgaaggctttctcagcatcataactagatgagcccagagtccattcaagcctttacttaatatactaaatcactcctgataccartcttctatgaaggagagagagagagagagagacacttttaaaccatgagatatcaaaagaactcactgtcacaagaacagcaaaggggaagtcctctgccgtgattcattcacctcctaccaggctcctcctctaatttgatatgagatttgggcgggacacaaatccaaaccatatcatttcagcttgcatcaatgacttgggccatcagtgcaacaaggcaggtgctcacaattggttccgatggaaatgcagaactcttgggtgcttaggagaaagggcctgcagcttgctcttaga

SEQ ID NO: 186113 - DNA, 601 bp, Human
ccagcttagatgtctttggaaatgggagaaaatttaacttgtttttagaggttccttatgttttagaggttggagaaaaatcttcagttaatagtcataattaaaggcccgtttttattttcctctgtcagattaaactactgaaatctgtagttatctgttcatgtctctcagtggtaatgaggctcagccataacactcaggataatatggtatttcattggtagccatttgaagtcaggagccattgctcatataagaactacttttttacaattcccttgctcttggaatccaatartgttttcttggggcattgagagtaagatacactgtctaagttttcatacttattctgtgatagaaacatctagtttctctcttctgtctgtggtaaatctctacaagtctcttagataaattgcacttattaattctactttttaaaatagctttattgaagtaaaatcttctactataaaatatactggtaagtataatttgatgatcttttgtaaattatagagttgtaaaattatcaccacagttcaaagaacatttctctcacacccaaaaattcctgggacctgttcatagtcag

SEQ ID NO: 186114 - DNA, 601 bp, Human
ttgaagtcaggagccattgctcatataagaactacttttttacaattcccttgctcttggaatccaatagtgttttcttggggcattgagagtaagatacactgtctaagttttcatacttattctgtgatagaaacatctagtttctctcttctgtctgtggtaaatctctacaagtctcttagataaattgcacttattaattctactttttaaaatagctttattgaagtaaaatcttctactataaaatatactggtaagtataatttgatgatcttttgtaaattatagagttgtraaattatcaccacagttcaaagaacatttctctcacacccaaaaattcctgggacctgttcatagtcagtttgggtctggagtgcacacaggtggtgggaggttgcaaggtgatgctggcctacatgacttgttctgataatcctgagttattgcaccatctgttgaatgggctggcgccatcttgggcctgacgagttgtaaattagctgcagccttcaagtaataacccggtggtggaacattctatagatacctggattgtctctggaacttctaagcaaacataattagacaagct

SEQ ID NO: 186115 - DNA, 601 bp, Human
gttgtgagtggaattgttttttaattttatttttggattatttgttgctggtatatagaaatgaaattatttatttattatatcttgcaaccttattaaacttattagttcttgtggttttttaaatatacttcttaggattctctacatacaggatcatattgtctgcaaataaagaaagctttacttcttcttttataacttgtaagtttttctttctttttttttaattattgtactggctggaacttctggcacagtgttgaatagaaataagagtgaacatccttgccctgttccygatcttaaggaaaaacctttgtctttcactattagtatgatgttagttgtaagttttacccagatttcctttgtcagcttgagaaagtttccttctatttctaattggttgaaagtttttattatgaatggatgttgagttttgttagatgcattttctgcctctattgagatgactgtgatttttattcttctgctaatatattaattgacttatagttgttaaatcaaccttgcattccaagtataaaatccagtcgttctataaaatcctttttatatgtactgaattcatttagct

SEQ ID NO: 186116 - DNA, 601 bp, Human
gctaagaattgtagcccctctctgctgtttttagaaccttctgctaccatatccgtcacgtctaccgccagatccgtaaccaccaccaccacaggaactccccgagcttcttccaccaaaactgcaccctttaatgggttcataatttgattgtttttgtctgctaaaatttccagaatcattatagttcccaccaccaccatagttaccactgccagaatttcctccttcattgtaaccatcatatccttcaccactatccccatacccgccattgtggttttcatatcctggttcaccrtctccatagcccccactactgctgtaggcaggcccaccaccattgttgcccaccgtcacctccacatccattatatccaccattacaccctccataaccacctctgctgccaccacctctacttctaccaccagagcctcctcttccaccaaagtttccaccacagccaaaattacttgcaccacttccagagtttcctccacaacccataaagttgtcagatccacctccatcacctctgtgatcctgcagactgcatctcttgtttagaaagggcctttttcactttacagttgtgct

SEQ ID NO: 186117 - DNA, 601 bp, Human
agtaataagaatttgaatttttgaattgtagcagatttacttctctggttctttggatcaattcctaagtcttagccccatcaaagaagaagtgcagaatctaacgtgtctgtattttgacctctagaatactgtaaaactttcttcataaaattagaaaggatagaggggggaaaatgaaaagaaaaagaagaatctgagaggtccctaaggaaaaataccgtataaaccaaggcattatttatcagtttttagaaggagttatcacatagaatgtggtctttctaaaatttctggtacstaatatttcctttcaaaaaagactcaaattcttgaggcatcctagaagacttgtgtgctgcctcccccttgtccaccctccccaaaagcacattcaacaatggctgcctgtttctctccttggtgaggagtctgactcatcattcactctgtcttttcaactgatacctgcgtttcagttccattcaattaccaacttttaattggatcccattgccagattgattttgtgttcctgttccctcttggctgcactgttactatgactacttggtatcttctacttacttcctatattagt

SEQ ID NO: 186118 - DNA, 601 bp, Human
gccagctgacctgggaacagatctggtcatatacccaagctatttaagaagaggaatattattcatcagaataaaaatgttatatcataatgctctcttacataaaatgagcttacagccagtgggctaactggatatcatttttctggtttcttgttagctcccactaccatatttgttacacagagtgaactaaggccaagagaccttccatatcattcttcctgtggctacaaactaggattcacagctagctcaaataaaaacagaaataaaaggagagagatctcatagtctgcargaatggattctgacaataaagaccttgcatttactctgttccttgtgcctggggtttttaatttaacacatcaatgaaaaggcaccatttaaaaaaggggggaaacacccagcaggacttacttttattagtgcaatttgtaagaaattactgcacttaatgagaaaatcattaagcatgaaaaaatgggctctgactgaacttgtggaacttaaatggtgaggttttaattgagttttttagttattggtaagaataataataataatttaaaaatacaggactgcatctgtgtgttga

SEQ ID NO: 186119 - DNA, 601 bp, Human
taaaaacagaaataaaaggagagagatctcatagtctgcaggaatggattctgacaataaagaccttgcatttactctgttccttgtgcctggggtttttaatttaacacatcaatgaaaaggcaccatttaaaaaaggggggaaacacccagcaggacttacttttattagtgcaatttgtaagaaattactgcacttaatgagaaaatcattaagcatgaaaaaatgggctctgactgaacttgtggaacttaaatggtgaggttttaattgagttttttagttattggtaagaataakaataataatttaaaaatacaggactgcatctgtgtgttgaggtggtcagcactttgcatatcttagtccaatttcctgtgccactggtcatgcataatattatggctgtggtgttctctctgtcgtatctactgatttttctgttctgaaagggaagcagggaacttcttttttgttagattgaggaagtttggggcaaagagctagcagaacagtttctagaaggtggaagaactgtaggctaaggcaaagagcagagctatgtctgcttctcagtccagctgcttaaaaaagatgaca

SEQ ID NO: 186120 - DNA, 601 bp, Human
aacattttgaatatgatactgaagtattgtattgagattaattttgggtgtcaacatctgtactcatttaagatactgggttagtatatgatgcccatatctaaaggttttgcattttctaaaacctcaaaatccaaaacagacatttgaagtaatcctggaaataaatgacagccatttgcctgacttagtatcctaagatggatggcccttccaatggccattttttattttagctactaatgagtattattgagtcactaactaatttcgaaaagcattttggtgaattataattggrgctgtgatttactgagtttgaagactgataagccattcctcagccctgtaattaatgtagaagcagagaaaagcaccctgatgatcagcatttcctttatgtggggcaggggagtcaaaagcatattccagccaaatattatagaatattattttttcagccatttctgcattttacttttattaaaaatggcagggaaatgtgaagtgccacaaaactttggaaaggaagtctcttgtttacatcccttttgatactcagtatattcaagcgtcatccatcacagctattccctggtgt

SEQ ID NO: 186121 - DNA, 601 bp, Human
tgtaatcaccaaagattttttaaaaattcaaaccaattaatatatttccttaaaactcatagccctcttcacattatttcccagtgttaattttatgtatatgcattatattccctattcaactgcaaactcctcaaaggcaagggccttgtcttcaacttaattctgtctcccacagaacataacatagtatcttctacatagtagttgcacaataagtatatactatcaaacaaagagaaacatttatattatagcttcctaagatttcctattctcatttcaaaagaaatggagaatwtagagtctctaggattattgcccttggcctgtaaaggtttttatttgtgcccaaatatgtaacctcgagtgaactttgtatcagatgatctgggaaagtacaccgctttctgttatcaaacatttctgttactttgcttttcaagctgaaaaggggagataacttctgtttgctttgagcttttgttgatggttttctgctctgcctactaatcagggttgtattatttaccttgtttaaaaaggttcatctgaacattctctctctattttgaattgtaattggatattaattcactgc

SEQ ID NO: 186122 - DNA, 601 bp, Human; identical to SEQ ID NO: 40222

SEQ ID NO: 186123 - DNA, 601 bp, Human; identical to SEQ ID NO: 40223

SEQ ID NO: 186124 - DNA, 601 bp, Human; identical to SEQ ID NO: 40224

SEQ ID NO: 186125 - DNA, 601 bp, Human; identical to SEQ ID NO: 40225

SEQ ID NO: 186126 - DNA, 601 bp, Human; identical to SEQ ID NO: 40226

SEQ ID NO: 186127 - DNA, 601 bp, Human; identical to SEQ ID NO: 40227

SEQ ID NO: 186128 - DNA, 601 bp, Human; identical to SEQ ID NO: 40228

SEQ ID NO: 186129 - DNA, 601 bp, Human
gggagtgaaggatgccccgtgtcttcctgagcgaggcagagccaccctctggcgccaagatcgcggtttgggggttctgcgccccccacccccaccccgagctcgtggcggcgtctccctcgcgccgcgcccctgaattccccagggccgagcccgtcacgccggctcctggacctgcaggaccaaaagatccaaagcgcggccgcagcacagccccgaatttaagccattttgaaatcctataggcaggagttccagccagagaagatgtttcaggcaagtttgaaaaggaaccgccaaktttcgagctgcttctttatagtgaaaaaaagatggcacagtgtgggtccctgaaacccggtgtggggggcgctgagacccccctgcggcgcatctcacattccagtcccccaccttagcccgtccccggcacacacccctggcgatgccgggtgggctcctgcaagtggctttgaaaatacccttgcagaggtgtgagcatacgagttagggattagggattgcaatgctaatggaaattggaagacgcttttccaaattccttaccagctctgaaatattttatataatttatttaaag

SEQ ID NO: 186130 - DNA, 601 bp, Human
gcgccgcgcccctgaattccccagggccgagcccgtcacgccggctcctggacctgcaggaccaaaagatccaaagcgcggccgcagcacagccccgaatttaagccattttgaaatcctataggcaggagttccagccagagaagatgtttcaggcaagtttgaaaaggaaccgccaagtttcgagctgcttctttatagtgaaaaaaagatggcacagtgtgggtccctgaaacccggtgtggggggcgctgagacccccctgcggcgcatctcacattccagtcccccaccttagccygtccccggcacacacccctggcgatgccgggtgggctcctgcaagtggctttgaaaatacccttgcagaggtgtgagcatacgagttagggattagggattgcaatgctaatggaaattggaagacgcttttccaaattccttaccagctctgaaatattttatataatttatttaaagagcgccagcacacctgccaacatatgtacttcataagggcagacgtccttccgagcgctgccgcttcctgcgcgaccctgataactgcggggcttgcttgagaaccgggctcccccagctc

SEQ ID NO: 186131 - DNA, 601 bp, Human
ccttctgagtaggccccacgaggccattcctggcccatctgaggacctgggcgcctcccctgcgtccctcgggtttcgggaccatctgggtggaagctcattaggcgtcgtggttcctgaaggccccgggcttgcttcctcatggagaacgcagagaagtacaggcctgtaagtagccacccagtcagaagtcgctccagacacaatgccccacgggctggggccaaacaaagctcaccctgttctctgccacttaacttcacagcgttgtttcccagctcagattagaaaatggcagggygctggcaccccgcttcatcacacccagcggggcttctgtctccgcagacatccccagcctctgggaggatgcgtccaagctaaacatttccatggagacacccagtgtctgtggaacgggcagctttgaatctggaccaatagctctgaaccatttgcaggaaggaagcccagcactggggcgggggaagggggggctcctaggagcagcaggggagccgccccaccgaccccttctctgggatggagaccagtgcagtcctaggacagcagcagtgagcctccatccctgcagggcccg

SEQ ID NO: 186132 - DNA, 601 bp, Human
acccaccaaccatccatccattaaacaaattgaacacattttatgtgccaggcacagtctttggctctgaaaacagcggtgagcagaatagactaaggcgtccagatgttctgtcttcatggaacttaggtttctgtttgtcaaagagatgacagtgtgggatgaatgagtaaaaacaggctgttagattgtgatacgtatttaggagaaaaaataaactagagaaggatggcccacgtgttgagtttggggtttaaatgaagatggggtggttgaggaaggtggtttttgaatgaagagyggaacccgtgaggacccagtcgcctctctctgggaaggacgttcggatgaagatggggtggttggggaaggtggtttttgaatgaagagcggaacccgtgaggacccggccgcctctccctgggaaggacgttcgggggcttgtgctgctgttaggggaggaggggaggtgggcagtgaggggctcacgggagccttgttggccaggtgggactggggctgtcactccaagtcgcccggagctgtccggcagcgtggtctcagggacgtttgctgaggcccgctccttggggtccgttgg

SEQ ID NO: 186133 - DNA, 601 bp, Human; identical to SEQ ID NO: 34062

SEQ ID NO: 186134 - DNA, 601 bp, Human
ttcctcggggaattgcacgtgcctggcccccctcggtggttgcctgctgctcccgcttcctcccctgcagtaattgccttccctgcctcgggtgcagatgggaccgcagctcaacagtgccccagagcacccagtccgccacgctttggaacagcacggcctcctgctccccagagacgccggctgtggcatcaggctgggggagctcacgcgccttccttctttgggtcccaggttgttggtttttctttttaaccgtgtgaggggctgctggaattccgctgggtccacttaaccagcytggtgtttttatctctaacgaaacagctttcccagctggtgggctgtgagtggcccctgagagtgctttctgctctgggatttttatctgaggcatgaaaacgtccgtgcaggaggtcgagggcagtgccccatggcccgtgacgtcagggctgccgctgtgtcctcaggaagaggcgtttgccacgcgcagcccggggtattccaggctgggtgttttcctgtttttgtttttttttttttttcgtccctccccaccccccactccttttttattagcgagcactcagggggcgagacc

SEQ ID NO: 186135 - DNA, 601 bp, Human
ttcggctgcctcagccccggtcttactgtcgcagtaaaaatggcaggcagcctttgaaagcgcaagctcgtcctggttccttcttcgtctcctgggcggcaaggtgtccgcagggatgtcgtgttctggcaggcacagcccctcctgtccaccttggacctgtgtttggtgtggaggttggaaagcatgggtggctgtttattttttcctctgcttgggggtttcaggaagaattccgtgcccacgtgaccctgttagctttatctcctggctgcagagcgcccagttaggtgtgatgccygtaacatttctgagtgttcacacaaacaaagctcagtaaatatgtcccaaactcgctcctggggtttgcagttaaccttttcccactgttctggttccacatcaaaatatgtttcctggttccttgtgccctgtttccaagtgacctcgtcagcgggtgccctggggcagctggaagccacggcagagatgaaatgttagttttttaccagcgaggtggagaggccagacttccttccccaggaatgcctctccgtcggtcacatgcagcagctctggcaggcgtggaaaatgtcaccag

SEQ ID NO: 186136 - DNA, 601 bp, Human
aaaaatggcaggcagcctttgaaagcgcaagctcgtcctggttccttcttcgtctcctgggcggcaaggtgtccgcagggatgtcgtgttctggcaggcacagcccctcctgtccaccttggacctgtgtttggtgtggaggttggaaagcatgggtggctgtttattttttcctctgcttgggggtttcaggaagaattccgtgcccacgtgaccctgttagctttatctcctggctgcagagcgcccagttaggtgtgatgcctgtaacatttctgagtgttcacacaaacaaagctcrgtaaatatgtcccaaactcgctcctggggtttgcagttaaccttttcccactgttctggttccacatcaaaatatgtttcctggttccttgtgccctgtttccaagtgacctcgtcagcgggtgccctggggcagctggaagccacggcagagatgaaatgttagttttttaccagcgaggtggagaggccagacttccttccccaggaatgcctctccgtcggtcacatgcagcagctctggcaggcgtggaaaatgtcaccaggatctcaggctgcacaactagaaagctgtattttt

SEQ ID NO: 186137 - DNA, 601 bp, Human
gagcgcccagttaggtgtgatgcctgtaacatttctgagtgttcacacaaacaaagctcagtaaatatgtcccaaactcgctcctggggtttgcagttaaccttttcccactgttctggttccacatcaaaatatgtttcctggttccttgtgccctgtttccaagtgacctcgtcagcgggtgccctggggcagctggaagccacggcagagatgaaatgttagttttttaccagcgaggtggagaggccagacttccttccccaggaatgcctctccgtcggtcacatgcagcagctcyggcaggcgtggaaaatgtcaccaggatctcaggctgcacaactagaaagctgtatttttaatgatctccaaagtttgggatggagaatgcacgacatgcccatcttctccccaccgtggtacagaactgctgctccattaatcctgtccctatgccagaaggagctttctggtggaaagtgtgctgtgtgcatccttcccagggaccgtctaggattgttgtcctttgaggccttttgttgcttgttcagcacctgtggcccccagtgctatgcagagcctctgagaggcccacaatggt

SEQ ID NO: 186138 - DNA, 601 bp, Human
actgctgctccattaatcctgtccctatgccagaaggagctttctggtggaaagtgtgctgtgtgcatccttcccagggaccgtctaggattgttgtcctttgaggccttttgttgcttgttcagcacctgtggcccccagtgctatgcagagcctctgagaggcccacaatggtcaaagaacgatactgaattcttgctgcaattgaagccatgataatgtttgtgaagttagtaagagtaggtgatagaaccttgatagttttagagtttggagccattttagagctcagcggaatgaygtgtctattgtcaaagcttggggggactggcacaggaatcacaggccacctgctataccccctaaaaattagaatcttaagctgtgaattctggcatcagaaaggagtggttttcttcccgccttgcttctttccaggggtaatgacggtgatcatagcaagtggcctcccagggcacctttccgtgtgctgttgagggtgcaacaggaggcgttgccgggctgcgtctggaggaggccagggcgagagtgcacgttgaaggctgtgcgggttatttataaatagtggttctcaaatggt

SEQ ID NO: 186139 - DNA, 601 bp, Human
caatgttactctgtccatgtctgttgttagccatgaggaggagaaggcactctgttcctggaaaggagaaaacaacgtggctttttgctcagatatttttttttgagccagggtcttgctctgttgtccaggctggagtgcagggtgtcatcacagcttactgcagcctcgacctcctgggctcaggtgaccctcccacctcagcctgccgagtagctgggaccacagacgtgcggcaccacacctggctaattgtttaagttttgtggagacagagtcttgccgtgttgtccagggctgrtctggaactcctggcctgaagcagtcctcccgacctgtcctctcaaagtgctggcattgcaggtgtgagccagagttttacagtcagatcatggagatctgaaatgttgccccatctcaccgaagaccgagtgcccgggagcccccctaggagggtcagaacctgcccgggagccccctaggagggtcagaacctgcccgggagcccccctaggagggccggcacctgcctgcccgggagcccccctaggagggccggcacctgcctgcccgggagcccccctaggagggccggcacctg

SEQ ID NO: 186140 - DNA, 601 bp, Human
gggagagacagtagttgtaaaggccacaccggacgccgtgtgcacctcccaaggtttcccatgtgagaccatgtggcctgcatgctgcgttccatcagcactgggctgtgcgacagatgtgtttccaggcgaggttgctgcagaggggaagagggggacgtgtttccaggcgacgtcgctgcagagaggaagagggggacgcgtttccaggtgacgtcgctgcagagaggaagagggggacacgtttccaggcgacgtcgctgcagagaggaagagggggacgcgtttccaggcgacgtcrctgcagagaggaagagggggacacgtttccaggtgacgtcgctgcagagaggaaggagggtcgcgtttccaggcgaggtcgctgcagaggggaagagggggacgcctttccaggtgacttcgctgcagagaggaagagggggacgcctttccaggtgacttcgctgcagagaggaagaggcagacgcatttccaggcgaggtcactgcaaagaggaagagggggatgcgtttccaggtgacatcgctacagacaggaagagggggatgcgtttccgggagacgtcgctgcagaggggaag

SEQ ID NO: 186141 - DNA, 601 bp, Human
cccatgtgagaccatgtggcctgcatgctgcgttccatcagcactgggctgtgcgacagatgtgtttccaggcgaggttgctgcagaggggaagagggggacgtgtttccaggcgacgtcgctgcagagaggaagagggggacgcgtttccaggtgacgtcgctgcagagaggaagagggggacacgtttccaggcgacgtcgctgcagagaggaagagggggacgcgtttccaggcgacgtcgctgcagagaggaagagggggacacgtttccaggtgacgtcgctgcagagaggaaggrgggtcgcgtttccaggcgaggtcgctgcagaggggaagagggggacgcctttccaggtgacttcgctgcagagaggaagagggggacgcctttccaggtgacttcgctgcagagaggaagaggcagacgcatttccaggcgaggtcactgcaaagaggaagagggggatgcgtttccaggtgacatcgctacagacaggaagagggggatgcgtttccgggagacgtcgctgcagaggggaagaggtggatgcgtttccaggcaaggtcgctgcagagaggaagagggggtcgcatttcc

SEQ ID NO: 186142 - DNA, 601 bp, Human
aaggcggagtccctgtccacaagctgcgttgcaggcacagagaccaggagagggctgtgaagcaactctgtgtttactgggctgaagcagcagctcttggcagtgccgccaccatgggctgtgtcctgtccccgtggcgacatcacagctgagcgcgaagctggaagcttgggcacgtcttggtgctgggtcttctccgaccccgagggccaagggtgctctgtagctccaggcgtcagagtctgagcatcctttgttttggcaacatccaggacaggagtctttggagagtaacacatcyttattttgaaagagccctttaggtgatttgagaaaccgctgtatttgttgtagctccaagtattacccgtgaatcacctaggctgctcttcagtgaacatccagaatgccgtcagttcttgtgaaacccccaagtttcccgtaggtccaagctgagaagattgagtgaactctgagagctgagccgggccgtcttggcaccactagaaacggaatcagttccatgactgatctgtgccccaccccacattaacttgtgcaatatgacatttctggttttggtttttgttttataagccat

SEQ ID NO: 186143 - DNA, 601 bp, Human
gtccacaagctgcgttgcaggcacagagaccaggagagggctgtgaagcaactctgtgtttactgggctgaagcagcagctcttggcagtgccgccaccatgggctgtgtcctgtccccgtggcgacatcacagctgagcgcgaagctggaagcttgggcacgtcttggtgctgggtcttctccgaccccgagggccaagggtgctctgtagctccaggcgtcagagtctgagcatcctttgttttggcaacatccaggacaggagtctttggagagtaacacatccttattttgaaagakccctttaggtgatttgagaaaccgctgtatttgttgtagctccaagtattacccgtgaatcacctaggctgctcttcagtgaacatccagaatgccgtcagttcttgtgaaacccccaagtttcccgtaggtccaagctgagaagattgagtgaactctgagagctgagccgggccgtcttggcaccactagaaacggaatcagttccatgactgatctgtgccccaccccacattaacttgtgcaatatgacatttctggttttggtttttgttttataagccatccatggcaagtgca

SEQ ID NO: 186144 - DNA, 601 bp, Human
gagagtaacacatccttattttgaaagagccctttaggtgatttgagaaaccgctgtatttgttgtagctccaagtattacccgtgaatcacctaggctgctcttcagtgaacatccagaatgccgtcagttcttgtgaaacccccaagtttcccgtaggtccaagctgagaagattgagtgaactctgagagctgagccgggccgtcttggcaccactagaaacggaatcagttccatgactgatctgtgccccaccccacattaacttgtgcaatatgacatttctggttttggttttkgttttataagccatccatggcaagtgcagtcggaggccccccactgccaaaacttcctgtgagtaataatgacagatgggccctgaccctggagacgtctgagaaggtgtttggggtccgagaagagtccgcgtgtgcagtgactggaacctgtccctggtgtgaacttggggatgagtgggtgacgggggtggtgggggcctggggcacttccccgccctccggaccacactgttgctctccagccacgagaagatgcagcggcccccggctgcagcagctactgtcccggagggcagg

SEQ ID NO: 186145 - DNA, 601 bp, Human
ccgctgtatttgttgtagctccaagtattacccgtgaatcacctaggctgctcttcagtgaacatccagaatgccgtcagttcttgtgaaacccccaagtttcccgtaggtccaagctgagaagattgagtgaactctgagagctgagccgggccgtcttggcaccactagaaacggaatcagttccatgactgatctgtgccccaccccacattaacttgtgcaatatgacatttctggttttggtttttgttttataagccatccatggcaagtgcagtcggaggccccccactgccaraacttcctgtgagtaataatgacagatgggccctgaccctggagacgtctgagaaggtgtttggggtccgagaagagtccgcgtgtgcagtgactggaacctgtccctggtgtgaacttggggatgagtgggtgacgggggtggtgggggcctggggcacttccccgccctccggaccacactgttgctctccagccacgagaagatgcagcggcccccggctgcagcagctactgtcccggagggcaggggagtgagggagagggagggtgtacggcatggggcctgctgcctggggcg

SEQ ID NO: 186146 - DNA, 601 bp, Human
ttaacttgtgcaatatgacatttctggttttggtttttgttttataagccatccatggcaagtgcagtcggaggccccccactgccaaaacttcctgtgagtaataatgacagatgggccctgaccctggagacgtctgagaaggtgtttggggtccgagaagagtccgcgtgtgcagtgactggaacctgtccctggtgtgaacttggggatgagtgggtgacgggggtggtgggggcctggggcacttccccgccctccggaccacactgttgctctccagccacgagaagatgcagcrgcccccggctgcagcagctactgtcccggagggcaggggagtgagggagagggagggtgtacggcatggggcctgctgcctggggcgctgggatcccacagcgaggccctgttcccactgcccaggggcactgagatcccacagggaggcccggttcccactgagcttgggttcccaacgggctccttttgcttcccaagcaccctctcccacccttgagctgcaaggaatgtttcagagccatggaaggtgctttctcccatctgtagtttttctgggagggagaaaggctgacatcgg

SEQ ID NO: 186147 - DNA, 601 bp, Human
aagccatccatggcaagtgcagtcggaggccccccactgccaaaacttcctgtgagtaataatgacagatgggccctgaccctggagacgtctgagaaggtgtttggggtccgagaagagtccgcgtgtgcagtgactggaacctgtccctggtgtgaacttggggatgagtgggtgacgggggtggtgggggcctggggcacttccccgccctccggaccacactgttgctctccagccacgagaagatgcagcggcccccggctgcagcagctactgtcccggagggcaggggagtgarggagagggagggtgtacggcatggggcctgctgcctggggcgctgggatcccacagcgaggccctgttcccactgcccaggggcactgagatcccacagggaggcccggttcccactgagcttgggttcccaacgggctccttttgcttcccaagcaccctctcccacccttgagctgcaaggaatgtttcagagccatggaaggtgctttctcccatctgtagtttttctgggagggagaaaggctgacatcgggggctttgtagaaagcgtgctctggcccacacgttaacatttggg

SEQ ID NO: 186148 - DNA, 601 bp, Human
tgactcctgaaatcctaaggttgcccgggccgccgagccctccctccactccccggcctgctgggcaggattttgtgaaaggccttgtcttgggtcgtggaagaaaaccacgtggtctgtggggtcatccctggggcaggctgtgggagggtgaaggctgcgtccagcggccaggcccagccagaggtcgggaatcatgtcgggggtgacgcacagatgccgccgcactatcaccgagaaacgcggcgtgtgcgggcccacctggcctctttaggccgggctccgggctgccctccaggarggccgacctctcctgggcgggcaaaactttctcagggccgagttctgccggcacaggtcagggggcaaagctggcctccgaggagcctctgaccgctggccactgtgtggtcttggggcagctccagacacacaagcccagaagacccagaggctgcctcacgtcggagaaatgcgctgatcgtctctctctctctttgtctctccatctctgtctctctccgtctctgtctgtctctccatctctgtctccctgtctctctctctgtctctgtctctctctgtctctgtctctccatct

SEQ ID NO: 186149 - DNA, 601 bp, Human
ggaggatcctgccgggagcgccttgcattttgcctaggaccttcttaactctccagactcatcagggaagctctgcaggagctcaggataaacaggtccttggcttgaagcctgccggcatgggttgggaatggtgggggctccatgtctgcagcagccacggcagaagctgtggccacatgagctgggctctgggtgcggctgtggccattgaggagggagcatgtcccgggttcttaggttaagtgcgtcttggcaggggggcccggggctgcagcccttcgtgtacccacgtgtccgrtgtctctgtgccatgccgtgacgttgtccttcacgtaaagttttcaagacccacgtcccattgtctgtgaaatcacaaggttttactttatggactgtgtggaatggacccagggaagggggaccagtatatgcccaatttgccagcatgtgcaacagtgaacttccctggacagctggccttggtgtggcagtgggtgctgtacggctggcctctgtgcagtgggttggggggagctggatggctggcctctgtgcggtgggtgggggggagctggacggctggcctctgtgcggtggg

SEQ ID NO: 186150 - DNA, 601 bp, Human
aggccctgtggtgtctttagtgagaaacaggaaataaatcaaggggatgttgtagaagttttaccgctgctggtttagaagtgtttgtttttattatttgtatataatgtgttgttttcagtcttgcactggtgtttttaactatcgtgtaaagatgcaaacagcaggccagaaaactgccttgatatatcacattggcaaagaccaagcgcaccccggaccctagtgggtgagccggacccattggcagtggcctttgtggtgcctccagggagcctcacgatgctcacgcctctgaccmgtggttctgcgctcagggcatgaccggagatgtggtctgggagttggttgtgtggatgtttgcgttgccagcgtttacaacaacagaggggaacagcccacagcccagcagtacaatgaggatggtccttgtgataaatgggatgctgtgattagattgtttctgaataagctaaaatgctcaaaatgtgatctttcttttataaaaaggccaggtatggtgatacgtgcctgtaaccccagcactttgggaggctgaggtgggaggatcccttgagcccaggagttggagaatgcagtg

SEQ ID NO: 186151 - DNA, 601 bp, Human
cgctgctggtttagaagtgtttgtttttattatttgtatataatgtgttgttttcagtcttgcactggtgtttttaactatcgtgtaaagatgcaaacagcaggccagaaaactgccttgatatatcacattggcaaagaccaagcgcaccccggaccctagtgggtgagccggacccattggcagtggcctttgtggtgcctccagggagcctcacgatgctcacgcctctgaccagtggttctgcgctcagggcatgaccggagatgtggtctgggagttggttgtgtggatgtttgcrttgccagcgtttacaacaacagaggggaacagcccacagcccagcagtacaatgaggatggtccttgtgataaatgggatgctgtgattagattgtttctgaataagctaaaatgctcaaaatgtgatctttcttttataaaaaggccaggtatggtgatacgtgcctgtaaccccagcactttgggaggctgaggtgggaggatcccttgagcccaggagttggagaatgcagtgagctgtgatcacaccctctagcctaggcagcagagcgagaccttgttctaagaaataaaaagag

SEQ ID NO: 186152 - DNA, 601 bp, Human
cagtcctgcaccgcggcgtcgggtcaacggcggacttcacctatgagggttctcgtgagatcgtgagagcgtagttttactgcatcttttccatgtttaaatgtgtttagattcacaaactgtgaccgctgtggggcagtcacccacggtgttcagtgcagccacatgccgtgcagacgtgtactggggagccgtgggccacgccacgtggctagggtgtgcactggacacaccgagtcggttcacacgagttcccacgacgacaaaatggcctaaggacgcgtttttcagaatgtgtccytgtcataaagtgacacgtggctgcgtttacacaaacttattcttatgtaatagtcagctgcagagtggtttagactgccttatctttaggaaatgtgtctgcctttaaccagaccagcggtggggggaggcggcttttcttttcttctttcctcctctctcctctctctcgctgtctcttctctgtctcttaactttcctgggaatccagtgagcccagttttttcactgtgaattttgtttttggtttgtttgttttgagatggagtctcactctgttgcccaggctggattgcagtgg

SEQ ID NO: 186153 - DNA, 601 bp, Human
tggccaggatggtcttggtctcctgacctcaggtgatctgtctgcctcggcctcccaaagtgctgggattacaggcatgagccaccacgcccggccatgaattttgtttttcatttgtttctttttcaattcatagcaaaagataggtgcaaggtgcctgagacgggcaccgcctcgcatcatctgcgactttgtttggtgcctgcctgtccaggagcaggtgtggccactgcagaggggcccttcattgcccagccctgcagctgccccctctcccttccccagaaactcacagctggcygcgagctctgtgcagagaagtctttctctggaggctcttgtccttcctgtgtggaggcctgggtccagccgcctttccttctgcctggcagcgttagctgatactgggtgtccatgctgatcacctcacgtgggaaacagctctgacagtacagcccatgaagctgcgtcttggagattcctctgtcagggaagctgtcgtggctgagttggggtccagcaggcacccgcagggcccaaaaccccacagagcggaggtgggtggtgagcctgccaggtgcatctttggataaatccattt

SEQ ID NO: 186154 - DNA, 601 bp, Human
tcttctattctgcccatcgtttttagtttgtttgttttgagacagagtcttgccctgtcgcccaggctgaagcacatgcgatcttggctcactgccatctcaacctcccctggctcaggcgatcctccccgctcagcctcctgtgtggctgggatcctccccactcagcctcctgtgtggctgggatcacagatgtgcaccaccacgtcctgctcatgtttttattttttgtttcgtagagatggggtctctccatgttgcccaggctggtctcgaactcctgagctcaagtgatctgttccccttggcctcccaaagttttgggattacaggcatgagccactgcgactggccttgtttttgttgttgtttgttgtttttttttagatggagtctcgctctgtcgccaaggctggagtgcagtggcgcgatctcggctcactgcaacctcctcctcttcggtataagcaattctcctccctcagcctctcgagtagctgggactacaggcctccgccaccacgcccggctaatttttgtatttttagtagagacagggtttcaccatgttggccaggatggtctcaatctcctgaccttg

SEQ ID NO: 186155 - DNA, 601 bp, Human
ctcatgtttttattttttgtttcgtagagatggggtctctccatgttgcccaggctggtctcgaactcctgagctcaagtgatctgttccccttggcctcccaaagttttgggattacaggcatgagccactgcgactggccttgtttttgttgttgtttgttgtttttttttagatggagtctcgctctgtcgccaaggctggagtgcagtggcgcgatctcggctcactgcaacctcctcctcttcggtataagcaattctcctccctcagcctctcgagtagctgggactacaggccyccgccaccacgcccggctaatttttgtatttttagtagagacagggtttcaccatgttggccaggatggtctcaatctcctgaccttgtgatccacccgcctcggcctccccgagtgctggggttacaggcgtgagccaccatgcccggcccttgttttgtttttaagtcactttgggttcacagtgtgtcctgaggtgtgggggccttcggggggctcgggaggcagtttcctttaacttgcagatgcccctgctctgcgactgcatcgcatggaacctgcccttctcgagaagctgcc

SEQ ID NO: 186156 - DNA, 601 bp, Human
tggtggtgcaccggggcaggccaccccctagatgcaagaaccccttgggtgcaccgtgtggcccccaggagtgttgagacagtctgcctgggcctcctacagaacacagttgggaagacacgccgagggcacgggcaggacctcaccttagcctttcacaccaaacattcatctcctgaaaagacaggggccgtggggcccccagctgggctgtaggctctgaggacagccccagcacctgtcacccgccaggtcatgcagctcgtgtccctctgtgcaaagtaaccgaacagcctcccamagccctcaccgtcgtaccccgccctgctgcgtttgctcccaccgccctccatggacgccgtgtccctcctcctggccctcagtcagggccttctgtttgtcttgcagcaatcatggaatttgggggctggcggcgctgcgcacatcacaacttccaaacccactattttataaagggcccagtcagtcacctgtctcatggcagccacacagctggttcatagcgaggagaggtttgagcttcctggttcttaggccacagcccatccctcttagattttaaaacagattttcaatgagt

SEQ ID NO: 186157 - DNA, 601 bp, Human
ttgagacggagtctcgctctcacccgggctggagtgcagtggtgtgatctcagctcactgcaacctctgtctcctgggttcaagtgattctcctgcctcagcctcccgagtagctgggactacaggcagccctgggttttaatggatgtattttcacctgcctgtgagtagcgccggtgcctggtgccgcccgtctctgcggacacagctcagtgcttgggtactctccctgcgtcttctggaatcttctggaatcccgtctctggttctgccatctgggtgtcttgggctgagggtgcasaaatctatcaatacagatgccactgagaggatccaggtgttctggaggactcaggaaacttgaaacagtaattaaaaatatctttaaaatgtaccctcaacaattattccaaatcaagtggcccgtgtgtgcgcagcagcgacacgggagaggctggctctgcgtttccacagaaggagccctttccattgaaacgcgggagaaaacggtcccctgcacggagaacgtcaggagctgtcagcatatctcatttgtagaaattagtaatttaaagagttttgtgatgtatctgtggcagag

SEQ ID NO: 186158 - DNA, 601 bp, Human
tgtattttcacctgcctgtgagtagcgccggtgcctggtgccgcccgtctctgcggacacagctcagtgcttgggtactctccctgcgtcttctggaatcttctggaatcccgtctctggttctgccatctgggtgtcttgggctgagggtgcagaaatctatcaatacagatgccactgagaggatccaggtgttctggaggactcaggaaacttgaaacagtaattaaaaatatctttaaaatgtaccctcaacaattattccaaatcaagtggcccgtgtgtgcgcagcagcgacacrggagaggctggctctgcgtttccacagaaggagccctttccattgaaacgcgggagaaaacggtcccctgcacggagaacgtcaggagctgtcagcatatctcatttgtagaaattagtaatttaaagagttttgtgatgtatctgtggcagagtggatttctgtctctgcaagtgtgaggtaaaagcagctaaaaagagggggttttgggggttagttttctctttcagttggtggaccacaaattggataaaaatagaatttgtgcataatttaaaaacaaacgagaatagaaagctc

SEQ ID NO: 186159 - DNA, 601 bp, Human
gggtactctccctgcgtcttctggaatcttctggaatcccgtctctggttctgccatctgggtgtcttgggctgagggtgcagaaatctatcaatacagatgccactgagaggatccaggtgttctggaggactcaggaaacttgaaacagtaattaaaaatatctttaaaatgtaccctcaacaattattccaaatcaagtggcccgtgtgtgcgcagcagcgacacgggagaggctggctctgcgtttccacagaaggagccctttccattgaaacgcgggagaaaacggtcccctgcmcggagaacgtcaggagctgtcagcatatctcatttgtagaaattagtaatttaaagagttttgtgatgtatctgtggcagagtggatttctgtctctgcaagtgtgaggtaaaagcagctaaaaagagggggttttgggggttagttttctctttcagttggtggaccacaaattggataaaaatagaatttgtgcataatttaaaaacaaacgagaatagaaagctctcagttgccgtggaagctcctcgtaaccgcagacgtgccctcggtgccgtcgggttattttagtacatcctt

SEQ ID NO: 186160 - DNA, 601 bp, Human
tcagaaacgaggctcatcgcactggcctgggggcgcgaggacgaggccgtgggtagtgggcgctgcgggcggctggtcagagccactgggagccgttgggaacaactggcgcgggagtttcctgcatttgagaaatgctgttctcttcgttgtgaatcgtctgtccgctgcatctcaaaaagcttgtccagaaaattaaagcccgctgtctcctgcagtgcagctgagccctggagggtggcggggggccgggggatgtgggtgtcagctctcgcggccaggggcacgctgtgcccccgcrcccggtatccccgtcctcccgcacccggcgtccgcgtcctcccacgcccgctgtctccgtcctccccatccccatgtgtttcgcagttgggaagtgaagcacgtgagcagaacgcagcaccttctctccaggaagcattcggagcatggactctgggttaggaaagggtgtttgctcctctggataggtgctcgctcttacttgtgggtgctgaggggcgtgagggggtccggcatccgggtacctgtgggcgctgaggggcgtgagggggtccggcatccggggcttctcccatttagg

SEQ ID NO: 186161 - DNA, 601 bp, Human
acgaggctcatcgcactggcctgggggcgcgaggacgaggccgtgggtagtgggcgctgcgggcggctggtcagagccactgggagccgttgggaacaactggcgcgggagtttcctgcatttgagaaatgctgttctcttcgttgtgaatcgtctgtccgctgcatctcaaaaagcttgtccagaaaattaaagcccgctgtctcctgcagtgcagctgagccctggagggtggcggggggccgggggatgtgggtgtcagctctcgcggccaggggcacgctgtgcccccgcgcccggyatccccgtcctcccgcacccggcgtccgcgtcctcccacgcccgctgtctccgtcctccccatccccatgtgtttcgcagttgggaagtgaagcacgtgagcagaacgcagcaccttctctccaggaagcattcggagcatggactctgggttaggaaagggtgtttgctcctctggataggtgctcgctcttacttgtgggtgctgaggggcgtgagggggtccggcatccgggtacctgtgggcgctgaggggcgtgagggggtccggcatccggggcttctcccatttagggccttt

SEQ ID NO: 186162 - DNA, 601 bp, Human
cgaggctcatcgcactggcctgggggcgcgaggacgaggccgtgggtagtgggcgctgcgggcggctggtcagagccactgggagccgttgggaacaactggcgcgggagtttcctgcatttgagaaatgctgttctcttcgttgtgaatcgtctgtccgctgcatctcaaaaagcttgtccagaaaattaaagcccgctgtctcctgcagtgcagctgagccctggagggtggcggggggccgggggatgtgggtgtcagctctcgcggccaggggcacgctgtgcccccgcgcccggtrtccccgtcctcccgcacccggcgtccgcgtcctcccacgcccgctgtctccgtcctccccatccccatgtgtttcgcagttgggaagtgaagcacgtgagcagaacgcagcaccttctctccaggaagcattcggagcatggactctgggttaggaaagggtgtttgctcctctggataggtgctcgctcttacttgtgggtgctgaggggcgtgagggggtccggcatccgggtacctgtgggcgctgaggggcgtgagggggtccggcatccggggcttctcccatttagggcctttc

SEQ ID NO: 186163 - DNA, 601 bp, Human
gctcatcgcactggcctgggggcgcgaggacgaggccgtgggtagtgggcgctgcgggcggctggtcagagccactgggagccgttgggaacaactggcgcgggagtttcctgcatttgagaaatgctgttctcttcgttgtgaatcgtctgtccgctgcatctcaaaaagcttgtccagaaaattaaagcccgctgtctcctgcagtgcagctgagccctggagggtggcggggggccgggggatgtgggtgtcagctctcgcggccaggggcacgctgtgcccccgcgcccggtatccscgtcctcccgcacccggcgtccgcgtcctcccacgcccgctgtctccgtcctccccatccccatgtgtttcgcagttgggaagtgaagcacgtgagcagaacgcagcaccttctctccaggaagcattcggagcatggactctgggttaggaaagggtgtttgctcctctggataggtgctcgctcttacttgtgggtgctgaggggcgtgagggggtccggcatccgggtacctgtgggcgctgaggggcgtgagggggtccggcatccggggcttctcccatttagggcctttccttc

SEQ ID NO: 186164 - DNA, 601 bp, Human
ggtggaggctggtcctccacctgcgtgttctccatctgggggactgtggtcccggaggagacctggagtccggctccccgctccgtccgaggaggagctgagcggcgtgagcagtgcccgccctggtcactctgccttgctttcctcctctctgtttctggttgtgcctccttccttccctcctgctctctttgccgtggactgcagccccctcgccagatgtgttcctcacatgagtcaacccgtccttggcctgcgtcctccactgctcgtggcagctacactctcccggaggtggccrggaagggcccagggccttgagaagatgtctttgcagcacgtccccggccctcggcctccacctccatggcacccaccatcccacgggggcacgtggacctctgtgggatatagcctgacctctgacccaggggtcaaataactcaggtctgtttaccaagtcaccaaaataacctgcccgatagcatctcacccatcacacgggaggccgggctcgtgtgaataattaataggtcactggaatgtgaaacgagaagcctcggcccgttctgaaacagcattttaggtttgcagcttataa

SEQ ID NO: 186165 - DNA, 601 bp, Human
ccctcgccagatgtgttcctcacatgagtcaacccgtccttggcctgcgtcctccactgctcgtggcagctacactctcccggaggtggccgggaagggcccagggccttgagaagatgtctttgcagcacgtccccggccctcggcctccacctccatggcacccaccatcccacgggggcacgtggacctctgtgggatatagcctgacctctgacccaggggtcaaataactcaggtctgtttaccaagtcaccaaaataacctgcccgatagcatctcacccatcacacgggaggcygggctcgtgtgaataattaataggtcactggaatgtgaaacgagaagcctcggcccgttctgaaacagcattttaggtttgcagcttataatattgtcagttaggagaagggccaactgagtctgcaaagaggtgagggcgggtggtctgggatcctgcctcagccgcgcgggtgagaggggcgggcgggtcaggcgaagactcagagtcaggaggccagactggccccagggagggctcctggccataccccaagctcaggacgcagggtggggcgggcccgctggtgcccacagtggc

SEQ ID NO: 186166 - DNA, 601 bp, Human
acccaccatcccacgggggcacgtggacctctgtgggatatagcctgacctctgacccaggggtcaaataactcaggtctgtttaccaagtcaccaaaataacctgcccgatagcatctcacccatcacacgggaggccgggctcgtgtgaataattaataggtcactggaatgtgaaacgagaagcctcggcccgttctgaaacagcattttaggtttgcagcttataatattgtcagttaggagaagggccaactgagtctgcaaagaggtgagggcgggtggtctgggatcctgcctyagccgcgcgggtgagaggggcgggcgggtcaggcgaagactcagagtcaggaggccagactggccccagggagggctcctggccataccccaagctcaggacgcagggtggggcgggcccgctggtgcccacagtggccttggtgggcctctccttccattgcccagcttgtaggtcaactttgcctccacagatccgtaacagacgttttttctgtcatgtaagaaacttgacagctgaagaccaaggagtggagcctcccgtgaggcagctcttcttttccggttgttaaaatgcgcg

SEQ ID NO: 186167 - DNA, 601 bp, Human
cgggcgggtcaggcgaagactcagagtcaggaggccagactggccccagggagggctcctggccataccccaagctcaggacgcagggtggggcgggcccgctggtgcccacagtggccttggtgggcctctccttccattgcccagcttgtaggtcaactttgcctccacagatccgtaacagacgttttttctgtcatgtaagaaacttgacagctgaagaccaaggagtggagcctcccgtgaggcagctcttcttttccggttgttaaaatgcgcgtcgggccagtggttctgactrattctcactttgtgtggtaccttcagctggcaggggctcggggagtgttcagtaccgtgaggagcaggttcctgagagcccgtgaataccgtggacagattaccacagcacgcactgttccacgcagggcctcatccacgctttcttaagtggtttgccacacacaggagctcctggttctccatgtcccctgccaggcagggctgttaaactggaaagccggggagggacgtcgctgggacacattgttatctgatcagagctccgaggccccaccaggagctgtgctattgcagaacc

SEQ ID NO: 186168 - DNA, 601 bp, Human
ttcttttccggttgttaaaatgcgcgtcgggccagtggttctgactaattctcactttgtgtggtaccttcagctggcaggggctcggggagtgttcagtaccgtgaggagcaggttcctgagagcccgtgaataccgtggacagattaccacagcacgcactgttccacgcagggcctcatccacgctttcttaagtggtttgccacacacaggagctcctggttctccatgtcccctgccaggcagggctgttaaactggaaagccggggagggacgtcgctgggacacattgttatcygatcagagctccgaggccccaccaggagctgtgctattgcagaacctcaaacagcagccgctccggccccgccccaggagccacgcagaggcccacgcacggggaggacgccgtggggtggaaactaaagtgcaggtctgaccacaaaaccacacgccacggcaccgctgctgccaaatgccggaggcctgcaggaggcacggattaattttttatgagtctgccttggaacctagacaacagccctctcctctttcagcacaatttcagggcgaatgaccgtcacttccctggactgct

SEQ ID NO: 186169 - DNA, 601 bp, Human
ttgccacacacaggagctcctggttctccatgtcccctgccaggcagggctgttaaactggaaagccggggagggacgtcgctgggacacattgttatctgatcagagctccgaggccccaccaggagctgtgctattgcagaacctcaaacagcagccgctccggccccgccccaggagccacgcagaggcccacgcacggggaggacgccgtggggtggaaactaaagtgcaggtctgaccacaaaaccacacgccacggcaccgctgctgccaaatgccggaggcctgcaggaggcayggattaattttttatgagtctgccttggaacctagacaacagccctctcctctttcagcacaatttcagggcgaatgaccgtcacttccctggactgctaagcgcataaacgcacagggaatttcctagttccacatacgccgttgttcccgcagcccatgcagctgggagagcacacatggttgccgtcgggctgtgtctgttttcccaggagcaagaactctcagaagtgcagtgttgaagcccgagccttccccgtgtcagcttttatgatgaacgaggattcaccatttatttctc

SEQ ID NO: 186170 - DNA, 601 bp, Human
ctccggccccgccccaggagccacgcagaggcccacgcacggggaggacgccgtggggtggaaactaaagtgcaggtctgaccacaaaaccacacgccacggcaccgctgctgccaaatgccggaggcctgcaggaggcacggattaattttttatgagtctgccttggaacctagacaacagccctctcctctttcagcacaatttcagggcgaatgaccgtcacttccctggactgctaagcgcataaacgcacagggaatttcctagttccacatacgccgttgttcccgcagcccaygcagctgggagagcacacatggttgccgtcgggctgtgtctgttttcccaggagcaagaactctcagaagtgcagtgttgaagcccgagccttccccgtgtcagcttttatgatgaacgaggattcaccatttatttctcccctaaagcaaagcccacgggctctgttttgagcgatggggacagatgctcggtgctgctgggaaggtgttcacggggcagattcgctgtgtcaggagaccaacgtggaatgaggtcggcccagccagtcactgcttaaaaacagtaatgacaatatttg

SEQ ID NO: 186171 - DNA, 601 bp, Human
tctttcagcacaatttcagggcgaatgaccgtcacttccctggactgctaagcgcataaacgcacagggaatttcctagttccacatacgccgttgttcccgcagcccatgcagctgggagagcacacatggttgccgtcgggctgtgtctgttttcccaggagcaagaactctcagaagtgcagtgttgaagcccgagccttccccgtgtcagcttttatgatgaacgaggattcaccatttatttctcccctaaagcaaagcccacgggctctgttttgagcgatggggacagatgctyggtgctgctgggaaggtgttcacggggcagattcgctgtgtcaggagaccaacgtggaatgaggtcggcccagccagtcactgcttaaaaacagtaatgacaatatttgagaaaatgggtggaattttgtggagatttactggcacggggaaggcgtgtggcctctggcaggtctgcgacactgatttctaactacctgttccacagctccactgcctggaaaaactggcaaaaatgtggcctgggtctcctgacaggcctggccattggagtgggggtgtgcagctgagacaggaaata

SEQ ID NO: 186172 - DNA, 601 bp, Human
cacgcactgtcacacacacttgcctcgggcccccacacacaccgccctgagagctaggaagacgaatcggtcagtcacacggattctgcagacagcttccttcaccaggcatggtagtgagggcagcgcccactactcacccagggcctctcgtgcaggaaactgcatggacacgtcgtcctgttcctgtcatgggaaggggcctggagccgtccctcggggggtggggaggagctagtttcccagtcggcgcccgtgcattcaccggtctgagaatccactcagcaggcttgctatgtarcctccgccgttcaggcctcagcatgcagcaagcccgtggggtcccgtctgcccagcctctgcctcggttcctgccgggcacatggacgcttcccttgaatccttctgccgacggcatctgtgggagggcaggtacgatcgatcctggtcctgtccccctagccctgggcgggtgtcccggcacctccaggcacaaggccccttccccaggctgcccagagaccccagccccgaggtgctggtccgcccaccctctctgggaagggctgtgccacatggcgaaagctgctgtgggtcctgg

SEQ ID NO: 186173 - DNA, 601 bp, Human
acatgggggctgtgtcctcatccctgtctgtggcttccccaccgtgttcccacgtgatgccttcgttcagcctctggctttgtgtttcagaccccaaacgccccttcgatgtctcagctgggacctgggtcccggctcagcctcacgcggcgtcccagtccctgcccatcagtctgggcctcacggtcaggccctcagtgacagcagccgtcgcttcactgtggcctcgtccctggagggctctgagttcagccgtcgcttcactgtggcctcctccctggcggggctctgagttcagccrccggtgagattggtttgttctttactgtggtgaccacacggcggctgaggctaagctggagccacggagcaagggccgcctcttcgcctgcccgggcccctctagccccatcttccctctgcccactgacatctgagaatccgccgtcccctggcccgggctcccccgccttctccctcgcctcgctggccctgagtgggcagcaggcatctgcgtggtcaggggcaggcgtcgcattttcctgtggctggaacgtgcctgcaggagcccaggcctggactctgcacgtggtcatcgtgc

SEQ ID NO: 186174 - DNA, 601 bp, Human; identical to SEQ ID NO: 34063

SEQ ID NO: 186175 - DNA, 601 bp, Human; identical to SEQ ID NO: 34064

SEQ ID NO: 186176 - DNA, 601 bp, Human; identical to SEQ ID NO: 34065

SEQ ID NO: 186177 - DNA, 601 bp, Human; identical to SEQ ID NO: 34066

SEQ ID NO: 186178 - DNA, 601 bp, Human; identical to SEQ ID NO: 34067

SEQ ID NO: 186179 - DNA, 601 bp, Human; identical to SEQ ID NO: 34068

SEQ ID NO: 186180 - DNA, 601 bp, Human; identical to SEQ ID NO: 34069

SEQ ID NO: 186181 - DNA, 601 bp, Human; identical to SEQ ID NO: 34070

SEQ ID NO: 186182 - DNA, 601 bp, Human; identical to SEQ ID NO: 34071

SEQ ID NO: 186183 - DNA, 601 bp, Human; identical to SEQ ID NO: 34072

SEQ ID NO: 186184 - DNA, 601 bp, Human; identical to SEQ ID NO: 34073

SEQ ID NO: 186185 - DNA, 601 bp, Human; identical to SEQ ID NO: 34074

SEQ ID NO: 186186 - DNA, 601 bp, Human; identical to SEQ ID NO: 34075

SEQ ID NO: 186187 - DNA, 601 bp, Human; identical to SEQ ID NO: 34076

SEQ ID NO: 186188 - DNA, 601 bp, Human; identical to SEQ ID NO: 34077

SEQ ID NO: 186189 - DNA, 601 bp, Human; identical to SEQ ID NO: 34078

SEQ ID NO: 186190 - DNA, 601 bp, Human; identical to SEQ ID NO: 34079

SEQ ID NO: 186191 - DNA, 601 bp, Human; identical to SEQ ID NO: 34080

SEQ ID NO: 186192 - DNA, 601 bp, Human; identical to SEQ ID NO: 34081

SEQ ID NO: 186193 - DNA, 601 bp, Human; identical to SEQ ID NO: 34082

SEQ ID NO: 186194 - DNA, 601 bp, Human; identical to SEQ ID NO: 34083

SEQ ID NO: 186195 - DNA, 601 bp, Human; identical to SEQ ID NO: 34084

SEQ ID NO: 186196 - DNA, 601 bp, Human; identical to SEQ ID NO: 34085

SEQ ID NO: 186197 - DNA, 601 bp, Human; identical to SEQ ID NO: 34086

SEQ ID NO: 186198 - DNA, 601 bp, Human; identical to SEQ ID NO: 34087

SEQ ID NO: 186199 - DNA, 601 bp, Human; identical to SEQ ID NO: 34088

SEQ ID NO: 186200 - DNA, 601 bp, Human; identical to SEQ ID NO: 34089

SEQ ID NO: 186201 - DNA, 601 bp, Human; identical to SEQ ID NO: 34090

SEQ ID NO: 186202 - DNA, 601 bp, Human; identical to SEQ ID NO: 34091

SEQ ID NO: 186203 - DNA, 601 bp, Human
aaacgacgtcgccgtaaagcagcgtggcgtgttgcacatttaactgtgtgatgtcccgttagtgagaccgagccatcgatgccctgaaaaggaaaggaaaagggaagcttcggatgcattttccttgatccctgttgggggtggggggcgggggttgcatactcagatagtcacggttattttgcttcttgcgaatgtataacagccaaggggaaaacatggctcttctgctccaaaaaactgagggggtcctggtgtgcatttgcaccctaaagctgcttacggtgaaaaggcaaatagktatagctattttgcaggcacctttaggaataaactttgcttttaagcctgtagtcctgatgtggtctttaaggatggtgaatgagctttgtgctgggcggacgtccccgagacacttctccaggggtaacttcatctcctgggaccacgggcatccaggctggggcaccttctcctcaacctgcctgcccctcacccgccgtgggaatggctccttttcactcatacaaaaaaaaaaaaaaatcatcttacctttttaacctttagggtgttttcttaaagaaaataccatccagtttgt

SEQ ID NO: 186204 - DNA, 601 bp, Human
caagcacactgaccagccccaccagcccccaggggctccccggctccctgtcaccccacctggtcctgggggctgcgaccgcaacctgcaccagactgtgagcccctcaggcagagcccccaggctgccgcagggcgagatccccagtgttgacgctgggcctacctcgaggccactgtcagtgtggttgttaaataaataatgaatagaaaccagcacccaggtatccgtgttccgtcccgcgtgcccgctgcacttcctgcctctgcaaccccggctgggtctgaggacgccgaggccrctccaggacctgcgtcctccgtgctgtgcatctgtgtcttggggtccagctcagatggcttctgccacgtggtccgagagatagttgccagctctgcttctgccgaccctggaggtggaggcaggacgggtgggtgtgggtggaagacagctgcttagcaagcaccgccctgactcaaagctgctcttggctttttcccttttctacaccgtcatcatggggtcgttagcagtctaggtttccgctgtgccgatgagcttcgggtctgcatgcccgggggtcacggcagtgaggggcgga

SEQ ID NO: 186205 - DNA, 601 bp, Human
tggtctgtgatggggcccagagggagagttcccttcaccctccctggggcggggggcaggcattaaatggggagaagttcccagcagaatgtatgagccccatgaacggagtgggcatagccctcggggagtcctgccggccgcccctcctgacatcccggggtgctgcccggtgaggaaagtgaaaatgttgtctgcagttagaggctggaacacacatgcccacagagaggcttcctgagcggcttgtctgtcactgtttttgtgtaactgcgcctgaatttaatctcccggaaggcgygttaggagggctgagggatgatctggtgccaggaaggttggcagttccgagaggttattccagcacgtcagcattaaaggagagaggcgaacctggaacgtgggaaccctgcccaggtctggttagaaaggcggcgtccgcgtggcctggggcttgtgtgaggggtgcacttgtgcccccagatacaagcaggcagggccgggaatctgtctcgtggggggctgcgggcactttggagaaagaaaaccaagttacaaactcaaaattacctaccaaagtcagtatttttttaaacgagaa

SEQ ID NO: 186206 - DNA, 601 bp, Human
ctgccggccgcccctcctgacatcccggggtgctgcccggtgaggaaagtgaaaatgttgtctgcagttagaggctggaacacacatgcccacagagaggcttcctgagcggcttgtctgtcactgtttttgtgtaactgcgcctgaatttaatctcccggaaggcgcgttaggagggctgagggatgatctggtgccaggaaggttggcagttccgagaggttattccagcacgtcagcattaaaggagagaggcgaacctggaacgtgggaaccctgcccaggtctggttagaaaggcrgcgtccgcgtggcctggggcttgtgtgaggggtgcacttgtgcccccagatacaagcaggcagggccgggaatctgtctcgtggggggctgcgggcactttggagaaagaaaaccaagttacaaactcaaaattacctaccaaagtcagtatttttttaaacgagaaaataaaacatgacaaatgccaggtctttttgtctgaagtcgttttagtcggttacctggaaacgctcccagggcccctgagctggggacacggagctcttcccccatcagtgcccaggagaagctgctcccgg

SEQ ID NO: 186207 - DNA, 601 bp, Human
ccgacgggcgcacctggggctgggcgagtctggctccagaaggggggtggggccgggagcctgagatgggatgagagggcgggaaggggcttgttgagaaatctaagggccacgggccaccaaaaacaaaccaggaggtgtgagtcagtggggaggctgggtgccaggaagcctgcgctctgggacatgcgtggggcaagaggggcgccctgagcttggcgacgccagccgcgcgcctgggagggatccgcctgtccacgtgcagccgcctccgggcggcgtcggccatgctgctgccccrccgtggctctgtggctccagccggaatggcaaagcctggctccacagctgcctgggagcgtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgaagccccacttgcgcttcccctcgctgccgtgctgtcctggccccgtcgctgccacctgaggccccc

SEQ ID NO: 186208 - DNA, 601 bp, Human
acgggcgcacctggggctgggcgagtctggctccagaaggggggtggggccgggagcctgagatgggatgagagggcgggaaggggcttgttgagaaatctaagggccacgggccaccaaaaacaaaccaggaggtgtgagtcagtggggaggctgggtgccaggaagcctgcgctctgggacatgcgtggggcaagaggggcgccctgagcttggcgacgccagccgcgcgcctgggagggatccgcctgtccacgtgcagccgcctccgggcggcgtcggccatgctgctgccccaccrtggctctgtggctccagccggaatggcaaagcctggctccacagctgcctgggagcgtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgaagccccacttgcgcttcccctcgctgccgtgctgtcctggccccgtcgctgccacctgaggcccccatc

SEQ ID NO: 186209 - DNA, 601 bp, Human
gcgagtctggctccagaaggggggtggggccgggagcctgagatgggatgagagggcgggaaggggcttgttgagaaatctaagggccacgggccaccaaaaacaaaccaggaggtgtgagtcagtggggaggctgggtgccaggaagcctgcgctctgggacatgcgtggggcaagaggggcgccctgagcttggcgacgccagccgcgcgcctgggagggatccgcctgtccacgtgcagccgcctccgggcggcgtcggccatgctgctgccccaccgtggctctgtggctccagccrgaatggcaaagcctggctccacagctgcctgggagcgtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgaagccccacttgcgcttcccctcgctgccgtgctgtcctggccccgtcgctgccacctgaggcccccatcaagtacctgagctctgcgtc

SEQ ID NO: 186210 - DNA, 601 bp, Human
cctgggagggatccgcctgtccacgtgcagccgcctccgggcggcgtcggccatgctgctgccccaccgtggctctgtggctccagccggaatggcaaagcctggctccacagctgcctgggagcgtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgargccccacttgcgcttcccctcgctgccgtgctgtcctggccccgtcgctgccacctgaggcccccatcaagtacctgagctctgcgtctgttttcacgcttctgtatgtgtaggaagccccccaccgatgttgctcggggtcgacgtgataaacctgagggaaagggaattctctcaccccgaccgacacacaggatgggtgtgggggcaaagtgagatcatgaacaaaagcatctgggcccgtcctggacacatggccagggttagccacggttgtcagcctccacggagctgcagttt

SEQ ID NO: 186211 - DNA, 601 bp, Human
gccccaccgtggctctgtggctccagccggaatggcaaagcctggctccacagctgcctgggagcgtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgaagccccacttgcgcttcccctcgctgccgtgctgtcctggccccgtcgctgccacctgagrcccccatcaagtacctgagctctgcgtctgttttcacgcttctgtatgtgtaggaagccccccaccgatgttgctcggggtcgacgtgataaacctgagggaaagggaattctctcaccccgaccgacacacaggatgggtgtgggggcaaagtgagatcatgaacaaaagcatctgggcccgtcctggacacatggccagggttagccacggttgtcagcctccacggagctgcagtttcagcctggaggtctgtggcgtgcatggttggaatactcaccagactcacgtggtcgtgac

SEQ ID NO: 186212 - DNA, 601 bp, Human
gtgagtcacgcgccccacagaacacggcgggcagcgcgggcgaggattggcgaaagccgaccgatgtgttttggcttgtgtggtctgtgggagcgtcctttgtcatcagcctaattgggcaacagatcccacctcactgtgccctggagcagcacggggccaccacacagcctgaagccccacttgcgcttcccctcgctgccgtgctgtcctggccccgtcgctgccacctgaggcccccatcaagtacctgagctctgcgtctgttttcacgcttctgtatgtgtaggaagccccccamcgatgttgctcggggtcgacgtgataaacctgagggaaagggaattctctcaccccgaccgacacacaggatgggtgtgggggcaaagtgagatcatgaacaaaagcatctgggcccgtcctggacacatggccagggttagccacggttgtcagcctccacggagctgcagtttcagcctggaggtctgtggcgtgcatggttggaatactcaccagactcacgtggtcgtgactccggaagatcatgccttcctggaaaccttggaacgcgcttcagcagaaactccagtgaagagtc

SEQ ID NO: 186213 - DNA, 601 bp, Human
aagggaattctctcaccccgaccgacacacaggatgggtgtgggggcaaagtgagatcatgaacaaaagcatctgggcccgtcctggacacatggccagggttagccacggttgtcagcctccacggagctgcagtttcagcctggaggtctgtggcgtgcatggttggaatactcaccagactcacgtggtcgtgactccggaagatcatgccttcctggaaaccttggaacgcgcttcagcagaaactccagtgaagagtcggtgagagagcacaaattcccaaaggcggatggagttyggaaggacccttctctgtctcccacatcaggcggtgcctggttggtgcagatttaccccatggtgggccgtggatccctcacctgctctggaaactgatcttggctctgaacaaggagaaatgatgcctctcagcctcgagggatgggtgataaggcagcttcatccgctgttttctttcattgtttgagaaaagtcatgccccggaggtgtcattcctggttgtttatgttgatggcaaaacttggactttcttgtcatacagcaaacagaagacaatctgatctttgttttccagggg

SEQ ID NO: 186214 - DNA, 601 bp, Human
cagccaaaatcctgccatatcctcacatggcaggacaggcgatttgtctctccctccctgtgggacggcagtcccgttggatcagggccccaccctgatgacattgtttaacccccagttacctcctgcaaacaccactctcaagtagagtcacgcggacgggggttagggcttcaacatgaggttgaggggacacgagtccgtccatagcagtgaccccacttgtctaaagccacagggctgagcctgccccctgcccccctgcctgcccatccccaggcccccgttcttgcccccaggcccccccccgcccacccccaggtgctccctgtgctgcagacagagcccccgaggagccaggagctgccgggcaccaaccacacaggaagccaacaggtggggcaggcttgtgcctgccaccgtgttgctcatgccgatttttattctcagatcttgtcacctctgtcttgtagcagaagggggccctgatctgggagccgtgaagaccccagctgtcccccgggagccaggccacaccaaggcagccaaggggactacgttgggaggaggatgtggtccgggccattaagagctgtgatga

SEQ ID NO: 186215 - DNA, 601 bp, Human
taacccccagttacctcctgcaaacaccactctcaagtagagtcacgcggacgggggttagggcttcaacatgaggttgaggggacacgagtccgtccatagcagtgaccccacttgtctaaagccacagggctgagcctgccccctgcccccctgcctgcccatccccaggcccccgttcttgcccccaggcccccccccgcccacccccaggtgctccctgtgctgcagacagagcccccgaggagccaggagctgccgggcaccaaccacacaggaagccaacaggtggggcaggctygtgcctgccaccgtgttgctcatgccgatttttattctcagatcttgtcacctctgtcttgtagcagaagggggccctgatctgggagccgtgaagaccccagctgtcccccgggagccaggccacaccaaggcagccaaggggactacgttgggaggaggatgtggtccgggccattaagagctgtgatgagcccccaggtctgccctgggtgaggggctctgcctgccctggggctgcatagacccggctggggctttagaacaggaaccgttcgaggggctgcggtgggtgaagccc

SEQ ID NO: 186216 - DNA, 601 bp, Human
tgcgcgccgcctccacagacagtccccatggacgctggggctgccgtggacgatggggcagccatcatggacaacgggactgccatggacaccgcagccagcctgctctgtgggaatatgctttgtaaagccagccggccctgaggccagcactcgccttccacactctgctctttgtaacgagtttcataaactcaccctcaggtgattggtgtttctgttgcaccgttgcttagcctgaaaatgagctgccctttttctgagcccatcctttcgccacctctaccccagcccctcatgrctgatatcaggaggtagccagaggccgcctggtgcagggtgagcccggaacacgggcaacagcttgaactgggcctgtgcggccccctccacgggcgacagcgtgaactgggcctgtgcggcccccctccacgggtgagactcccaggcgctcttgcagacgctcactcactttctcactgataggatgcgtcttacgaggctctgatttacagagcaggcatccatcttctctgaaacccacacaaaaagcacagtttaggccaagcccaggtgcagtatgttcgtgtgtttaagcttc

SEQ ID NO: 186217 - DNA, 601 bp, Human
cactgataggatgcgtcttacgaggctctgatttacagagcaggcatccatcttctctgaaacccacacaaaaagcacagtttaggccaagcccaggtgcagtatgttcgtgtgtttaagcttcttagatgctggggtgtggaagcagccgtgtggctttcctttgcttgtgaaggtgagtttgcactttccagcttctctctgtattgggaaggctgcagctctccaggacatgacttagcagagaacatcccgctgcatcctcataggccagcgggtcaggcggggccattctgaaacrtcccctgtgggtgccgggtgcctcgcgcatccctgccgtccaccgccctttgtccctggctgtgcttcgcggcagtgccccttagggcaaggacagggagatggggcagtcgcctggggaaggcccggtcccagtgggaggcagcctcagagcagctgggatggcacaagacgccgctgccagggctgagaaaccatccggccaaccccagacttgagccagacttcatgggcaaggctgggagaagccgcgtggagaccccagcccagggaggggcactgtggcaggaacagggcccgc

SEQ ID NO: 186218 - DNA, 601 bp, Human
ggggtgtggaagcagccgtgtggctttcctttgcttgtgaaggtgagtttgcactttccagcttctctctgtattgggaaggctgcagctctccaggacatgacttagcagagaacatcccgctgcatcctcataggccagcgggtcaggcggggccattctgaaacgtcccctgtgggtgccgggtgcctcgcgcatccctgccgtccaccgccctttgtccctggctgtgcttcgcggcagtgccccttagggcaaggacagggagatggggcagtcgcctggggaaggcccggtcccrgtgggaggcagcctcagagcagctgggatggcacaagacgccgctgccagggctgagaaaccatccggccaaccccagacttgagccagacttcatgggcaaggctgggagaagccgcgtggagaccccagcccagggaggggcactgtggcaggaacagggcccgcacctgcagggtcagcccaggccaccttccaagcacggtgaccacgtcgcagctcatgctgccagctccgggccaagggacctggactggctctccagactcacaagatgccgtcgtgggtggggcacgtgcgg

SEQ ID NO: 186219 - DNA, 601 bp, Human
cagggtattaatttaaccttccagccatgtgcttttgcttaagatctaaactctgaaaattaccagcctaatttagaatggaggcttggccattcgggacaccagcatcttctgagcgggagagatgtgggtgcccaccggcgtctcactcccacatctgggcctgtttccagtgacccctgcacctctcaaaggcgcaggcctgagttcacagagagcacttggccaagccctgcctctggggctccccatcgtctggctttgtcgtggactcatcatttctggatttaccacatgcttsaagctggaacagcaggaaggggcagttcctgaggcccagctgcgtccgcagagctgggggcgccatggcctaaggcaagacgcgtgccctggatgaaaatgactccagctctgtagtctccagacagcggttagagccccaccctccacggacaccgcctcctgccaccccttcaaaaaagtgttgcagcccagggcccagatattcaattttctaatgtaaaacgaggcgggtagggtttcccaatcaacatgagggcgccgtgtcctctgcagccccctgacttgcacaggcagtcct

SEQ ID NO: 186220 - DNA, 601 bp, Human
cccacatctgggcctgtttccagtgacccctgcacctctcaaaggcgcaggcctgagttcacagagagcacttggccaagccctgcctctggggctccccatcgtctggctttgtcgtggactcatcatttctggatttaccacatgcttcaagctggaacagcaggaaggggcagttcctgaggcccagctgcgtccgcagagctgggggcgccatggcctaaggcaagacgcgtgccctggatgaaaatgactccagctctgtagtctccagacagcggttagagccccaccctccacrgacaccgcctcctgccaccccttcaaaaaagtgttgcagcccagggcccagatattcaattttctaatgtaaaacgaggcgggtagggtttcccaatcaacatgagggcgccgtgtcctctgcagccccctgacttgcacaggcagtcctggggctctgccccatctgtgaaccctcagctgaagagggcagccccagaggcagccacattcaggtggctgaaggcagagtcctcctcccaggaaccgcctcggcgctgccaaggcctgtgcaccttcttcagcccgaactaaggagaat

SEQ ID NO: 186221 - DNA, 601 bp, Human
ttccagtgacccctgcacctctcaaaggcgcaggcctgagttcacagagagcacttggccaagccctgcctctggggctccccatcgtctggctttgtcgtggactcatcatttctggatttaccacatgcttcaagctggaacagcaggaaggggcagttcctgaggcccagctgcgtccgcagagctgggggcgccatggcctaaggcaagacgcgtgccctggatgaaaatgactccagctctgtagtctccagacagcggttagagccccaccctccacggacaccgcctcctgccrccccttcaaaaaagtgttgcagcccagggcccagatattcaattttctaatgtaaaacgaggcgggtagggtttcccaatcaacatgagggcgccgtgtcctctgcagccccctgacttgcacaggcagtcctggggctctgccccatctgtgaaccctcagctgaagagggcagccccagaggcagccacattcaggtggctgaaggcagagtcctcctcccaggaaccgcctcggcgctgccaaggcctgtgcaccttcttcagcccgaactaaggagaatgtgcgggactgagagcc

SEQ ID NO: 186222 - DNA, 601 bp, Human
cctcctgccaccccttcaaaaaagtgttgcagcccagggcccagatattcaattttctaatgtaaaacgaggcgggtagggtttcccaatcaacatgagggcgccgtgtcctctgcagccccctgacttgcacaggcagtcctggggctctgccccatctgtgaaccctcagctgaagagggcagccccagaggcagccacattcaggtggctgaaggcagagtcctcctcccaggaaccgcctcggcgctgccaaggcctgtgcaccttcttcagcccgaactaaggagaatgtgcgggrctgagagccatagaccctcgtgagccaggcttgagcgttgtcttcagatggggcccagtgggcctcactgttgtgacgactgaatgtgacgtctggggtgtaattccagcgtgacctggtcctggggtgtcactccagcgtgacctggttcctgaggtgtaattccagcgtgacctggttcctggggtataattccagcgcgaccttgttcctggggtgtcattccagcgtgacctggtcctggggtgtcattccagtgtgacgtggtcctggggtgtcactccagcatgacctggttcc

SEQ ID NO: 186223 - DNA, 601 bp, Human
tagcctccctactctgtgtagggcggacgctttaaacctcgatgtttctactcagtgtgcagggcggacgctttaaacctcgatctccccactcagtgtgcagggcggacgctttaaacctcgatctttctactcagagggtggatgatagaaagatttgaatgagtgaatgaaagtagagacttgaaaagtcagcacaaaagcaacaaaatgcagcaactccactcggaatccctgggtggaaagctctggttgacttcctgcggactcaggctggtgagatcctacagctgggaacggyccatatgggtcagtccctgtgatgcctccagtgtggcgggaaggtggcttggccaccatggatgactcgcgcctgccttcacgaccgccgggacctgtgcggggggggaagagggcggctgcaggggaggccgcacgtggcacaggtgctccggcgtctcgagctgcaggaaaacgccgtctccatcgttcgcagctgctggtggactcctcggcacccagccgtggcggggaacagctgcatggactcacgggctcaagcccggggctaaatattttctctcgaattgtggaaatgctt

SEQ ID NO: 186224 - DNA, 601 bp, Human
tgacttcctgcggactcaggctggtgagatcctacagctgggaacggcccatatgggtcagtccctgtgatgcctccagtgtggcgggaaggtggcttggccaccatggatgactcgcgcctgccttcacgaccgccgggacctgtgcggggggggaagagggcggctgcaggggaggccgcacgtggcacaggtgctccggcgtctcgagctgcaggaaaacgccgtctccatcgttcgcagctgctggtggactcctcggcacccagccgtggcggggaacagctgcatggactcacgrgctcaagcccggggctaaatattttctctcgaattgtggaaatgcttttgtttactgcaggaggctgccaggctctctgtggtggcgactgtttgcaccgggagcctgtgtactggctttgggggccacacataggcccccaggtggtgacaggaggggagtttccctccctgtggccgaccctgctgccaaaaacccaccagtgtgcagcccacggggaggagaaaacaggctgaggagactcactcacagcttgctgtctgcgtagcattcgctcagagtggcaccacgcgtctgtta

SEQ ID NO: 186225 - DNA, 601 bp, Human
gctctgccccagcagcccctctcctccactcccgcctgccacccaagagccgacctgcctgcagccctgcagcccagcgtgcccgcccgccacgggccgcccgcagcacctgccgtccacggtccgcagggacgagtctccgactgccgggccacggctgctgccagaggtgcatgaggacggtagtcctaatttggcccctattcctgtaacggtcaagcgagagcctgaagagttggaccagttgtacctggatgacggtgagtgcccgcagccatgcaggtgtgtgccccgcctggcrccatggcgtgagctcatggaggggccgtgtgcgtgctgcgtgtgtggcacgtgtggaagtgcaccgaggcaccgggcagggtgtggggtgcgtcctcctgatataaagtgcccgtgcggtgccacggcgtcagcgccacctggggcgctcgccgtgagatctgctccggtggtcgcagtgtggggcccttggcgggtcctgggctgcagatcctcctgcgagacctgtcccggggtctaaggctcacattggtgtccaggtttgcttctgcagctgaatatggagccgcacggctcaggc

SEQ ID NO: 186226 - DNA, 601 bp, Human
cacgttaccccgtgcggctctgtaaacacatctaaatgcagtggcggccttgccaggagctcgcagggtggccgtgacaccgggggccctagactgtgccttcaggccccaggtgcagggtcttccccatctagcccctgggctcgcacagcgcggagatgcacccaacaccgcacacctggggttgttagggaaggaagtggcctcacgtctgtagccaggcgggtggtgtggggcgtctgagcactcaggcctttctgtgacgagtggtgaccgaaggcgccgtggcgttcttctcgastgtttacactttaaggcgcagcccgacttgcttgcagtcgcgctgtgatcggggcgtgcccgtggccctggtgaccacgcgttagagggtgattccgctcgtgttttctggccctgcggtttgtgtgcgcgttgtgatcggggcgtgcccgcggccctggtgaccacgcgttagagggcgattccgctcgtgttttctgctcgaatggtttgtgtgggaattggcttcatttcctcggaggcacagtgagtcctcccaagtgtatgacgtttcccaggcccgggttccagcagacacacc

SEQ ID NO: 186227 - DNA, 601 bp, Human
tctcacgcggtaccaggtggtcccaaggcggctgggagatgctgagaaattctctttccacctgccatgccttgtcccagttgtgacccaccagctctgggctcccacaattgggtagtgccctgcaggcccaggtgggaagcaggtcccggtcatgtttctgctgccctgtggcccacgtgtggctttatggcgagggtagagttcggggtgggacttggggtgggtgagcagcggcagtgctgggggctgggacgtgttctgcgtcaacacagcaggcaggggactgttgacccgcacrgtgctcaggtgagatcatccctttacccagcccgttactgccaaagcctcaccaggtggcccgggcccctctggccttggtcctagaggtcaaagctaagtgagccaggccttgccttggggcctggtgggccacagagggtgggctgttgtgtcgctgagtgcacaggctggggatgttggagctgcatgggtgtgggtgtgaccccgccctggcctgcctgactgtgcgtggacatggaggggatgggtcttggggaggggagtgcacagacgactccctgacacatggaagggctga

SEQ ID NO: 186228 - DNA, 601 bp, Human
gtgacccaccagctctgggctcccacaattgggtagtgccctgcaggcccaggtgggaagcaggtcccggtcatgtttctgctgccctgtggcccacgtgtggctttatggcgagggtagagttcggggtgggacttggggtgggtgagcagcggcagtgctgggggctgggacgtgttctgcgtcaacacagcaggcaggggactgttgacccgcacggtgctcaggtgagatcatccctttacccagcccgttactgccaaagcctcaccaggtggcccgggcccctctggccttggtyctagaggtcaaagctaagtgagccaggccttgccttggggcctggtgggccacagagggtgggctgttgtgtcgctgagtgcacaggctggggatgttggagctgcatgggtgtgggtgtgaccccgccctggcctgcctgactgtgcgtggacatggaggggatgggtcttggggaggggagtgcacagacgactccctgacacatggaagggctgaggccagagtgcatctgccatggggctgggcctggcctgcagctcctctgaggatgcccaatgccacgttcccattggggcct

SEQ ID NO: 186229 - DNA, 601 bp, Human
ggcccacgtgtggctttatggcgagggtagagttcggggtgggacttggggtgggtgagcagcggcagtgctgggggctgggacgtgttctgcgtcaacacagcaggcaggggactgttgacccgcacggtgctcaggtgagatcatccctttacccagcccgttactgccaaagcctcaccaggtggcccgggcccctctggccttggtcctagaggtcaaagctaagtgagccaggccttgccttggggcctggtgggccacagagggtgggctgttgtgtcgctgagtgcacaggctrgggatgttggagctgcatgggtgtgggtgtgaccccgccctggcctgcctgactgtgcgtggacatggaggggatgggtcttggggaggggagtgcacagacgactccctgacacatggaagggctgaggccagagtgcatctgccatggggctgggcctggcctgcagctcctctgaggatgcccaatgccacgttcccattggggcctctcctgacagccagtgggaccctggagcccaggattcgccagctgtaaagcagtcgctcacaccccttttaagaaagtttgtttcccggc

SEQ ID NO: 186230 - DNA, 601 bp, Human
acagcaggcaggggactgttgacccgcacggtgctcaggtgagatcatccctttacccagcccgttactgccaaagcctcaccaggtggcccgggcccctctggccttggtcctagaggtcaaagctaagtgagccaggccttgccttggggcctggtgggccacagagggtgggctgttgtgtcgctgagtgcacaggctggggatgttggagctgcatgggtgtgggtgtgaccccgccctggcctgcctgactgtgcgtggacatggaggggatgggtcttggggaggggagtgcacrgacgactccctgacacatggaagggctgaggccagagtgcatctgccatggggctgggcctggcctgcagctcctctgaggatgcccaatgccacgttcccattggggcctctcctgacagccagtgggaccctggagcccaggattcgccagctgtaaagcagtcgctcacaccccttttaagaaagtttgtttcccggcgtgctgccgtcgggacacttgaggacaacctctccccgcagagtgagctcagttcccagcgggcctctctccccattttcctcactcagttgccgtggt

SEQ ID NO: 186231 - DNA, 601 bp, Human
atgcccaatgccacgttcccattggggcctctcctgacagccagtgggaccctggagcccaggattcgccagctgtaaagcagtcgctcacaccccttttaagaaagtttgtttcccggcgtgctgccgtcgggacacttgaggacaacctctccccgcagagtgagctcagttcccagcgggcctctctccccattttcctcactcagttgccgtggtgatcctccccaaactcggatcgaatgggtcacgtcctgttcaaaagacccaggggtttctgtgttgtcagagcagaccacaycccagcccaccgaccacagtcatctcgtccacgtacgcttcgtcaggcccagggccggtcctgggaccttgagcacagaccccgagcgccagccctgcacactgttctggtcacagtttatgggtcctgtgtgcttccgcctccataacctgggagcagccacacacaagctttcggggttagcgtacggcgctaggcggtgccgctttgggggtcggggttgggatggaggttgagatacctgtgcagacacctccctatgacatggcaagtgtgtgcaggtaatgtggtgatgtccgt

SEQ ID NO: 186232 - DNA, 601 bp, Human
acgttcccattggggcctctcctgacagccagtgggaccctggagcccaggattcgccagctgtaaagcagtcgctcacaccccttttaagaaagtttgtttcccggcgtgctgccgtcgggacacttgaggacaacctctccccgcagagtgagctcagttcccagcgggcctctctccccattttcctcactcagttgccgtggtgatcctccccaaactcggatcgaatgggtcacgtcctgttcaaaagacccaggggtttctgtgttgtcagagcagaccacatcccagcccaccraccacagtcatctcgtccacgtacgcttcgtcaggcccagggccggtcctgggaccttgagcacagaccccgagcgccagccctgcacactgttctggtcacagtttatgggtcctgtgtgcttccgcctccataacctgggagcagccacacacaagctttcggggttagcgtacggcgctaggcggtgccgctttgggggtcggggttgggatggaggttgagatacctgtgcagacacctccctatgacatggcaagtgtgtgcaggtaatgtggtgatgtccgtttcatctccacc

SEQ ID NO: 186233 - DNA, 601 bp, Human
ctcggtcatggtggggtggtctctggtgcaggcccaggctctgggtcaggatgggggtgttccctggtgcaggcccggctctgggttagggcagggtggtccctggtgcaggctcaggctctcagtcatggtggggtagtccctgatacaggcctgacattgccgccaccctgggagacaggcaccaggccatggactccaggttcctcctgagcacctgggggcaggtccacccactctagacacctgttcctccctgtgagaaaagcagattcaaatgtttattgctctgtcggagccragtggatggagccttcactgagaatgacacgggccgagccgtttcccgcgtcctgggtggatggagccgtagatgggtcgctgcctgtccttgtgagaagatggctggagcatccaccaacatggccgggaagggtcccgggtcagggttgagtctgggtcggcccctcccctgcagatgacctctggcttgccctgggtccctggaacctggaacccacaccccaggctcacaaacgccgtgacataaacgaggtcagggcctgggttatgtcgggaaagcctcacgcaggctgaagac

SEQ ID NO: 186234 - DNA, 601 bp, Human
agacacctgttcctccctgtgagaaaagcagattcaaatgtttattgctctgtcggagccaagtggatggagccttcactgagaatgacacgggccgagccgtttcccgcgtcctgggtggatggagccgtagatgggtcgctgcctgtccttgtgagaagatggctggagcatccaccaacatggccgggaagggtcccgggtcagggttgagtctgggtcggcccctcccctgcagatgacctctggcttgccctgggtccctggaacctggaacccacaccccaggctcacaaacgcygtgacataaacgaggtcagggcctgggttatgtcgggaaagcctcacgcaggctgaagacctgaattgtgaggtggaactctgagtccccgagactccagctccatggaaatgcgggggtgtacctggggaccgtctcgatggggacagcgggagagggagcccagaccccaacaagctccacggaaatgcgaggagccatcttgatggggacagcgggagagggaaggcaggctagggtgaatgtgggtagtccttgtttagtattaatatatattttgtctaatttcacaacccctaa

SEQ ID NO: 186235 - DNA, 601 bp, Human
tggccgggaagggtcccgggtcagggttgagtctgggtcggcccctcccctgcagatgacctctggcttgccctgggtccctggaacctggaacccacaccccaggctcacaaacgccgtgacataaacgaggtcagggcctgggttatgtcgggaaagcctcacgcaggctgaagacctgaattgtgaggtggaactctgagtccccgagactccagctccatggaaatgcgggggtgtacctggggaccgtctcgatggggacagcgggagagggagcccagaccccaacaagctccayggaaatgcgaggagccatcttgatggggacagcgggagagggaaggcaggctagggtgaatgtgggtagtccttgtttagtattaatatatattttgtctaatttcacaacccctaagagaatcgggcacctcagcagccaccctggggctcagtcgctggcttagaaagcaggcaagcgtgacctggagttggggggcggagaagaataggaagcacagggcgccccaacaagggacgatcccagcacctggagaaggagcagagacgagagacagaaacaacacgaaccccaggtcaa

SEQ ID NO: 186236 - DNA, 601 bp, Human
gcggagaagaataggaagcacagggcgccccaacaagggacgatcccagcacctggagaaggagcagagacgagagacagaaacaacacgaaccccaggtcaagtcggtgccgtgcgtgccaagtgtcctcagcgggtggaaagtgtcgctgtgtctttgatagtttacacaacagggagagagcgaaaagctggggttggaggaaacaggagagaagtaaggctgtgtggcggggacaagactcagacacacccctgactatctgtaaatgggccgatcggacacaaggccagggacctsctggccagccccgagccccgtgaggtgcctgtggcaggacgtgggtatggcaggtgacagaaaccctgccgggtccactttccagcctccccggcttcccttctgcgttccgctggcctggccgccacctccagggacaacaagcctggcatggggtgcagatttagtctccagccctctgcgaaccaagcagtggtggatcgcagagctgcgtgcggggagagggggagacaggccagcgtctgggatgtcctcgtggggccggggactcagccccggcccctgggcgcccagccatgt

SEQ ID NO: 186237 - DNA, 601 bp, Human
gcagagacgagagacagaaacaacacgaaccccaggtcaagtcggtgccgtgcgtgccaagtgtcctcagcgggtggaaagtgtcgctgtgtctttgatagtttacacaacagggagagagcgaaaagctggggttggaggaaacaggagagaagtaaggctgtgtggcggggacaagactcagacacacccctgactatctgtaaatgggccgatcggacacaaggccagggacctgctggccagccccgagccccgtgaggtgcctgtggcaggacgtgggtatggcaggtgacagaarccctgccgggtccactttccagcctccccggcttcccttctgcgttccgctggcctggccgccacctccagggacaacaagcctggcatggggtgcagatttagtctccagccctctgcgaaccaagcagtggtggatcgcagagctgcgtgcggggagagggggagacaggccagcgtctgggatgtcctcgtggggccggggactcagccccggcccctgggcgcccagccatgtttgagaggcttccctccgcctgaccagaatcagagctgtgggtccatgaattgagtcacttca

SEQ ID NO: 186238 - DNA, 601 bp, Human
gagcgaaaagctggggttggaggaaacaggagagaagtaaggctgtgtggcggggacaagactcagacacacccctgactatctgtaaatgggccgatcggacacaaggccagggacctgctggccagccccgagccccgtgaggtgcctgtggcaggacgtgggtatggcaggtgacagaaaccctgccgggtccactttccagcctccccggcttcccttctgcgttccgctggcctggccgccacctccagggacaacaagcctggcatggggtgcagatttagtctccagccctctkcgaaccaagcagtggtggatcgcagagctgcgtgcggggagagggggagacaggccagcgtctgggatgtcctcgtggggccggggactcagccccggcccctgggcgcccagccatgtttgagaggcttccctccgcctgaccagaatcagagctgtgggtccatgaattgagtcacttcaaggtcttgctgcttcacatgaacagctgtgcagaggcagccagagacagcccggggctcctcacgcccagtgatgctgacgacggcctgcccgtgaggacatagaactttttctgtgc

SEQ ID NO: 186239 - DNA, 601 bp, Human
ctttcccctcagacttctcgagcatggccgagccacagaggttcagtttttaaacagtggttttctgtatcttgcattattttaaatgtagatttgaaaaaatgccacagagctccgtgtggctccttttctaatgtgatctccacgcattccgcatcgtggagaagggccgtgaggaggctccgctgggggcggactcgcggtggattacgcgtcagcgagggccgccccgtgccacgcgctcgcgcgctgagagcgtttgtggggcctgtgtcttccgaaacggaggcgctcggggccygctgcggtgcccgcgggtctgtgccgctgaagtgggcacccctcctccagcctcgtgaggacagcggccgtccctcggcgcggggctggtctgccacgggcgcctccccgtgtcccctgggccgccgcacggcctctgccacggtcggccctttcagtccctcagaagcacttgggtttaaagtctccatgtcattaaaacaacgagcaggtagacgaggcggccggagcgtgtccgccgcagtctgggctgtgaacgggcccctcgcccgcccctcctgagccggagctgctccggagg

SEQ ID NO: 186240 - DNA, 601 bp, Human
cgcgggtctgtgccgctgaagtgggcacccctcctccagcctcgtgaggacagcggccgtccctcggcgcggggctggtctgccacgggcgcctccccgtgtcccctgggccgccgcacggcctctgccacggtcggccctttcagtccctcagaagcacttgggtttaaagtctccatgtcattaaaacaacgagcaggtagacgaggcggccggagcgtgtccgccgcagtctgggctgtgaacgggcccctcgcccgcccctcctgagccggagctgctccggaggacgagaagctcycctcgtggaaagtcttactaacctggcccggcgcccaggtctgaggccttccccccggctgaggatgattgaaagagcctgtgtgccgccatccaacgtcgttaccgtcgcagacggcggctaccgcgtgatggatggagcagcggactcagccgtgcaaatcattcatcggggtcagtgcctggtgccgtgggaccgcggcgtgggggtttcaaggcgtaaaaatcgcaccgcacgccacccggagacggagcctgctgtcggcagggcgggccgggctgcggggccgggtgctccgga

SEQ ID NO: 186241 - DNA, 601 bp, Human
cgggtctgtgccgctgaagtgggcacccctcctccagcctcgtgaggacagcggccgtccctcggcgcggggctggtctgccacgggcgcctccccgtgtcccctgggccgccgcacggcctctgccacggtcggccctttcagtccctcagaagcacttgggtttaaagtctccatgtcattaaaacaacgagcaggtagacgaggcggccggagcgtgtccgccgcagtctgggctgtgaacgggcccctcgcccgcccctcctgagccggagctgctccggaggacgagaagctctcytcgtggaaagtcttactaacctggcccggcgcccaggtctgaggccttccccccggctgaggatgattgaaagagcctgtgtgccgccatccaacgtcgttaccgtcgcagacggcggctaccgcgtgatggatggagcagcggactcagccgtgcaaatcattcatcggggtcagtgcctggtgccgtgggaccgcggcgtgggggtttcaaggcgtaaaaatcgcaccgcacgccacccggagacggagcctgctgtcggcagggcgggccgggctgcggggccgggtgctccggagg

SEQ ID NO: 186242 - DNA, 601 bp, Human
gccgtccctcggcgcggggctggtctgccacgggcgcctccccgtgtcccctgggccgccgcacggcctctgccacggtcggccctttcagtccctcagaagcacttgggtttaaagtctccatgtcattaaaacaacgagcaggtagacgaggcggccggagcgtgtccgccgcagtctgggctgtgaacgggcccctcgcccgcccctcctgagccggagctgctccggaggacgagaagctctcctcgtggaaagtcttactaacctggcccggcgcccaggtctgaggccttccccscggctgaggatgattgaaagagcctgtgtgccgccatccaacgtcgttaccgtcgcagacggcggctaccgcgtgatggatggagcagcggactcagccgtgcaaatcattcatcggggtcagtgcctggtgccgtgggaccgcggcgtgggggtttcaaggcgtaaaaatcgcaccgcacgccacccggagacggagcctgctgtcggcagggcgggccgggctgcggggccgggtgctccggaggccgctgaagaggcagctccccaacgccaagagcccgtccagccccaggcccgg

SEQ ID NO: 186243 - DNA, 601 bp, Human
cggggctggtctgccacgggcgcctccccgtgtcccctgggccgccgcacggcctctgccacggtcggccctttcagtccctcagaagcacttgggtttaaagtctccatgtcattaaaacaacgagcaggtagacgaggcggccggagcgtgtccgccgcagtctgggctgtgaacgggcccctcgcccgcccctcctgagccggagctgctccggaggacgagaagctctcctcgtggaaagtcttactaacctggcccggcgcccaggtctgaggccttccccccggctgaggatgaytgaaagagcctgtgtgccgccatccaacgtcgttaccgtcgcagacggcggctaccgcgtgatggatggagcagcggactcagccgtgcaaatcattcatcggggtcagtgcctggtgccgtgggaccgcggcgtgggggtttcaaggcgtaaaaatcgcaccgcacgccacccggagacggagcctgctgtcggcagggcgggccgggctgcggggccgggtgctccggaggccgctgaagaggcagctccccaacgccaagagcccgtccagccccaggcccggagctgcttcctcag

SEQ ID NO: 186244 - DNA, 601 bp, Human
tgggccgccgcacggcctctgccacggtcggccctttcagtccctcagaagcacttgggtttaaagtctccatgtcattaaaacaacgagcaggtagacgaggcggccggagcgtgtccgccgcagtctgggctgtgaacgggcccctcgcccgcccctcctgagccggagctgctccggaggacgagaagctctcctcgtggaaagtcttactaacctggcccggcgcccaggtctgaggccttccccccggctgaggatgattgaaagagcctgtgtgccgccatccaacgtcgttacygtcgcagacggcggctaccgcgtgatggatggagcagcggactcagccgtgcaaatcattcatcggggtcagtgcctggtgccgtgggaccgcggcgtgggggtttcaaggcgtaaaaatcgcaccgcacgccacccggagacggagcctgctgtcggcagggcgggccgggctgcggggccgggtgctccggaggccgctgaagaggcagctccccaacgccaagagcccgtccagccccaggcccggagctgcttcctcagggagcccaccctgtgacgtgcccgaggtgaggcggcc

SEQ ID NO: 186245 - DNA, 601 bp, Human
tcgctgtgacgcgggtaagccgtgaacagtagtaaggtattcgcaagtgtgtcattgtaacgctgtgtttttctggtgtagatgcactctgttttcctcctacagatgatttcaaactttacagaaacattttaagtggcattgtctccatttcaaatcaagttgcctagcttcctcctaccgccatacgttttctcttcctaatgtgtagacatttcaaagagcttccttatttgagaacgagtgttctttacagacacgcttagatctgtgagccagcatgtcgcactgatgtgctggrgtaccggagcgtgaagccatgagcgaggtatttaaaaagcataacagccacattcagcgcccagaggccgatcgcccgtcagagggagagaggtggccggggcagtggagggctctgcccatgtctgtcagacagccatgttcttgccagggcagccagggccgggccactcaagctgggtgcttggctctccctgagctcgagcacgggcacgttcaggtgatcttcctgatagcaaagtgcgtttctgcgcatggactcctgaggagcagcgaggagctgactcacacattctgccaa

SEQ ID NO: 186246 - DNA, 601 bp, Human
gctggggtaccggagcgtgaagccatgagcgaggtatttaaaaagcataacagccacattcagcgcccagaggccgatcgcccgtcagagggagagaggtggccggggcagtggagggctctgcccatgtctgtcagacagccatgttcttgccagggcagccagggccgggccactcaagctgggtgcttggctctccctgagctcgagcacgggcacgttcaggtgatcttcctgatagcaaagtgcgtttctgcgcatggactcctgaggagcagcgaggagctgactcacacattcygccaagcccaggctagaaagaggggacagtcggaaccgtagtgttttcttcctgtcaatgctgagagactcactcctgaggtcgcacatccttgccagcaaacggaagacccagatcacagtcctaggctcgtcctggacgtgtagcctttgtacgttccatagtgaccttttgtacattttctcctgtgcgtgttcagccttagaatggcactgtgggcaggcagaactgccggtgctcaccacccccctttcccggggggaaactgaggctcagagagatgccgctggacttgctcca

SEQ ID NO: 186247 - DNA, 601 bp, Human
ctggggtaccggagcgtgaagccatgagcgaggtatttaaaaagcataacagccacattcagcgcccagaggccgatcgcccgtcagagggagagaggtggccggggcagtggagggctctgcccatgtctgtcagacagccatgttcttgccagggcagccagggccgggccactcaagctgggtgcttggctctccctgagctcgagcacgggcacgttcaggtgatcttcctgatagcaaagtgcgtttctgcgcatggactcctgaggagcagcgaggagctgactcacacattctrccaagcccaggctagaaagaggggacagtcggaaccgtagtgttttcttcctgtcaatgctgagagactcactcctgaggtcgcacatccttgccagcaaacggaagacccagatcacagtcctaggctcgtcctggacgtgtagcctttgtacgttccatagtgaccttttgtacattttctcctgtgcgtgttcagccttagaatggcactgtgggcaggcagaactgccggtgctcaccacccccctttcccggggggaaactgaggctcagagagatgccgctggacttgctccaa

SEQ ID NO: 186248 - DNA, 601 bp, Human
gggcagtggagggctctgcccatgtctgtcagacagccatgttcttgccagggcagccagggccgggccactcaagctgggtgcttggctctccctgagctcgagcacgggcacgttcaggtgatcttcctgatagcaaagtgcgtttctgcgcatggactcctgaggagcagcgaggagctgactcacacattctgccaagcccaggctagaaagaggggacagtcggaaccgtagtgttttcttcctgtcaatgctgagagactcactcctgaggtcgcacatccttgccagcaaacgraagacccagatcacagtcctaggctcgtcctggacgtgtagcctttgtacgttccatagtgaccttttgtacattttctcctgtgcgtgttcagccttagaatggcactgtgggcaggcagaactgccggtgctcaccacccccctttcccggggggaaactgaggctcagagagatgccgctggacttgctccaagtcagtcaatgaggcagaaccaggagcgccccaaccccagcgccaaggcccgcatgctctcgcgggtcccagctctaccgttgagtattttcttcccactagag

SEQ ID NO: 186249 - DNA, 601 bp, Human
aggggacagtcggaaccgtagtgttttcttcctgtcaatgctgagagactcactcctgaggtcgcacatccttgccagcaaacggaagacccagatcacagtcctaggctcgtcctggacgtgtagcctttgtacgttccatagtgaccttttgtacattttctcctgtgcgtgttcagccttagaatggcactgtgggcaggcagaactgccggtgctcaccacccccctttcccggggggaaactgaggctcagagagatgccgctggacttgctccaagtcagtcaatgaggcagaascaggagcgccccaaccccagcgccaaggcccgcatgctctcgcgggtcccagctctaccgttgagtattttcttcccactagagagatgtgatgagcaaagatttccgctcagaactcctaacatccaagtatgagttggctttgcaagccgaaggggagcatggtgtctgtttttcttcagagaatttctgactgtttgctaaggcacgtttccataagaaggactggagagaagcaggccttctaaactgctggagagcatcttgaatcagctctcccccaaagcaacaaaaatacag

SEQ ID NO: 186250 - DNA, 601 bp, Human
ctgtcaatgctgagagactcactcctgaggtcgcacatccttgccagcaaacggaagacccagatcacagtcctaggctcgtcctggacgtgtagcctttgtacgttccatagtgaccttttgtacattttctcctgtgcgtgttcagccttagaatggcactgtgggcaggcagaactgccggtgctcaccacccccctttcccggggggaaactgaggctcagagagatgccgctggacttgctccaagtcagtcaatgaggcagaaccaggagcgccccaaccccagcgccaaggccsgcatgctctcgcgggtcccagctctaccgttgagtattttcttcccactagagagatgtgatgagcaaagatttccgctcagaactcctaacatccaagtatgagttggctttgcaagccgaaggggagcatggtgtctgtttttcttcagagaatttctgactgtttgctaaggcacgtttccataagaaggactggagagaagcaggccttctaaactgctggagagcatcttgaatcagctctcccccaaagcaacaaaaatacagcatcactgtcaaatcaaccaccaaatctggc

SEQ ID NO: 186251 - DNA, 601 bp, Human
tgtacattttctcctgtgcgtgttcagccttagaatggcactgtgggcaggcagaactgccggtgctcaccacccccctttcccggggggaaactgaggctcagagagatgccgctggacttgctccaagtcagtcaatgaggcagaaccaggagcgccccaaccccagcgccaaggcccgcatgctctcgcgggtcccagctctaccgttgagtattttcttcccactagagagatgtgatgagcaaagatttccgctcagaactcctaacatccaagtatgagttggctttgcaagccraaggggagcatggtgtctgtttttcttcagagaatttctgactgtttgctaaggcacgtttccataagaaggactggagagaagcaggccttctaaactgctggagagcatcttgaatcagctctcccccaaagcaacaaaaatacagcatcactgtcaaatcaaccaccaaatctggcagtcagccaagaggacagaacaaacacagatgcattcactcaaggaagagcggccccagggggaagaacaggatggcagcgtcttcacttggggccgctccagccccgaggcgcacagccg

SEQ ID NO: 186252 - DNA, 601 bp, Human
atggtgtctgtttttcttcagagaatttctgactgtttgctaaggcacgtttccataagaaggactggagagaagcaggccttctaaactgctggagagcatcttgaatcagctctcccccaaagcaacaaaaatacagcatcactgtcaaatcaaccaccaaatctggcagtcagccaagaggacagaacaaacacagatgcattcactcaaggaagagcggccccagggggaagaacaggatggcagcgtcttcacttggggccgctccagccccgaggcgcacagccgtggaaagccrgtgacagcacagaccgtggaggagctgggctctgttgaaaaccccatcccaggatgcagtccgcatttggactggtcatggagctcctggaaaaggcccgttccgaggcacaatcaccgttggctgcagtcgtgatcatgggagctgccccaaggctgcgatcgacattggagcaaacaagagcctggccagaccaggtgaccccggggactttgaaaaaccttggagattcccgggcacatacgaaaatggatgtgtgaaggcttcggtacagagagggccccagccactcttctctgg

SEQ ID NO: 186253 - DNA, 601 bp, Human
ggaaagtcatgagtcacataagcaacaaccaaggagaggggaagccgagaaacaacaagtcctatttggagggggatggggggggggaatctcatttcagagtcgctacaatgcattagttgtcatctccagttgtaaaccaaaaaattatagtacatgcaagaaaacatgaaaatatgtcccatccacaggaagaaaaatctgtagcccctgagagggctcaggtattagaccagcaaaggctttaaatcagctgcaataaatatgctcaaagaactgaaagaaattgtatttaaaaaaktacaggggagtgtggcaaatatatcttaccagatagagaatatccataatgagatttttaaaaaaaaaaaaaaagaagccaaatagaaattacacagttgaaaagtaaatgaaaaatgcattagagaggctgaacaacagatttgagctggcagagaaaaagaatcaaacgtaaaaatcaacagattatttagactgaggaacagaaagaagaaagaatcaataaaaatgaacaaagcctcagagcatgtgagatgctgtaaacacatatacacatgcataatgagttatagaaagagat

SEQ ID NO: 186254 - DNA, 601 bp, Human
atttaaaaaattacaggggagtgtggcaaatatatcttaccagatagagaatatccataatgagatttttaaaaaaaaaaaaaaagaagccaaatagaaattacacagttgaaaagtaaatgaaaaatgcattagagaggctgaacaacagatttgagctggcagagaaaaagaatcaaacgtaaaaatcaacagattatttagactgaggaacagaaagaagaaagaatcaataaaaatgaacaaagcctcagagcatgtgagatgctgtaaacacatatacacatgcataatgagttayagaaagagatgattagaagaaatacgtgaagaaataatggccccaaacttcctaaatttgatggaaaacattattcagtgcatccaaatggttcacaaaattcaaatgggataaattaaaagcagctcacacacagacataaaccaaactgttgaaagtcaaagggagagacaatcccgaaagcagtgagaggaaaacagcttctcagtacgtgggatgctcagcaggattaacagccagctgcttattgtgaatcgtggatgtcggaggacagtgggacggcgcattcaaaatgctgaa

SEQ ID NO: 186255 - DNA, 601 bp, Human
ttaaaaaaaaaaaaaaagaagccaaatagaaattacacagttgaaaagtaaatgaaaaatgcattagagaggctgaacaacagatttgagctggcagagaaaaagaatcaaacgtaaaaatcaacagattatttagactgaggaacagaaagaagaaagaatcaataaaaatgaacaaagcctcagagcatgtgagatgctgtaaacacatatacacatgcataatgagttatagaaagagatgattagaagaaatacgtgaagaaataatggccccaaacttcctaaatttgatggaaarcattattcagtgcatccaaatggttcacaaaattcaaatgggataaattaaaagcagctcacacacagacataaaccaaactgttgaaagtcaaagggagagacaatcccgaaagcagtgagaggaaaacagcttctcagtacgtgggatgctcagcaggattaacagccagctgcttattgtgaatcgtggatgtcggaggacagtgggacggcgcattcaaaatgctgaaagaaaaccactgtcaaccaagaattctatatctagtaaaactcatctttagagatgaagaaacaaagc

SEQ ID NO: 186256 - DNA, 601 bp, Human
acagaaagaagaaagaatcaataaaaatgaacaaagcctcagagcatgtgagatgctgtaaacacatatacacatgcataatgagttatagaaagagatgattagaagaaatacgtgaagaaataatggccccaaacttcctaaatttgatggaaaacattattcagtgcatccaaatggttcacaaaattcaaatgggataaattaaaagcagctcacacacagacataaaccaaactgttgaaagtcaaagggagagacaatcccgaaagcagtgagaggaaaacagcttctcagtacrtgggatgctcagcaggattaacagccagctgcttattgtgaatcgtggatgtcggaggacagtgggacggcgcattcaaaatgctgaaagaaaaccactgtcaaccaagaattctatatctagtaaaactcatctttagagatgaagaaacaaagctgtgctcagataaacaagacacacagaatttgttgccaacagacctgacctacaggacatattaaagggagtccttcaggctgaggtaagaagcactggtgagagtaattacataggtgaattaaaaagacagcacaaacatgt

SEQ ID NO: 186257 - DNA, 601 bp, Human
accactaagaaaatatatatgtgtgtgagtgtgtcacacacacacataaaatgtcaaaaaatgcacttaaatgatacactagaaaatatgtgtgtaacacaaaataagccagtaatgaaggaacatagaaacaatgacaacagcaaaagttacacaagacatgtagagaacaaatagcaaaatggaaaacataatcctaccgtatcaataatcacattaaatgtcagtggaataaacaccccaataaaaaggtagatgttgtcagactggatgttaaagacagaatgaaacagggtacaascatatgctgtctaaaaaatacatattttagatttaaagacacaaataggttgaaagtaaaatgataaagagatactgtgcaatagtaatcaaaagagatatggagataatggaaaaaatacatacttcagatttaaagacacaaataggttgaaagtgaaaggatgaaaaagataggcagagttaatgtagaaatttggagtagctacactaatatcagacaaattaaactctaagataaaaatattactagaaacaatgaactgtcagtagtcatgttctctttgatcttaaacctgat

SEQ ID NO: 186258 - DNA, 601 bp, Human
gcagaggtggccactttcactgctgctactcagccttgtactggaggttctagccagtgtagccaggtaagaaacagaaataaaaggcaaccggaatggacaggaaaaagtaaaattgtctttattggaagaaaacgtgattctatatgtagaaaatcctgagaaatctgcctacaccccaccccccctccccccgccaaaaaggtaaaggaaaacccactgttaaaactaccaaacaagtgcagcaaggtcatcagatgtgagaccagggtacaaataaattatgtctatatgcaaggartaatccaaaaatgaaatcaaggaaaaattcctatctacgatatagcattaaaaagaataaaatatgaataactttaaagaagttaaggacttatactctgaaaatgacagaacgttgctgagggaaagttaagatctaaataaatgggagaacattgcatgttaatggaacagaagaatcaatattgtgaagatggcagctttctccagattgatctggagaatcagtgcaatctccatcaaaactccagcaattttttcttctaaaattcacaaaatgatcctaaaatctacatggagt

SEQ ID NO: 186259 - DNA, 601 bp, Human
gaggagattccgcgtcattcttaggggccttgggattttcggggtggcagatggacactggattcaacttaaagtcaccagctgcattagcccctaccaagggggtcagcctgtccttggaagctttgcagccagacactgagtcctctccagctatgggagtcccagacggcatctccaatagaaggctgttttgtctgcacagaaaatctgttgtttagtgtggccaccttcaccaatggtctcagccagatctcctggagaacttgctgcagcttccccatcagcacttgctgcttcrtctttgcttttatggtatggagatggcttctttccttcaacctcatgaactagcctctgctggcttcaaacttttttttctgcagcttcctcatctctcagccttcgtaggacagagagagcgagggtcttggtctggattaggctttggcttaagggagtgttgtggctggttcaatcttctgtccagatcactcggactttctctgtatcagcaataaggctgttccgccctcttatcatcggtgttgttcactagggcagcggttttcacttctgtctgtctagagttttccgctgc

SEQ ID NO: 186260 - DNA, 601 bp, Human
ctcagccagatctcctggagaacttgctgcagcttccccatcagcacttgctgcttcatctttgcttttatggtatggagatggcttctttccttcaacctcatgaactagcctctgctggcttcaaacttttttttctgcagcttcctcatctctcagccttcgtaggacagagagagcgagggtcttggtctggattaggctttggcttaagggagtgttgtggctggttcaatcttctgtccagatcactcggactttctctgtatcagcaataaggctgttccgccctcttatcatyggtgttgttcactagggcagcggttttcacttctgtctgtctagagttttccgctgcattcacagttggactggcgcgggaggctgagctgtcagcctgtctcggctttcgacgggtgttcctcaccaaatttaatcattcctagttttgaagtgagagacgtgtgacctttccttgcccttgaacttttacttgaaaacttggaggctgtcgtagggttcttaattggcctaatgtcagtatggttgtgtctcagggaatagggaggcctgagcccagggagagagatagagaatggct

SEQ ID NO: 186261 - DNA, 601 bp, Human
ctcctggagaacttgctgcagcttccccatcagcacttgctgcttcatctttgcttttatggtatggagatggcttctttccttcaacctcatgaactagcctctgctggcttcaaacttttttttctgcagcttcctcatctctcagccttcgtaggacagagagagcgagggtcttggtctggattaggctttggcttaagggagtgttgtggctggttcaatcttctgtccagatcactcggactttctctgtatcagcaataaggctgttccgccctcttatcatcggtgttgttcrctagggcagcggttttcacttctgtctgtctagagttttccgctgcattcacagttggactggcgcgggaggctgagctgtcagcctgtctcggctttcgacgggtgttcctcaccaaatttaatcattcctagttttgaagtgagagacgtgtgacctttccttgcccttgaacttttacttgaaaacttggaggctgtcgtagggttcttaattggcctaatgtcagtatggttgtgtctcagggaatagggaggcctgagcccagggagagagatagagaatggctggtcagtggag

SEQ ID NO: 186262 - DNA, 601 bp, Human
cggttttcacttctgtctgtctagagttttccgctgcattcacagttggactggcgcgggaggctgagctgtcagcctgtctcggctttcgacgggtgttcctcaccaaatttaatcattcctagttttgaagtgagagacgtgtgacctttccttgcccttgaacttttacttgaaaacttggaggctgtcgtagggttcttaattggcctaatgtcagtatggttgtgtctcagggaatagggaggcctgagcccagggagagagatagagaatggctggtcagtggagcagtcaggaygcacccagctcttatccattcacttcatcttagatgggcacagttcgtggcaccccaaaacaatgacaacagtaaccccaaagatcacagatctccgcagcagatatgatagcaatgagaaagcttggaacatcatgagcattattgaaacgtgacacagagatatgaagtgggcacctgctgttggaaacgtggtgcccacagacatgcctggtgcagggttgccaaagacctcccgtttgtgaaaagcagtgtctgaagcacagtgaagtgaggcttgcctgcaagacatccacaaaa

SEQ ID NO: 186263 - DNA, 601 bp, Human
gttcctcaccaaatttaatcattcctagttttgaagtgagagacgtgtgacctttccttgcccttgaacttttacttgaaaacttggaggctgtcgtagggttcttaattggcctaatgtcagtatggttgtgtctcagggaatagggaggcctgagcccagggagagagatagagaatggctggtcagtggagcagtcaggacgcacccagctcttatccattcacttcatcttagatgggcacagttcgtggcaccccaaaacaatgacaacagtaaccccaaagatcacagatctccrcagcagatatgatagcaatgagaaagcttggaacatcatgagcattattgaaacgtgacacagagatatgaagtgggcacctgctgttggaaacgtggtgcccacagacatgcctggtgcagggttgccaaagacctcccgtttgtgaaaagcagtgtctgaagcacagtgaagtgaggcttgcctgcaagacatccacaaaaggcgcagctctggagacaggagactgctgcgtgggaggaggtggtgctggaggcccttgggtgagggaagaggcaggagactgctgtgtgggaggag

SEQ ID NO: 186264 - DNA, 601 bp, Human
ggcctaatgtcagtatggttgtgtctcagggaatagggaggcctgagcccagggagagagatagagaatggctggtcagtggagcagtcaggacgcacccagctcttatccattcacttcatcttagatgggcacagttcgtggcaccccaaaacaatgacaacagtaaccccaaagatcacagatctccgcagcagatatgatagcaatgagaaagcttggaacatcatgagcattattgaaacgtgacacagagatatgaagtgggcacctgctgttggaaacgtggtgcccacagacrtgcctggtgcagggttgccaaagacctcccgtttgtgaaaagcagtgtctgaagcacagtgaagtgaggcttgcctgcaagacatccacaaaaggcgcagctctggagacaggagactgctgcgtgggaggaggtggtgctggaggcccttgggtgagggaagaggcaggagactgctgtgtgggaggaggtggtgctggaggcccttgggtgagggaagaggcaggagactgctgcgtgggaggaggtggtgctggaggcccttgggtgagggaagaggcaggagactgctgtgtggga

SEQ ID NO: 186265 - DNA, 601 bp, Human
taatgtcagtatggttgtgtctcagggaatagggaggcctgagcccagggagagagatagagaatggctggtcagtggagcagtcaggacgcacccagctcttatccattcacttcatcttagatgggcacagttcgtggcaccccaaaacaatgacaacagtaaccccaaagatcacagatctccgcagcagatatgatagcaatgagaaagcttggaacatcatgagcattattgaaacgtgacacagagatatgaagtgggcacctgctgttggaaacgtggtgcccacagacatgcytggtgcagggttgccaaagacctcccgtttgtgaaaagcagtgtctgaagcacagtgaagtgaggcttgcctgcaagacatccacaaaaggcgcagctctggagacaggagactgctgcgtgggaggaggtggtgctggaggcccttgggtgagggaagaggcaggagactgctgtgtgggaggaggtggtgctggaggcccttgggtgagggaagaggcaggagactgctgcgtgggaggaggtggtgctggaggcccttgggtgagggaagaggcaggagactgctgtgtgggaggag

SEQ ID NO: 186266 - DNA, 601 bp, Human
acagatctccgcagcagatatgatagcaatgagaaagcttggaacatcatgagcattattgaaacgtgacacagagatatgaagtgggcacctgctgttggaaacgtggtgcccacagacatgcctggtgcagggttgccaaagacctcccgtttgtgaaaagcagtgtctgaagcacagtgaagtgaggcttgcctgcaagacatccacaaaaggcgcagctctggagacaggagactgctgcgtgggaggaggtggtgctggaggcccttgggtgagggaagaggcaggagactgctgygtgggaggaggtggtgctggaggcccttgggtgagggaagaggcaggagactgctgcgtgggaggaggtggtgctggaggcccttgggtgagggaagaggcaggagactgctgtgtgggaggaggtggtggatgagacccttgggtgatggaagaggcaggagactgctgcgtgggaggaggtggtgctggaggcccttgggtgagggaagaggcaggagactgctgcgtgggaggaggtgatgctggaggcccttgggtgagggaagaggcaggagactgctgtgtgggaggaggtggt

SEQ ID NO: 186267 - DNA, 601 bp, Human
tgatgagacccttgggtgatggaagaggcaggagactgctgcgtgggaggaggtggtggatgagacccttgggtgagggaagaggcaggagactgctgtgtgggaggaggtggtgctggaggcccttgggtgagggaagaggcaggagactgctgtgtgggaggaggtggtggatgagacccttgggtgagggaagaggcaggagactgctgtgtgggaggaggtggtgctggaggcccttgggtgagggaagaggcaggagactgctgcgtgggaggaggtggtgctggaggcccttggrtgagggaagaggcaggagaccgctttgtgggaagaggtggtggacgagccccttgggtgatggaagtgttctgacacctgcagtgatggtggcacaactgggcacctttaccaaaaatcactgaattttgtgcccttctcaagggtgcattacctgtgtgaaacgtgcctccgtagaatgctgtgtgtttagggaggggctgggagaccctagcaatgccacgtgctttttacttttcttcaactgagttttgagcattttgttaatgcaagaaaaaggactccttataaagagcggttc

SEQ ID NO: 186268 - DNA, 601 bp, Human
ctcagccgcagtgtggagaggaacagtggtctcggccgagcagcggctgtgggcacctgcgtgtcagcccctccctccgtggacagatgctcctgagcttccccagcaaagacactgggactgtgcgccttgtccccccatcttcccacctccggtgaccaggcctctcccagggaccctctgtgctggcccggcacctgctctgatatgccctccccaggggtgtgggtccgtctgccctccacacagcccttggagcctctcttcacagggcctgagagctgagtgtggtttcataacrtggttcattggcctctgaagatgctcagtgctgggggaattgggcttgaagccatcacgtccaacacacggtccctggaccatgtcctgtagggagtgttaggaggagtctagctctatttttaaatgacagtgttcatgacagaatttctcgtagggaataaaaatgtgtgtgcttcccagttacttattgtgttgcttaattaagaaatctctttagaaacacagacaggagcatgaacttctcagccacttcctgcctggcttctgggtggttctgtgttgcattactggaggtctg

SEQ ID NO: 186269 - DNA, 601 bp, Human
ccgtctgccctccacacagcccttggagcctctcttcacagggcctgagagctgagtgtggtttcataacatggttcattggcctctgaagatgctcagtgctgggggaattgggcttgaagccatcacgtccaacacacggtccctggaccatgtcctgtagggagtgttaggaggagtctagctctatttttaaatgacagtgttcatgacagaatttctcgtagggaataaaaatgtgtgtgcttcccagttacttattgtgttgcttaattaagaaatctctttagaaacacagacrggagcatgaacttctcagccacttcctgcctggcttctgggtggttctgtgttgcattactggaggtctgggtgtggaattttgagaatctcttgatccttttcagtttaattctgaaacagggttcttccttccttccagattacagtgtggacactcacacacagtaagggacaaagaaagtgtatccccttccaaagatccgcccaccaggccccggacccgtaatcaaagcctgatactgggacaatggacccagcggccgggccagccctcccctagttatcaccccagagctgt

SEQ ID NO: 186270 - DNA, 601 bp, Human
agggaataaaaatgtgtgtgcttcccagttacttattgtgttgcttaattaagaaatctctttagaaacacagacaggagcatgaacttctcagccacttcctgcctggcttctgggtggttctgtgttgcattactggaggtctgggtgtggaattttgagaatctcttgatccttttcagtttaattctgaaacagggttcttccttccttccagattacagtgtggacactcacacacagtaagggacaaagaaagtgtatccccttccaaagatccgcccaccaggccccggacccrtaatcaaagcctgatactgggacaatggacccagcggccgggccagccctcccctagttatcaccccagagctgtggctgggctctctttgttccgaaacggagctgatggagcaggacgctgtcgccaggcactgcggggagggggttatcagcccctggcccgcgtcccaccccagaggtgaagtcttcgccccagacaggccctatcaggccctcccagctgctgttattttagatatggcaggaagtagggcctggaaaccgcacggctcccagcccttggcagcagctcagttcc

SEQ ID NO: 186271 - DNA, 601 bp, Human
tgcgagcggccgcgtaaatcaggcaggcgtggccggcaggctgtggctccccacagacatggggctgacggtgtgcagcgctggctggcgcagcctctgccaagggagcccctgccctccggggcagcaccatgaagacctcacccctcaagtggatgggtttgcagttcagcccagtgtctgttcagctggcaccgatgggcccagatgtcctccctggcagtgtctcagcaggcgcacagacgagccctgggccaggggacaaatgtgtgggttcctgacgcacgtcccccggagcccyagaaaggacaccggggttctgcacccccacccgtgatgtgttgcaagaagcctcacgagtcagtaaagaaaaaccttctccctcgccctctgaaatagtaaacgttagtgagcgcattcgcatccgcagtgcttttacgtgagaagttaggttttgggagctttcggaggagctggctgtggagggaaacacgtccgtcacgtggccaccgtcccgcgggaagctgggggccgtcgctctggccgggctccccgcagccgcagtcgccgcgtcaggcggaggatccctgttatgtacttt

SEQ ID NO: 186272 - DNA, 601 bp, Human
gtaaatcaggcaggcgtggccggcaggctgtggctccccacagacatggggctgacggtgtgcagcgctggctggcgcagcctctgccaagggagcccctgccctccggggcagcaccatgaagacctcacccctcaagtggatgggtttgcagttcagcccagtgtctgttcagctggcaccgatgggcccagatgtcctccctggcagtgtctcagcaggcgcacagacgagccctgggccaggggacaaatgtgtgggttcctgacgcacgtcccccggagccctagaaaggacaccrgggttctgcacccccacccgtgatgtgttgcaagaagcctcacgagtcagtaaagaaaaaccttctccctcgccctctgaaatagtaaacgttagtgagcgcattcgcatccgcagtgcttttacgtgagaagttaggttttgggagctttcggaggagctggctgtggagggaaacacgtccgtcacgtggccaccgtcccgcgggaagctgggggccgtcgctctggccgggctccccgcagccgcagtcgccgcgtcaggcggaggatccctgttatgtactttcccttttccacag

SEQ ID NO: 186273 - DNA, 601 bp, Human
aatcaggcaggcgtggccggcaggctgtggctccccacagacatggggctgacggtgtgcagcgctggctggcgcagcctctgccaagggagcccctgccctccggggcagcaccatgaagacctcacccctcaagtggatgggtttgcagttcagcccagtgtctgttcagctggcaccgatgggcccagatgtcctccctggcagtgtctcagcaggcgcacagacgagccctgggccaggggacaaatgtgtgggttcctgacgcacgtcccccggagccctagaaaggacaccgggsttctgcacccccacccgtgatgtgttgcaagaagcctcacgagtcagtaaagaaaaaccttctccctcgccctctgaaatagtaaacgttagtgagcgcattcgcatccgcagtgcttttacgtgagaagttaggttttgggagctttcggaggagctggctgtggagggaaacacgtccgtcacgtggccaccgtcccgcgggaagctgggggccgtcgctctggccgggctccccgcagccgcagtcgccgcgtcaggcggaggatccctgttatgtactttcccttttccacagtag

SEQ ID NO: 186274 - DNA, 601 bp, Human
agccctgggccaggggacaaatgtgtgggttcctgacgcacgtcccccggagccctagaaaggacaccggggttctgcacccccacccgtgatgtgttgcaagaagcctcacgagtcagtaaagaaaaaccttctccctcgccctctgaaatagtaaacgttagtgagcgcattcgcatccgcagtgcttttacgtgagaagttaggttttgggagctttcggaggagctggctgtggagggaaacacgtccgtcacgtggccaccgtcccgcgggaagctgggggccgtcgctctggcckggctccccgcagccgcagtcgccgcgtcaggcggaggatccctgttatgtactttcccttttccacagtagctgctgccagcgggctgtaaactaccgtatatcactcagatttaagaacccaaactttaaaacaaattaaactcttgttgacattgtaataaaaatcagaatggaactgaacagctcagtaaaagtgaacttcaattatttttgtggatttcagattgttttctgggattcccagactcccagtgcagctgagttatttcctcttggcagaaggctggagaaaaaaggt

SEQ ID NO: 186275 - DNA, 601 bp, Human
gaaaaaaggtggagggagggagggacggacggacggagggcgcctggtgggaggaagcctggtcacctggctggagggagggatggacggacagagggtgccgggcaggaggaagcgtcgtcacctggcagttcgctcggcctgaccagcagccacagggcagcggcgtgcgtgtgagggttgggtgagggggcgcatgggcaggtgttttttatgtgttttaatttaagaaaagagctcagaaatgtttgtcagagcctatctgttaattaggtgtttatgctggattaaaagaaaaatkgaaagcactagtctgactgcccctcaaaaatgtgctcgaaggctcataaacgcacggagggtctgaactccctcccctctctctcggtctttctctgtatctctatccctctctctgtctctgtctctcggtctgtctctttctcagtctgtctctctgtctcccttcctccctgtctctgcccctttgtctccctccgtctctgaatctctgtccctctctccatccatctctctccgtctccctcccttcctcgctctgtttctctgtccctctctccatctctccgtccatctctct

SEQ ID NO: 186276 - DNA, 601 bp, Human
gtgagggggcgcatgggcaggtgttttttatgtgttttaatttaagaaaagagctcagaaatgtttgtcagagcctatctgttaattaggtgtttatgctggattaaaagaaaaatggaaagcactagtctgactgcccctcaaaaatgtgctcgaaggctcataaacgcacggagggtctgaactccctcccctctctctcggtctttctctgtatctctatccctctctctgtctctgtctctcggtctgtctctttctcagtctgtctctctgtctcccttcctccctgtctctgccyctttgtctccctccgtctctgaatctctgtccctctctccatccatctctctccgtctccctcccttcctcgctctgtttctctgtccctctctccatctctccgtccatctctctctctctccatctccctccgtgtgtctctgtctctcttatctctctccctctgtctctgcctctctgtctctctctccgtccctccctccctccctttctctctcatggcggccttttcttttgttgctgtgttcactgtgatgtctggttcttttcagctccttttctctgctggagtggacag

SEQ ID NO: 186277 - DNA, 601 bp, Human
ggacagggttgtcggtctccactgccgtgccaggtgtctgtgcttcttgcagtgtcctgtacggagaaagcggagaactagagcattggagagacccgcatggaaggaaacgccattgctgggcagtgttgcagcctccgcagaggtgtgtgggctccggggagagggacgtgctggcccctgtgcagtggcgtggcccgtgtcctttccccgccgtccacttcctgttccccttttctgcacctgtctctagctgccttcaaggcggagctttggcacccacatatgcagatgtccaccrcgcctgccggacgccagctctccaccagccggaactcaccgccacccaccctgggctgccagctcagctggggcccagccactcccccaggtcccccttcactgtaggaggagctgggcctgggatgtggacagtgggcggcgagggggttggccatgcagagggcgtgggaggagaggagagcacgcagatgccggcccggtgatgtttcctcagacgcccgcgcagtgccatgccgtgggcctcacatgcaatgctcccctgcctagaggggcacccctgctcccaggagggtctcaa

SEQ ID NO: 186278 - DNA, 601 bp, Human
aagcgagaagttaaataattcacgtttaaatcacaattccaggtgagatgaatgcggccctacctgatggcacctgcgtggttgccacaggcgtggtggagggctcttgcgtttggatttgaggggcttagaggtcaaaaaacttttcggaggaacagggatgggcctgtctctcttttatttcagcggtcttttctgtttatgtgggaaacgcagtgtcatgaggtttgaaaccctgaggatgagatgcattcccagttgccaggctcggtttccaagtctgctgggtttgggagcggtyggttgatagaatttcttctagaagacagggtgtgggggcacccaggtccttcctgcggaggcgtccctgccctgtgtggccctgggcacagaccccggcatcccctccacggggctcctctgccggggcatcctctgccggggcatcctctgccggggcatcctctgccggggcatcttccgccggggcatcctccgccgggacatcctccaccgggggctcctccgccggggcatcctgctccggggcatcgttcgccggtcttgtcgctgcggtggaagtgtcgtgttcccagccagg

SEQ ID NO: 186279 - DNA, 601 bp, Human
gaggtcaaaaaacttttcggaggaacagggatgggcctgtctctcttttatttcagcggtcttttctgtttatgtgggaaacgcagtgtcatgaggtttgaaaccctgaggatgagatgcattcccagttgccaggctcggtttccaagtctgctgggtttgggagcggttggttgatagaatttcttctagaagacagggtgtgggggcacccaggtccttcctgcggaggcgtccctgccctgtgtggccctgggcacagaccccggcatcccctccacggggctcctctgccggggcatcctctgccggggcatcctctgccggggcatcctctgccggggcatcttccgccggggcatcctccgccgggacatcctccaccgggggctcctccgccggggcatcctgctccggggcatcgttcgccggtcttgtcgctgcggtggaagtgtcgtgttcccagccaggctgggagtggtcgctggcgaggcctggcgtgggcccgcggtgtctgtcagggtgccctgggccagccccgctgattcgatttagagctaacgagagtccaccaacggcaattacaggaacctaatggcct

SEQ ID NO: 186280 - DNA, 601 bp, Human
tacaggaacctaatggccttcctgccgcaccgctccgtggcacccggctcgctgtgatgaattgctcattatgtgcagtgttggaatagcctccacaagattaataattggataatcaatacagaaattcaatcttggggtgtttttttcactccggggtcaatatgtcctgaagattacaaggcccgactctgcctcccccctccccgctgcttccgcgttgggagtttggccagcacctcgccacacgatgggtcatggtgcgttgtctccgtacctccgtgacttttctattctttgyaaacagcaggttctgccgggggtcagtgctgctaacacagacagcagtgactccacggtggcttccgttaagccaggggagggcggcacaggtaatggctgtgagggcaccagggccatggcacagtggcggccgtggagggaagcctcgccgtgcccaggatgtacgtagcctgagctgtggaggggtggagggcaggttcaagaggggctgtgcctcccgccaggacacgtctgcgcccctgagctcctgaggcagtcagggcctggatttccctcccagaggtgctcccctggctgc

SEQ ID NO: 186281 - DNA, 601 bp, Human
gcagggagttgtatctgccatgtttttaaagagcgctttaaaaacggtatcactttcgaacgctcggctctcaataaaaaggagcactgccagtattttaattcctctctcgatacccagaaccaccaccaggctgtgtcaactcccgtcggcgtagagcagctgatgcccgcgggtggactccgggttcagggcactgggaccgctgcagagacgccgtccccggcccccacctgtagggtctgcagggagatgacctgcttcccgtggcggagggcaccttggcctccgcggccagggygtgaggctcccgggtcagcacacggctttctcaaggaccaggcttgaggatctttcccttttctgctcttccacccgcctcccacccaccttcccagatacccgcgtcatcccccgaggcttctgaggactctgggctgtccccaaacctcaaacaaaatgtcactttaaaaactggtacaaaagcacctcttaaagattcaaacgataattcgaaaacatcgtggtggtgagggacacgtgctttcccgccggcgggggcgtggacgtcgtctttcgtgggcagccctagagaagtact

SEQ ID NO: 186282 - DNA, 601 bp, Human
cagcacacggctttctcaaggaccaggcttgaggatctttcccttttctgctcttccacccgcctcccacccaccttcccagatacccgcgtcatcccccgaggcttctgaggactctgggctgtccccaaacctcaaacaaaatgtcactttaaaaactggtacaaaagcacctcttaaagattcaaacgataattcgaaaacatcgtggtggtgagggacacgtgctttcccgccggcgggggcgtggacgtcgtctttcgtgggcagccctagagaagtactcttcaaggcgagtgtscctggggcatgggggccgtttcccttgcagctagctcccggtctcctccctctgacccagggctccccagacattactggggctgcatctgccgggggtgtgtggcctgtgtgctgccgagctccaggtgacacccacggtggttcgtggacactcaccatgaggggaggtgcgtggcgtggtgaagcctgagggtacactggctgtgccatgtgcatgcccacgtccaggacgggccactgtggagcccatggatcctttgtctccctgtgtgctagcctctgtcccttctcggggacg

SEQ ID NO: 186283 - DNA, 601 bp, Human
cacggctttctcaaggaccaggcttgaggatctttcccttttctgctcttccacccgcctcccacccaccttcccagatacccgcgtcatcccccgaggcttctgaggactctgggctgtccccaaacctcaaacaaaatgtcactttaaaaactggtacaaaagcacctcttaaagattcaaacgataattcgaaaacatcgtggtggtgagggacacgtgctttcccgccggcgggggcgtggacgtcgtctttcgtgggcagccctagagaagtactcttcaaggcgagtgtgcctgrggcatgggggccgtttcccttgcagctagctcccggtctcctccctctgacccagggctccccagacattactggggctgcatctgccgggggtgtgtggcctgtgtgctgccgagctccaggtgacacccacggtggttcgtggacactcaccatgaggggaggtgcgtggcgtggtgaagcctgagggtacactggctgtgccatgtgcatgcccacgtccaggacgggccactgtggagcccatggatcctttgtctccctgtgtgctagcctctgtcccttctcggggacgtgtcc

SEQ ID NO: 186284 - DNA, 601 bp, Human
aaggaccaggcttgaggatctttcccttttctgctcttccacccgcctcccacccaccttcccagatacccgcgtcatcccccgaggcttctgaggactctgggctgtccccaaacctcaaacaaaatgtcactttaaaaactggtacaaaagcacctcttaaagattcaaacgataattcgaaaacatcgtggtggtgagggacacgtgctttcccgccggcgggggcgtggacgtcgtctttcgtgggcagccctagagaagtactcttcaaggcgagtgtgcctggggcatgggggcsgtttcccttgcagctagctcccggtctcctccctctgacccagggctccccagacattactggggctgcatctgccgggggtgtgtggcctgtgtgctgccgagctccaggtgacacccacggtggttcgtggacactcaccatgaggggaggtgcgtggcgtggtgaagcctgagggtacactggctgtgccatgtgcatgcccacgtccaggacgggccactgtggagcccatggatcctttgtctccctgtgtgctagcctctgtcccttctcggggacgtgtccccacctgagctg

SEQ ID NO: 186285 - DNA, 601 bp, Human
accagcctgggcaacatagcaagaccctgtctctatacaatttaaaaattagccaggcatggtagcatgcacctgtggtcccacctacttgagagtctgaggagggagtattgcttgaacctgggaggtcgaggctgcagtgagctgagatcattccactgcacaccagcctgggcaacagacagagcaagacgctgattctaaaaataaaatgcaggccaggcacagtggctcacacctgtaatcccagcactttgggaggcaacggcgggcagatcactgtagctcgggagtttgagamcagcgtggccaacatggcgaaaccccatctctactaaaaatacaaaaattagctgggtgtggtggcaggttcctgtaatcccagctactcaggaggctgaggcaggagaatcgcttgaacctggaaggttgcagtgagcagagatcgcgccactgcactcctgcctgggtgacagagcaagactccatctcaaaaaaaaaaaaaaaaaaaagaaggaaggcaagtttcccatcccacaggagtggtggtctccagccacctcctttgggagtccctggcccacaggatacctgcagtggt

SEQ ID NO: 186286 - DNA, 601 bp, Human
ggagaatcgcttgaacctggaaggttgcagtgagcagagatcgcgccactgcactcctgcctgggtgacagagcaagactccatctcaaaaaaaaaaaaaaaaaaaagaaggaaggcaagtttcccatcccacaggagtggtggtctccagccacctcctttgggagtccctggcccacaggatacctgcagtggtggtggtgggtgggtggtggtggtggatgggggctcggagggggctcggctcacacccctgcagcctggccggggaccaggggcgtattggcttctgagttgccartggagcttttgacctcctgctgctacacacttcacatggtgacattctatcctgaccctctctgccaccctacaaagaaggaggccgcctgatcagtgccagttcacaccaagtgcccgtctccccctggaacaggcagaggaagaatcgtgtttctgtagcagagggacaggaggaagcgggacctaccgagacccaacccggtcactctcctcggggtccattcactttatcttcattaaaaggagctttaacatttttattttttaaattctgttaattctgtttgaaatggaattt

SEQ ID NO: 186287 - DNA, 601 bp, Human
taaggaagcaggcagttaaggtaggaaaattattctgtcttaatggctgacgtcccgagtggcggtcccgctccccaccaccagctgcgtccagatgaggggcttgttttatgaaaactgtgacttgtcaggccgtccctccgttgtcccgtcctctccttccaaaaatagcaggccctgtggcggtggcttattgcgatgaaaaagataaaaataagtgaaggctgaaataggtcctggacttgagaacttactttttaatgaaacttgagaagctgttattttccactgctttacaaarcatctttgaaaaatgcagaatcgtaaagaagggttctagagacgctgcgaccctgcgttttcagaatgtggtggctcctcgactgtggagtggcagaaccgcccttgttcttaccccgtttctcagccgagcgccgggcgcccagcagtgtcggacagtttagggtggaccgaggaggccgtggtggaggcttcatgtaggaggttatggaaaatccagatatttgcttgtgaaggaggaaacatttatggtagactttctaagaggttgcttcttctcaaaaaattaaaaaacccacat

SEQ ID NO: 186288 - DNA, 601 bp, Human
ggaaaattattctgtcttaatggctgacgtcccgagtggcggtcccgctccccaccaccagctgcgtccagatgaggggcttgttttatgaaaactgtgacttgtcaggccgtccctccgttgtcccgtcctctccttccaaaaatagcaggccctgtggcggtggcttattgcgatgaaaaagataaaaataagtgaaggctgaaataggtcctggacttgagaacttactttttaatgaaacttgagaagctgttattttccactgctttacaaagcatctttgaaaaatgcagaatcktaaagaagggttctagagacgctgcgaccctgcgttttcagaatgtggtggctcctcgactgtggagtggcagaaccgcccttgttcttaccccgtttctcagccgagcgccgggcgcccagcagtgtcggacagtttagggtggaccgaggaggccgtggtggaggcttcatgtaggaggttatggaaaatccagatatttgcttgtgaaggaggaaacatttatggtagactttctaagaggttgcttcttctcaaaaaattaaaaaacccacatgagaggcggcctcttcagttacc

SEQ ID NO: 186289 - DNA, 601 bp, Human
cgcccagcagtgtcggacagtttagggtggaccgaggaggccgtggtggaggcttcatgtaggaggttatggaaaatccagatatttgcttgtgaaggaggaaacatttatggtagactttctaagaggttgcttcttctcaaaaaattaaaaaacccacatgagaggcggcctcttcagttaccttggcgcacacaccgaagccacctctgcatcagacacgatatacgtacagtggaacaaaagcgttttcctcttcgcttcctattttctgatctctaatttgtggctttaaccatawttttatgtacttagctcatatctactgtaataccttaaatgagagccatacaagtctaaatgtgtatgtcagatggaaaaattgaaagctgtgtattcagcaattcaatgaaaccataaaacagtcagtaaacacatctatcatgcccctttgtaatgaacgccacagccatgaaaatccatatgttcattaaggttttcaaccaccatcaaatggcgttcttactccaagaattattagatattgtcaaagctgagtacagcaaatgtcattgggagacatcttagaagttagttattt

SEQ ID NO: 186290 - DNA, 601 bp, Human
tatggtagactttctaagaggttgcttcttctcaaaaaattaaaaaacccacatgagaggcggcctcttcagttaccttggcgcacacaccgaagccacctctgcatcagacacgatatacgtacagtggaacaaaagcgttttcctcttcgcttcctattttctgatctctaatttgtggctttaaccatatttttatgtacttagctcatatctactgtaataccttaaatgagagccatacaagtctaaatgtgtatgtcagatggaaaaattgaaagctgtgtattcagcaattcartgaaaccataaaacagtcagtaaacacatctatcatgcccctttgtaatgaacgccacagccatgaaaatccatatgttcattaaggttttcaaccaccatcaaatggcgttcttactccaagaattattagatattgtcaaagctgagtacagcaaatgtcattgggagacatcttagaagttagttatttaagaataggatttggcctgagatatttctggttctatctgtgtcctacccaaattattaccctcttaggttacaagactaactttagctaaaggtgtattttctggga

SEQ ID NO: 186291 - DNA, 601 bp, Human
gctggggacaattgcgttcctgctgcaggtttaattacgctgtgtccagtgggacggtgggccttagaagggagcctgctggacggaaagtgaggcggatggggacgctgcgacaggaagaggcaataggaacatgcccccgtaggccgtgggtggcatcacgacggccttttttgtttcctgtattgctttagtgtaaaggaaaatgacaactctaaagaaggagcagtcctgcaggacgttctgatgtctgataattctgaggcctgtgtccttgccaaactgtctggtttgtttagcrgtcatagataaatactcttagacttgaataatcatagcacaattggttgttgattggaactaacataaccattgaaaaagagggaagatgcttttaaatgtgttttgtgcaattaagttagtggtacctatatgaacaaatatgctttttaaaaattgacacaaaaatcgtttatgcaagttatagtcttcatctgtgctacttaaactttttaactgcaaggattaaacagtgtatttgggttagcgtggctgaaccacattgtttattctttaagcccaaatccagttcctaaaaaca

SEQ ID NO: 186292 - DNA, 601 bp, Human
tgcatgtttaaatttttattctcagaacgttgaagggacgcactgcatttcaggatcctgggtctccgtccgtgaaggactttccttctgtgggtctttcctcttgcagcttaaagtgggattattttcactttattcagaggccctgttagtcacagccaagcacagacgtgctcgctgtcgctcctttgctggagtcggaagtaggacagttggtgataaagtcctggacgggcgagataagtggcattggcagagctctgttgtccagacagcaagaaaccggctgcccccaggaagyggggatggagggcacacaccaggagagggggcgttttgaccgtcggcaggggtgccacttggaagtcagatttaaaatggaatcaaaactggtagaatgagggtctgcagggggaaacttgacggagcccatcaggcgacagccttctcgaagcccctccgggcccctcacgggaggggatcccccgctgcgctgccgggaggtccggacgaaatgttggagctggagagtcggcagccctcgcgtggcgttgctgcctctgcagatgcctccggagggactcggtgtgtctcggtgttg

SEQ ID NO: 186293 - DNA, 601 bp, Human
tcggtgttgatttcagaacaggggagatgctgacgtgtcccggtggctctcacagcacagtggaaggcgagtggcagctccgacatcctgctccgctggcgcctctggccacctgcctcccccacccccacataaaaaaagtttaaggcacatttaagctagtaccggagaaatgactgaaaaataagtatagccaagcagcagaagactctgtgtgtgggggggggagggtgcatccaccactaatgtgtgtccgtgtgtgtgggggcatccgctgatgtgtgtgtctgtgtgtgtgtgkggggggcatccactgatgtgtgtgtctgtgtgtcggggggggcatccactgatgtgtgtgtctgtgtgtggttggggggcatccactgatatgtgtgtgtggggggggggcatccactgatgtgtgtgtctgtgtgtgtaggaggggagcatccactgatgtgtgtgtgtgtgggggggcatccactgatgtgtgtgtctgtgtgtgggggggggcatccactgatgtgtgtgtctgtgtatgtgtggggggggcatccactggtgtgtgtgtctgtgtgtgtgtaggaggggagcatcc

SEQ ID NO: 186294 - DNA, 601 bp, Human
gatatgtgtgtgtggggggggggcatccactgatgtgtgtgtctgtgtgtgtaggaggggagcatccactgatgtgtgtgtgtgtgggggggcatccactgatgtgtgtgtctgtgtgtgggggggggcatccactgatgtgtgtgtctgtgtatgtgtggggggggcatccactggtgtgtgtgtctgtgtgtgtgtaggaggggagcatccactggtgtgtgtgtgggagggagcatccactgatgtgtgtgtctgtgtgtgggggggcatccgctgatgtgtgtgtctgtgtgtgtgkgggggggcatccactgatatgtgtgtctgtgtatgggggtgggagcatccactgatgtgtgtccatgtgtgtgtgggggcatccgctgatgtgtgtgtctgtgtgtgtgtggggggcgtctgctgatgtgtgtgtctgtgtgtgtgtgtagggggggagcatccactgatgtgtgtccatgtgtgtgtgggggcatcagctgatatgtgtgtctgtgtgtggggggtggagcatccactgatgtgtgtccatgtgtgtgtgggggcatccgctgatgtgtgtgtctgtgtgtgtgggggg

SEQ ID NO: 186295 - DNA, 601 bp, Human
tgtgtgtggggagggggcgtccactgatgtgtgtgtctgttggggggggccgtctgctgatgtgtgttttgttttgtgtatggggagggggtgtccactgatgtttgtgtctgtgtgtgtgtgggggggtatctgctgatgcgttttgtgtgtgtgggggggggtgtccactgatgtgtgtgtctgggtgtagggggggtggcatctgctgatgtgtgtgttttgtgtgtagaggggtgcgtctactgatgtctgggtgtaggggctggcgcctgctgatgtgtgtgttttgtgtgtggtrgggggtgtccactgatgtttgtgtctctgtgtgtgtgggggggggtgcgtccacggattgtgtctgggtggggggacgtctgctggtgtgtgtgttttgtgtgtgtgttgggggggtgcgtctactgatgtctgtgtgtggagggtatctgctgatgtgttttgtgtggggggggtgcgtccactgatgtgtgtgtctgtggggggtgtctgctgatgtgtgtgttttgcttgtgttaaaaggcgcacaccgcaggaaaggaaagtggcagtaaacacccccgcccccagccttccctca

SEQ ID NO: 186296 - DNA, 601 bp, Human
cgacagctctcttgaggtcggccctcctcccctcccgagagctcagcagccgcagacccaggcagagagagcaaaggaggctgtggtggcccccgacgggaacctgggtggccgggggacacaccgaggaactttccgccccccgacgggctctcccaccgaggctcaggtgctcgtgggcagcaaggggaagccccatggccatgccgcttccctttcaccctcagcgacgcgccctcctgtgcccgcggggaacaagacggctctcggcggccatgcaggcggcctgtcccacgaacasgatggagacctcagacgccgtccccaccctgtcactgtcaccatcacccatcctgtcccctcacgcctccccacatcccatcattactacccctcaggcctccccacgtcccaccgtcgttacccctcagtcctccccacgtcccaccgtcgttacccctcaggcctccccacgtcccaccgtcgttacccctcagtcctccccacgtcccaccgtcgttacccctcagtcctccccacgtcccaccgtcgttacccctcagtcctccccacgtcccaccgtcgttacccctcagtcctc

SEQ ID NO: 186297 - DNA, 601 bp, Human
gggcgggaggccgctgagcaaccagcagcctagggcatttgggtggggacgtgcgacccccacacagaacagagccgtctttctctctgcgttgtgccgaggccccgcagcgccgcccgagtgtcacggaaagtgcctctggtgaggagctgccgtgcgcactctgggacaagtcaggtcctgcgtgccagtccgggagcagcctgcgagcacctgggccctgtcgttatcctccttagtgtttgtgaagagtcacacggaggggcgggagcccgggctccttctggtgccttccacactrggggcggagccctctgcagagagcctggctctgcgtcctgtggctgagtgccaggtcccgtcttgggcagggcccaggatcagcgtggctctgagcagggcctgcggggagcccacgcgtgcctgtgtctttacagaggctgagctcccacacgggacagagtcgggaccttctgtgggcgccatgtcaggaggtgctgctggcggggccgggcatgtggggcacctttgcttgcctgggtctctggccccgcagagccttgggcgagccagcctcgggtgtgtgtttgcagccagggtt

SEQ ID NO: 186298 - DNA, 601 bp, Human
tgtgggggactcagggactctgccatccaaagggaaataaaaatcaggaagagcctgagagggaggctcaggcgacactggtgctgacaccacagaagtgctggtgtggacctgtgggtcgcttggttcgtggagagacagccacagcatcttcccagcatcgcggccggcacctggcacctgcactttggccgtcagagacgtgctggtaccgtgctacggacgagggcggtcactctggcgaccccagctctctgccgaggcagccaggcactggctcacgacactcatggaccagggygggaccgaggaggaaatgtgggttcctggggagatgccttgtcacaggcgtgagcgtcactgatggagaagcagggctgggggcgttgctttgatgtttatggtatttctctaatactttctcaatttttcttttcttacagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaac

SEQ ID NO: 186299 - DNA, 601 bp, Human; identical to SEQ ID NO: 38787

SEQ ID NO: 186300 - DNA, 601 bp, Human; identical to SEQ ID NO: 38788

SEQ ID NO: 186301 - DNA, 601 bp, Human; identical to SEQ ID NO: 38789

SEQ ID NO: 186302 - DNA, 601 bp, Human; identical to SEQ ID NO: 38790

SEQ ID NO: 186303 - DNA, 601 bp, Human; identical to SEQ ID NO: 38791

SEQ ID NO: 186304 - DNA, 601 bp, Human; identical to SEQ ID NO: 38792

SEQ ID NO: 186305 - DNA, 601 bp, Human; identical to SEQ ID NO: 38793

SEQ ID NO: 186306 - DNA, 601 bp, Human; identical to SEQ ID NO: 38794

SEQ ID NO: 186307 - DNA, 601 bp, Human; identical to SEQ ID NO: 39288

SEQ ID NO: 186308 - DNA, 601 bp, Human
taaaatgagcagaaatgagtttgatatatggtatgcttgatacagaaattgaagactttcaagaaaagctttagttataagtaatctgagcttccacatcctataaggtcaattattttgttatcatcaatacttcaaacaacaaaatgctatcattaaatatgacctacccaaatgtataactggaactaaaacttgaaatttacatacataatttagcaaaaggtcatagcatggtcactaagtataatttaaccaattatatagtttttgtgttttcttcaccatactcagtgaccakgtactttatcctttatatttatggctttcaacttatttctctacttaagaatgtcaagttctgactaacattcattaatgcaaaaacttggtaggaacatgaatttcagtagtttcttgaatgtctcaggtctgatcagtgaaaagaaacaaaacatccaggagggatgttttaaattagaacaagaaatattttacaacagagagaatagtacttttactaaacattggacttaattgcaatatgcagtcacttggcctgagaacactaataagtatttgactttttaaaaaatgcaag

SEQ ID NO: 186309 - DNA, 601 bp, Human
acaggctcagaaaggtgtataacttgtccaaaatcatccaactagaaagtgacagaactagatccaaacccagatctacctggttaaaaaaacccacttgcaagacaattcaaatttctacaaagacttcaaagcaacctagaaaacatttatgacaagtaggaaagtgaaaatataaaagtgtttactagattaaaaccacaaaaaagtatgtttgcatgtggacaaacagcaaaaggaaatcattgcgtaagtgcagttgatagcaacattaaaagaaatttatacaatacaacaaagrgtacagaaaaaaatcagtttaagtcggataaaacaaataccagtgtcaactttgtatttttcactatgtaaaatgagcagaaatgagtttgatatatggtatgcttgatacagaaattgaagactttcaagaaaagctttagttataagtaatctgagcttccacatcctataaggtcaattattttgttatcatcaatacttcaaacaacaaaatgctatcattaaatatgacctacccaaatgtataactggaactaaaacttgaaatttacatacataatttagcaaaaggtcatag

SEQ ID NO: 186310 - DNA, 601 bp, Human
gttctgtctttatttaaaattttgtgcctgaggcaagagcctccctcacttcatttgcctcatcctagtctaggacccaaaccaaatttttcctttaagtcttgagctccaatcaatgactggctaaccttatcatagtataatagtaattatctgaactgctgataccatctttctgaaacatgcaacaggcaaaagcattctatattgaatgaatattactgaatataattaatattgaatagtcaaagctttcatactttaagacgaaaagagaaacccaattttgacaacattctaygctcaactttagcctgctgtactatctctaccacattcagtaatcacatatacatttaacaaatatttttcgagcacctactatgtaccacatcaaagttggtgctccaacaataatgaaatgattaagtagaatttttacataggaaaagggggaaacagaacagcactttttggtacgtatctacttatggagttcttaatggggtacattttctcatttaatcctcctattatcactattttgtagatgagaaaacaggctcagaaaggtgtataacttgtccaaaatcatccaact

SEQ ID NO: 186311 - DNA, 601 bp, Human
cttgagctcctatatggcttgtcattgttactagttctgtctttatttaaaattttgtgcctgaggcaagagcctccctcacttcatttgcctcatcctagtctaggacccaaaccaaatttttcctttaagtcttgagctccaatcaatgactggctaaccttatcatagtataatagtaattatctgaactgctgataccatctttctgaaacatgcaacaggcaaaagcattctatattgaatgaatattactgaatataattaatattgaatagtcaaagctttcatactttaagaygaaaagagaaacccaattttgacaacattctacgctcaactttagcctgctgtactatctctaccacattcagtaatcacatatacatttaacaaatatttttcgagcacctactatgtaccacatcaaagttggtgctccaacaataatgaaatgattaagtagaatttttacataggaaaagggggaaacagaacagcactttttggtacgtatctacttatggagttcttaatggggtacattttctcatttaatcctcctattatcactattttgtagatgagaaaacaggctcag

SEQ ID NO: 186312 - DNA, 601 bp, Human
caggtctaggaactaaagttagtggctcttctcatgattacccttaatgatcctgtaacaaatatttgcttctagtcctcgcaacattgggccctattgctttagaggttttctatttccaaagaaagactgcttccatctgagaacacaaggattcccatgaaacaggtaaaaattataaaaagactttaagctcaaggaattcaatgaacatatctaaacattcaaataatatactacttatttgaattcaattaacatatctcagcattcaaatgatatactacttatttgaattcawttaacatatctaaacattcaaataatatactacttatttgaagaatatactagaatttaatagtcacagttttggcaattcactaataatccaaaggtctacaatatatactttatgtgtctatagtaattagtcttccttctggaaaatggttttcaaatgacaggtaaaactgtagtaaatgcagaaacggcatttaacttgtggtgaagttcatatcaacacagaactttctaaagaaatatgattccagagagtgctaaagtctgaataagcatttctgtatgaatttggggattc

SEQ ID NO: 186313 - DNA, 601 bp, Human
ttggctcactgcaacttccacctcccaggttcaatcgattctcctgcctcagcctcccaagtagctggggttacaggtgcctgccaccacacccggctaatttttgtattttttgtagagatgtacagaagccttcctttttttttttttttttttgagatggagtcttgctctgttgcccaggctggagtgcaatggcgggatcttagctcactgcaacctccgcctcccaggttcaagtgattctcctgccttagcctcctgagtagctgggattacaggcatgcaccaccacgcctgrctaatttatgtatttattagagacggggtttcaccatgttggccaggatggtctcgatctcttgacctcgtgatctgcccgccttggcctcccaaagtgctgggattacaggtgtgagccactgtgcccggcctcagcttctttttgtagcttctctcatctttgctcagtgggatcaatgacacgggctttctctcaccaagactgatctgactacagccactactgaaaacctcacagaaacaggtcagtcttgatatggcagaagaagaacacagaacagaagaacaagaagtctta

SEQ ID NO: 186314 - DNA, 601 bp, Human
acactgacacttctccttcaactgataccaatgactagatggacagttgcctatgaccagctgactgagaaaggaaaatattcacaatggtttctagatggttatgcattatatgatgacaccattcaggggtcaacctgaaagtgggtttgggaagaacttcaagcactggacctgaaagaagacagaaccagaagtgtggatttgcactgattatgagctaatgtgtgaatgccattcagccttttttttttttttttttttttttgagaccgagtcttgctctgtcaccaggctacartgcagtggtgtgatcttggctcactgcaacttccacctcccaggttcaatcgattctcctgcctcagcctcccaagtagctggggttacaggtgcctgccaccacacccggctaatttttgtattttttgtagagatgtacagaagccttcctttttttttttttttttttgagatggagtcttgctctgttgcccaggctggagtgcaatggcgggatcttagctcactgcaacctccgcctcccaggttcaagtgattctcctgccttagcctcctgagtagctgggattacaggcat

SEQ ID NO: 186315 - DNA, 601 bp, Human
aacactttgtcttaccacactgacacttctccttcaactgataccaatgactagatggacagttgcctatgaccagctgactgagaaaggaaaatattcacaatggtttctagatggttatgcattatatgatgacaccattcaggggtcaacctgaaagtgggtttgggaagaacttcaagcactggacctgaaagaagacagaaccagaagtgtggatttgcactgattatgagctaatgtgtgaatgccattcagccttttttttttttttttttttttttgagaccgagtcttgctytgtcaccaggctacagtgcagtggtgtgatcttggctcactgcaacttccacctcccaggttcaatcgattctcctgcctcagcctcccaagtagctggggttacaggtgcctgccaccacacccggctaatttttgtattttttgtagagatgtacagaagccttcctttttttttttttttttttgagatggagtcttgctctgttgcccaggctggagtgcaatggcgggatcttagctcactgcaacctccgcctcccaggttcaagtgattctcctgccttagcctcctgagtag

SEQ ID NO: 186316 - DNA, 601 bp, Human
gagttgctggtccctgaatgcttgatcactattattatacagtgatctgagagactgaatgctttatcactattattgtacagcctaagcaaataacaccaccataacctgacccatcatctgacccatcaagccacacaactgggaacgcacagcagctctccatcattgagtggaagtagcatatatgagatcagcttgagaaggacctaaaggtacaaacaagttgtataagaagtggctcagactcagaaaacactttgtcttaccacactgacacttctccttcaactgataccartgactagatggacagttgcctatgaccagctgactgagaaaggaaaatattcacaatggtttctagatggttatgcattatatgatgacaccattcaggggtcaacctgaaagtgggtttgggaagaacttcaagcactggacctgaaagaagacagaaccagaagtgtggatttgcactgattatgagctaatgtgtgaatgccattcagccttttttttttttttttttttttttgagaccgagtcttgctctgtcaccaggctacagtgcagtggtgtgatcttggctcactgcaac

SEQ ID NO: 186317 - DNA, 601 bp, Human
catgatctaaaagggagtgtggggagagttaatgactgcagattctgtcttagatgtagtcagaataggaaagaacactgaaaagggggaattattgggaaactattttgcctgcatttgtactactgatatacaacagaaggctggagaaggtatattatccctacaggtgccttctttttttttttttttgagatggagtctggctctgtcgccaggctggagtgcagtggcgcaatcttggctcactgcaacctccacctccctggtggtctcgaactcctgatctcgtgatccgccygcctcggcctcccaaagtgctgggattaccggcgtgagccacagtgcctggacaggtgccttcttagttctaatttctgaatttaattttgtttctcaatctatttcaaaacaaccagacttgtttaggtaacacctattcctttttatttcttccttcttttcccccagagtgtagcactcttgtgctacttccttagagttgctggtccctgaatgcttgatcactattattatacagtgatctgagagactgaatgctttatcactattattgtacagcctaagcaaataacaccac

SEQ ID NO: 186318 - DNA, 601 bp, Human
aaaagtgaaacaaaaaatgctatagtatatatgaattctagaataagcactgtaaccactaagtgctgggaggcacagtaagctaaggaagcaaaacatgatctaaaagggagtgtggggagagttaatgactgcagattctgtcttagatgtagtcagaataggaaagaacactgaaaagggggaattattgggaaactattttgcctgcatttgtactactgatatacaacagaaggctggagaaggtatattatccctacaggtgccttctttttttttttttttgagatggagtctrgctctgtcgccaggctggagtgcagtggcgcaatcttggctcactgcaacctccacctccctggtggtctcgaactcctgatctcgtgatccgcctgcctcggcctcccaaagtgctgggattaccggcgtgagccacagtgcctggacaggtgccttcttagttctaatttctgaatttaattttgtttctcaatctatttcaaaacaaccagacttgtttaggtaacacctattcctttttatttcttccttcttttcccccagagtgtagcactcttgtgctacttccttagagttg

SEQ ID NO: 186319 - DNA, 601 bp, Human
tactatactttgaaaatttccacaataaaaagtgaaacaaaaaatgctatagtatatatgaattctagaataagcactgtaaccactaagtgctgggaggcacagtaagctaaggaagcaaaacatgatctaaaagggagtgtggggagagttaatgactgcagattctgtcttagatgtagtcagaataggaaagaacactgaaaagggggaattattgggaaactattttgcctgcatttgtactactgatatacaacagaaggctggagaaggtatattatccctacaggtgccttctttttttttttttttgagatggagtctggctctgtcgccaggctggagtgcagtggcgcaatcttggctcactgcaacctccacctccctggtggtctcgaactcctgatctcgtgatccgcctgcctcggcctcccaaagtgctgggattaccggcgtgagccacagtgcctggacaggtgccttcttagttctaatttctgaatttaattttgtttctcaatctatttcaaaacaaccagacttgtttaggtaacacctattcctttttatttcttccttcttttcccccagagtgtag

SEQ ID NO: 186320 - DNA, 601 bp, Human
gacagaggaacatgttaaaaaacaaggaaatgcaattagcaaaatccatacagtgggaaagtctacagaagaaatgatccagtgtctttgtcaaaaaattgcagagacagaattaatcacactggtaattgttgaagctgagtgacaggtacacaggattcattatactatactttgaaaatttccacaataaaaagtgaaacaaaaaatgctatagtatatatgaattctagaataagcactgtaaccactaagtgctgggaggcacagtaagctaaggaagcaaaacatgatctaaaagggagtgtggggagagttaatgactgcagattctgtcttagatgtagtcagaataggaaagaacactgaaaagggggaattattgggaaactattttgcctgcatttgtactactgatatacaacagaaggctggagaaggtatattatccctacaggtgccttctttttttttttttttgagatggagtctggctctgtcgccaggctggagtgcagtggcgcaatcttggctcactgcaacctccacctccctggtggtctcgaactcctgatctcgtgatccgcctgcctcggcctcc

SEQ ID NO: 186321 - DNA, 601 bp, Human
aatttattttataaactgtaccttaaagggaaagagtcaaatacacccacccccgctacacgcacagacactggtactgtctcttaaggcaaacaaacaaacaaaaattgatgaagggaagtttctttttatagaagtattctggctaagagaaacaaatgaaggaatgacagatcataaattttttctcctccaattaatatgttgaggcagtattcacatatctgataatatcacaaaaggagaaacaatcagacttatttatctaatgattgcatagaacattatggagtagtcctgytaaaggaaagaaaggaagaaaataaaaatctgaactgaatctgattaagactctatatcttactaccaagtttcaggaaacacaagggacagaggaacatgttaaaaaacaaggaaatgcaattagcaaaatccatacagtgggaaagtctacagaagaaatgatccagtgtctttgtcaaaaaattgcagagacagaattaatcacactggtaattgttgaagctgagtgacaggtacacaggattcattatactatactttgaaaatttccacaataaaaagtgaaacaaaaaatgct

SEQ ID NO: 186322 - DNA, 601 bp, Human
atattttgaaaatgatgtatgtaatggagctattttattttttaagagttaagaatcataaactgtggaatgaaatatataaagcatttcagatgtacaaatatataaaacatctagtaaaacaatgcatttacaaacattaaacattaagataaattgctatattaaatacaattagttttcaaaaataaaactaagctacgaaaaacaaaaataatgagaatgaattatttaatctttgatatggtttggctctgtgtccccacccaaatctcatcttgaattgtaatccccacatgtygagggagggagctggtgggacgcaattggatcatggggtcagtctccgcaatgctgttgtcatgatagtgagtgagttctcttcaaagtgtttagcagttcccccctcacttgctgtatctcctgctgccatgtaagatgtgccttgcttccccttcgccttctgccgtggttcctgaggcctccatagccatgtggaactgtgactcaattaaatttcttttctttataaattacccagtctcaggtagttctttatagcagtgtgaaaaaggactaatacagaaaattggtaccagga

SEQ ID NO: 186323 - DNA, 601 bp, Human; identical to SEQ ID NO: 39289

SEQ ID NO: 186324 - DNA, 601 bp, Human; identical to SEQ ID NO: 39290

SEQ ID NO: 186325 - DNA, 601 bp, Human; identical to SEQ ID NO: 39291

SEQ ID NO: 186326 - DNA, 601 bp, Human
aattctttttctggagaaatcagagcaacactccaaaaaggaaaggttaaaactgagctctctgaaatacctattcagtgtgtttaactgatgaactaagaacggtgaagtcagaagtgtaacttaattatcttaagagatagatgttctttgcaattaattccattcagctcttgctcagaccccaacgcaatataaagctgtccgcacagtcttcagccttctcttaacccgaaaggagttatctctaacccgatccatcgactggaataaagtaacagtgaccacagcggcggacgakgatggatgaaattacaattgaactaggagtcaggacagatgtgtacaccctaacaggagagactgaggtggggctggaaactattttctggccttctcccgcgtgctgctcccggggaaccaacaggaccctgcacgcccggattcggcagagcccttgcccccgaggtggagtggggagaagtcagcgggaagccttttcagggaatcgagtaggacaagggctggcgcggtgggaatctcgccggtgagagaacttcctaaccccgggttgagggggcggggggaaggaccgtcccgg

SEQ ID NO: 186327 - DNA, 601 bp, Human
taaattgtggtatcactggtaaagtggggaaaaaaaaaaggaacaacatctcatatcagaaacacaaaaaggccctcttgttcccttaatattttaataagctttaaattttctaattacaaaagtaaatctcaacattttctttaactgctgctcacttttcaggctaaaatcccttttatgttcttcaaaagaaattttactttctaggaaccttataaatcatttaccatacatcattcaaatctcctccatactctatctagaatacagttaacagtgcttgtttaatactttctgcctgataaccacctagaattttgtggaatgtgctgcccaccttcatattctcccaaggatatggatataatttagattctgaactcaaggaagggtttatgttaagcaattaattcaattttattcaacacattttatgtaatcaaacttgactttgtaagaagtaattggtatctggtttagatttttccctcatgttccagttacttctacaacctttctaaaattggaatttcttgtctacccttaaaccagttattaagtgctactgaacattccataaaattcatgggaaaagatt

SEQ ID NO: 186328 - DNA, 601 bp, Human
taaaataaaacccaaactctttaccatggattctaaatcctagagtttctaagtattgctctaatctcatcctgtcactctcccttacaaccattatgttccagttacagtgtttttagtaatttatctgcaacataccagctctttcctgatcctgggcctttcatgcattgttctcatatgtaaagctttcttacccaaccataacacagttagctatgctttaggtctcataaacgtcccttcatgaaaaagtcttcccctaattactctgtgcctgttactcactatctctgccccrtgtctgtttctttgagagcacttattacaacttattcattagactataagctccatgagggcagaaactatgtgcatcaggttttatctaacacagtgctagacataagcaagggctcaataaatatttgctaaatgaactaagtgaagagacagccagggttaggctacaatcctgactctactacttcatactggtttgacttcagttaagtcacaatatttctgtgtttcaatgttctcttccataaaacaaaagaaagagtacatatctgacaggattgccaaataagacctacta

SEQ ID NO: 186329 - DNA, 601 bp, Human
ctcttagcaaaactttcacaagcaataataatttcacgaaacaattctacttcaaaatatatcagatacaaagattattcttatgttttctccaatatatgtaaaaagatgccttaactattaatgaaattaagtcagattatgaaaggtttactcacttatatttgaaaaagtaaattccaactactaaacatcctattgtgctccatttaatcctaatattaaaagattggcatcatttttaatttctctaaaaactgaaatgtaagtgaattaaaggtaggtatcaagttagtctcaytcaatgacaaaacatgagcataaaacaatttcacatcttcaccaaactgataccagcaagtaaatgagttattaactatttaagaggaaaactagaaaactcttttgtcagttttatttactttgaagttttgggacctactaaagttatatcttctgtaaagctacacaataaaaaaaaaagataaaagctcaatttttccaaatctgctctgaaattcaccaatcttttaatacattcttgcctctaccaaagacaatctgatttctaaagcaatctttattgatagcttagcagaaa

SEQ ID NO: 186330 - DNA, 601 bp, Human
gcctgggcgacagagcaagactccgtttcaaaaaaaaaacaaaacaaacaaacaaaaaattaatctaaatctataaagaacttaaaacacatttacaagaaaaaaacccattgaaaactgggtaaaggacatgaacacttttcaaaaaaagacatacatacagccaacaatcatatgaaatatagctcaacatcaccaatcagagaaatgcaaatcaaaaccacaatgagataccatctcacaccagtcagaatggctaattattaaaaggtcaaaaaaataacaaatgcttgcgaggttrtggtgaaaaaggaatgcttgtacactgttgggagaagtgtaattagttcaatcattgtggaagacaacgtggcgactcctcaaagacctaaaaacagaaatatcattgacccagcaatcccattactgggaatacacccaaaggaatataaattgttctattataaagacacatgcatgtgttatgttccttgtagcactgattcacaataacaaagacatggaattaacctaaatgcccatcaatgacagactggataaagaaaacgtggtacacatataccatagaatactatgtagt

SEQ ID NO: 186331 - DNA, 601 bp, Human
gggagaaaatttttgcaaactacgcatctgacaaagattcataatttgcaaaatatccagcatctattaagaactaatctaggctgggtgcggtggctcacgcctgtaatcccagcactttgggaggcccaggcaggtggatcacgaggtcaggagattgagaccatcaggactaacacagtgaaaccctgtctctactaaaaaaaaaaaaaaaaaaaaaaaaaaattagccgggcatggtggtgggtgcttgtagtcccagctactcgggaggctgaggcaggagaatggcatgaacccrcgaggcggggcttgcagagagccaagattgtgccactgcactccagcctgggcgacagagcaagactccgtttcaaaaaaaaaacaaaacaaacaaacaaaaaattaatctaaatctataaagaacttaaaacacatttacaagaaaaaaacccattgaaaactgggtaaaggacatgaacacttttcaaaaaaagacatacatacagccaacaatcatatgaaatatagctcaacatcaccaatcagagaaatgcaaatcaaaaccacaatgagataccatctcacaccagtcagaatg

SEQ ID NO: 186332 - DNA, 601 bp, Human
caaatgcaaaaattgacaaatggaatctaattaaactgacgagcttctgtccagcaaaggaaacggtcaacagagtgaataggctacctacagaatgggagaaaatttttgcaaactacgcatctgacaaagattcataatttgcaaaatatccagcatctattaagaactaatctaggctgggtgcggtggctcacgcctgtaatcccagcactttgggaggcccaggcaggtggatcacgaggtcaggagattgagaccatcaggactaacacagtgaaaccctgtctctactaaaaataaaaaaaaaaaaaaaaaaaaattagccgggcatggtggtgggtgcttgtagtcccagctactcgggaggctgaggcaggagaatggcatgaacccgcgaggcggggcttgcagagagccaagattgtgccactgcactccagcctgggcgacagagcaagactccgtttcaaaaaaaaaacaaaacaaacaaacaaaaaattaatctaaatctataaagaacttaaaacacatttacaagaaaaaaacccattgaaaactgggtaaaggacatgaacacttttcaaaaaaagacatacat

SEQ ID NO: 186333 - DNA, 601 bp, Human
ccacatgattatcttgacagatgcagaaagggcttttgatgaaactccacaccccttcatattaaaaactctcagtaaacaaggtattaagaaatatacctcaaaataataagagccgtctatgacaaacaaacccacaaccaacatcataatgaatgggcaaaagctggaagcatgacccctgaaaaccgacacaagacaaggatgccctctctcaccactgctattcaacatagtactggaagtctcggttagggtaatcaagcaaaagaaataaataaagcgcatctaaataggaagrgaggatgtcaaattatccctgtttgcaaatgacatgatcctatatgtagaaaaccccatagtctcgggcccaaagcttcttaagctggtaactacttcagcaaattcacaggatataaaatcaatgtgcaaatatcactaacattcctatacaccaacaacagtcaagctgaagccaaatcaggaatgtaattccattcacaactgccataaaaagaataaaatacccaggaacacagctaaccagggaggtgaaagatctctagaaggagaactataaaactacgcttacagaaatcag

SEQ ID NO: 186334 - DNA, 601 bp, Human
cagaggaaagaatctcagagcttgaagactggcgttctgaaacaagatagtcagacaagaacagaaaaaagaatgaataggaacaaacaaaacctctgagaaataagggattatgtaaagagatcaaatccacaactcattggtgtctctgaaagagatggggaaaatggaaccaacttggtaaacatatttcaggatatcatccatgagaacttccccaacctagctagagaagccaacgttcaaattgagaaaatgcagagaactcaagtaagacatttcaaaagatcatccccaaggygtgtaatcatcagattctccaaggtcaaaatgaaagaaaaaatattaaaggtagctagagagaaaaagcaggtcacctacaaagggaagtccatcagactaacagcacacctctcagcagcaactctacaagccagaagagactgggggccaatattcaaaattcttaaagaaattccagcccagaatttcatatcttgccaaagcgtcataagcaaaggagaaataagatccttttcagacatgcgaatgctgaaggaattcgttaccaccagacgtgctgtgcaagggctcctgaatg

SEQ ID NO: 186335 - DNA, 601 bp, Human
tatgttttacatataaatctgaccctatggtaattgcaaaaactaagacaatgccactattctcaaaaaatttttgtttctgttggaaaatatagttgtcatcttacatatttttatttaacatgttatttacggtaatatgtaataggtttcttattgtcattttaaatgaattaatgttttaataattactcaattttaattcctaatattcttaaaaacatatatagctcctatacaaaaaccattctttggattcctcaataactgtggagtcctgcgacccgaaagtttggaaacygctgctaaacagaattatcttatgctaatataccataatttattcatctattctattgctgatggccatagggttgtttctagtctgggattataaccaataaggatgctatgaatattcttgtacatgtcttttgtcacacattatatacctgttgagttcatatctagaggcagaattcctgggccacaggacatgtttacatacagctttaatagacactgttttccaagtggctttcagcatttaaaatgtggttagttgaattgagatgggctgtaagtataaaatttacaacgg

SEQ ID NO: 186336 - DNA, 601 bp, Human
tagcaaggtggtatgccctatgaatgaatgcaaaaatgattcaacattaggaatcacataaatgtaatttactccatttatagatagatgaattcatttattcaacaagtattgtctggcattatactaaatatgttttacatataaatctgaccctatggtaattgcaaaaactaagacaatgccactattctcaaaaaatttttgtttctgttggaaaatatagttgtcatcttacatatttttatttaacatgttatttacggtaatatgtaataggtttcttattgtcattttaaaygaattaatgttttaataattactcaattttaattcctaatattcttaaaaacatatatagctcctatacaaaaaccattctttggattcctcaataactgtggagtcctgcgacccgaaagtttggaaactgctgctaaacagaattatcttatgctaatataccataatttattcatctattctattgctgatggccatagggttgtttctagtctgggattataaccaataaggatgctatgaatattcttgtacatgtcttttgtcacacattatatacctgttgagttcatatcta

SEQ ID NO: 186337 - DNA, 601 bp, Human
aataggtgaactgataaactgtggtatatccataaaatggcaaggaataaaactagtgattgatgcaacaatgtgcatgaatctccaagatattatgctgagtaaaagcagtcagtctcaaatggttatgtgttggacaattccatttatatgacattcttaaaaagacaaaactatggttaggaacatctcagtggctatcacagattatgggtgaggacatggttgtgactataaaggaagagcaggcaagagttttctgggggtgatgaactgttctacatcctgattttagtggcasctacatgaatgtgtacatgtgttaacagtcacataactgcaccagaaaaaaagagagtcagttttactgtataatgtataaaacaaaatttaaaaataaacaaccagctaaaaaatcaacaaaataaagaaatagtgaaagaaaattaataaaacagaaaacaaggaaagcagtacagcatgaaaccaagagctggttctttgagaagaacgtctaaaataaagaaacctttgataagtctgttcaagaaaagaatgacagacaagagacagatgggtattaggaatgactatggtgata

SEQ ID NO: 186338 - DNA, 601 bp, Human
acttttcctttgccaatggcactgtctagagaaaaaaaagacaagctacagattcagaggggggaaaaatatataagaactcccaaaactcaacagcaaaaaaccaccaacccaattaaaaatgagtaatgaactcaagcatttcacacaagatggcaaagaagtatatgagaagatgttcaatatcattagccattaaaaaatacaaatgcaaaccagacgagctaccaccatatcccttctagaatgacaaaaataaaaatattaacaataccaagtactgacaaagatgcagagcaaytgaaacactcccacactgctagtcagaatgcaaactgatatagtcactctggaaaacggtttggtagtttctgaaaaagttaagcatgtatgtgtaacttaggacccagcaattcttctcctaagtatttatcctaaagcaggagtccctaacccccaggctgcagaccagtaatgggccgtggcctattaggaagtgggcagcacagcagcaagtgagtggtgggtgagcaagcactaccacctgataaggtctgcctatgtccccacccaaaatctcatcttgaattataatccccat

SEQ ID NO: 186339 - DNA, 601 bp, Human
taatgaaaaagacagacaataaagtgttggcaaggatgtggagagactggaaccctcacatactgctagtgggaatgtaaaatagtgctgccctttggaaaagagtttggagttcctcaaaaaggtaaacacagaattactatatgagtcagtaattccactcctctgtatatacccaagagaactgaaactatgtgtccacacaaaaactttcacacaaatattcatagcattattcataatagtcccaaagtgcaaattactcaaatgtctgtcaactaatgaacagatacacaaagtrgaatatccatacaatggaatttttgggaataaagtactgagccatgttacagtcatgctatgacatgaataagccatgaaaacattatgctagatgaaagaagccagacacaaaagaccaaatattgtatgatttcatttatatgaatgcccagaataggcaaatccatagtgacagaaagttgatttgtagtttccaggggctagagagtaggaagaatgggtagtgattgttaataggtacagagtttccttttgggccaatgcaaatattttggaattagatagtggtgacagttgt

SEQ ID NO: 186340 - DNA, 601 bp, Human
aaaacagctgtaatgaaaaagacagacaataaagtgttggcaaggatgtggagagactggaaccctcacatactgctagtgggaatgtaaaatagtgctgccctttggaaaagagtttggagttcctcaaaaaggtaaacacagaattactatatgagtcagtaattccactcctctgtatatacccaagagaactgaaactatgtgtccacacaaaaactttcacacaaatattcatagcattattcataatagtcccaaagtgcaaattactcaaatgtctgtcaactaatgaacagayacacaaagtagaatatccatacaatggaatttttgggaataaagtactgagccatgttacagtcatgctatgacatgaataagccatgaaaacattatgctagatgaaagaagccagacacaaaagaccaaatattgtatgatttcatttatatgaatgcccagaataggcaaatccatagtgacagaaagttgatttgtagtttccaggggctagagagtaggaagaatgggtagtgattgttaataggtacagagtttccttttgggccaatgcaaatattttggaattagatagtgg

SEQ ID NO: 186341 - DNA, 601 bp, Human
gcagaggccataatcaaaaagtagagtttccttagtagtatcttcaatacgttatttaattttttattgtcccaaagaagaaaaggcccttaattattattgtttaaacaaagttatagatcactgtttgatgtaaataataagagtgaatattttcaaatataaaatagcacaagcggctggtgataaaatgtgaaattatgggtaacctccttggctgtgatcttatgtatgtaaagcaaaatgtaaatatataattatatactgattacaaaatccgtaataaatgtcattttatttaaaaaaaaaacaaaaatgacaggacaaaaaaagtggtaagagagcaggaaaattaaaggtgtttacaaataaaaacaaggatatccactcttgccacttccattcaacaccataccagaggttttggccaggagaattaggtaaggaaaaaaagccatttagattggaaggtgtattagtctgttttcatgctgctgataaagacacacctgagactgggaagaaaaagaggtttaattggatttagttccacatggctgtggagacctcagaatcatggcgggaggcaaaaggcacttct

SEQ ID NO: 186342 - DNA, 601 bp, Human
aaaatatatacaacccaggccgggcgcggtggctcacgcctgtaatcccagcactttgggaggccaaggcgggtggatcaacgaggtcaggagatcaagaccaccctggctaacacagtgaaactccgtctttactaaaaatacaaaaaaattagccaggtgtggtggtgggcgcctgtagtcccagctactcgggaggctgaggcaggagagtggcgtgaactcgggaggcagagcttgcagtgaaccgagatcgcaccactgcactccagcctcggcgacagagcaagactccatctcaaaaaaaaaaaaaaatacacacacacacaccccatacatgttacttggttgtgggggaagaatggaaagacggagggggagaaaggctggggcagggagagagagggagagggggcgacggggagagggggagatgcggggagagggagaggacgcagcaaaataaaattcagcctgattaaagacttcaaaaaaaatggcaggtcattggcttgttggcactgtcatagtgggtgtgctgaagaccactggccttgtgggattggctatatgcaagagtccataagagaggctgagaata

SEQ ID NO: 186343 - DNA, 601 bp, Human
aacagttttagctgtgtacccataaaaatatatacaacccaggccgggcgcggtggctcacgcctgtaatcccagcactttgggaggccaaggcgggtggatcaacgaggtcaggagatcaagaccaccctggctaacacagtgaaactccgtctttactaaaaatacaaaaaaattagccaggtgtggtggtgggcgcctgtagtcccagctactcgggaggctgaggcaggagagtggcgtgaactcgggaggcagagcttgcagtgaaccgagatcgcaccactgcactccagcctcrgcgacagagcaagactccatctcaaaaaaaaaaaaaaatacacacacacacaccccatacatgttacttggttgtgggggaagaatggaaagacggagggggagaaaggctggggcagggagagagagggagagggggcgacggggagagggggagatgcggggagagggagaggacgcagcaaaataaaattcagcctgattaaagacttcaaaaaaaatggcaggtcattggcttgttggcactgtcatagtgggtgtgctgaagaccactggccttgtgggattggctatatgcaag

SEQ ID NO: 186344 - DNA, 601 bp, Human
gcttctaagaggacaactctttggtatgagaaccaaaatgtttaacgtaaaagttacaaaaggataaaataacatacacagaattctgaaagaaaatattgaagcctggaattccatatccagccaaaccattactcaaacgtgagggcaaaataaaaaaaacagttttagctgtgtacccataaaaatatatacaacccaggccgggcgcggtggctcacgcctgtaatcccagcactttgggaggccaaggcgggtggatcaacgaggtcaggagatcaagaccaccctggctaacacrgtgaaactccgtctttactaaaaatacaaaaaaattagccaggtgtggtggtgggcgcctgtagtcccagctactcgggaggctgaggcaggagagtggcgtgaactcgggaggcagagcttgcagtgaaccgagatcgcaccactgcactccagcctcggcgacagagcaagactccatctcaaaaaaaaaaaaaaatacacacacacacaccccatacatgttacttggttgtgggggaagaatggaaagacggagggggagaaaggctggggcagggagagagagggagagggggcg

SEQ ID NO: 186345 - DNA, 601 bp, Human
aaaaaagaaaattaggctgggtgcagtggctcacacctgtaattccagcactttgggaggccgaggcgggcagatcacttgaggtcaggagtttgaggccagccttgccaacacggtgaaaccctatctctaccaaaaaaatccaaaaattagctgggcatggtggcacacgcctgtagtcccagctactagggaggctgaggcagaagaatcacttgaacctgggaagtcgaggttgcagtgagcctagatcgcaccactgcactccagcctgggtaacagagtgagactctgtcaaagaaaaaaaaaaaatcataaatagacgtattacagacaaattataatttagaagactaaactgaagaatctttaaattatagaataaaaagataaggatattaaaacctaagagacaaaaaaaagctaggtacttctattaagtgtaatataatattcacttaatagttctaaatggatgaaaccttcaggataaaatggatttaaaacacatatacaagtgtagacatatatatgtgcacacatatccataataaatacatatgtgtgcatatatccacacaactagacatatacacacaat

SEQ ID NO: 186346 - DNA, 601 bp, Human
agggagtaatcaggggagataagaaagacacaaatcagcaccgcatagctaactaaaaaaacaaaactatcattatgaaaaaaaaaagaaaattaggctgggtgcagtggctcacacctgtaattccagcactttgggaggccgaggcgggcagatcacttgaggtcaggagtttgaggccagccttgccaacacggtgaaaccctatctctaccaaaaaaatccaaaaattagctgggcatggtggcacacgcctgtagtcccagctactagggaggctgaggcagaagaatcacttgarcctgggaagtcgaggttgcagtgagcctagatcgcaccactgcactccagcctgggtaacagagtgagactctgtcaaagaaaaaaaaaaaatcataaatagacgtattacagacaaattataatttagaagactaaactgaagaatctttaaattatagaataaaaagataaggatattaaaacctaagagacaaaaaaaagctaggtacttctattaagtgtaatataatattcacttaatagttctaaatggatgaaaccttcaggataaaatggatttaaaacacatatacaagtg

SEQ ID NO: 186347 - DNA, 601 bp, Human
aaaggacctacaattcttatattctcaggtgtagggatgagagtaggggacagggcagggagggagtaatcaggggagataagaaagacacaaatcagcaccgcatagctaactaaaaaaacaaaactatcattatgaaaaaaaaaagaaaattaggctgggtgcagtggctcacacctgtaattccagcactttgggaggccgaggcgggcagatcacttgaggtcaggagtttgaggccagccttgccaacacggtgaaaccctatctctaccaaaaaaatccaaaaattagctgggcrtggtggcacacgcctgtagtcccagctactagggaggctgaggcagaagaatcacttgaacctgggaagtcgaggttgcagtgagcctagatcgcaccactgcactccagcctgggtaacagagtgagactctgtcaaagaaaaaaaaaaaatcataaatagacgtattacagacaaattataatttagaagactaaactgaagaatctttaaattatagaataaaaagataaggatattaaaacctaagagacaaaaaaaagctaggtacttctattaagtgtaatataatattcactt

SEQ ID NO: 186348 - DNA, 601 bp, Human
ctagaggtcataaatgagcttttagacattctagaatcgcgcattatgtacaaaattttctgtgaatgtgcgcaggggcattactttctgaggaaaggacctacaattcttatattctcaggtgtagggatgagagtaggggacagggcagggagggagtaatcaggggagataagaaagacacaaatcagcaccgcatagctaactaaaaaaacaaaactatcattatgaaaaaaaaaagaaaattaggctgggtgcagtggctcacacctgtaattccagcactttgggaggccgaggygggcagatcacttgaggtcaggagtttgaggccagccttgccaacacggtgaaaccctatctctaccaaaaaaatccaaaaattagctgggcatggtggcacacgcctgtagtcccagctactagggaggctgaggcagaagaatcacttgaacctgggaagtcgaggttgcagtgagcctagatcgcaccactgcactccagcctgggtaacagagtgagactctgtcaaagaaaaaaaaaaaatcataaatagacgtattacagacaaattataatttagaagactaaactgaagaat

SEQ ID NO: 186349 - DNA, 601 bp, Human
aatgtagctgtttctataagagcactttgaaaagcaaggatctagaggtcataaatgagcttttagacattctagaatcgcgcattatgtacaaaattttctgtgaatgtgcgcaggggcattactttctgaggaaaggacctacaattcttatattctcaggtgtagggatgagagtaggggacagggcagggagggagtaatcaggggagataagaaagacacaaatcagcaccgcatagctaactaaaaaaacaaaactatcattatgaaaaaaaaaagaaaattaggctgggtgcartggctcacacctgtaattccagcactttgggaggccgaggcgggcagatcacttgaggtcaggagtttgaggccagccttgccaacacggtgaaaccctatctctaccaaaaaaatccaaaaattagctgggcatggtggcacacgcctgtagtcccagctactagggaggctgaggcagaagaatcacttgaacctgggaagtcgaggttgcagtgagcctagatcgcaccactgcactccagcctgggtaacagagtgagactctgtcaaagaaaaaaaaaaaatcataaatagacgt

SEQ ID NO: 186350 - DNA, 601 bp, Human
tgcagcacaaaagcagctacagacaatatgtaaattattcagagtggctgtgtttaaaaaacaaaacaaaacaacgttatttgaaaacagtcattaggtagaatttgactgaaaggccgtgttttgccaaaccctgctacagaagcttgatcttaatttgacacaggctcaacatttttggctggaaaacttcagagcttatgctgtatgtttcatacgtatgacagaagaagacatacactgtctccttaccctacttttcataagactcagattaagcaataggtccaggtagggcagwctgattcctccattgagaagttctcacatgaccatatgtctaatgctttcatccactgatgatcacagcctgaataaatcatttcattagggttggcaaaatgatattctaatcctgtcattacttccacattcattaacaaaaattctgcaaagaagtttccctctttcttcataattgcttgttatcagagtatggagttagtgcctatttgtttttactgtatccagtaattcactgttgttgtagtggtggtgtgtatttgtgttccttattacacatctattgttataaaccaag

SEQ ID NO: 186351 - DNA, 601 bp, Human
caaaataatggcatttgcagcaacctggatggaattagagaccattattctatgtgaagtaactcaggaatggagaaatcaaacattttatgttctcattcataaatgggagctaagctatgagggctcaaaggcataagaatgatacaatggactttggggactcgggggaaaagagtgaggaggggtgagcgataaaagactacacactgggtaatttggcatagcatacactgcttgggacgggtgcaccaaaatcccagaaatcaccactaaacaacttattcatgtaaccaaacaycatctgttccccaaaagcctattgaaataaaaacttttttaattaaaaaaaaatagtttagagagaaaggacctcttaacaatattgtacatgcctatccaaaaaaaaggatatctctctatttagtatcctctttatgttacaggaattttcttcacataagttctgcataattcttgttaatcataccatttgatattcaaaaaaagttttttaagttatccattgtaaatatgtctagctacactatacaggtatatttccccaaatgaaaaaaaagaaaaaatatttaattagcat

SEQ ID NO: 186352 - DNA, 589 bp, Human
aacccttccagacactggcttaggcaaagacttcatggcaaagaacccaaaagcaaatgccacaaaaacaaagacaaatagatgggacttaattaaactaaaaagcttctgcaaagcaaaagaaataatcagcagagtaaacagacaacccacagagtgggacaaaatcttccctaactatgcatccaacaaaggactaatatctagaatctacaaggaactcagagcagtaagaaaaaaaaaaacaaataatcctattgaaaagtctgctaaggacatgaataaacarttctttaaagaagatatacaaatggccaataaacatgaaaaaaatgctcaacatcactaatgatcagggaaatgcaaatcaaaaccacaatgcagtaccaccttactcctgcaagagtggccataatcaagaaatcataaaataacagatattggcatggaatgtggtgaacagggaacacttttacattgccagtgggaatgtaaactagtacaagcactatggaaaactgtgtggagattacttaaagaactacaagtagatctaccatttgatacagcaatcccactactaggtatc

SEQ ID NO: 186353 - DNA, 601 bp, Human
tgccagtgaaactggcaaaaaaccacagggagaaggaaacttccagttgaactttgtaacaatttcaactgaatgtgaagtttactggacagaatccgggggagggggaaaatggggagtgcagatacatgcacagaagtcttggcaggggcagaggcatgaaacctgaaagccctgcttgctttctcagcagggaagtttgtagactgggccaagttctcagccttgctcaccggctgcctggaaataaacttggtgctgttggagaagcacggtgggagtgaaaccggcctttcaggckgcatgggagctgggtaaggcctgtcattgctggctttcccccacttccctggcgacctgtatgatacagcagaggcagccataatcctcctgggtacgtaactccattggcttgagaactacaccttcattccccacagcagctgcagcaagccttgcccaaggagagtttgagctcggccacacctaaccctgcccccacctgatgatctttttctacctgcctggtagccaaaaaacaaaggacataatctcttgggagctctgtggtcccacccactgcctgagaaaccttatccag

SEQ ID NO: 186354 - DNA, 601 bp, Human
taccaagaaagcctagagaatccacagatcctttgaatgaagctgcttgctgctgcaggctctgtgagatagccaaaaactgtgagtgcccaaagtgtgaggggggaacgtttgcccctaaatgcacatcctcactggtccagatcatgggaaaagaacttgaccttacctggagctgagattaatttagaaagctgagtgaaatataggggtacaggaagcagtgggaagagccctgtgggcactctaggtccacagggaagccatttctgactttgtcttccaggggtccttggggagkgctgccagtgaaactggcaaaaaaccacagggagaaggaaacttccagttgaactttgtaacaatttcaactgaatgtgaagtttactggacagaatccgggggagggggaaaatggggagtgcagatacatgcacagaagtcttggcaggggcagaggcatgaaacctgaaagccctgcttgctttctcagcagggaagtttgtagactgggccaagttctcagccttgctcaccggctgcctggaaataaacttggtgctgttggagaagcacggtgggagtgaaaccggcctttcag

SEQ ID NO: 186355 - DNA, 601 bp, Human
gaacgaagtcagaaagccacaagtggaagatttcaaacccaactattcccttgaattagagagaaatttattatcactgtctttcaaaatgtttggtaaatgactatcaaatattttacattttgagcagcttcagtctttagattgtaagggactttgctctgcattagctttagaacttgttggggatggggataccaagaaaatggcattttttaaatttaccatttttgatcttcagtgactcctgggttcttaacagcttatagcccatcaatctaataaatgtataaatacgtcgttttttttgttgtttttttttttttgccgggcgtggtggttcatgcctgtaatcccagcactttgggaggccgaggcgggcagatcatctgaggttgggagttcgagaccagcctgaccaacatggggaaaccccttctctactaaaaatacaattttttttttctctcagcaaatagctaacttttcacttacttctacttaagtcatctcatagcttacctactctttcatggaaccttaaagtactatcttccagttaacctgtcagcttggcatttttctacagaaatatcacatg

SEQ ID NO: 186356 - DNA, 601 bp, Human
gagtgaacgaagtcagaaagccacaagtggaagatttcaaacccaactattcccttgaattagagagaaatttattatcactgtctttcaaaatgtttggtaaatgactatcaaatattttacattttgagcagcttcagtctttagattgtaagggactttgctctgcattagctttagaacttgttggggatggggataccaagaaaatggcattttttaaatttaccatttttgatcttcagtgactcctgggttcttaacagcttatagcccatcaatctaataaatgtataaataygtcgttttttttgttgtttttttttttttgccgggcgtggtggttcatgcctgtaatcccagcactttgggaggccgaggcgggcagatcatctgaggttgggagttcgagaccagcctgaccaacatggggaaaccccttctctactaaaaatacaattttttttttctctcagcaaatagctaacttttcacttacttctacttaagtcatctcatagcttacctactctttcatggaaccttaaagtactatcttccagttaacctgtcagcttggcatttttctacagaaatatca

SEQ ID NO: 186357 - DNA, 601 bp, Human
gtgcctggttcatattagacagtcaatgaatatttgctgaatgtataaataaatgaattagcttgcaaactggttttcctacttttggtctcacaactctttgatcctttttgcactattctctcatgaatcctctatcattctttgcaatgctaccagagatcttttttaaaggtacatctgacattaaccttcagcttataaaactgtaactagttcaattccttccatgtgttaagagtctctaaggctcaccataatctggctcttctatctctccatcccttaaattttgctactycttttctgcctttaccttgtacttatatattttggattcagcactactaaaatacatacagtttctgaaattttgccattgttgaatatgatgtaccctttgcatggaaaagttgagtgcattgccactggttactctctaactccttcaacccagttcaggaaatacaattctgtctaccttaggatgagttaggggtcctccttgatgctcacatagtacattgtattagtacgtattgagttataagcatattactaccacaatcctcatcatattttggggttatcaatatttaaa

SEQ ID NO: 186358 - DNA, 601 bp, Human
gggcagaacacagaatagtgcctggttcatattagacagtcaatgaatatttgctgaatgtataaataaatgaattagcttgcaaactggttttcctacttttggtctcacaactctttgatcctttttgcactattctctcatgaatcctctatcattctttgcaatgctaccagagatcttttttaaaggtacatctgacattaaccttcagcttataaaactgtaactagttcaattccttccatgtgttaagagtctctaaggctcaccataatctggctcttctatctctccatcscttaaattttgctactccttttctgcctttaccttgtacttatatattttggattcagcactactaaaatacatacagtttctgaaattttgccattgttgaatatgatgtaccctttgcatggaaaagttgagtgcattgccactggttactctctaactccttcaacccagttcaggaaatacaattctgtctaccttaggatgagttaggggtcctccttgatgctcacatagtacattgtattagtacgtattgagttataagcatattactaccacaatcctcatcatattttgg

SEQ ID NO: 186359 - DNA, 601 bp, Human
gcactatatattaagttctcagttctttccaaccctcctgctatttctttattccatgtctttgatatttctttccttcttactgcattaaatataagcttcaaaggggcagaacacagaatagtgcctggttcatattagacagtcaatgaatatttgctgaatgtataaataaatgaattagcttgcaaactggttttcctacttttggtctcacaactctttgatcctttttgcactattctctcatgaatcctctatcattctttgcaatgctaccagagatcttttttaaaggtayatctgacattaaccttcagcttataaaactgtaactagttcaattccttccatgtgttaagagtctctaaggctcaccataatctggctcttctatctctccatcccttaaattttgctactccttttctgcctttaccttgtacttatatattttggattcagcactactaaaatacatacagtttctgaaattttgccattgttgaatatgatgtaccctttgcatggaaaagttgagtgcattgccactggttactctctaactccttcaacccagttcaggaaatacaattctgtc

SEQ ID NO: 186360 - DNA, 601 bp, Human
atctaccctcagtctgctcttcctcttatattccttaccttggtgaatgacaccagcatctcccagttgttcaagtaggaacctggaagtcatttcagtttcttccttatcgttccttccttccttcccttcatgcactatatattaagttctcagttctttccaaccctcctgctatttctttattccatgtctttgatatttctttccttcttactgcattaaatataagcttcaaaggggcagaacacagaatagtgcctggttcatattagacagtcaatgaatatttgctgaatgyataaataaatgaattagcttgcaaactggttttcctacttttggtctcacaactctttgatcctttttgcactattctctcatgaatcctctatcattctttgcaatgctaccagagatcttttttaaaggtacatctgacattaaccttcagcttataaaactgtaactagttcaattccttccatgtgttaagagtctctaaggctcaccataatctggctcttctatctctccatcccttaaattttgctactccttttctgcctttaccttgtacttatatattttggattcagca

SEQ ID NO: 186361 - DNA, 601 bp, Human
ttttgaaagaagaatctatactgattaatagagcttccttacctatcatttactcctgaaccctcctcaatctagcttttacccctagcacatctgaagctcatgtggaaacggataccaatgacctacttagaaaacactttatcctaaaaaacatcaactctgaatccactttttttttttttttttttttgagacagagtcttgctctgtcgcccaggctggagtgtagtggtacgatctcggctcaccgcaagctctgcctcccgggttcatgccattctcctgcctcagcctcccragtagctgggactacaggcgcctgccaccacacctggctaattttttgtatttttagtagagatggggtttcaccgtgttagccaggatggtctcgatctcctgacctcatgatccgcccgcctcggcctcccaaagtgttgggattacaggcgtgagcccccgagcccggcctccacttttcttaaagttggagaaaaccatataactacaaagaacagtatcactgtaaattcatggtttcaattcatctggatactcaatgctattgaataacctttaaataattgactcagctcta

SEQ ID NO: 186362 - DNA, 601 bp, Human
ccttgtttcctcttaaatatacattcaagtaattcctgtccattaaaaaacaaaagcaaaaccactactttcttgccagtgcacctccttccttacattttcctattttggtctttctcagccaaagtttttgaaagaagaatctatactgattaatagagcttccttacctatcatttactcctgaaccctcctcaatctagcttttacccctagcacatctgaagctcatgtggaaacggataccaatgacctacttagaaaacactttatcctaaaaaacatcaactctgaatccactttttttttttttttttttttgagacagagtcttgctctgtcgcccaggctggagtgtagtggtacgatctcggctcaccgcaagctctgcctcccgggttcatgccattctcctgcctcagcctcccgagtagctgggactacaggcgcctgccaccacacctggctaattttttgtatttttagtagagatggggtttcaccgtgttagccaggatggtctcgatctcctgacctcatgatccgcccgcctcggcctcccaaagtgttgggattacaggcgtgagcccccgagcccggc

SEQ ID NO: 186363 - DNA, 601 bp, Human
aataaatatatattaataattaaaatataatataattctatattatattttgtatataatataaaatcatatattatatataattctatattatgttatattttgtatataatatataatcatatataatatataattctatattatattttgtatataatatataattatatattatatataattctatatactttgtatataatatataattctgttatattttgtatataatatacaattctgttatattacattttgtatataatatacaattctgttatattttgtatataatatrcaattcaatgttatattttgtatataccattgttatattttgtatataatatataattgttatattttgtatataatatataattctgttatattatattttgtatataatatataattcctgttatattatattttgtatataatatataattctgttatattatattttgtatataattctgttatattatattttgtatataatatataattataattatattatatattaataattattatataatatataatatataatatataatatataatatatataaatatatgatatatt

SEQ ID NO: 186364 - DNA, 601 bp, Human
atataattacatattatatattaataattattatatattaatatataatatataataattattaatatataatatattaatatataataaatatatattaataattaaaatataatataattctatattatattttgtatataatataaaatcatatattatatataattctatattatgttatattttgtatataatatataatcatatataatatataattctatattatattttgtatataatatataattatatattatatataattctatatactttgtatataatatataattcagttatattttgtatataatatacaattctgttatattacattttgtatataatatacaattctgttatattttgtatataatatacaattcaatgttatattttgtatataccattgttatattttgtatataatatataattgttatattttgtatataatatataattctgttatattatattttgtatataatatataattcctgttatattatattttgtatataatatataattctgttatattatattttgtatataattctgttatattatattttgtatataatatataatt

SEQ ID NO: 186365 - DNA, 601 bp, Human
attttgtatataatatacaattctgttatattttgtatataatatacaattctgttatattttgtatataatatataattctgttatattttgtatacaatatataattctgttatattatattttgtatataatatataattgttatattttgtatataatatataattacatattatatattaataattattatatattaatatataatatataataattattaatatataatatattaatatataataaatatatattaataattaaaatataatataattctatattatattttgtatataatataaaatcatatattatatataattctatattatgttatattttgtatataatatataatcatatataatatataattctatattatattttgtatataatatataattatatattatatataattctatatactttgtatataatatataattctgttatattttgtatataatatacaattctgttatattacattttgtatataatatacaattctgttatattttgtatataatatacaattcaatgttatattttgtatataccattgttatattttgtatataatata

SEQ ID NO: 186366 - DNA, 601 bp, Human
tcttataattattattatatatattatataattatatataattatatattatattttgtatataatatataattatatatcatatataattctatacattttgtatataatatataattatatattctgtatataatatataattataaataatatacaattctatattatatcatactttgtatacaatatacaattctatatcatagtttgtatataatatataattctgttatatcatactttgtatataatatacaattctatgttatatcatactttgtatataatatacaattcagttatatcatattttgtatataatatacaattctgttatattttgtatataatatacaattctctgttatatcatattttgtacataatatacaattctgttatatcatattttgtatataatatacaattcctgttatattttgtatataatatacaattctgttatatattttgtatataatatacaattctgttatattttgtatataatatacaattctgttatattttgtatataatatataattctgttatattttgtatacaatatataattctgttatattatattttgtat

SEQ ID NO: 186367 - DNA, 601 bp, Human
gttcccttgtaatcaatcccgctcccacacctttaaagctggacaaccactaatcacagtcaacatttaataaacattacacattgtacgaattcatgatgtattattaaatctaccttctaaagttgtaagaatagattccatcgtccccacattatggatgcgaaaactcactcaggttttctcatacaattaacttagacaattctatagctagtaagtggcagagacagactcaaatccagatttacccaactccaacattaaaaattgagttttcacctaaaaatactgaatttckgggcttcttttgaaaaaaaattagtatctgtgtacatctatttctgcatacatacttactgagctggatctgtggctgacctcttttagaagaggcatgccatttttaggtgcccagtgcccactaccttcccctgtcattcggagactgatcccaggccctcttcattcttataattattcttcttataattattattatatatattatataattatatataattatatattatattttgtatataatatataattatatatcatatataattctatacattttgtatataatatataa

SEQ ID NO: 186368 - DNA, 601 bp, Human
ggtagttttttctttcttgtttcccagtgggcaagatctttcacactgtggggcttgtaactggggctcagaggggacagtaagagactagcgataaaaatgttagaaacctttggtatcaactctattttattaacagttgatgtaactggagtacacagaaaagggaaaggcagttatctttataaaatcagctttgttgaggtataacttatatgcaaaaaatccatcaacttcaagggtttgataagtgcgaacaaatatgtccagtcaagcaaccaacactacaatcaagacacaraacatttccataacccaaaaaagctctctgatgttcccttgtaatcaatcccgctcccacacctttaaagctggacaaccactaatcacagtcaacatttaataaacattacacattgtacgaattcatgatgtattattaaatctaccttctaaagttgtaagaatagattccatcgtccccacattatggatgcgaaaactcactcaggttttctcatacaattaacttagacaattctatagctagtaagtggcagagacagactcaaatccagatttacccaactccaacattaaa

SEQ ID NO: 186369 - DNA, 601 bp, Human
taaaggctcagatgatcattagaatttcgaagcaataaaatatttttaaattaaggtatatatattttttagatatgtcattgcatacttaacagactacagtatagtataaacataacttttatatgcactggaaaaccaaaaaatacacgtgactcactttattgtgacattcactttattgtggaggtctggaaccaaaccatatctctgatgtatgcctgtatattacttatgcttctaatttttcttcttggtttattaagttttatagcttattactaaacagtgggtaattagyttgtagattatattataacacttctgcaaagtaactaagtgacctgctttactcatattatgtatcaagcacagtacccaaattgataaatccagtacatggtttgcacagtataggagaagagtatattggactaataaaggtagttttttctttcttgtttcccagtgggcaagatctttcacactgtggggcttgtaactggggctcagaggggacagtaagagactagcgataaaaatgttagaaacctttggtatcaactctattttattaacagttgatgtaactggagtacac

SEQ ID NO: 186370 - DNA, 601 bp, Human
ttgatggtctggaaagaagatcaaaccagccacaacatcgccttaagccaaagcctaacacagagcaaggcacacagaacacttcaattctacgaaggctgagagaggtgaggcggcttcaaaagaaaagttggaatctagcagaggttggttcatgatgtttaaggacagaagcactctacataacataaaagtgcaaggtgaggctgtaagtactgatggagacactgctgcaagttatctagaagatctagctaagatcactaatgaaggtggctacacgaggcaacagattctcaaygtagatgaaacagccttctattggaagaagatgtcatctaggacttttcctagcgagagagaagatatcaatgcctggcttcaaagcttcaaaggacaagctgactctcctgttgcaggctaatgcagctcgtgactttaagttgaagctaatgattatttaccattccaaaaatcctagggcccttaggaattaagctaaatctgctctgcttgaacaaagcctgggtgacagcacattgtaaacatctgtttacagcattgtttactgaatattttaagcccactcttgagaccatcc

SEQ ID NO: 186371 - DNA, 601 bp, Human
ctgtaaggccaaaccctaatatagtttgccaaaaaggcaggcttgatagcggaggcctcattttgcttgtgttacatgtcggcaggcctaacatctagaatcaaagtgtgcagagtggtcactttctcactgagtgagaacattttcagtgaattttggtcctctgctaaataaggtaagggtgggggctctatccaagaaggctggtgtcctcttataagaagaggagataccagagatctctgtccacacatactatatgaggacacagtaagagaagaggccatgtgaggacacagtraggaggacactgcatgctaggaaaagaggccataccagaaaccaaccctgacaacacctaaatcttggacttctagcctccagaactgagagaaaacaaatttctgttgtttaaaccacccagtctgtggtattgttatggtagtccaaatagactcatatacctactttccccatgtaggtctagatgaagatttttgggaatccctttcaagtgtatgacaaattcagtacattcttctaaggaaaggctccataatgtctaacaaatacctataatgagatgtttacttttgtaaaa

SEQ ID NO: 186372 - DNA, 601 bp, Human
ttttataaaactgaggaaaaattaacaatcattcctaagataatggcatggcacttatattgatttaaaaagaaagcatatttgttcttttagagatgcactctaaaatattagtggatgaaatgatgtctggtatttcttcaaaatatgcagaagaatttaacaggctagcaaggaggcagattggctctgggttaataactgctgttagggcctaggttttgggtacatagggggtcattatcctgtcctatctattttcacaaatatttgaaattatccataggaaattttttaaacaaaaaaaaacccctctgatagcatattatacaacacacaaaatattctggatttgagatttgtacaaatgacttatgaatcttaaaacatgtaggtgaattaagatcagggttaatatcataagcattgttttattcctctcagtatcttaatctagtatcacatatacaaattatgcaaaataatatttccaataattatagttttaaatttctttcttagttttatggtaagacagcactgtaaagaatcttatagataattcatgtcaaattatgtgagaagataaaaaaaaatgagg

SEQ ID NO: 186373 - DNA, 601 bp, Human
ctaggagtgaggtgttgaattacattttctgaagcatttaagggcattgttaaaaagagaaaaaggataactggacggtaggcaatcaacaaatagctactatcgcattttccctttcaaataaaatccaatgccttgtccttgcattcaggatctacatagtataggctccaaatatacttttcaattttaatttcccatactccttgtgcatcaaacacattagtcttctgccctgtttaaaaaacaaaaacaaacacaaccaccacaacccaaaaccacaaaaatcctcttctccctstatcttcacttatcaaatttttagagaaatttcaaggctcaattaaatgttacctcagccataaagcttctggagatcacctcaagcagaagtaattcttttaaactcctatggtcaacattttgcattcttgaatgaatgaatggattcagccattgactatcagtaactgctaacatcagaaaaaaaggacaatgagacatcacacatcatgggcctcctaatggaagaacacaaagaaagagaaacctgaatttgatcaagactctatctaaagcagcactgactaacagaacttcc

SEQ ID NO: 186374 - DNA, 601 bp, Human
tgatatgaagtttaagttctagagtcagactcctgtaataaaatcccagctctactatttatatagtcatgaacttcaaatgactcctaagattcagtttgctcacttatataatggggatgttatcataagagaatgtctaaatttatagtctgtgcatccctgttgctttattaactttgtcttcttttatatatttctgtcctttttatttaagaactaaagttcttaagaatagctaataaatacacctaagatttgataggtatgtaccagccaaatcctaagtgccttacaagcrttcactcagctaatccttaaaacaacagttcattttacaaatgagaaaaccaaagcttctagtagtttggtaatttttttttccaaagagctagtaactgcgtggattgaacattcaaatacacagtcattaaaaagtctgtattcctcacctcttaaaaagatttcaggttcaatactaattcccacattaaaaagtttgtgttccttactttttttaaaaaaggattcagacatgaatatatttcttgcttgtaaaagaaatagtgcttagctctcagaattaaaatctacctgccac

SEQ ID NO: 186375 - DNA, 601 bp, Human
ctgcttctgaacatcacttgaagaagtgggctacttaatttatgtgtactaccattctaaaaaatatgtttatgaagatgtcactttcaattatttctaggttaccagtagatagcccaaagaaaatcgctttgttaacacaaagcaaattacattctccttaatgccccctcccaaaccccaagaaaatttcatatatatgaatatgaacacccaccaccaatcttactatgactagtgttcaaatgcagccatgtcagatattttttcagacgtcaccctttagaggtagcaaatactaaaaaaaaaaaaagtctgataaaacattacttctttaactacacattagcagctaattatgtaatgaaccagttaagtagataaaccctaaaaaagatttttcacgtacgaaaaagtttgattatcacctaaatcagaaaatagtttgttataacaattttttggtctcactaaacaccaagaagtaatcaaccaaccccatttattgctttctgtagttttgactacaatatgagagagaatcaactaaaatagatgctgctttaggaaagaaactatacaacagtgatatgaagtttaa

SEQ ID NO: 186376 - DNA, 601 bp, Human
gcttcctgagcagctgggactacaggagtgtactatcacacccagtttagatatattttaaacatgaaatcttttttccagtttggtaaacagagcaaaaacagaaggcaaaaaaccagcataatgtaatattgaagattgtggattctgagctatattgccaggattctaaaaccagctccattacttcttgctgtgcaatttagggcaagttacccaatctctctgtgcctcaatttcatgttttaaaatggagataatacctaccttatagggcttagtgaaattctttataatagcaaaaaaaaaaaaaaaaatctaaaactattatcaacatgcacaggaataaactgatacagccttataataaaatattcaataaacaaataattatatatgtactaacttggatagatacacatattaaattaaaaatgtttcagatgagcagtaaagtatgatttaattttaactttaaaattatgtatgtatagtttataatatgcagatgttaaacatgtcatatgtatgtctatgcatttatataaacactgatgagcctaagggtataacactgatgtggaggaaaacctctggaact

SEQ ID NO: 186377 - DNA, 601 bp, Human
tatacattgctacaaatcacagttacataatttgtgatactaatgtttccagtatctgtaagatagcatattatgcccaggagagttttaatatcagattttacttttttaaaaaagagacagggtctgactatgttgcccaggctggactagaactcttgggctcaagcaatcctcctaccttagcttcctgagcagctgggactacaggagtgtactatcacacccagtttagatatattttaaacatgaaatcttttttccagtttggtaaacagagcaaaaacagaaggcaaaaaascagcataatgtaatattgaagattgtggattctgagctatattgccaggattctaaaaccagctccattacttcttgctgtgcaatttagggcaagttacccaatctctctgtgcctcaatttcatgttttaaaatggagataatacctaccttatagggcttagtgaaattctttataatagcaaaaaaaaaaaaaaaaatctaaaactattatcaacatgcacaggaataaactgatacagccttataataaaatattcaataaacaaataattatatatgtactaacttggatagat

SEQ ID NO: 186378 - DNA, 601 bp, Human
aagactgtacccatttctttaccacacaaaaattataaaaacaggcagcagaaacaaaacatgaaactgattcaataaaacacctaagaaggtttgccaaaggtcagtataaactgcctaaatccttgctactcacgagtagactagcagtactggccaccttgggagtgtgctagaaatgcagagactcaggctcattccagattatggaatctgaatttatatgcacacttagtgatctatatgcacattaaagtttaagaagcactggcaaggtttgggcttaaatcttctacttctrtattatacattgctacaaatcacagttacataatttgtgatactaatgtttccagtatctgtaagatagcatattatgcccaggagagttttaatatcagattttacttttttaaaaaagagacagggtctgactatgttgcccaggctggactagaactcttgggctcaagcaatcctcctaccttagcttcctgagcagctgggactacaggagtgtactatcacacccagtttagatatattttaaacatgaaatcttttttccagtttggtaaacagagcaaaaacagaaggcaaa

SEQ ID NO: 186379 - DNA, 601 bp, Human
aagtcggtgtaatatctgtcagggccacatatgttggtacttaaaaaaaaaaaaaaaaagtcttgcattgtcttctaaatcttcaaaaaaatctttcaaatttttctcaccaacaattctaacaatcttaagtattgcgaatatttactccctcaaattaatgtaagcaatgtctcttcagatatttgtcttaaaattttgtattttatacatcattagttctaaaggtttctctctttacccattagttggatctggcatcacaacagctcagaaaccgaacagacaaagaattctcctyggagtcaggtggggaaggaagctagtcagaaaaagcttagaaggcaaaagcagaattttctttcatggttgagagtggagaaaatagcaaatattgtaattaacaactttttgtttacaagtatcacacttctataattgcttgaatattgtattgcaccccccaccccaatgcactaagctgtaggagaacagaatttgtgtttatttggctccccactgtaggcacagttcctgatacagaggaggcgcacaaatagctgaaagatgaatgagggatgtcctgatgattaaaatgaaa

SEQ ID NO: 186380 - DNA, 601 bp, Human
ataattaaaaataatatattatttcgctttcaaagtgtcctgatttggaaaataaattacctgataacactaggtgcagacaattaaaattctttctaaaatcatcaatatactttccaaagtgcaaacgacaatccagcagggcactgagcaccggcaaatggagtagcagaggtgaaaagagcaggggaagagcagaaatagatggcagcacagaatactgaagcatctcaccatttctgtggcttgctgatctcaacagaaagcaagtcctgcattttgagattcttccaaaggctasctctctatttagaccagcactgaaggggccctactttctactggggatgcaaggatttcagaaagcttatactctattaaacattacatctatagctccgtactggccacagaaaaaatgcaatgaggccgggcacggtggctcatgcctgtaatgccagcacttagggagaccaaggtgggcggatcacttgaagtcaggagtttgagaccagcctggccaacatagtgaaaccacgtctctattaaaaatacaaaaattagctgggcgtggtggcgcacacctgtagtcccagctact

SEQ ID NO: 186381 - DNA, 601 bp, Human
ttttacaaattcatattctaacttaatgttcattatttgccataatgtgccttagtacattaagaccatattatataagagctatgacaaacccacagccaatatcatactgaatgggcaaaaactggaagcattccctttgaaaactggcacaagacagggatgccctctctcaccactcctattcaacatagtgttggaaattctggccagggcaattaggcaggagaaggaaaaaaagggtattcaattaggaaaagaggaagtcaaattgtccctgtttgcagacgacatgattgtrtatctagaaaaccccactgtctcagcccaaaatctccttaagctgataagcaacttcagcagtctcacgatacaaaatcaattgtacaaaaatcacaagcattcttatacaccaataacagacaaacagagagccaaatcatgagcgaactcccattcacaattgcttcaaagagaataaaatacttaggaatccaacttacaagggacgtgaaggacctcttcaaggagaactacaaaccactgctcaatgaaataaaagaggatacaaacaaatggaagaacattccatgctcatggg

SEQ ID NO: 186382 - DNA, 601 bp, Human
gacaaataaaaaatttaatatactactattaattattgtaggaaggtagggttaatgggtgattttcttaatctttttgcttttttctaaatgtttaatgaaacttgtgtaatagaatttgtgaaaacaaaaaacttgatttagaagtaatcaagaataaagacagcataaattatttctagaatatcctgattaaagtcaatatcacagattacagagtaattcagtttaaagtagatatattttaaaaaatcaaatatatttgtttaatgtgtacaagggccttgtggtaaatcaactwgacgtaagatatatttcattctatgtagcagatgagcagtaatttggtaattttaaacatttcaaaaagaaacatataatttagacacttttttaaaaagcgattaaaagagccttcctactctctcatgtatgcaattaaattacttggcagtttctgtggtataattcataatgattttcatatattattaaatttataaaaataccatttgtcttttctcctttctctagcttatatatgaagagagatttaaaattctgaaccaagaaaagttctaaattaaaataagtacaaaaa

SEQ ID NO: 186383 - DNA, 601 bp, Human
gctgaggtgggagcatggcttgagcccaggaggtggaggttgcagtgggctgagatcatgccgctgcactccagcctgggtgacaaagtcagaccctgtctcaaaaaaaaaaaaaaaaaaaagaatacagtatttaatacatataacgtacatatatttaattgaatgtttatgttgttgttaagatttccagtcaacagcatgctattgagtacttaaacttttggagaatcaacaattatatatggcttttcttccactatgcagggaattggtgcccctaaccaccatgttgttcaarggtcaactgtatatgaatatgtctcttgagcatgatccaaattaggcaaaatccattggaaacaacccattgtaatgaagtcacatgatggaaattttatgcaggcattaaaataatgaatatgaaggctaagggaaaaatgtacatagtgttaaacagaaagagcaggagataaaattagggataattcaaatgcatatacaattatttttaaggtatgtacacaaaaggacaaataaaaaatttaatatactactattaattattgtaggaaggtagggttaatgggtgattttctta

SEQ ID NO: 186384 - DNA, 601 bp, Human
aagtcagaagaggcaaaaatataaagagagaaggagaaataaaaaaaaaacgggtcatagcacagtatgaatgaagatgaggagagcaaagaaactgaatatacccacctaaaatggaactaactagccagcttcaccctgaaatttcttagtaagaataatttaggattttgctaacaatgcataacgtaagatgaatagagaagattcatccttttatgccttttttaaagggcttatgagggcaatttttttttcctgcaagggtataaaaattactaacatggtacctacattttcytattttaagcactacagaagactaaaatgctaaagcaagctactactatttcccaaatgggaaaaattactaatttttgaaggttactgtgactctggctggaagcataaaaaggtaaggcagaaatcctcacttaagctaacaaactggccttggagctcacgattttgtaggtcatctctatcagctttgacatagtttttagtatactcacatcttctatgagtgttccagttactgtgtcttttgtcaagggtggtacccagaaataaacaataccagagtacgtttgcatgaaga

SEQ ID NO: 186385 - DNA, 601 bp, Human
tgagccaagctgcgttataatgtgaatgtcagaagtcaacattttgaggatggacagagttggaaggggacagagattgaacatgagtaagatttccttagaattactccaaatttcattctttttaaaaaagaagttagaaaactgaacttctccctgtatgggaataattactagcacttgaacataggttgagtatccctaatccaaaatgcttgggaccaaaagtgttttggatttcaaaatttggaatatttgcgcatacatactggttgaacatccctaatccaaaatctgaaawgcttcaatgagtatttcctgtgagcatcatgtcagtgctctaaaagattctggagcatttcaaatttcagatttttagattagggatgctcaacttgtagcaatatttactagtctaagatgggaaaggttttaactatgacttgaaagacaagaatcaggcaagcagaaaaaatgatattaatccatcactcccacttaggactctcattactctgagacttattattagaaaccgcaagtgccatggcaagtaggaaatcttatatccagctgtttataatttaaatattcttctgca

SEQ ID NO: 186386 - DNA, 601 bp, Human
aagggtagataatctataataacacagagaaaataagtatagttagtagttttaaagcttctaaagattgattccttatttgctacacattatctaagaactacaggcagaactgaccagcttcttagtatctttggtattaaaaattttataaacagcattctagaacctacttttaatgataagagaacatatatacatatagttaattatgggtaagatgcttagggcaaggagtagaatagtagcaataaggggatgaagtggaggctgagggagacatttcaaaggaaagagcaayggacagatacttaaagacacttaataatggacagtctggaaagcatgcatgttcagcatagagtctatgggccactgagaatacaaggcaagtgaccaactgttggaatctgcaagaaaaataagttagagtactatagttgccctttgttggactgccatgtataacataactaagccctgtaacctgaacaggaaacacacgcccacagctaggcagaaattactttgattcaaaagtcctcttcctgtatcttgactgtgtttgttgcctaaatagtgtcctgatttctctgaccct

SEQ ID NO: 186387 - DNA, 601 bp, Human
gtgacgagtaaattttcagaaaaacaaacactacatactaaactcaaaaaccatgagctcataatttatatattgcctgtctctcaaaaggtaagactgttgtattatatcatcataataaattaatattcatactgatctaagagttgttgagtgaataatgaatcagtataggcaaaatgactggtataaaacacggcctgcactcccatgctttttaagttctgctgtagtttaaaaatcaggtaacccaagagatggccaaataccactattacaattgtaatttggaaaaatgacyttttttttttttttttttttttttttgagatagagtctcactctgtctccagggtggatggagtacagtggtacaatctcggctcactacaacctctgcctcccaggttcaagcaattctcctgcctcagcctcccgagtaagtaggactacaggtgcacgctaccacacccagctaatttttgtatttttagtagagaaggggtttcaccaggttggccaggatggtctcgatctcttgaccttgtgatgttaccacctcagcctcccgaagtgctgggattacaggcgtgagccaccg

SEQ ID NO: 186388 - DNA, 601 bp, Human
tcaaaattagagatatttttatgttacatttcagtttttacagatatctaaaaatactatttacacgtaaaattttttctttgaaattaaccacttgattttgctaatgtgttcataaataagcatatattacattacaaatattaaaaaatatctgatagctgtactttaacataattggttccctttgtaatgctatgtattttttttaatgaatttaaacacattattctgggaaagaatacataggttttaccagaatactaggtggccgtggcataaagaaagttaagaaataatycctgacagaatacatcttaaaatgcctggagtaaatttgagttccaacttaattttgtttggctgtttttctcagcattcaattttttcacacattctggaattttggtttacaggtttattttatggaagttttttggttttctctcttttttttaatcctctcttcttctatgttcccctacttgggtctacattccagaacaagtcttaaatgatggttcagagtattacagatcctttcatggagtcagcaggtgacatagttattcatgtttgttaggttatgccctctcagctc

SEQ ID NO: 186389 - DNA, 601 bp, Human
gcccatctccttgtttttagacattctgtattagttttgttttagatgtgttacaacctttctacttgggagagagttctcattttccttctttcctttttttttttttttttttttttgagacagggtttcactctgttgcctaggctggagcacagtggcatgatcttggctctgtaacctccacctcctgggttcaagcagttatcatgcctcagcctcctgagtagctaggattataggcgcgtgccaccatgcccagctaatttttgtatttttagtagagatgaggtttcgctaygttggccaggctggtctcaaactcctgacctcaagtgatctgcctgcctcagcctcccaaagtgctgggattacaggcgtgagccaccacatctagcttcctgtcttttttgaatatatttttaaagttccttttcctctgttaactgctcaatattactcctatttttaatcagtggctaccttttgatattttaactgaaatgctgaaacacactttttttctaacaaagtccaagtaagaatattcggtgtttctcctgtcccctcaaaaatcacaaatagggtagaaacaatttaa

SEQ ID NO: 186390 - DNA, 601 bp, Human
tgcgtattttcctggtctttactgctactttaaaatttaccctctaattcttttccttaactcttgagttaaatgctgagcttatttattttctaatttttaaatcaatgcattaaagttgtaaacttttctaagtattctttcaatgtattctaacagttttaatatgtattactttcactatggttatttaaaaaatatttggtcccattgtgatttcctctttaattcaggagttatttaggaatatatttctaaacatacaggtttatttttttcttttattttaattgcattgtgktaagaaaacacaatctgaatgatgtacagtctttgaaatgtattaagagttcctttgtgatgtgaaacataatcaatttttataaatgttccacatgtctttgaaaagaatgtgtattctttgttgaaataagtattaaaggtgtgttaaaaatctcccactgcaactgtggattggtcaaatttgccgggcaattctccacattttgctttgcatgtattttaggctatgtaattaagtaaatgaaatttactgctggtttattttcctggtagaataccccaattgttactagtattt

SEQ ID NO: 186391 - DNA, 601 bp, Human
ggccgggcatggtggctcacacctgtaatcctagaactttgggaggctgaggtgggcagatcacttgaggtcaggagttcgagaccagcctggccaaccaaaatggtgaaaccccgtctctactgaaaatacaaaaattagctgggtgtggtggtgcatgcttgtagtcccagctactcgggaggctgaggcagaagaactgcttgaacttgggaggtggaggttgtagtgagctaagatcgcaccactgcaccccagcctgggcgacagagcaagactccacctcaaaaaaaaaaaaaaatggattcaagtcctttgttagacatgtgtattgctaatattttcttccagcctgtggtttgtcttttcattttcttaatggaaccttttaataagcagaagttttaaattttagtcttcattaagtctaatttgttatttttgctttgtgtttagtgcatttgttgtcctaagatatcttggtgtttccaaagatctcaacgatgttcaactactttttaagtatttcagagttttagtttttacatttatagctgagatttatataaattttcgtgttttcaagtagaaaatgagattc

SEQ ID NO: 186392 - DNA, 601 bp, Human
ctggccatgatgaaaccccgtctctactaagaatacaaaaattagccgggcatgatggtatgtgcctgtaatcccagctactcgggaggctgaggcaggagaatctcttgaacctgggagacagagtttgcagtaagccgagactgtgccactgcactccaacctgggcaacagagtgagactccgtctcaaacaaaacaaaaccaaacaaaaccaaacaaaacaaaacccttatacatgtacgtatctctcttacaagaacaagaatttctctaggacaaactattctagaactagtattgctaggtcagaagaataattcctctttaaatctgacagacactggaaaaacatgtttatacgaatttacagttctaccaagtatgtaccaaagtaccatataccccacacgtttagcaaaatgacatattctatttttaaaaatgttttgccaattaggtagacaaaagagatttatcacttctatttagcatgtctttatttactgagattgaaatccttttccaatttttgggttatttctatttcttttactccaaattgccttgttttccaaattgcctcctttattcattaatat

SEQ ID NO: 186393 - DNA, 601 bp, Human
gcctggccatgatgaaaccccgtctctactaagaatacaaaaattagccgggcatgatggtatgtgcctgtaatcccagctactcgggaggctgaggcaggagaatctcttgaacctgggagacagagtttgcagtaagccgagactgtgccactgcactccaacctgggcaacagagtgagactccgtctcaaacaaaacaaaaccaaacaaaaccaaacaaaacaaaacccttatacatgtacgtatctctcttacaagaacaagaatttctctaggacaaactattctagaactagtattgctaggtcagaagaataattcctctttaaatctgacagacactggaaaaacatgtttatacgaatttacagttctaccaagtatgtaccaaagtaccatataccccacacgtttagcaaaatgacatattctatttttaaaaatgttttgccaattaggtagacaaaagagatttatcacttctatttagcatgtctttatttactgagattgaaatccttttccaatttttgggttatttctatttcttttactccaaattgccttgttttccaaattgcctcctttattcattaat

SEQ ID NO: 186394 - DNA, 601 bp, Human
cagcctggccatgatgaaaccccgtctctactaagaatacaaaaattagccgggcatgatggtatgtgcctgtaatcccagctactcgggaggctgaggcaggagaatctcttgaacctgggagacagagtttgcagtaagccgagactgtgccactgcactccaacctgggcaacagagtgagactccgtctcaaacaaaacaaaaccaaacaaaaccaaacaaaacaaaacccttatacatgtacgtatctctcttacaagaacaagaatttctctaggacaaactattctagaactagtattgctaggtcagaagaataattcctctttaaatctgacagacactggaaaaacatgtttatacgaatttacagttctaccaagtatgtaccaaagtaccatataccccacacgtttagcaaaatgacatattctatttttaaaaatgttttgccaattaggtagacaaaagagatttatcacttctatttagcatgtctttatttactgagattgaaatccttttccaatttttgggttatttctatttcttttactccaaattgccttgttttccaaattgcctcctttattcatta

SEQ ID NO: 186395 - DNA, 601 bp, Human
ttcaggtcccacttataagtgagaacatgcagtgtttggttttctgttcctgtgttattttgctgaggataatggcttccagcttcatccatccatccagcttccagcaaaggacatgatctcgctcctttttatggctgcatagtattccatggtgtatatgtaccaacattttctttacccagtctatcattgatgggcatttggtttgattccatctctttgctattgagaatagtgctgcaatcaacgtatgtgtgtatgtatctttataaatggaatgatttaacaggttgggttytaatgacaaattagtactggcatgcttactcaacaattcaatttgttaaatacttattattattccatgaagatcttgcattttgatctaaaagagaggactaattctgaattattcacatttgtatgatctggtcttgttttttagacacaatttaagaaaagaaaagatgtcgttttttctgagactataaactatgaaggtgaaatttgttaggtcttttctctggaggtataaaaacaatgacaattaccacaaaaatacattctgaagtaactttctggatatgcgtaagcactt

SEQ ID NO: 186396 - DNA, 601 bp, Human
tctcatctcctaggtcaaggcagtcaatgttcccatcacattttaaagattcggggaggcaagtgtaaactttggtaaaacgggataaacactggaactggttgtaagcacagggttgaaaagcagcagcagttggaggatttgcttctttggcacagatctcttcatcggaactatctccacattcatccatgttattacatttccaggcttctggtatacactttccattaccacaacgaaactgatcacaagcacaatttggttcctcagatttccctgtgaagatgtgagtagaaakagatggaaagagaaggagaaaaattataatctttaaaagacataaaacagcaagtgatatttttataataaatgttcataaagcccaagtgctagaagttttaaaaaacaggttggttttttaatattttaattttaagttccagggtacatgtgcaggatgtgcaggtttgttacatgagtaaacatgtgccatggtggtttgctgcacccatcaatccatcacctaggtattaagtccagtatgcattaggtcttttccctaatgctctccctcccaccccaccctccctagaaaggc

SEQ ID NO: 186397 - DNA, 601 bp, Human
tactttatgctttttctgtacttaaggtccatttctgtacccttacaaatgatatggctataaatgtatgtattatacaaatgccttataaactgaatacctgcagtgtgtacttattttgataaccttaactgcctctagctttaggaaagtgaagagttactgtcttttctaaagacggctctgctctatttttgagaaaagatgcctcgcattaaaatgcaacttatatggctctgtcatctatcacttgccaccctgacaaatctgaacattatatgttttttcaaaagaacagacwctaataggtaacagctttagcgacggggtcaggcagtactaaatttgaagagccactcagtgagttacagccctaggtgtacaaccttaggcaggtagcttaagcttcaatttcctcaattgtaaaaaagtagacaatggcatctgggatttttggaagataatgcacaacttagggcattggctggtatgtacttgataaaatagatgttacttaaaggtataataggaagatgtttttcaagtttaacatatcatacaaccagtatttacaaaaggcctatctttgtctctagctccc

SEQ ID NO: 186398 - DNA, 601 bp, Human
acctgcttaatcacacactgccttgtaagtaatccccacaatggcattttaccaaaaagtttcaaagcaaagtgtaatttcccttctcaataattttgagaactttttgtcctttacaataaagaaaaaacaaaagaaaaaaagaaaaatgtgttgcatggtttcccaatttttaaaaagatgttcctcctgccagctactgacactaccgggttttcagtgcaactccacccactctgacctgcatacacctctgaatacaaatttatgtatatttgaaaacttgccaaactcttatacytcattctcttatcacagaatgtagtaaaagcaaagtcacgattctttcaaatttattgaattcatactacccattgaataaaaaattccattgtccttcctcatagatattgaattatctgaagaccactgtacatctggtatagaccaacaaaatgaaatatgatttctttaaagcagaacattatttccattagttacttcagaaagcttttacctgtaattaagctaatcaattataggctttaaaccaatctctgacatgaattagatttacaaaataaataacctttagttaatg

SEQ ID NO: 186399 - DNA, 601 bp, Human
gatttgcaaccagggtttttgaagcacagctcttccacaagttgcagaagctctataaatacaactaaatgtgtggtgtgcttaatcacacttacctgcttaatcacacactgccttgtaagtaatccccacaatggcattttaccaaaaagtttcaaagcaaagtgtaatttcccttctcaataattttgagaactttttgtcctttacaataaagaaaaaacaaaagaaaaaaagaaaaatgtgttgcatggtttcccaatttttaaaaagatgttcctcctgccagctactgacactrccgggttttcagtgcaactccacccactctgacctgcatacacctctgaatacaaatttatgtatatttgaaaacttgccaaactcttatacttcattctcttatcacagaatgtagtaaaagcaaagtcacgattctttcaaatttattgaattcatactacccattgaataaaaaattccattgtccttcctcatagatattgaattatctgaagaccactgtacatctggtatagaccaacaaaatgaaatatgatttctttaaagcagaacattatttccattagttacttcagaa

SEQ ID NO: 186400 - DNA, 601 bp, Human
cagctcctgaagcccagccgggagctctggcaagcaacagaaaaggggatttgatttgcaaccagggtttttgaagcacagctcttccacaagttgcagaagctctataaatacaactaaatgtgtggtgtgcttaatcacacttacctgcttaatcacacactgccttgtaagtaatccccacaatggcattttaccaaaaagtttcaaagcaaagtgtaatttcccttctcaataattttgagaactttttgtcctttacaataaagaaaaaacaaaagaaaaaaagaaaaatgtgttrcatggtttcccaatttttaaaaagatgttcctcctgccagctactgacactaccgggttttcagtgcaactccacccactctgacctgcatacacctctgaatacaaatttatgtatatttgaaaacttgccaaactcttatacttcattctcttatcacagaatgtagtaaaagcaaagtcacgattctttcaaatttattgaattcatactacccattgaataaaaaattccattgtccttcctcatagatattgaattatctgaagaccactgtacatctggtatagaccaacaaaa

SEQ ID NO: 186401 - DNA, 601 bp, Human
tttgttttcctatgtgtcttttctccctgtgaccatcccctattaagaagttgtttttttgtaagtgcctgctccgccttcccttgttctgttaagatggtgtataaccccccaaatctagccccctcgttgagtcacatttttctgtgaattcctatatatgtatgtgaatttttttaatttgtcttttcttttgtgaatctctcttttgtcagtttaatttgcaggcccccaattactaaacataagagggtaaaggaaaagactttcctccctgagagaagcatcatggaaaccttgwtttctagactacctctctcagacattttatggtttggctctgtgtccccacccaaatctcaagttgaattgtaatccccaatgttgggggagtgaccatgtgggaggtgattgaatcatgggggcatatttcccccttgtcgatctcatgagtgagttctcatgagatctggttgtttaaaagggtgcagcacttccccctttgctctctctcctgccaccatgtgaatatgtgcttgcttccccttcaccttctaacatgattgtaagtttcccgaggcctccccggtcatgcctcctg

SEQ ID NO: 186402 - DNA, 601 bp, Human
catatacctctagtctgtttaccgctgagaacaaataccatggttttcatctctataacctctgcaccagccacaatgcctggcacttagtgggtttccaagaaatacttgttgactgaattaatggaacctaacagccagcttgaaaaatccttagtttgggattattccatattagatggcagttgagactctagaatataccactgtagcataaatattattttgagctccagatatttgagaataggtgtttttttgtttgtttgtttttgtttttccttaagtcccaaatctgctrtaaagcaaagcctccccaaagacctcaattatcataaatcccctctctaggagtttcacaaccagggaagattgacttatcactagagacttggaagctgacaccatacctaaatagacactgtcacaaaactgtcatatgtcccatatctccttctaagggcccatttatcttttctaaaagtcatttgttttcctatgtgtcttttctccctgtgaccatcccctattaagaagttgtttttttgtaagtgcctgctccgccttcccttgttctgttaagatggtgtataacccccca

SEQ ID NO: 186403 - DNA, 601 bp, Human
atgatggttcacttttccaatagcaaactgggaaagctgtgtaagttgcgtgttagtgtgaaatgtcatttcccaaaaatattgctagtcctggccctgtagtttcctagatccttctatgaacatgttaatatggagtgtcaatgcagaccacatctgaaggctgaatgctcagtttttccaaagttcattaccaaagcagtgttaactaagacttttaacaaacacaattttagtttatttctgtatctatgcctcaaatactttcttgacttctaaaaatgattacattttgttttaytttcaggtgaatgttaaggtcttttctgtgtgaaaagatcctcaggctcaggaactcatccatgactatcactatataatacagtctccctgttagatgcaatgaaacataacagaaaaaattgaagtgtcctttctcaacttgttacttgacgtgtgagaagaaagcacaaagcagtgttgaggtgtagatggtggccagttgcccaggctcacttgtcagccaagtaagcaggtcagaaacacagccaggtgatgcaggccactgtgattgatgactcagcaacagggaaaatgccag

SEQ ID NO: 186404 - DNA, 601 bp, Human
tgtttgaaggggaaaggaagagaaggaccagtgaatttccctaaaagtcacgagatggaataattatgatggttcacttttccaatagcaaactgggaaagctgtgtaagttgcgtgttagtgtgaaatgtcatttcccaaaaatattgctagtcctggccctgtagtttcctagatccttctatgaacatgttaatatggagtgtcaatgcagaccacatctgaaggctgaatgctcagtttttccaaagttcattaccaaagcagtgttaactaagacttttaacaaacacaattttartttatttctgtatctatgcctcaaatactttcttgacttctaaaaatgattacattttgttttactttcaggtgaatgttaaggtcttttctgtgtgaaaagatcctcaggctcaggaactcatccatgactatcactatataatacagtctccctgttagatgcaatgaaacataacagaaaaaattgaagtgtcctttctcaacttgttacttgacgtgtgagaagaaagcacaaagcagtgttgaggtgtagatggtggccagttgcccaggctcacttgtcagccaagtaagcagg

SEQ ID NO: 186405 - DNA, 601 bp, Human
ttgaaccctacatatgctatgttttttcctatatgtacatacctgtgataaagtttaatttattactgggcacagtaagagactaacagcaataactaataaaaaatagaacaattagccagcatcactcttgcactttggggccattatgaagtaaaataagggtgacttgtgggtggccacaagcactgcaatattgcaacagttgacctgataaccgagccaactactaagtgactgacgggcagggagcgtctatagcatgaatgtgctggacatagggaggactcacgtcccagtmccaggcaggatggagcaggatgtcttgaggtttcatcacactactcaggacgttgtacaatttaaaacttatgattgtttatttctggaattttccacttaagttttttggactacagttgacctcaggtaactggagaaattgaaactgtgattcagggtacactactgtatccaaatgcattttcttcccttttatggtgccaccaaattcttatttctaagcttatcctaaaacaagtgactttgtttcactaaaatccatcacagaacctgcaccacccaagtaaaacaaaaagaa

SEQ ID NO: 186406 - DNA, 601 bp, Human
tactttcactgttcttccttgtaaaccttccagtttatctaaaaaactcttttgggggacaggggagcccacactgcttccagaagaaatgcagtggaacagaaattgagataaactctaacagtgggtcataatattacacaagattttgtttaagaatattccattgtaaatcattactgaaagtacaggagttatcccttatccaagagggatacattccaagacctccagtggatgcctgaaactgaggatagtattgaaccctacatatgctatgttttttcctatatgtacatayctgtgataaagtttaatttattactgggcacagtaagagactaacagcaataactaataaaaaatagaacaattagccagcatcactcttgcactttggggccattatgaagtaaaataagggtgacttgtgggtggccacaagcactgcaatattgcaacagttgacctgataaccgagccaactactaagtgactgacgggcagggagcgtctatagcatgaatgtgctggacatagggaggactcacgtcccagtaccaggcaggatggagcaggatgtcttgaggtttcatcacac

SEQ ID NO: 186407 - DNA, 601 bp, Human
tgagacgatggcaggcgagtggacagaggaggagcatgatctgcacttaggagggacgtgaatgaagtggggaacatcctgagagtgaggtgcttgggcacgtgtccacctggtggcatttgcagacaggaagacatacagacctgtttccaaacagcatacaagactaggagaaaatgtaggagtgacctattagaggatgccatagaggtcccgagactggccgaaatggccagggagcgagaagccagacatgacaacatgagccacaataacatgcttcggaacataccaacactcwgcacgaacacaaaaccacactgagccaagacaaaatgtttacagtggctggttctaggtggtataattccaggtcattttaattttcccctacttcaattttattttcaatatttgctaaactttctattaaaatcataattttatatgaaaaataaatattttacatataaatatatgacacagggcatatatatgtacagccatgtaccataatggtgttttgatcaatgacagtaccacatgtatgacggtggccccataagatcacagtaccatatttgtactgtaccttttctat

SEQ ID NO: 186408 - DNA, 601 bp, Human
ccactttggaaaacaatttggagttcctctcacagttaaagatagagttaccacaagaccaagcaattccactcctaggcctatagccaagagaaatgaaaacatgttctcgtaaagacttgcacatgaatattcacagcagcatgatccatggtagccaaaaagtagaaacaatacaaatgtccatcgactcatgaatggataaataaaatctaatagattcatacaatgggatagtattttaccataaaaggaaatgaagtactgacatacgctatgacatgggtgaagtttgaaaatmtgatgctaagtgagaaaagctagtcacaaagataatatattgtgtgattctatttatatgaaatgtccagaagaggcaaatccatagagcaagtggaatagtggttgtctggggctgggtgggatgaggagagtccaaggtgatagctaaagggtatggtgtttcttttgggggtatcaaaagtgttctggctgggcatggtggctgacgcctgtaatcccagcactttgggaacctgaagcaggtggatcacctgaggtcaggagttcaagacaagcctggccaacatggtgaaacccc

SEQ ID NO: 186409 - DNA, 601 bp, Human
gcaatcaatgtcaccagtttcttgctcttgtgcagagtgaggacaagaggacaatgggaacacattgaaatccaggtgctttacctggtcactccaccacgtcactgccacatgaaggctgtagtcgcagcaaactttgggatcagcccagcttcgccaggtctcgaaggcctcaatgagggagccacctttctgaggaatggcgaaatcaataatcatggtggtgcctcctgagagagcagcctggaatcataagaggttttcaacaaattagctatcaatttcctagttaagtcatttrtcatcttgaacaatgtgcatttgtaagcacttgggcaaactcgatgggtccaggaaattgcaaaaagatgctgcctgtttaaatgacccagaagggcatgaatagacttttcataaattaagtttaaagtattaaacctgctggaattgcttctgcaaaaagaatgtcatatctgataagatgaaaatggatttgactcaaagaaaacagagtgaggattgtaaagaaaaatcaaaatggaaaagtggaaaaaatgcacatattttttcttgagaagtgatattcattattataaaattc

SEQ ID NO: 186410 - DNA, 601 bp, Human
tgccatggcctgggcaattagtggacatggaaggttgttttaagctctattatgaaatcatctgaccaggtgtggtaacattagcagagtaggaagatcactcggtcaagatacagcttggagaagactctggaaacagtccaggcctgtcccttcctctctaaagaaggctcatgagtgggaaggcaggcttctagttctagagaattctaaatttagaatttccttgattttatttttgagaaattaaacattttttattgaagttctaacctgtgggaaaatactgtttaaaagattygggggatattgaatttaagaaaaagagaaatcagtatattaaacattacacttaaagcattgatgattcattgattaaatattaggagaagctgttatgaatgagcataaaagatttatcctattgtctttatatgatttttttaatttagtttttaaaattggtaatacttcacagaattaaaaattcaaaagatacaaaagaatatgcaatgaaaagtcttcctgccagttctgtcctcctgttgtctaggaagcaatcaatgtcaccagtttcttgctcttgtgcagagtgaggaca

SEQ ID NO: 186411 - DNA, 601 bp, Human
cttgcagatgtaattagttaagatgaggacacgagcatgtgcgctttatccaatgtaactgctgcccttatatcaagtggaaactgggatgcagacctccacggggagaacatcatatgaagatgaaggcagagattgggatgatgcttctacaagacaaggaatgccaaaggttgtcagcaaacttccagaagttaggagagaggaaaggaacaggttctccctcagagccttcagaaggaaccaaccctgctgacacctaaatctcagacttctggcctccacaactgtgaggcagtawatgtctgttgtttaagccattctgtttgtcgtacattctgtttgctagggttacagcagccctagcaaacgaataacccccctgaacagaatctgcaatctgcattttagcaaggtttaccaggtgactctttgtatactaaagtgtgagaagcactgataaggacaaacaccatcacctttgctccatcttataaaataggagaataggaaaatgaagagaaggaaggaagggagggagggaagagaagaaaagaaagaagggagggaggaagggagggagggagggagaaagaagaag

SEQ ID NO: 186412 - DNA, 601 bp, Human
aaacatgttgaaaaatgttggcaacaattcatggagtaataaatgactaaaaacacatgcaagaaatttcctactaactaaaaagtgcaaaataaagcagcgtaattctattgagtcagcaaagtttaagaatgataatattacacgtgaatttactcattgctaccactgtttattcccttggaaatgtccctcccttttcttgatggtgcttatcacccggcatagcagtccttacttgctgatcacctgtcggccccaccaggatttcagccccatgagagaaggggccttgtaaggyttgtccactgctgtatcctagaacagtgcctggtgcatagtgcccactcaataactatttattgaataaattaattgctacttaattaatctagaaaaaagcaccaaaatattgagagtggacaagtgatggaatgtgctccaagttaggttaagtgacaacagcaagggacagaacatgggacagtgcacctcatttgttccccctaacagtttctaattttttacaatgagtacattagttttatagtcagaaaaaaaaatgcttgaaacattgttagcatattcacataatgggctt

SEQ ID NO: 186413 - DNA, 601 bp, Human
tccagctactcaggaggctgaggcaggagaatcacttgaacccagaaggcggaggttgcagtgagctgagatcacaccattgcactccagcctgggcgacaaagtgagactccatcacaaaacaaacaaacaaaaaccggagagctttgcattcagctatcatatttaaaagtggctgctagtggcattgagtgtgggggcatgtggctaaaggaaatgtcctggggtcgcaaggatggagaagaaataacaaataaaacatgaaggtagagaggcaaggatgaagatgaacaaaagtggkggaaaacagacacacataaggataaatgaaaccaggaggctaataaaaagggaggaagaaaagtagtggaaatccacatgcactttctcctaaactgaagcagaggctacagacgtggacttttctcttcagctaacactgagttctaagtgaggttacattcgagaattaccatctctccttgcatccgctatcaccttagctgcagacttgctcatcacatgcacaatgtagagaggacagttcacagcgctggctatggtgatggctctcagcgtggcctctgcctccactgcctct

SEQ ID NO: 186414 - DNA, 601 bp, Human
cacacctgtaatcccagcactttggaaggctgaggcgggtggatgattagaggtcaggagtttgagactagcctggccaacatggtgaaaccccgtctctactaaaaatataaaatttagctgggtgtggtggtgctcacctgtaattccagctactcaggaggctgaggcaggagaatcacttgaacccagaaggcggaggttgcagtgagctgagatcacaccattgcactccagcctgggcgacaaagtgagactccatcacaaaacaaacaaacaaaaaccggagagctttgcattyagctatcatatttaaaagtggctgctagtggcattgagtgtgggggcatgtggctaaaggaaatgtcctggggtcgcaaggatggagaagaaataacaaataaaacatgaaggtagagaggcaaggatgaagatgaacaaaagtgggggaaaacagacacacataaggataaatgaaaccaggaggctaataaaaagggaggaagaaaagtagtggaaatccacatgcactttctcctaaactgaagcagaggctacagacgtggacttttctcttcagctaacactgagttctaagtga

SEQ ID NO: 186415 - DNA, 601 bp, Human
ctctacaaaaagtttaaaaattagctgggcatggtggcacatgcctgtggtcccagctacttgggagactgagatgggaggatcacttggaagttagagacttcagtgagccaagattgtaccactgcactccagcctgggcaacagagtgagacccatgatttttataatgaatcttacaaaaatacagcctgttttaataaaaaacaaacaaaaacagcaaggttgaattataacactgtctctgattatctgcattcctaaaattgagatgacagaagctaccatgggactaaagtcwttgagtaaaatgcaccttatttatttttcctcctttctctaccagtattggcaaaagagtgaaatcatttctttgcccagtgcttatcaaaaataggagattttctctttcctttaagatgagtatttacatactaggctgaaccagagaactgaggcaattaggcagtttggggtaaaaataacttagattttaaaatcttaaaataaccatcataaaaataccatttggataattgcttcaattgctccaacatccaagtggctgtcagatgaatcaattcaattcaaaagaaattta

SEQ ID NO: 186416 - DNA, 601 bp, Human
ttgttttggtatcaattatatacatgccaaaaccatgcagcgggtcatgcttgtaatcccaacattttgggaggccaaggtgagaggatggcttgagcccaggagttcaagactaacctgggcaacatggcgagaccctgtctctacaaaaagtttaaaaattagctgggcatggtggcacatgcctgtggtcccagctacttgggagactgagatgggaggatcacttggaagttagagacttcagtgagccaagattgtaccactgcactccagcctgggcaacagagtgagacccatkatttttataatgaatcttacaaaaatacagcctgttttaataaaaaacaaacaaaaacagcaaggttgaattataacactgtctctgattatctgcattcctaaaattgagatgacagaagctaccatgggactaaagtcattgagtaaaatgcaccttatttatttttcctcctttctctaccagtattggcaaaagagtgaaatcatttctttgcccagtgcttatcaaaaataggagattttctctttcctttaagatgagtatttacatactaggctgaaccagagaactgaggca

SEQ ID NO: 186417 - DNA, 601 bp, Human
gcaatggtatttacagatgggagattttcatagtataaatgtgtaaaactgaatgatttcttatttacatctatcttgctcttttacatttagaaatgatgttagataataaatgagtacagacagcatcttctgtaaaaggtcagtgtggtccaacagctcttgtcccacagtactacccagggatctgtcctttggtttgctgatgcagtcaccatgtgaacagctgggcacagtttatgtccaacgcttcctctttgggcccctgcttgatcccatgccttggtcacatgcatggggyaggaaatctttcaaactattttattctgaagcaattttgcctctttgacaactgcgcatgagggtattttcacaagtattatactgtcacagtaagtctgactcaactacaacgtttagggaggtattttaaatatttcatgtttacaattccttggggaaaatatgagcaatgtcccaaaaattacatatgcaatttgaaccagcaatcccacttctaggaatctaccctcaagatacccattttgtggtgggcagaaagatggagcccagcagatgtccacatcttaatccccatagc

SEQ ID NO: 186418 - DNA, 601 bp, Human
ccttacctctgctgggaaataaagcttcttaggtggtattgatgctagattgaggtccctgcaccttaaactgaagctgtccagtgactatgccccatgtgcattcacacagcaagttcaggaaacagacacgcttggtggaagaggaaatccatgcccgttcccacactgaccaactgaactgtcccgtcaacatacggacagccaaggatcaccagacttttgaagaaaacacaaacagcacacgcacacacaaaaaagaagaccaggagttttaaaaactgaaaaattggccaggcayagtggctcatgcctataatcccagcactgtgggaggcagaggtgggcggatcacctgaggtcaggagttcaagaccagcctggccaacatggcgaaaccctgtctctactaaaaatacaaaaattagctgggcatggtggtgggcacctgtaatcccagctacttgggaggctgaggcaggagaatcacttgaacctgggagaagaaggttgcagtgagccgagattgtgccagcctaggcaacagagtgagactccatctaaaacaaaacaaaacaaaaccctgaaaaattgaactaga

SEQ ID NO: 186419 - DNA, 601 bp, Human
taagtaaaactataagcaaaaccaaaaccaaacgaaatcaaatcaaataaacaacaatcaaatatacaaacacattaaacaaccacaatctagcccagtttactgtgagctgcttgagatctgaaattgtcttaatcatcttagcaaatctaatgcctagagcacagtacctagcatgcgcttggcatccaagaactttgttgtttatgaaaaatataaggaaaatatttgttacgttcaaatgagcatcatatttttaccgtaaagaaaggaacatggatttaaaatagacgtaaacttwattaagacaagctaaaacaagtttaactgtaaaccaaaacaacagcaaagcagtgcattgacaatttcagtcataaatgagaaacaacgccagatacatagcaattagggcatcaagttaaattgctttgagaaattgtcaccattctaaacaaatcacagaaaggtagtgaattcatgagcctacaggttctactgggaagtacaaaggtgaagtgaacaatgcatttcctaaaaagccattaatgatcccatatgccaacactgtggcagaaaaagaacatgtatagctactcagacc

SEQ ID NO: 186420 - DNA, 601 bp, Human
tctgcaagagaactttttattttacaaagatatgcctattaagtaaaactataagcaaaaccaaaaccaaacgaaatcaaatcaaataaacaacaatcaaatatacaaacacattaaacaaccacaatctagcccagtttactgtgagctgcttgagatctgaaattgtcttaatcatcttagcaaatctaatgcctagagcacagtacctagcatgcgcttggcatccaagaactttgttgtttatgaaaaatataaggaaaatatttgttacgttcaaatgagcatcatatttttaccstaaagaaaggaacatggatttaaaatagacgtaaacttaattaagacaagctaaaacaagtttaactgtaaaccaaaacaacagcaaagcagtgcattgacaatttcagtcataaatgagaaacaacgccagatacatagcaattagggcatcaagttaaattgctttgagaaattgtcaccattctaaacaaatcacagaaaggtagtgaattcatgagcctacaggttctactgggaagtacaaaggtgaagtgaacaatgcatttcctaaaaagccattaatgatcccatatgccaa

SEQ ID NO: 186421 - DNA, 601 bp, Human
gccaaggtcatgccactgaactccagcctgggcaacagaacgcgactctttttccaaaaaaaagagaagaaaggaaacttgagactcaaaatcaccttgactcagttgcacatcgattcttcctacagcactagtgcctaagcatcagttcgttgcacatgagtaaatgaaatttggtgtattcttgttcaacattgccaagcagcactcagcgtgactacttgggaagagaggggccactgtgtagatttttctccgcatcttttaaaacacaagaggaatatatgggagacagagtttmcataaaatggaaaataggaattccaaagcctatgttgacaaaaagagtcaaactctgtaaaatatttgaagagattcattctaaggcaaatatgagtaaccaatggcctatgacacagccctcaggagatcttgagaacatgtgcccaaggtggttggggcacagtctagttttatacattttagggagatacaagacatcaatcaaatacatgtaagctatacattgttctggacagaaaggcaggacagctcaaagtgggggcttcctggttataggtagatgtcaaaattttctgat

SEQ ID NO: 186422 - DNA, 601 bp, Human
aaaggcagcctggctaacatggtgaaaccccatctctactaaaaatacaaaaaattatccaggtatgacggtgcacacctgtagtcccagctacttgggaggctgaggcatgagaatcacttgaacccaaaaggtagagggtgcagtgagccaaggtcatgccactgaactccagcctgggcaacagaacgcgactctttttccaaaaaaaagagaagaaaggaaacttgagactcaaaatcaccttgactcagttgcacatcgattcttcctacagcactagtgcctaagcatcagttcrttgcacatgagtaaatgaaatttggtgtattcttgttcaacattgccaagcagcactcagcgtgactacttgggaagagaggggccactgtgtagatttttctccgcatcttttaaaacacaagaggaatatatgggagacagagtttacataaaatggaaaataggaattccaaagcctatgttgacaaaaagagtcaaactctgtaaaatatttgaagagattcattctaaggcaaatatgagtaaccaatggcctatgacacagccctcaggagatcttgagaacatgtgcccaagg

SEQ ID NO: 186423 - DNA, 601 bp, Human
taaatttaaaggacaatggagtgttctgatgttcatatgcaagaaagaagaaaggcagcctggctaacatggtgaaaccccatctctactaaaaatacaaaaaattatccaggtatgacggtgcacacctgtagtcccagctacttgggaggctgaggcatgagaatcacttgaacccaaaaggtagagggtgcagtgagccaaggtcatgccactgaactccagcctgggcaacagaacgcgactctttttccaaaaaaaagagaagaaaggaaacttgagactcaaaatcaccttgacwcagttgcacatcgattcttcctacagcactagtgcctaagcatcagttcgttgcacatgagtaaatgaaatttggtgtattcttgttcaacattgccaagcagcactcagcgtgactacttgggaagagaggggccactgtgtagatttttctccgcatcttttaaaacacaagaggaatatatgggagacagagtttacataaaatggaaaataggaattccaaagcctatgttgacaaaaagagtcaaactctgtaaaatatttgaagagattcattctaaggcaaatatgagtaacc

SEQ ID NO: 186424 - DNA, 601 bp, Human
gatgaacagagggtgagactggctggggatgctgatattaccagggacaggaatcctgctttgacttgtgagtaatcttggggatgctgaatcatgaaggaggaaggaagctgaaaagaatgggtaagtgaactcttgtacggtctgtcatgaaaaactcttagcttgagactgagtatctgtgaatggggagtgtcgggatgtccatgaaggatagaattttcttttctcttttctttttttttttcgagacagagtcttgctctgtcactcaggttggagtgcagtggcactatctctrctcactgcaacctctgcctcctgggttcaagtgattctcgtgcctcagcctcccgagtaactgggattacaggcataagccaccacgcccagccaatttttgtatttttagtagagatggggatttgccatgttcaccaggcttgtctcaaactcctggcctcatgtgatccgcccacctcagcctcccaaagtgctgggattacaagcatgagccactgcatctggcccaagaatggtagaattttcaagaaaaatgatcatatgttcccagaaagtaacagggttaacctagttccca

SEQ ID NO: 186425 - DNA, 601 bp, Human
tttcatccctctcctgtctctattctaggaagcactttcagaggacacactgatcggaagcatgatccaagatgggttaggaaacctgagttctaagctcagctccgtcacttaactagctctgtgatatgagcttgtccgagactccatttctcatctagaaatgaatagtcacatgtacttgatgaagataacttcagaatcaccagcaaatatgtgagagaaaactccttgtgagcagaatgctgcatccacaaagacatcaccatggtgatcctcatgaatggagggcaggccctcyggggcagtccctagccacacggccacactgggatgaacagagggtgagactggctggggatgctgatattaccagggacaggaatcctgctttgacttgtgagtaatcttggggatgctgaatcatgaaggaggaaggaagctgaaaagaatgggtaagtgaactcttgtacggtctgtcatgaaaaactcttagcttgagactgagtatctgtgaatggggagtgtcgggatgtccatgaaggatagaattttcttttctcttttctttttttttttcgagacagagtcttgctctgtc

SEQ ID NO: 186426 - DNA, 601 bp, Human
ggttagatcatcactgtaaaagaaaaaacacgagagtgatggggtgagtatacagaatatgttaggaggaaactgccataacctttcctaatctcctggctcccttctcaattgaagtcagaaaaatccaatggagaatgagcagttttttcaagaacatatttcatccctctcctgtctctattctaggaagcactttcagaggacacactgatcggaagcatgatccaagatgggttaggaaacctgagttctaagctcagctccgtcacttaactagctctgtgatatgagcttgtcygagactccatttctcatctagaaatgaatagtcacatgtacttgatgaagataacttcagaatcaccagcaaatatgtgagagaaaactccttgtgagcagaatgctgcatccacaaagacatcaccatggtgatcctcatgaatggagggcaggccctccggggcagtccctagccacacggccacactgggatgaacagagggtgagactggctggggatgctgatattaccagggacaggaatcctgctttgacttgtgagtaatcttggggatgctgaatcatgaaggaggaagga

SEQ ID NO: 186427 - DNA, 601 bp, Human
tggctgaagaactaggcaaagcaaggctggaacctgtgaaacccaccacgcctttttcccatattacggacatccgatcttcaacaccattcaccccattggggatcttggtaaaatcatccttcccaagagctttctggcaggtgttgaaagtgcagttatcagtccctgttgtggttagatcatcactgtaaaagaaaaaacacgagagtgatggggtgagtatacagaatatgttaggaggaaactgccataacctttcctaatctcctggctcccttctcaattgaagtcagaaaartccaatggagaatgagcagttttttcaagaacatatttcatccctctcctgtctctattctaggaagcactttcagaggacacactgatcggaagcatgatccaagatgggttaggaaacctgagttctaagctcagctccgtcacttaactagctctgtgatatgagcttgtccgagactccatttctcatctagaaatgaatagtcacatgtacttgatgaagataacttcagaatcaccagcaaatatgtgagagaaaactccttgtgagcagaatgctgcatccacaaagacatca

SEQ ID NO: 186428 - DNA, 601 bp, Human
gagtgcaatggtgccatcttgactcaccacaacctctgcctcacaagttcaagcaattctcctgcctcagcctcctgagtagctgggattacagccacgtgccaccatgcccggctaacttttgtatttttagtagagatggggtttcaccatgttagccaggttggtcttgaactcctgacctcaagtgatccacctgccttggcctcccaaagtgctgggattacaggtgtgagccactgcaccctgccccttcgtgtattttttatcatttcaagcattcgtgccaatgacacatgaygcactggaattcaagagcatgagaaatcaagcagaagggctatgccatttcagagaattgaagaataaccctctttgtatgcaatcttaattcatcctctaatgtctccgcaaaatagtgcgatgcatcgtctaaactaaaataaactatgcagagaagattatttctttgctgatgctatactgagggatggaatggtggtcgaggtgatagtattgcattcctagtatcctccctagtaaaaacaatcaaaaagcttctctatgaaaatttgtgccactctggtcctcaaatgggcag

SEQ ID NO: 186429 - DNA, 601 bp, Human
agagggtactaaaggtttatttaattatcaaacaatgcttgccttaaaaatgactaagaaccatgccctgaaagtaatattcccataagtaaaccatattaatgtttcataaaatgacatggttttctatatattattaagaactattcagtcactgtaaagccatttatataccagggaactatatagattatgaaaatctgctataataaagatattcattgtaaaacagaagttcaagtggaagcttgaacttttatcaagaaaatctaagtgaagagaagtcatctgggatggttaragttagggtggaggaaggggggtgaggaaaataatcagcagaagatgaggctatagagatgttttgaagatctaattgtaagttaatgattcaactatcatccaataagtaatggaggcaagtaaagggtttttgagagaacaatagcacaaacagaactttatttctaaatgagaactcccattcaaaacctatcctccctctataatattgtaaaaataataataaaagcattgtcagctgttctcagtacagaacaagagttcttgtactggagtaaagaatacactgtagcaagtg

SEQ ID NO: 186430 - DNA, 601 bp, Human
gagatatggtctcactctgttgcccaggctggagtgcagtggtgtgatcatggctcactgcagctttaacctcccttggctcaggtgatcctccccactctgcctcccaagcattaggttggtgcgaaagcaatctgttttgccatcacttttaatggcaaaaactgcaattacttttgcaccaacctaatagctgggactacatggtggggtatgccccaccatgcctggctaattttttatagagatggggtttcaccatgttgcccaggctggtctggaactgtaatcctaacacttygggaggccgaggcaatccacctgccttagcctccccaaagtgttaggattacaggcataagccaccacacccagatgcaatccttttgaaaagataaaaaaacaactcaagaggttcaattttatgcaattgaagttttacatgaaccaacaattatggatagtctattgcaagagattttaatgtggacagaattcagaggggtgtggctcctctaaaataaaattggaaagtgttaggggtttatccctatttatatggtaagagggtactaaaggtttatttaattatcaaacaatg

SEQ ID NO: 186431 - DNA, 601 bp, Human
cataatgccaatgatggagatgatggggtaacatatggaagcctgaagatgacttttcagaaaccccactacttagcatccacactaattcttcccattcatcctagaatcacaaaaattgttataggtgacagctaaattttggtaatggtattttcgattctcctttaaagtttgacaataccacatttatgatctgacttatttattacagacctaagatttatgagataatcatgtagacattagatagaatattatagagtgagaataggtgacaacactttttttttttttttttgagatggaatttcactctcgttgcccaggctggagtgcagtggtgcgatcttggctcactgcaacctccatctcccaggttcaagcgattctcctgcctcagcctcccaagtaagtaactgggattacaggcatgcaccaccacacctggctaattttctgtatttagtagagacggggtttcaccatgttggccaggctggtctccaactcctgacctcaggtgatccaccctccttggcctcccaaagtgttgggattacaggcgtgagccactgcacccagctgacaacatttttaa

SEQ ID NO: 186432 - DNA, 601 bp, Human
tcttttaacgtgaaccacaacaaacacgctttctccttgaattcttccagattcattattctatgaagcctcctcttcaacagcccccttctctcctttttcccacattctgtaactgaaaaaaatgaataatgatagtgcaaaaacattctgatgatggtttagaggaaaatgttaaattagaggagtaaagaagcaagatatagagtaagtcaaataagtcaaagaaatccaagggaggctcaatcaattcaatataccctgagaatatttttccacttttcaaaaaaaaaaaaaaaaacgataaaacaagaaaagaaagacaaaaaggtcaccagctttttaaaaggatctagagtcagagaaatagaaccccatggttcatctgccttctgatcaccacaggcaaaatagctaagaacatctaaaaatgaaaatgtcctgcaaagaatgaaactagtcaaactagagaaatagaaaataaccataataatacatatcttgtctttgtgtaacacgttcttagttgacaaagcattttcacatgtatctcatgtgattctaaccaaaactttatgaggtaggcataacaattcttaat

SEQ ID NO: 186433 - DNA, 601 bp, Human
acgtcaaataggatcaattaaaacaaaaatcgagagcataactcctcactccttaagtatgggctgtacatggtgacttccttccagaaaatacaacatggaaaggggtggggaaaacagctgtatggtggagaaacttggcaagtacgacctcagccagttcatccaggtcaacaccagtagtggtaagtcgtgctcaccgtatgtcttttgatgaaaatggttctttacttttgtgatcttcctcccgcaaacccacaacccgaagcttataattagaaaaacatcaggaaaatcacarcagaggccattctacaaaatacctgatcgatattcctcaaaactgtcatggtcatcaaaaacagagtcagagaaattgtcacaagtcaggggagcctaaggacacatgaccactaaatgtaatattaaatcccggaagggaaaaaacaggcaaaaactaaggaaatatgataaagcatggattctagttaataatagcatatcaatattggatcattaattgtgacaagtgtaccatactaatgtaagataataatagtggcaaccagctgtggggtacataggagtgtcttgtactatc

SEQ ID NO: 186434 - DNA, 601 bp, Human
ttgggggaaaatgcagttattagtagtaaagtccctagaaatcatttctagttcacttgaaaggttcagttgcataaaaatatgtttaaataaacaacttggaataaagagtggttaaaattgtatgcatatgtaatcaacaatgttagctttttttcatgcatagcccagacttttttttttttttaaagcaaatgtcttctgaaggccacaaaatgaatcttaggaggtttgtttgaacagtttcactgctaataatttttaaaaggtgtcagttctggaggctcgggctatcttagcyaaaataatccatccaagcttcttaattttagtcattctgaaatttagtggtgaaaattaaaggtgtgcaagaaacctgggagacagagtttttatatgaaatataattatagtatcttttggtcctgtctgaattaagtcattatacaaagatttctgactcacagctatagctaataagagctcccactcatttcacaaactgaccacctactactactatctattaccactaactgactacctactacatgccaactgctactgaacactaactatgttccaagcatcttatgacgct

SEQ ID NO: 186435 - DNA, 601 bp, Human
gtctagttctgggactcacatgtttgcaggacatggacaagtgtgtgtcaagagaagggtggatacaggagaggtcaggtgattgggattttgctactcatgggcctaaggatctggtgaagaacctgggaatgcatatctggtgatgggaaggcttactgggagccagtaactttcttcaaacatttgaatgaataaatgaaaggactatcatatgagaatgtagatatattctgcataattccaaaggctaaacatgtgaaggtctaagaggagataattttaatgcaaccagaagaasaatgtcctcataattacaggcatcccagaaagaaaaggactgtttggttaggtagtaagttccctgaaactagcagcaatcaagcaaaggtatagagaactccatttgggggcgctaattggacttttttagttccaaagtgttatctaattttatgactctaaaccagtgtttctcaaacttgagtgtgtatcagaagccgctggagggcttgggaaaacctagattgctggaaccaactacaggagtttttgaggcagcagctctggggtagggtctgagagttggcatttctgaaaa

SEQ ID NO: 186436 - DNA, 601 bp, Human
gtggtaagatattcaaacctcatgcaattgctcacaattactgttttggatgtacaaggtgtattcaaggaaaatgttattttaaaaaattgcaaagttctgcatttaattataaaactaatcagcctcagatattcctgctctgatggtattacaggcaggaacatgtctagttctgggactcacatgtttgcaggacatggacaagtgtgtgtcaagagaagggtggatacaggagaggtcaggtgattgggattttgctactcatgggcctaaggatctggtgaagaacctgggaatscatatctggtgatgggaaggcttactgggagccagtaactttcttcaaacatttgaatgaataaatgaaaggactatcatatgagaatgtagatatattctgcataattccaaaggctaaacatgtgaaggtctaagaggagataattttaatgcaaccagaagaagaatgtcctcataattacaggcatcccagaaagaaaaggactgtttggttaggtagtaagttccctgaaactagcagcaatcaagcaaaggtatagagaactccatttgggggcgctaattggacttttttagt

SEQ ID NO: 186437 - DNA, 601 bp, Human
caacatagataaatctaacaattataatgttgagaaagttgcacaatacatatagtacaattcatatgaagctaagaatacacaaaaattatatataatatatattatgtaaatatatagtcatgccttagaaatgcacctatatatatatagtaaatagaaagaaatgcatggaaatgataaacaccaaattgggtagttgttgagatgaggaaggagacaggcctgggaaggttaatacacaagtgttagctatagtactctttgtaccttttgtttatattaaatattgtactttttwaaaaaattatggacgttgtaagttactgtctactcaaagagacttaaaacacagaaaccagccatttactataatcctagtcattttaacataaacatcagagaagacccaatataagttttttaattactcactgaataaatgtggtaagatattcaaacctcatgcaattgctcacaattactgttttggatgtacaaggtgtattcaaggaaaatgttattttaaaaaattgcaaagttctgcatttaattataaaactaatcagcctcagatattcctgctctgatggtattacag

SEQ ID NO: 186438 - DNA, 601 bp, Human
tgcccttaccaccctggtaaagaatgggattatgcctaatcactttgtctccaccacctactatgtctctggcacatggtagggcccaagatatggtttgtaatggctgaataaatgaatgtggaacaagataaaagcataagagagagaaatgggaatttctgcatttagttgcaaaggcccataaatttatacgtttctattgagaaaatgtgagagcatttcatataaaacaaaccaggggatagatgaatgccccagagaaactctcacacatatatacaaagacatacagtgtctraaatagtgaaaaattgcaaacaacctgaatgtccaccagcaaaagaatatatcatcaattatggtatattcataaagcataatagtataaagcagtgaaaataaaaaaaccacatttcaacatagataaatctaacaattataatgttgagaaagttgcacaatacatatagtacaattcatatgaagctaagaatacacaaaaattatatataatatatattatgtaaatatatagtcatgccttagaaatgcacctatatatatatagtaaatagaaagaaatgcatggaaatgataa

SEQ ID NO: 186439 - DNA, 601 bp, Human
atgatgaaatacgtgcagactcaagtcaccaaataggtgaatattcggctgtgtcgcctcaggggactggaaggggtctggagctttgttgtcttcacttcctcccccattcatattccagctccaggcccacccctgccagggttgcagggcccaccagctttgtttctgtggctctggtgtggtagatctggtcagagaacccactgtctgattggtgggcttactctggcagtgagagctggtacctggaccatcagaatcacaattcaaaagacaactggggcaaaaagcaaaagcyaccacttctctgctggccatgcccttaccaccctggtaaagaatgggattatgcctaatcactttgtctccaccacctactatgtctctggcacatggtagggcccaagatatggtttgtaatggctgaataaatgaatgtggaacaagataaaagcataagagagagaaatgggaatttctgcatttagttgcaaaggcccataaatttatacgtttctattgagaaaatgtgagagcatttcatataaaacaaaccaggggatagatgaatgccccagagaaactctcacacatatat

SEQ ID NO: 186440 - DNA, 601 bp, Human
gtgtgtcttgggtgggtgccaatattatatatttcaagcattgtgtgtgcggttagaatgatgaaatacgtgcagactcaagtcaccaaataggtgaatattcggctgtgtcgcctcaggggactggaaggggtctggagctttgttgtcttcacttcctcccccattcatattccagctccaggcccacccctgccagggttgcagggcccaccagctttgtttctgtggctctggtgtggtagatctggtcagagaacccactgtctgattggtgggcttactctggcagtgagagctrgtacctggaccatcagaatcacaattcaaaagacaactggggcaaaaagcaaaagctaccacttctctgctggccatgcccttaccaccctggtaaagaatgggattatgcctaatcactttgtctccaccacctactatgtctctggcacatggtagggcccaagatatggtttgtaatggctgaataaatgaatgtggaacaagataaaagcataagagagagaaatgggaatttctgcatttagttgcaaaggcccataaatttatacgtttctattgagaaaatgtgagagcattt

SEQ ID NO: 186441 - DNA, 601 bp, Human
atctctggtactgatgtgttgagctgatatttttctcttccaaaacttagttatccttcactatgtttatatctttgtcttaccaaaatgcaacctctctgatgacaggtattacaccttatatttatgtctccctcagtactcagtaatttctcacacatttcttacacacaatgaacatgcaatcaatatatgttttcagataactgattaacattgtcctcatccccctcgcctccaccatgtgaggaattcagcaatccttctacacagataaaggctccatttgtttttcttgtgrgtaaattgccttctcattattctgcctccagaaacttagctctcttaaataaatgcctggtaggaggacagaactgagagcaaagtaagaacatttcccttctctggtgagaagaaaagggcacaatcatagcacaggatgatagtggagggctcacgggaagaaaatataacaaaaacgtgaagaaaccacctttaagaaattttggagagggaaagagcattgcaaatatacaaaatgatagagaaaacatagggagaaaaggacttcacaggaaaggaaaaaataaaacaaagctat

SEQ ID NO: 186442 - DNA, 601 bp, Human
gtgccaggcaaattgggaagcacagatttggatcaactcaaaccctcactcaaagacattcaatagctcatgctgcctcacataaaatctgctatacttcacctaacattcaaagcccttggcagtctgacaaggacaaatctcatcttcaactccttcccatcctgacccctctctcattctccagtttttattatcccacgactgtatctttcccattttcctcatttgcccctgactccaccatctggatggctttactgtccccatccacctgtccagagccacctccaaggattcrgttagtgcaaagccccttcccaagcccaaaccagtcatctgtgaagtcttcacagatgacctcaacttaggacaattatttggactactcctttgtcaaggagaccagcacgtgagacctccttcatctctggtactgatgtgttgagctgatatttttctcttccaaaacttagttatccttcactatgtttatatctttgtcttaccaaaatgcaacctctctgatgacaggtattacaccttatatttatgtctccctcagtactcagtaatttctcacacatttcttacacacaat

SEQ ID NO: 186443 - DNA, 601 bp, Human
caaaccagggtgagttggttttgctacatcctcctccccatctccaaagccccttctctttacagccatgtactctacaaataacaccattttctactggtgccaggcaaattgggaagcacagatttggatcaactcaaaccctcactcaaagacattcaatagctcatgctgcctcacataaaatctgctatacttcacctaacattcaaagcccttggcagtctgacaaggacaaatctcatcttcaactccttcccatcctgacccctctctcattctccagtttttattatcccaygactgtatctttcccattttcctcatttgcccctgactccaccatctggatggctttactgtccccatccacctgtccagagccacctccaaggattcagttagtgcaaagccccttcccaagcccaaaccagtcatctgtgaagtcttcacagatgacctcaacttaggacaattatttggactactcctttgtcaaggagaccagcacgtgagacctccttcatctctggtactgatgtgttgagctgatatttttctcttccaaaacttagttatccttcactatgtttatatcttt

SEQ ID NO: 186444 - DNA, 601 bp, Human
ctagtgctttatcacttgatacatgatcatgatattaatggtttttaaagttctactatatgccaggcaccatattaaaggcattaactcttctcaacaagccccaaaagttgctacaattattatcatatctacattttactggggaggaaagagcctcgaagaggggagtaacttgcccaaggtcctgcagccagtactggcacagttaagatttaaatacagttgcctaatttggctctaaatgccatgtcccttaaccattgggcctaatcttttaccttgtattatagttatttgmgttacttggggtgttccttatctgtctaattagatcctaagttcccttagggtaataattttttcactcaactttgagtacaatgtattgcatccagctggcactcgataaatgcttggttcatacatgagcaaggctgcagttattttgaagtcacttctgactcctctctttcagtccatttccaatttttcaccaacctaaattaactccttttttcccccattttccaggccttcattttgtttgctttcatcttgacttatcccctccggccagactcctacaatagcctcctga

SEQ ID NO: 186445 - DNA, 601 bp, Human
aaatgtataaacaaggatgaaactgtgattgacaaaacaaactgaaatttgggatagttgaatttttctaagctttttttcctagaatcccacattataaaagtcatttactttggtatctccctactactgtataactctctagtgctttatcacttgatacatgatcatgatattaatggtttttaaagttctactatatgccaggcaccatattaaaggcattaactcttctcaacaagccccaaaagttgctacaattattatcatatctacattttactggggaggaaagagcctygaagaggggagtaacttgcccaaggtcctgcagccagtactggcacagttaagatttaaatacagttgcctaatttggctctaaatgccatgtcccttaaccattgggcctaatcttttaccttgtattatagttatttgcgttacttggggtgttccttatctgtctaattagatcctaagttcccttagggtaataattttttcactcaactttgagtacaatgtattgcatccagctggcactcgataaatgcttggttcatacatgagcaaggctgcagttattttgaagtcactt

SEQ ID NO: 186446 - DNA, 601 bp, Human
tctactaaaattgtggttaccactgtgcctcaccaacatgccagtcacaaactaaatgtgcagggccgggcacagtggctcatgcctataatcccagcactttgggaggccgaggtgggcggatcacttgaggtcaggagttcaagaccagcctggccaacatagtgaaaccccgtctctactaagagtacaaaaattagctgggcgtggtggtgcacgcctgtaattccagctactcaggaggctgaggcaggacaattgcttgaactagggaggcagagattgcagtgagccaagatcrtgccactgtactccagcctgggtgacagagaaataaattaattaattaaataaaatttaaaaaatcttaaaaaaatacaaactaaatatgcaggacaggaaatgtataaacaaggatgaaactgtgattgacaaaacaaactgaaatttgggatagttgaatttttctaagctttttttcctagaatcccacattataaaagtcatttactttggtatctccctactactgtataactctctagtgctttatcacttgatacatgatcatgatattaatggtttttaaagttctactata

SEQ ID NO: 186447 - DNA, 601 bp, Human
aacgtttgccatattttaggaattggaaacactgctatattaaaaacaaaactacaacttagtcttttatcattgttgaaaatcattcttggatcattaaactcttcttgtctctggtttctctcttaaatgagggagaataatatactaactaggcttaaaatattaccataaagaaagttaggttctaataaatgggtttcctatgtccagaatcttaagaccacaattccatagctctagcccacgaactatacacaacccttttcacttctggcttaagacaggaagaaaaaaaaaagtcatcttggtggaagaatgtagaaaatccctaccattcaatgggtttatcatacactcattcattttacatgcatttattgatcacctactccgtgccaggcacggttctaggtgctggggatacagcagtgaacaaagataaaaatctgagctcacaccctagccatgctatttctgcatttggaagaatctctttgttataaatatgattctgacataccttagtgaacaaagtcaatgtttcaataatagtaacatgcttgtagtaccttacagtttatacaaaacactttcatgt

SEQ ID NO: 186448 - DNA, 601 bp, Human
tcacagtgtatatgactcaaatagtaagtgcttaaccactgtatagtgtctctcactataagtgatccatccagaacacaagtctagagctaaatgcacatttatataaaattttaacccctcttcttccagaaatactaaagtactttaaaaggaaaacataacaggaggtaggatgattagggataaaaacagaacaggaaaacattagaaaaaaggacggtaccatgtacctgtgagtagtggaatttaggtctacataggagattatactcattagcagaaacttctatacaaaacctttacccaaaaataggcaaccaaaaaatgaatccattgaaggcaagttgtcatgttttcttttaggccatgcatacaatttattctcataggtaacagaaaaacaacaaatgaggcatgagaggagaagaaaacaacgtttgccatattttaggaattggaaacactgctatattaaaaacaaaactacaacttagtcttttatcattgttgaaaatcattcttggatcattaaactcttcttgtctctggtttctctcttaaatgagggagaataatatactaactaggcttaaaatat

SEQ ID NO: 186449 - DNA, 601 bp, Human
ggtctgtaagctgttttggaagtgacctgagacaatcagtcagtaaccatgcaatgctcactgtactagtactaagcttatatatttctgccaaggctaggaagttttacctaatgctcactgctcaaaaccatcagttggttttgaattgatgaagccacttatgatctaagtgtttaagtggaatttgtttagaatcttctaaacttaaatgagtaaacaaagtaacagttgtgaataacaaagtaacttcatgcttcactgtctgaagactgtgccgtggaaaaataaggcaaaaagscttccaggcatcaaaggctccttggtgtgaactggagatcaggatgtccatctgaagagatgaccttggatattcaatgacaggagtctgacctcaaatttctaaaccagaggttggcaaaccatggcccgcaggccaaatctggcccatagcctgcattgtaaataaagttttattgaaacacagtcacattcatttacatattatttgttgctgcttttgcactacaacagcagagttgagtactagcaacagagtccatatggcccacaaagccaaaaagaaagtactatgtggctc

SEQ ID NO: 186450 - DNA, 601 bp, Human
cagaggtattttatatatgtatttgtttatctgcaaataagttattagcaaatttctggatttccacttagcataaatattccttgttctatacggtagtttttagaaagtgggaaactaaaaataatttagtgtctttaaggaacaggaactgaatgtgaatcagccaagctagcatgatactaggatgtatgtcttatgaatattaaacagataagtacttataggtaaggtacgattattagcttttggaaagctaggctattagcctgaatactggtgagagttagaaataactttctggggtgatgtgtggacttggtcttataattttattgtcatccttcccaggaagctgtgttgtctttggcaagctgacattgcttgacagactatgaggacaacttgagcaggaaaagatgtcagtttcctatatagaaatacactgggtaaaactcacacaacatccttcccgaaagtacacaataggccagggacttattggtatgttcagttctagctccatattttaggaagaaaaaggaattaagagacaggactagctggatttcctaggccaactaagaatccctaagcctag

SEQ ID NO: 186451 - DNA, 601 bp, Human
aaatgggaattgcttcagccacgttattaaatctaaattggacaataacttggaactctaccggtgctcagtagatgacaaaatacttaatgcaggtttataaaaatgctccccaagcattgacttaaaggaataaagttcactctgctattttgtccttggaggtatgtaatataggtcatggatggtgatgtaggtcatggtgagataaattggatttagacatgagcaagctgaccttgtatgtaggtaccatgtccttcacctcctatgcctcacacagtactgagcaaacagaggyattttatatatgtatttgtttatctgcaaataagttattagcaaatttctggatttccacttagcataaatattccttgttctatacggtagtttttagaaagtgggaaactaaaaataatttagtgtctttaaggaacaggaactgaatgtgaatcagccaagctagcatgatactaggatgtatgtcttatgaatattaaacagataagtacttataggtaaggtacgattattagcttttggaaagctaggctattagcctgaatactggtgagagttagaaataactttctggggt

SEQ ID NO: 186452 - DNA, 601 bp, Human
agtaatgtgggtctccccaaccccagataaatgacttgttttaggtattctgttatattctctcccactcaggcactttggccttggaacagatagattcttaccaggttgccatgagaaacaaaaaaagttaatagaatcatgtcaggattattagtggcatctttaaaaatatacctcatctctctacattgtgttgtgtgatgccttatgtattcagtgtgaaacaataataatcatgacatcttcctatgaggtaggtattattattattattattattattattattattattatycccatgggctagataaggatgatgaggcacagaaagattaataacactcaccccagtttacacagctagtaagttcatgtagctgagatataaatatgacatatgagataagcctgggcctttcgcttcagaggttgtgctcttaaccactagacaatactgcccctcgaaagctttatgggaagctacctggaaagcacgcggttgatgaaaacattcttaatccaccagaaaataaataggaagcagcttgtttcatactccatgatgtttcttggtctgttttctgtttagcagtaa

SEQ ID NO: 186453 - DNA, 601 bp, Human
agtattttccacattttataggaaaaataaattgagatttagaaaggttatatcacttgccaaaggacatatgaccactttgatgaaactaagattttttttaattttaatttttagtttttgagacagggttttgctcttgttgcctaggctggaagtacagtggtgtgaccatagctcactgcaatctctacctcctcagttcaagcgatcctcccacctcagcctcccaagtagctggcactacaggcacgtgccaccacacccagctaatttttatattgtttttggtagagacagrgtttagccatgtcacccaggatggtctcaaactccaaggctcaagcaatccacccaccttggctttccaaagtgttgggattacgagcatgagtcactgcacctggttggaaacttggatctttttatattttttaaatttacaataaaaatgaccttctggtgcacatttctatgaatgtttacacatacatagatttgtgttaccatcacaacaattaagacacagaacagtgataccactaccctagactcatactatccctctgtagtcacgccctcccccaatccctaacacctg

SEQ ID NO: 186454 - DNA, 601 bp, Human
gctcagacagaattcttgacttgtaatgctgaccacaacccacccactcaagtttgctcctcccttgagttctcatctcagtaaatgacatcaccatctatctttcctcacccctcaaccagcatcaagcttctttgttctaccttctcccaaaataaaccccccgcttctcctctccccactccatggctcccactggagtctataccgtcatctctcacctggacaaccccaacacttcttactggcttctttgtttcaattcttaccctcctgcattccttaccactctccacaaagytgctcaaattgtcttttaaaaatgaagatcagatcatgtcactttcctgcttgaaaccctcagtggctccaggctgttacctaagagccaaatagctgtaaaaaagcatggtgatgataataataaaaaataatctgctctcagtgagaaatagctgccatggaaaagagaaagaggagcatctagtatgtcagggagatcgtttataacatcttatttcatctttagaatgcctctccaaggtagagagtattttccacattttataggaaaaataaattgagatttagaaaggttata

SEQ ID NO: 186455 - DNA, 601 bp, Human
tacgctgaacccaatgtatagtcttttatccctcaccccttcccaccctttcccgctgagtccccaaagtccatggtgctattcttatgcctttgcatcctcatagctttgctcccacttatgagtgagaacatacaatgtttggttttccattcctgagttacttcacttagaataatagcatactctaaattctggtagaaggttctacaatccctctcaggaatggattaaagagataaattttttaaaaatcgtcaaggctgagtgagtctaaggaggagcagctcaaagttccccyagccttatttggaagggctgatgaggaagcccccgctgctgtgtgctgcagtcctagtaatgaacaagataacactggcctgttccttggtctaactgcttacttggtttccaatcccaacatgctcagacagaattcttgacttgtaatgctgaccacaacccacccactcaagtttgctcctcccttgagttctcatctcagtaaatgacatcaccatctatctttcctcacccctcaaccagcatcaagcttctttgttctaccttctcccaaaataaaccccccgcttctcctctc

SEQ ID NO: 186456 - DNA, 601 bp, Human
attttggtgcacccatcacccaaacagtgtacgctgaacccaatgtatagtcttttatccctcaccccttcccaccctttcccgctgagtccccaaagtccatggtgctattcttatgcctttgcatcctcatagctttgctcccacttatgagtgagaacatacaatgtttggttttccattcctgagttacttcacttagaataatagcatactctaaattctggtagaaggttctacaatccctctcaggaatggattaaagagataaattttttaaaaatcgtcaaggctgagtgastctaaggaggagcagctcaaagttcccctagccttatttggaagggctgatgaggaagcccccgctgctgtgtgctgcagtcctagtaatgaacaagataacactggcctgttccttggtctaactgcttacttggtttccaatcccaacatgctcagacagaattcttgacttgtaatgctgaccacaacccacccactcaagtttgctcctcccttgagttctcatctcagtaaatgacatcaccatctatctttcctcacccctcaaccagcatcaagcttctttgttctaccttct

SEQ ID NO: 186457 - DNA, 601 bp, Human
tgagtaagttctttagtggtgatttgtgagattttggtgcacccatcacccaaacagtgtacgctgaacccaatgtatagtcttttatccctcaccccttcccaccctttcccgctgagtccccaaagtccatggtgctattcttatgcctttgcatcctcatagctttgctcccacttatgagtgagaacatacaatgtttggttttccattcctgagttacttcacttagaataatagcatactctaaattctggtagaaggttctacaatccctctcaggaatggattaaagagatamattttttaaaaatcgtcaaggctgagtgagtctaaggaggagcagctcaaagttcccctagccttatttggaagggctgatgaggaagcccccgctgctgtgtgctgcagtcctagtaatgaacaagataacactggcctgttccttggtctaactgcttacttggtttccaatcccaacatgctcagacagaattcttgacttgtaatgctgaccacaacccacccactcaagtttgctcctcccttgagttctcatctcagtaaatgacatcaccatctatctttcctcacccctcaa

SEQ ID NO: 186458 - DNA, 601 bp, Human
tttttatagatacaatgggggcttcttcaataccccttcccaaatcccatgcccgttcctgccttcccaaaggaaatagctatttggtagttatcaaattggacttggtagttatcaaggaaaagtatgtatggaatttctttcattgtctgtagcaaaactagaaatttgaagataacagaaataataaaatacgttggaatataatctcttagcatattctgtgtcatacatttgtcatcattctcagtagtttattaatacttttcaatcctacataatacgattgatgactttcagrctgggtatttgaaaatgctacatgcctcctttccttaaatctcattaaatggaaaagaaaaaaatctggcagcagtgactaatatgagcataatctgagtcctttttttctttaaaatgttttatttccataggcttttggggaacaggtggtatttggttacgtgagtaagttctttagtggtgatttgtgagattttggtgcacccatcacccaaacagtgtacgctgaacccaatgtatagtcttttatccctcaccccttcccaccctttcccgctgagtccccaaagtccatggt

SEQ ID NO: 186459 - DNA, 601 bp, Human
aatgagggtggagtgagtggaaggagggcattgtcttttatgttcagattttaaaattatttttatttatatgttaacaacacattttttcatttttaaattataaaatatttttaaacgcagatgactgatgaacacactgaccctatatccagctctatgaaattttaactttttatagatacaatgggggcttcttcaataccccttcccaaatcccatgcccgttcctgccttcccaaaggaaatagctatttggtagttatcaaattggacttggtagttatcaaggaaaagtatrtatggaatttctttcattgtctgtagcaaaactagaaatttgaagataacagaaataataaaatacgttggaatataatctcttagcatattctgtgtcatacatttgtcatcattctcagtagtttattaatacttttcaatcctacataatacgattgatgactttcaggctgggtatttgaaaatgctacatgcctcctttccttaaatctcattaaatggaaaagaaaaaaatctggcagcagtgactaatatgagcataatctgagtcctttttttctttaaaatgttttatttc

SEQ ID NO: 186460 - DNA, 601 bp, Human
aacattaacatttcattacaaagtaattacatttttctgagagaaaaacccaagagatcactctttaaggtgattaatgagggtggagtgagtggaaggagggcattgtcttttatgttcagattttaaaattatttttatttatatgttaacaacacattttttcatttttaaattataaaatatttttaaacgcagatgactgatgaacacactgaccctatatccagctctatgaaattttaactttttatagatacaatgggggcttcttcaataccccttcccaaatcccatgccygttcctgccttcccaaaggaaatagctatttggtagttatcaaattggacttggtagttatcaaggaaaagtatgtatggaatttctttcattgtctgtagcaaaactagaaatttgaagataacagaaataataaaatacgttggaatataatctcttagcatattctgtgtcatacatttgtcatcattctcagtagtttattaatacttttcaatcctacataatacgattgatgactttcaggctgggtatttgaaaatgctacatgcctcctttccttaaatctcattaaatgga

SEQ ID NO: 186461 - DNA, 601 bp, Human
ggatgctcctacccattttatctctttcttttctttactggtttcagacttaacttgcaatctgagggctctcccaatcttttccagccacctcctagtttctttcacaggtgtttcccctaataaaactcatacacctttatccatcttggtgtctgcctcttggaggaccctgactaacacaattgccaaaagcccccaccagattaccccacaatctggaaatcccgaactgacctatcagtctgcaaggggaaatgcgtgcatccaataatgatcctttatctaaaaactggcatcyctaatctctcatatcaatcctgacaccccaggaatacattaaaccaagtgtgatgtgtcaacaccactactaccaacaataaccagccagacatccagaagcaggagacagtccgacttgtggcagtatcccactgtggcacactcacccggtctcgctgctttattcgtttgtaaatatattcagcaaatggttttcgaggaataaacttcccatctcctgccgtgacactgaacactccggcttcatataccactttgcctcttgaaatagtcacaaggggcaccccgtggcaaacca

SEQ ID NO: 186462 - DNA, 601 bp, Human
cgagggcaagagagaatttaggtcttctccagcccaaaactccaccattgctctggtggtcataaaaactgaccttgcagatcttcaactaatgggagcacattttttcaaggggctgctgctgacctctgaacttcattacacttttacacagaggtcacacctcccacagtggctctcagccaatgactgggcctggcctgtagctgggagatctgagacttggctcaaggactccctgacggcctttttcagcctcccctagactgtagggtgttccaggatgctcctacccattttmtctctttcttttctttactggtttcagacttaacttgcaatctgagggctctcccaatcttttccagccacctcctagtttctttcacaggtgtttcccctaataaaactcatacacctttatccatcttggtgtctgcctcttggaggaccctgactaacacaattgccaaaagcccccaccagattaccccacaatctggaaatcccgaactgacctatcagtctgcaaggggaaatgcgtgcatccaataatgatcctttatctaaaaactggcatctctaatctctcatatcaatc

SEQ ID NO: 186463 - DNA, 601 bp, Human
ggaaatggtggcgagggcaagagagaatttaggtcttctccagcccaaaactccaccattgctctggtggtcataaaaactgaccttgcagatcttcaactaatgggagcacattttttcaaggggctgctgctgacctctgaacttcattacacttttacacagaggtcacacctcccacagtggctctcagccaatgactgggcctggcctgtagctgggagatctgagacttggctcaaggactccctgacggcctttttcagcctcccctagactgtagggtgttccaggatgctcytacccattttatctctttcttttctttactggtttcagacttaacttgcaatctgagggctctcccaatcttttccagccacctcctagtttctttcacaggtgtttcccctaataaaactcatacacctttatccatcttggtgtctgcctcttggaggaccctgactaacacaattgccaaaagcccccaccagattaccccacaatctggaaatcccgaactgacctatcagtctgcaaggggaaatgcgtgcatccaataatgatcctttatctaaaaactggcatctctaatctc

SEQ ID NO: 186464 - DNA, 601 bp, Human
gaattgagcccaaggaggatcgagaaacttgctcaaggcaacacagctaggaaatggtggcgagggcaagagagaatttaggtcttctccagcccaaaactccaccattgctctggtggtcataaaaactgaccttgcagatcttcaactaatgggagcacattttttcaaggggctgctgctgacctctgaacttcattacacttttacacagaggtcacacctcccacagtggctctcagccaatgactgggcctggcctgtagctgggagatctgagacttggctcaaggactccctracggcctttttcagcctcccctagactgtagggtgttccaggatgctcctacccattttatctctttcttttctttactggtttcagacttaacttgcaatctgagggctctcccaatcttttccagccacctcctagtttctttcacaggtgtttcccctaataaaactcatacacctttatccatcttggtgtctgcctcttggaggaccctgactaacacaattgccaaaagcccccaccagattaccccacaatctggaaatcccgaactgacctatcagtctgcaaggggaaatg

SEQ ID NO: 186465 - DNA, 601 bp, Human
acctccctccctcccagggttattatagtgacagagaccttagcagtgtgtcttgcattcagtaagcactcactaaatgttagtgctgctgttatttatcacatacatcttcagaaacaccgaggatcctaggattcttatagttaccacctacttgtcacccattaatgttaacatttataaactaactccccagaaatattaactgtaaccttaaaccacctattttgactgagcatataaatacagcatataaagaactgcagttttctgagaatttaaagcacgtgagaaaacttgwttacctaatcaaagccttaggaagtgtttaaaaatggataaatcttgcataatggactctgagaatccacaagtaaaaatttttcataagacattaaaggagaaaccaaagcctctacaagatccaaatgaattgaatcaaaaaaacagccagagagctctggaaaaggagaggtacatttgaaaaatggaaagaagagggagaagccttagaactagtccaagggtggcaaacactaccatctacatggccaggcaagtaatgtgtgaagccttctgggtgaaaaccagaaatacctcc

SEQ ID NO: 186466 - DNA, 601 bp, Human
catcacacacagggcctgtcctcctcactcagaacagggcttgctctacagcctgctctatcacctagaggatgcttccccagaacccagcttgcaggctctgggagcaggcaccacccaggccaggcacatcagaatccttcctggtagcttccggtcagggccatgcttttgcatgggctgggctgccgctctcatttttgtgtaattatctgacttctcttttatcactcagctcagctaatcatcagtctaggaagctttggccctctgtcccctatccactatcttgcttaccccrggtttctggaataatctgttcactcgtcagtctcccccagcagacagagggccggtgtgctgctctctttcttcataacaagcactcaatagatatgggtagaagggatttttggggagggagctatgaagggggcttcccatctaagcctgctttcttctttttgtggtttggcctggcgtgggctgactccgtttctgtcaggctcttttgttgtgctgcatcatttatctgttctccaggctgtactttttttttttttcgagacagagtttcactccatcacccaagctggagcac

SEQ ID NO: 186467 - DNA, 601 bp, Human
atcctccctttcaggtccttggtccctgttttttttttttttttttcttctcctgacttgactttccaagccagactgcctgaatatcacttaaacctagggtgactgtacaatttatcatccaaagtaggacacttcttagcatgaaaagggcactaaacataattaacgtaagtataatccaggcccgtctgagcaaaccaagatttatgtccttctttcagctcgttcctgcctatcacctagagggcttgacttctctctgctcctcttggcattcatactcagcaaagccgatggyatatttcagttcaatcttcaggctcttttgcagtgagtgcctctggagcatgtgacctaactgagcagacttttgtgccgcctactgtgtgctgtgcagccctcctcagatcccattccgtctccctcttcctacaccacttccttgaacctacactacttgcacttttcagctgttcattttttgtctgtcctggactccgtcttgggaactgactgcccatgccagtggctcaggtggggccatcacacacagggcctgtcctcctcactcagaacagggcttgctctacagcctgct

SEQ ID NO: 186468 - DNA, 601 bp, Human
ccttccctcaccaggccaagcctctgctcactttctgtatctgtctaaatgctttgctggacttccattttggctcactgtctactcagtctttgagccctgttctcatcttgaggaacacagacaccaggaaatgaagggccagcctcccatttctaccaccttggaccaccacatctgaaaccttaaactcactaataccccactctctggccacatcctccctttcaggtccttggtccctgttttttttttttttttttcttctcctgacttgactttccaagccagactgcctgartatcacttaaacctagggtgactgtacaatttatcatccaaagtaggacacttcttagcatgaaaagggcactaaacataattaacgtaagtataatccaggcccgtctgagcaaaccaagatttatgtccttctttcagctcgttcctgcctatcacctagagggcttgacttctctctgctcctcttggcattcatactcagcaaagccgatggtatatttcagttcaatcttcaggctcttttgcagtgagtgcctctggagcatgtgacctaactgagcagacttttgtgccgcct

SEQ ID NO: 186469 - DNA, 601 bp, Human
gtgtgcactgagtgctcaggaaatggggggactcctgcccttccctcaccaggccaagcctctgctcactttctgtatctgtctaaatgctttgctggacttccattttggctcactgtctactcagtctttgagccctgttctcatcttgaggaacacagacaccaggaaatgaagggccagcctcccatttctaccaccttggaccaccacatctgaaaccttaaactcactaataccccactctctggccacatcctccctttcaggtccttggtccctgttttttttttttttttttcttctcctgacttgactttccaagccagactgcctgaatatcacttaaacctagggtgactgtacaatttatcatccaaagtaggacacttcttagcatgaaaagggcactaaacataattaacgtaagtataatccaggcccgtctgagcaaaccaagatttatgtccttctttcagctcgttcctgcctatcacctagagggcttgacttctctctgctcctcttggcattcatactcagcaaagccgatggtatatttcagttcaatcttcaggctcttttgcagtgagtgcctctg

SEQ ID NO: 186470 - DNA, 601 bp, Human
cgcatacccagtaatgtttttatattttagtacttaggtttgtgctatttatatgcattttatatctaaaacttaacaatgtaacaataatatatattttatatctaattacatgttactatttatatattattttttgtatctgtttttgttttttctgttgcccaattttctattggctttatctttgcttaccaatttgtaagagtattgttaaactaatccttttttgttactacattttgctaatatttttcactgtgtggcttctcctctttatatttatgttcaattttttgtrcagatgtttttgattttaatacagccaaaattgtcatattttattgtttatgctttttgtcttggttaagaaatcctgtctacctagatcaggacagtttttctgtatgttttcttttaaatcttccggttttttcatttgcatttaatccacatggaactgactttgtataaaaatctaatttttttttccatataggtaactaattgtcgcagcaccatttattgagtagtctattcttagtttttaatgccatctatgtcatatcaaggtttcctaaatatgtagttctgttttggg

SEQ ID NO: 186471 - DNA, 601 bp, Human
acattgctgttctttgtaattgcgctctttacacttagtcctttataaaaagacttactgggatttttattggaactgagctgaatttatggatcaagtaagtttttattccatgaatattgtataagctacaattggtgggaatttatctttttgccttaaatatcttataattatccactttgggagactgggcgggcagatcacgaggtcaggagatcgagaccatcctggctaactcggagaaaccccgtctctactaaaaatacaaaaaaacattagctgggtgcggtggcgggcrcctgtagtcccagctaatcaggaggctgaggcaggagaatggcgtgaacccacgaggcggagcttgcagtgagccaagatcacgccactgcactgcagcctgggcaacagagggagactccatctcaaacaacaacaacaacaaaaaacttataattacctccatgaaatttttttccatattttattttttattcctagattatttttgctgtagtagttgcaaatgggctttcttttttccttttacattttccagttggttattaactggtatggcagaatgctattgatttttttt

SEQ ID NO: 186472 - DNA, 601 bp, Human
gtacctggttcatctcactgggactggttgaacactggtcgcaccccatggagggtgagccaaatcgaggcggggcatcacctcacccaggaagcgcaagggattgggggatttccctttcctaaccaagggatgccgtgacagactatacctggaaaaatgggacacttctgcccaaatagtgggctttttccacagtcttagcaacaagcagaccaggagattctctcccatgcctggcttgacggatcctatacccatggagccttgctcagtgctagcacagcagtctgagatcaayctgcgaggcagcagcctggcagggggaggggaatccaccattgctgaggcttgagtaggtaaacagagcgcccaggaagcttgaactgggaggagcccactgcagctcagcaaggcctactgcctccatagacttcagctctgtgggcagggcatagctgagcaaaaggcagcagaaacttctgtggacttaaacgtccctgtctgatagctctgaagagagcagtggttctcccagcatggtgtttgagctctgagaacggacagacggcctcctcaagtgggtccctgacccccgtgt

SEQ ID NO: 186473 - DNA, 601 bp, Human
cggggcatcacctcacccaggaagcgcaagggattgggggatttccctttcctaaccaagggatgccgtgacagactatacctggaaaaatgggacacttctgcccaaatagtgggctttttccacagtcttagcaacaagcagaccaggagattctctcccatgcctggcttgacggatcctatacccatggagccttgctcagtgctagcacagcagtctgagatcaatctgcgaggcagcagcctggcagggggaggggaatccaccattgctgaggcttgagtaggtaaacagagcrcccaggaagcttgaactgggaggagcccactgcagctcagcaaggcctactgcctccatagacttcagctctgtgggcagggcatagctgagcaaaaggcagcagaaacttctgtggacttaaacgtccctgtctgatagctctgaagagagcagtggttctcccagcatggtgtttgagctctgagaacggacagacggcctcctcaagtgggtccctgacccccgtgtagcctgactgggaaacacctcccagtaggggctgacagacacctcaaacaggcaggtgtccctctgggac

SEQ ID NO: 186474 - DNA, 601 bp, Human
gagcatgttctaacccgtcgcaaagaagctaaaaaccttgaaaaaaggttagatgaatggcttactagaataaacagtgtagagaagaccttaaatgacctgatggagctgaaaaccatggcacaagaacttcgtgatgcacgcacaagcttcaatagctgattcaatcaagtggaaaaaaggatatcagtaattgaagatcaaattgatgaaataaagtgagaagacaagattagagaaaatgtttattgtatcaaccttctattgttgaaccatccttgcatttctcaatgaactttgrttagtcttgatttttttctgatatgcaattccaaattctattctaaaccagttggagtggttcacatttgtaatcctagcattttggaaggccagggcaggaggattgcttgaggccagaagttcaagactagtctgagcaacataacaagactctgtctataaaaaattttaaaattggccaggtgtagtggtgtgtgcctgtagtcctagccactagggaggctgaggtgggaggatccctttgagtccaggagttcaaggctgcagtgagctgtcatcataccactgcactccagcc

SEQ ID NO: 186475 - DNA, 601 bp, Human
caagactagtctgagcaacataacaagactctgtctataaaaaattttaaaattggccaggtgtagtggtgtgtgcctgtagtcctagccactagggaggctgaggtgggaggatccctttgagtccaggagttcaaggctgcagtgagctgtcatcataccactgcactccagcctgggtgacatagcaagaccctgtctccaaaaagaaaaagaactctattctaatattgtgagactgttgcatacatgttcctaggtgaaattgaattttttttctttgtactattctggttttgtmtcaaagttttatagctagataggtttttctgttgagtctaatttccttttttttttcagacagtgtctcactctgccacccgggctggagtgcagtggtgcagtcatggctcactgcagcttctacatcctgggattaagtggtcctcctgcctcagcctcctgagtagctgggactacaggtgcatgccaccatgcccaactaatttttatatttttagtagagatggagttttgccttgtttcccaggctggtctcgaactcctgggctcaagcaatcctctcacctcagcctcccaa

SEQ ID NO: 186476 - DNA, 601 bp, Human
ccaggtgtagtggtgtgtgcctgtagtcctagccactagggaggctgaggtgggaggatccctttgagtccaggagttcaaggctgcagtgagctgtcatcataccactgcactccagcctgggtgacatagcaagaccctgtctccaaaaagaaaaagaactctattctaatattgtgagactgttgcatacatgttcctaggtgaaattgaattttttttctttgtactattctggttttgtatcaaagttttatagctagataggtttttctgttgagtctaatttccttttttttttcagacagtgtctcactctgccacccgggctggagtgcagtggtgcagtcatggctcactgcagcttctacatcctgggattaagtggtcctcctgcctcagcctcctgagtagctgggactacaggtgcatgccaccatgcccaactaatttttatatttttagtagagatggagttttgccttgtttcccaggctggtctcgaactcctgggctcaagcaatcctctcacctcagcctcccaaaatgctgggattacaggcatgagccatctcacctggcctaattcatttctttatag

SEQ ID NO: 186477 - DNA, 601 bp, Human
tttgtttgtttgttttgtttttgagacagtctcactctgttgcccaggctggagtgcagtggcgtgatctcggctcattgcaacctctgccacccaggttcaagcaattctcctgcctgagcctcccccgtagctgggattacaggcacctgccactgcacccagctaattttttatagtttttaatagagacggggtttcaccatcttggccaggctggtcttgaactcctgacctcatgatccacccataattttgttatgtaagccctatcattattattattattatcattattatyattattattaagacagagtcttgctctgttgcccaggctggagtgcagtggtacaatctcggctcactacaacccctgtcacccaggttcgagtgattcttgtgcttcagccacctgagtagctgggattacaggcattcgccaccacacctggctaatttttgtatttttagtagagacagggtttcgccatgctggacaggctggtctcaaactcttggattcaagtgacccacctgcctcagcctcccaaagtgctgggattataggagtgagccaccatgcccagccaagcccgtt

SEQ ID NO: 186478 - DNA, 601 bp, Human
cccagggagtcttaaaatctctgcccagcttctcatcctgtcaaccatctcttctggaattggccctggtttctagagaaacgcctgaaaagatctggctctctgggttttttttttcctccttgattttgtctccagaattcttcggtgcctcgttctctaatgctttaaacagaattccttcctatttccttcccttctagttcattgggagggttaatctaattacctcgacaaccattacttaaaatagaattcccaagttctgtatttccattctgctccttagtgtacagcagckaattttcttcttgaccggtagttgaaaaacggttccagtggctgtggccaccttttcttttttcttttttttttttttttttgagacggagtctcactctgtcgcccaggccggagtgcagtggtgctatctcggctcacctcaacctctgtccgcttcccaggttcaagcaattctctgcctcagccacccgaggagctgagattacaggcgcccaccaccacgcgtggctaatttttgtatttttagtagagacagtatttcaccatcttggccaggctggtcttgaactcctgacat

SEQ ID NO: 186479 - DNA, 601 bp, Human
aattttcttcttgaccggtagttgaaaaacggttccagtggctgtggccaccttttcttttttcttttttttttttttttttgagacggagtctcactctgtcgcccaggccggagtgcagtggtgctatctcggctcacctcaacctctgtccgcttcccaggttcaagcaattctctgcctcagccacccgaggagctgagattacaggcgcccaccaccacgcgtggctaatttttgtatttttagtagagacagtatttcaccatcttggccaggctggtcttgaactcctgacatygtgatccacccacctcagcctcccaaagtgctgggattgcagacatgagccaccacgcctggcctgtggccaccttttctaagatttctaatggaatttttaaaatatttaaatgtttttatttaatttcaatttttatttcacagatattatttcatttctctctctgataatttttaacatatctaaaatcattcctgagctgttatataaaattagtttttttaaattgggttttatacttgctgatttttgttggctttgtttcttagtgtttttatttcttcatgtgtgtggcat

SEQ ID NO: 186480 - DNA, 601 bp, Human
tctctttgtaggagtcaaggtggcacatcctcattcccagcctcaagcattgaactggttccattttaatggagcacttttcgtttttgttacttcattgaagcctgcatcttggctgtcactgcctgattacagaaccagaattgagtaggcccgtagcttcagccctccttaccattttacatttctgtttagtttctcttccataagtctgtcttgtgttaaatctagataatgtctgtttgtttgtctctctgttttctctattattgcttatacttgggagcagaactgtttcatyaaagcctgaatgcactgcactatctggccgttcactggctccttttaagttttgttccatttttaaatatcagatccaataaaagaaaaaaaaatagagttctagtagcttgtttataatattacgatacaagtctaaattaaaactttagcctggattagaaaattaccattttgcagttccacatctaatatttgtttcaggcaaggatgatgaatcgatgctaaactatcaaatgaacagttgctgaggaatagaatatttgtggtacaaaactgtcatcccatagattatatacta

SEQ ID NO: 186481 - DNA, 601 bp, Human
acagttggccttccacatctgatcaaccaactgtggatcaaaaatattcggaaaataggccagacgtgttggctaacacctgttatcctgacattttgggaggctgaggtgggaggatcacttgaggccaggagttggaggctgcggtgagctatgatcatgccacaacactctagcctggacaatagagtgagaccctgtctcttaaaaaaaaaaagtattcagaaaaaaaaaaactgcatctgtactgaacatgtacagactttattccttgtcattatttcctaaacactacagtatragtaattacatacatttacagtgtattagatactataagctagagatgattttaagtatacaggaggatgtgcataggttatatgcaaatgctatactattttatattaaggacttgagcattcatggattttggtatctgaaggagattttgaaaccactcccccacagataccaagggctgcctgtgctgatacatgctataaaatggataaaccctggaaacattatgctaagtgaaagaagccagtcacaaaatactacgtattgtatgagtccatttaccatagatcctcattat

SEQ ID NO: 186482 - DNA, 601 bp, Human
ctagggtcacatctttaataaggcagaactataaacaaaaccaggactggttgaatgttaagctgtattctctcaactagtagagagtattagctcactttagaaaagagaagctaacattttttactgtggtatccaggaagaaatggcatctaagttagatttttgaaagctaggcaacctttcaaaagttagataaagaaacaaaaactatcaagctgatagaccagcttgaacaaaagtatataggcagaaaatatgagatttatttggtagttgtcctatagtattgcattggatmgtaagaaataatgctgagaaattaggttgaaagctaatagtagaagctcttaattggcattatgagacttaatctttacataaggaatggatggttttttggtagtttatgtttgtttttgtttttaagcagactgtgacatacatgtaaacgaaaaagtcagtctgaagggtttaagataaatcagtagaagtcagcacgttgtaattaggtggtaaagttcataaaggatttgggttgtattcacctttgtattcctactgtctaacctgcttgacacatagaaggtacttaatagat

SEQ ID NO: 186483 - DNA, 601 bp, Human
tcactactagtgcagcagtctgagatcaaccagcaacgctgcagcttgatggggcagggccagcatctgccattgctgaggcttgagtagctcacagtgtaaacaaagtagcccagaagctcgaactgggcggagcccaccacagctcagcaaggactattgcctctctagattccacctctgtgggcagggcatagctgaacaaaaggcagcagacagcttctgcaaacttaaacgtccctgtctgacagctctgaagagagcagtggttctctgagcacagtgtgcgagctccaagaaygcagactgcttcctcaagcaggtccctgacccctgtgtagcctgactgggagacacctcacagtaggggtcaacagacaccttcaacaggcgggtgcccttctgggacaaagcttgcagaggaaggatcaggcagcaatatttgctgttctacagcctctgctggtgatacccaggcaaacagggtctggagtggacctccagcaaactccaacagacctgcagctgaggggcctgactgttagaaggaaaactaacaacagaaaggaatagcatcaacatcaacaaaaaggacatccac

SEQ ID NO: 186484 - DNA, 601 bp, Human
ttaaagtattaaatgtaaatatatatataggtatatacatatatatatatacctatatattaaagtatagtatatataagtatatatgtatatatataatatatgtgtatatatataaaaaagtatatatatgtgtatatatataaaaaaggtatatatatatacacctttttactaagaatggtttttaggtagagctagggcagaagagaccaatcaggagagtcaagcagccattaccttaattcaagtgagaagtgatggtggcttggctcagcatggcagtgacatgggtcctaaratagagtcagattgggattactcacccctgtaatcccaacactgggaggatgaggcctgcagatcgcttaagcctggcaaatcgcttgagcccagaagtttaaggccagcctgtgcggcatagggaaaacctgtctctacaacagttacaaaaagtatccgggtgtggtggtgcatgcctatagtcccagttacttgggaggctgagatgggagggtggtttgagccttggaggttgagcctgaagtgagctgagattgtaccactgtactccagtttgggtgacacagcaagaccccgt

SEQ ID NO: 186485 - DNA, 601 bp, Human
gtgtatatatataaaaaaggtatatatatatacacctttttactaagaatggtttttaggtagagctagggcagaagagaccaatcaggagagtcaagcagccattaccttaattcaagtgagaagtgatggtggcttggctcagcatggcagtgacatgggtcctaagatagagtcagattgggattactcacccctgtaatcccaacactgggaggatgaggcctgcagatcgcttaagcctggcaaatcgcttgagcccagaagtttaaggccagcctgtgcggcatagggaaaaccygtctctacaacagttacaaaaagtatccgggtgtggtggtgcatgcctatagtcccagttacttgggaggctgagatgggagggtggtttgagccttggaggttgagcctgaagtgagctgagattgtaccactgtactccagtttgggtgacacagcaagaccccgtctcaaaataaataaatggaagaactaatataagtgaatgatactactatcatacatagaaagatagaaaagaagacagactaagatggaaatcaggaagaacagaagtagaaccatattattgctacattat

SEQ ID NO: 186486 - DNA, 601 bp, Human
tgccagagcagaatatgattttgctgccgtatctgaagaagaaatttctttccgggctggtgatatgctgaacttagctctcaaaggtaataaattatgaataagttggaattatctgtaaattttgatattcataaatgcagtattaaaaactacaacaaaggatcttgttcattgttagttaacttagagatagttactagaacttctttttcatgtcaatttagagcttccaaatctggaggagtcaggaagaaatgccccagcagagttattcgaatactatttcactgagataagraaaggctttgtttatataggcttttctaaactcaaaatacttgaatttcaaactgttaatccccacacaaaaacgtgatgtcagtaactaaacataacaaatctaataaagcaaaggaattatgtaacatcatctaagcattgctgttagtccttgtggactggtgttgcttctttattacttcagcagtgtttacctcagaaatttcatcataagtattttaggaaatagtgtcatgaagtattatagaaccccagcaagagatttatacgcatctcgggtttatttttggaccaagtc

SEQ ID NO: 186487 - DNA, 601 bp, Human
tatatccttaaccatacagtttttactctaaataaggacttatagaataggcatctccttgaaggaaatgatgttctggatattaaatgatgtatgaaatactctatattgtattaatctcctagcttggatctttcaaaatctctatattgtttacagagaagagataatacccaatctacagtcaagcacctgtttcacctcagcttagccataaactacaatacctctgttaccactgggcagcctcccttgagtaaagattctccatatctgcatctcttaaacaaaaataacttgsttctcacctttccaggcatgagtggggcaaagctgcaagtcctttgcacattttggcaggtggcttagctcctccgctttaagtacaacttcttaacagcagagccagtctttgaaaacttcaaaactgtctgggatgcctttcctcctgaggtatatatagaagctctttcccagccctctgttgctcttccagccaatccagagccttagaggaaactgcaggctggagagcagcagcagtgggccctgaggtggaggagggaatcctttctctgctacaggcactactgtggcataa

SEQ ID NO: 186488 - DNA, 601 bp, Human
ccctttaaacaataaaatcttccgagacaaacactgctaatgcctttagggctgaacatctgtgcaaggatcttctttatttactttaaataacgagggatcaaacccaatttaatcaaatccattctcaataaaaggagaaacatccctacttctctccatcagagaggatggttgggttaagttttctaacaagtaagatatttgttcttctatttgcttagcctagatacctaggattctctccagaatattgtccagcctacggacaaccagggagcctcaaagattttgatgcatytgtctgaaaaagaatgctagctaataaataacccctgtgtcccaagggctttttctctgtctagccatccagttacttctatctaatgaggtcagagaacaaagaacaatgggaaatttcctcttcctcactgcaaacttgcctccctctcccagtccctgtacattaataaaaattaacatttatacagtctactaggtgccagacatggttctgagtgcttcatatatattaattcattcagtcctcataaccagcctgtgaggtagagaactctcggtatctccattttacagataa

SEQ ID NO: 186489 - DNA, 601 bp, Human
gatggggtctcactctgcacccaggctggagtgcaatagtagcaatcatagctcactatagcctcagactcctgggctcaagcagtcctctcacctcagctcctgaatagctggcactacaggtgctatccactgtgcctggctaatatttgtggtgtttttatttatttattttttgttgttgtttgtttgtttgtttttagagacagggtctccctgtgttgcccaggctgcccttaaactcctggcctcaagtgatcctcccaccttggcctcccaaagtgctgggattacaggcagsagtaatgtgcctggccaatagtaacattttttgtttcataatacattcatcttttcccaaagagcaatatttactttaaaatttaaacttgtttagagaaattcaacagactctgaaaataaaataaattttcaaaagaagcctaaaattcaaacttgaaaatcatgggtaaaaataaggtattaaattgacgcgactcttttctttttcattgacagtataagattctcacccatatagtacaggtttcaatatgccagagggtagaaactctgtgcttatggttattcattgcccaaa

SEQ ID NO: 186490 - DNA, 601 bp, Human
tgaaaattacctttcccatttacttcctatggcttctgaaattcctagcattgacacacccttgagatggccaaaagcccctgtgtgaactgtggattaaacacattatacccttagcccttctcagtctgaaacagaaatcagatctatgccagtcacccagagtagcaaagggcttgtagctctttaaaatactaataactgcactggttcctttatattatgatgatatttagatttttgagactattgctcattaaaattttaaggaggcctcatatacttttatatatttaaagaracaaataatccaaacttttgggcaatgaataaccataagcacacagttttaagcctaaaaatcaaagttgtcatcataacataaagcaaccagttcaattattagtattatcagttttttaaaataatcctcttttttcagagatggggtctcactctgcacccaggctggagtgcaatagtagcaatcatagctcactatagcctcagactcctgggctcaagcagtcctctcacctcagctcctgaatagctggcactacaggtgctatccactgtgcctggctaatatttgtggtgt

SEQ ID NO: 186491 - DNA, 601 bp, Human
catgtattccttcaacaaaatgtttatttggtgtctactataccaaatacagtctatccttttagtaataaaatcatttaggtgaaggggaggactatctttcccctgaataaatctcttccatcctcagagttgggaacagatgagcactggagaagttcccagagaaccatatgcaggacttgctgcccaggaggttaactgtggttagaaactcagcggtttccctccttgctggcctctgagagataatacaggttgtacatagatgtcacaacatcagccaaattggctgtgccckcccatctctgggtctctgcacacacaggcctgtccccttcacctagatggccttccttctctctcctcttcctgtctagacctggctaactcctctgtcctcttagactttcttcaagcatcatccgtataaccttgtaaattcttccctgcccactaaaagctctaggggccccgcctaccaccccaacttctgtgcttcttggcactttatggatatattccttcgtagtggattgcaacactgagcattaattttttcttatttatctccctaactgggcttaaatttccatgggag

SEQ ID NO: 186492 - DNA, 601 bp, Human
acaacttcctagagctcacctaagggataccatcattgcagccaaaagaagactcacctctttaacaaggctttcctcattatagaaatgcagacagtctccttcacttttctttttctcctaatccccactccccttctcccatagcaggcacctctctttatttagcaacacacactctttttccgattgtggcctaaaatgtcaacactgatactgttcttggtctccccaatacccaaggaaagcagagaaaataccaagctgtcctagaagtgctcttgtctctatttgctgtaamttcattcatgtattccttcaacaaaatgtttatttggtgtctactataccaaatacagtctatccttttagtaataaaatcatttaggtgaaggggaggactatctttcccctgaataaatctcttccatcctcagagttgggaacagatgagcactggagaagttcccagagaaccatatgcaggacttgctgcccaggaggttaactgtggttagaaactcagcggtttccctccttgctggcctctgagagataatacaggttgtacatagatgtcacaacatcagccaaattggct

SEQ ID NO: 186493 - DNA, 601 bp, Human
actaaagaagcttcaacagtaactgcatgaggaacagcccaggcagtacaacttcctagagctcacctaagggataccatcattgcagccaaaagaagactcacctctttaacaaggctttcctcattatagaaatgcagacagtctccttcacttttctttttctcctaatccccactccccttctcccatagcaggcacctctctttatttagcaacacacactctttttccgattgtggcctaaaatgtcaacactgatactgttcttggtctccccaatacccaaggaaagcagagraaataccaagctgtcctagaagtgctcttgtctctatttgctgtaaattcattcatgtattccttcaacaaaatgtttatttggtgtctactataccaaatacagtctatccttttagtaataaaatcatttaggtgaaggggaggactatctttcccctgaataaatctcttccatcctcagagttgggaacagatgagcactggagaagttcccagagaaccatatgcaggacttgctgcccaggaggttaactgtggttagaaactcagcggtttccctccttgctggcctctgaga

SEQ ID NO: 186494 - DNA, 601 bp, Human
tagatgttggcatggatgtggtaaaaagggaacacttttatactgctggtgggaatataaattagtacaacctctatggaaaacagtatagggattccttaaagaactaaaagtagaactaccatttgatccagcaatcccaatccagtgtctgcccaaaggaaaagaagtcattatatgaagacatatgcacacttatgtttatagcagcaccatttgcagttgcaaagatatagaactaacctacgtgcccatcgaccagtgagtgagtggataaagacaatgtggtatacatataccrtgttgtatataagaatggaataatgtcgtttgcagcaacttggatggagctggaggctatcattctaagtgaagtaactcaggaatggaaaaccacatattgcatgttctcacttataagtgggagctaagctatgaggatgcaaaggaataagagtgatataatggactgtggggaatcagggggcaagggtgaaagggggatgagggataaaagactgcctataggctacagggtgcagtgcttgggtgaagggtgccctgaaatttcagaaatcaccactaaagaacttattcatgt

SEQ ID NO: 186495 - DNA, 601 bp, Human
atttatgcagtcagcagtcttcatagcacttccaagaattgtcagtactccatgatctacccagatggcagatgaaaattggttaattatgtaaagacctggaaaccctgacatacccttctcatcccatcctcaaggatgaaaacttttccactgttaaggcaaatgacaagtttacctctaagcaacattcagaagggcaggagtgggccaccctttcccactggagaaaatgtagtgtagtataaatgtagtcagtggtgccacacccccaaagtcacatgcgtctgtgtttactttkttatcttgccctcagtgacattatacacttgaagaggaaaaaatgaagttaactgtaaataaagtgcaagcatcatacactgttagattcagattctaattcatcctcaaattgtacaagaaaccgagaccaccctttttcttcatagaattcaccaaaataaaacagaatcactttccactgcatattaatatatacttttcacaaactgggagtatattctgaacttatcacaagtcttttaaagaaatatggggttcttaattgagtccactgagatttttaaacattatgggaaga

SEQ ID NO: 186496 - DNA, 601 bp, Human
catcaaggggctaggagggtggtgtgcccgaagaagtcacagaggctctgtgccccttcccatataccttgctctatgtacttcctcatttggttgttcaactgtatcctttgcaactgtatcttttgcaatagcctttacgataaatcagtaaaagtaaaaatgttttcccgtgtcttatgagacattatataaattattgaagctaaagaagggattacaggaaaccccaatttatagctgaacttacaactggcatctgaagtggggggcagtcttgtggggctgagcccttaacctrtgggatatgacgttaactccaagtagatagtgtcagagttgaattgaattgtagaacacacccttggtgcctacaaaatgttggagaatttcttggtggggaaatcccacacattgggtgtcagaagtgaagtgttgtgtgaggagagagaaaaagtttgtttttcccacttagtataaaatccaaactatggagatagaaaagacctattcgccttaaagtggaaaaaattcccatcaatctacgttcatctttgtgaaagaaaaatgtttcttcctaccaggcccaggtacactttca

SEQ ID NO: 186497 - DNA, 601 bp, Human
gtaggacatgctgatggccatcagaagtccctttcaggtttgaaaggtgattggatcaatacatatatatatattccctgtgtgctctcctgtgacggccacctgggtccatgaaatgagtggacatgggagtactacagcaaggcagagatggactaaatctggacatactcttcttgcacactctgaaaaacaaaatgccagtaagaactgtcctgtttgtcagcaaaagagacagagactgccgatggctatgtggcagattcttgggtgggaagggcaggaacatagctggcaagtragactgacgccagtagccttggagggctacaaatgggtcttgacaggaatagccactgaccctagagtgcgttttgcttatgaagtgtcagatgcaaatgctcaaaatgctataaaaaaaaaaagatagtgcagcaatttgggtagccagccatcatttattcagaccaaggaacacacagtatagcctgtaatgtccaacaatgagcagatagatatcctcttcagagtaacagtttaatggagaagtgaaacaagtaactgaaacattggttgtctaaaatgggagcagtgaaggtgt

SEQ ID NO: 186498 - DNA, 601 bp, Human
agtagttccacggtgtatggacagcatcctgttggaaggctgtcactcctatcaaagaagataaaaacaggtgagcccagtgggctgaattgcatgttgttttcctagcaatgacggaagaatttaacaatgatgaaagcccctgtgtttcagtttttactgactcatgggcagtggccaattgcctggctatatggtcagtggaagcctagcccattaaagggatacccacatggggcacagctttatggaaatgactatgggaattcaaggggttcattaaagtaggacatgctgatgrccatcagaagtccctttcaggtttgaaaggtgattggatcaatacatatatatatattccctgtgtgctctcctgtgacggccacctgggtccatgaaatgagtggacatgggagtactacagcaaggcagagatggactaaatctggacatactcttcttgcacactctgaaaaacaaaatgccagtaagaactgtcctgtttgtcagcaaaagagacagagactgccgatggctatgtggcagattcttgggtgggaagggcaggaacatagctggcaagtgagactgacgccagtag

SEQ ID NO: 186499 - DNA, 601 bp, Human
taaatatcttaaaagcaaagacagggtcctagctacgcgggaggctgaggcaggagaatggcgtgaacctgggaggcagagcttgcagtgagccgagatcacaccactgcactccagcctgggcgacagagcgagactctgtctcaaaaaaaaaaaaaaaaaaagaaaaagaaaagaaaaaaagcaaagacagacaaaattatgaatatatgaccaaaattcttaagtaaaagttcatctgataaaataaaatgaagatgaaatgtaaatccagaggccttgcataagctcaaactcacarctatgtgaccttagacaagtccccaaaacaatttggacctcttttctcatctatacaagaaggaattggtccgttaccctgaatcaattctcagtctgtgattctaagctggtcatattagagaaaggggaaaaaaatcacatcccgtatgtggagcagaatctatcaattgaattcaatagacttttattacatgcctctgtgtgatcaaaattgtgctaggcactcatcctagtctgtcataattgtcaactggctttgttattcttttctttttcatgctctcgagccagtatccat

SEQ ID NO: 186500 - DNA, 601 bp, Human
ctttctgtctttctcccgtctctccagtgattccttccaatgtttaatatggaagttcacatttccctaataagttttctaaaaatttcacataagttttcgaggtacatgcaaatcacattcctgaaaacttctcctcagcattcttagatgattccttccttttcctcccaatgagcaatgcagtctgccctgtggttcttgcacgttgaggactaaagaatagaaactcccttaaattgtgtggttactggaataggagtctctaagtcagagatctgggcttaatggagcaacaaastctaggaaccaagcaaaaggtcaccctgttgccacaagacaacagggtgtctttaggctgagtacacttttctagactgtagacatgaaccattttaaacaaatagaaatgtaattttatgtacttcaaatgcaagtcacaggtgacaggagaccatcagttataaaacacaccaccaagggaaacaaaaagacctgagaacttggagaagccacagagagtgttaggaagctttcctgaccaccccatccctccaaaaaaaaaaaaaaaagggaagaacaatgtctgttaaatgaaaaa

SEQ ID NO: 186501 - DNA, 601 bp, Human
cacaaaagatacaaattcattactacaaacaacaatacttagtcaatatttatctttgccagctttttaaaagagtttgctgaggaaaataacataacaatgaggaataagaggactgtttctgaagcatagaattagatctcaaaccatttcttctttctccccccaaaatttaacagccacttattattcccaagatttctattttcaggaacaatctactgattcatgcattcaattcatttatgtattcatttacttgtcagattttaatagagcaaccaccatttgtcaggcactktactggatgctatggggttgttttacaaaattaataagcaattattcctgacctgaaattgctttcattttacaaaggagacatgtatagatgcttttattgagatgcagctgtgatatggcagaaagagcccttggttttgaattagcacacctgaaggtaaactcaggattatggagtgcattttctgtccttgggccagatgtttaacttattcgctggtaaaataataatgttgataatatctaccttggaagattatgctaagaattaaattagataatatcaaatacacagaca

SEQ ID NO: 186502 - DNA, 601 bp, Human
gagatatttcccatgcttttctgggctgtctctgacatgctatccctcagagtaggttactgggggtaaggaaggagacagtggaaggacaagaccaacaagacagaaacagtttatttctctttgaccttaaattctcccatcttattccaaatgttgttggcaggatggctggacttttggcaattcattttggaagccagataatgaatagtgggaaaattgtcctcaggtcaaggaagacaggcatttatggtttattttgagttccaaaggtggaggggtcagaagggattcccaygagagctcctctgaacactgcagtcattcaaagtctttgagtgtctccatgtcctcctgctttgaattatactgcgggactttatagactgaaagtttcttattgtacatggcactagtaactcattttatataccacaaaaatataaatggggaaattttaaaggggtagtaaaaggtattggagaaggagggagggaaagaggagaaatgtaaaattaattgagatcttaataaacattaacatgtattacatcacttaataaaactacagttcccagaactttaatgtgtcctctca

SEQ ID NO: 186503 - DNA, 601 bp, Human
ttattttaaataaccttaaaaataactaagtaccgtaaagttgctttaactcttaggatgacatagatgataagaccacagctccgcactgcttgggtttatattccaactcttacttaccagcagagtgacattggacaaattaaattccaacccttaatttaaattccgacccttcatttttctatgtaaaaatggtgataatagaatttctaactcatagatatgttgcgatgctaaataagttaatgcattaataggtttagcatggaacttggtgtatagtattataaatactcartaaatgttacctattattattattgtcactatcatatttgtcctatccctatcaccgtatcttgcatgtatgtgttgattaataatatgttaattgaatggataaatggataggataggataggataggctcaagaaagatctatttgactagcattcaaggtaaactcctttcagaagatttccacctcataataatgcaaccaattctgatagcaaagagaagatacactgctggcctcttcattgggaactcctatggagtgacaaagaaagcaagtgtggagacctccactgctgc

SEQ ID NO: 186504 - DNA, 517 bp, Human
atatttactatataaatgagagcaatcaaggacctgaggtgttcaatgccttgtgaatggcaccatgtattcctttttactcaacccttcttcccaatatcccatttttatgtaactgtaatattctccttactctcataatttataaatgctccaatctacattatttagactttcttcttcattgccaatagctaatctgtcacaagtgtttttctgtcttcccagaaaatccttttatttttattttttgagacagggtctcactctgtcacccagattggagtgcagtggcatgatmttggctcactgcagcctccacctcctgggctcaaccaattcttctaacttttgtattaatattttttgtagagatggcattttgccatgttgcccagtctggtctcaaatgcctgagctcagatgatccacccgcctcggcctcctcaagtgctggaattacaggtgtgaaccgctgcgcccagacaaggaaatcctgttaaatgtgtccttgctt

SEQ ID NO: 186505 - DNA, 601 bp, Human
ggtactccataagtggcaaggtttattattattattacttacagaaagtcctgtgccaatgaaggaaactgtccagattattaacagaaaaaaatgacagctgtcaacatagaacgtaacatagagcataacaattggaaatagagaaaaacagaacaaaacagtacaacaggaaaagatttgcccttgactaaatcctattatcaacttagtcagtacttttatgggtgatcttgaatatgttatttgagctctcctgttttctgccaaaaaagaaaaggtagaaaaagagaaagggagraaggaaataagtttagtgagaaaacctctaatagctcctccagctataaaaaattaagatttcaagaggatcacattcaatatatttactatataaatgagagcaatcaaggacctgaggtgttcaatgccttgtgaatggcaccatgtattcctttttactcaacccttcttcccaatatcccatttttatgtaactgtaatattctccttactctcataatttataaatgctccaatctacattatttagactttcttcttcattgccaatagctaatctgtcacaagtgtttttctg

SEQ ID NO: 186506 - DNA, 601 bp, Human
ccgattcatcttactacatgtgtgacttttggcaagtttttaaaccttaccttgccttagttttctcatctgtaaaatgaagataataatggtatctatttcataagcctcttgtgattaagtgagttactatatgtgaaacactaatattagtgcccagcacatgtactatggtactccataagtggcaaggtttattattattattacttacagaaagtcctgtgccaatgaaggaaactgtccagattattaacagaaaaaaatgacagctgtcaacatagaacgtaacatagagcayaacaattggaaatagagaaaaacagaacaaaacagtacaacaggaaaagatttgcccttgactaaatcctattatcaacttagtcagtacttttatgggtgatcttgaatatgttatttgagctctcctgttttctgccaaaaaagaaaaggtagaaaaagagaaagggagaaaggaaataagtttagtgagaaaacctctaatagctcctccagctataaaaaattaagatttcaagaggatcacattcaatatatttactatataaatgagagcaatcaaggacctgaggtgttcaat

SEQ ID NO: 186507 - DNA, 601 bp, Human
gaggcaaactgccccgattcatcttactacatgtgtgacttttggcaagtttttaaaccttaccttgccttagttttctcatctgtaaaatgaagataataatggtatctatttcataagcctcttgtgattaagtgagttactatatgtgaaacactaatattagtgcccagcacatgtactatggtactccataagtggcaaggtttattattattattacttacagaaagtcctgtgccaatgaaggaaactgtccagattattaacagaaaaaaatgacagctgtcaacatagaacrtaacatagagcataacaattggaaatagagaaaaacagaacaaaacagtacaacaggaaaagatttgcccttgactaaatcctattatcaacttagtcagtacttttatgggtgatcttgaatatgttatttgagctctcctgttttctgccaaaaaagaaaaggtagaaaaagagaaagggagaaaggaaataagtttagtgagaaaacctctaatagctcctccagctataaaaaattaagatttcaagaggatcacattcaatatatttactatataaatgagagcaatcaaggacc

SEQ ID NO: 186508 - DNA, 601 bp, Human
tctctattctattactacagtcaaaagtaacgtgttgaattgtgttaaatcttccccacatttgagagagacaatgtccaactcccaactgtggcaaaaatcctgtctcagattatgtaactggaagcttgtaaagcaaatacgatacacgttaaaaagactgttcctagagagaaagtcaagtggaacattgaactcttagaaaatccaattaataccaaaactaaactcttgttttcttaaagcaagagacagaatgacatagtggtaaagggcctggatattggaggcaaactgcccmgattcatcttactacatgtgtgacttttggcaagtttttaaaccttaccttgccttagttttctcatctgtaaaatgaagataataatggtatctatttcataagcctcttgtgattaagtgagttactatatgtgaaacactaatattagtgcccagcacatgtactatggtactccataagtggcaaggtttattattattattacttacagaaagtcctgtgccaatgaaggaaactgtccagattattaacagaaaaaaatgacagctgtcaacatagaacgtaacatagagcata

SEQ ID NO: 186509 - DNA, 601 bp, Human
ctcccagatccctgatatatccaagtgtggaggaccacatgaggtcaccagactttcatttaatcatacaattccttaatctaggtgcaaggactccacccatgatcacgcagtcacccctctccacggcaaacacgcagaaaacaagtgatctgtagcaactcttaaagataataataatagcttaaatacatattaatgtatcgggtgttaatgcatatattcctccacatgtaatttttcctctttaaagactgttgccaggcatttcatgctttcttgcctctgagggagttgtgtygtgacgtcaaaagcaaatgataattgacaagagtatcccattttggtatttgttttccaaaaccccaaaatcactgagatacgccagcttgttcccagagagaaggagtgaaagactactgtgtttgatgagtggcaaagaaagaaacagaaagcctgagcatggtggctcatgcctgtgatcccagcactttaggaggccaaggcgggtggatcacctgaggtcaggaattcaagaccagcctagacaacatggtgaacactccccgccgtctcttctaaaaatacaaaaaaattagcc

SEQ ID NO: 186510 - DNA, 601 bp, Human
agggtggtcttgctttcataaacctggccctacttgttgggcatcctcttcttcagtcacctgggggagaaacacactttatctcccagatccctgatatatccaagtgtggaggaccacatgaggtcaccagactttcatttaatcatacaattccttaatctaggtgcaaggactccacccatgatcacgcagtcacccctctccacggcaaacacgcagaaaacaagtgatctgtagcaactcttaaagataataataatagcttaaatacatattaatgtatcgggtgttaatgcayatattcctccacatgtaatttttcctctttaaagactgttgccaggcatttcatgctttcttgcctctgagggagttgtgttgtgacgtcaaaagcaaatgataattgacaagagtatcccattttggtatttgttttccaaaaccccaaaatcactgagatacgccagcttgttcccagagagaaggagtgaaagactactgtgtttgatgagtggcaaagaaagaaacagaaagcctgagcatggtggctcatgcctgtgatcccagcactttaggaggccaaggcgggtggatcacc

SEQ ID NO: 186511 - DNA, 601 bp, Human
tgagattatagaataagtcatacaaacattttacatgagcttgttaataagtatttgtccaaaaagtatggcacagttggatttcattatgcatagggtggtcttgctttcataaacctggccctacttgttgggcatcctcttcttcagtcacctgggggagaaacacactttatctcccagatccctgatatatccaagtgtggaggaccacatgaggtcaccagactttcatttaatcatacaattccttaatctaggtgcaaggactccacccatgatcacgcagtcacccctctcyacggcaaacacgcagaaaacaagtgatctgtagcaactcttaaagataataataatagcttaaatacatattaatgtatcgggtgttaatgcatatattcctccacatgtaatttttcctctttaaagactgttgccaggcatttcatgctttcttgcctctgagggagttgtgttgtgacgtcaaaagcaaatgataattgacaagagtatcccattttggtatttgttttccaaaaccccaaaatcactgagatacgccagcttgttcccagagagaaggagtgaaagactactgtgt

SEQ ID NO: 186512 - DNA, 601 bp, Human
cagagaaaagcctgtgcaggccgggtgcagtggcccacgcctgtaatcccatcactttgggagggcaaggcgggcagatcacctgaggttgggagttcgacaccagcctgaccaacatggtgaaaccccgtctctactaaaaatacaaaattagccatgagtggtggtgcatgcctgcaatcccagctactccagaggctgaggcaggagaatcccttgaacccaggaggtggaggttgtggtgagctgagatcacgccattgcactccagtctgggcaacaagagtgaaactcagtctcaaaaaaaaaaaagaaaagaaaaaaagaaaaagaaaaccctgtgcagcctctccttttgttcacttatttattcaacaaattaaaagtatgtttactgaatgcctaccacatgatgtacgctataatatgttttgatattttcaacgaaataaaaaagataaggtcctctcattgagtttatgtttaaattgggcaagacagatacaaaacaagaaatgaaaaacaatgaaataaaaaattttagctggttgtaatcactacaatatgacatgatgtatgtcatagttaattcagctacttg

SEQ ID NO: 186513 - DNA, 601 bp, Human
ggcccagagggtccctgcgcgggcctatcaagagggagaatgcattttgctgaaagctggaacagctttcttcctggctgctcatttaaaacttcatatcagtggagtttgctccttgtaggtggctccgagacagggtaatggatgatcttgaaaacccttagcgggagtataagaatatgctagtggaaagtcggctcagttctggggctgaaatcctcaacttgccaggatcctcagcatggcccctaaaatcaagatggactcttaactgcagagaaaggcagtgccgggtgattgyggtggaaagaatctatcattttggcatctaccatctaccctatttctgaatttacctacttcagtttgaactacagaaaattcactcattgcttgtgctttaacagcatatgaaagagaagtttagtaatagtgtgatatcatgttaaaacatgtatttattttcttacttgatttatataattaatatatgatacatgatggaaaatgactctatggttagttaatatgaaatactcctcgggtgctccaaatgataaaaaggtgaagaaaatgctaaggaatatatagtagtagtagt

SEQ ID NO: 186514 - DNA, 601 bp, Human
catttccaaaagaggtgtcctaacatcggataatccaatttaaattcaatgcaatttaaatccgtgtcgcagatgccccctgctggctgtgggaaggcgtgagcattagcaaagaactgagcaaagagcagattggttccaggctgcttccttctgaagaaacactacgaggtttctttccacggactaaaaagaacatgtctggaatagatacccaggaaagagaaacacaagcttctaaaacactcgctagccgtcaatgtccacagccgagagtaagacatttgccggattagagacyagaggagagaggagctcctctgagttccgtgcagctgagaactaatctgagaggtagaacccagcagagactgacagagggaagagggcccagagggtccctgcgcgggcctatcaagagggagaatgcattttgctgaaagctggaacagctttcttcctggctgctcatttaaaacttcatatcagtggagtttgctccttgtaggtggctccgagacagggtaatggatgatcttgaaaacccttagcgggagtataagaatatgctagtggaaagtcggctcagttctggggctga

SEQ ID NO: 186515 - DNA, 601 bp, Human
tttgccatgtaaattgatgaatgagcaaatgaatgaatgaactgaattgctaggttatagtaaagctgcattttggggtggagtaggtgaaatattggagtgcagcttagaatgagtcacggaggactaagatgtctctaatttgctaactggacagaggtaacaccattaaatgactataagcactataaagtaagtgaattcaatttctgtccttgaaagagattgagaatggtcaagtggggcatttagttcctcatattatataggacatatgctgatgagaagaggcagggaggayaattgcaatcactagcaatctgaaaagaatcaattataagaccataatttttcaggatttaaaagaaacagaagtagccctggggcataggctattcctgtggttgaaaggctttcggcaatcacaaacaggtttcgctgtagacgccagacatatgtcaggaacagcgagaaggaagaagagagggaggagagttgagaagcataaggcaagatttttacaacacatttccaaaagaggtgtcctaacatcggataatccaatttaaattcaatgcaatttaaatccgtgtcgcagatg

SEQ ID NO: 186516 - DNA, 601 bp, Human
ctgtgcacccatctgtggaatccatgctgcaactgttttcagtttcaaccttgacacaatagtccactcaccaatatttagataacaatgatgtaatgaaagtctctcatgtttaggtttctgtttggttggttgttttggttttaactttatcccccctctcaaatttagttccttttttttctatttcttgctccatttgagccttttgcttttgtaaaaggcagaaaaatatttgtgtttgatttcctgatgcaagaataatagttggagattaagggataattagaacaaagaaatygaatgtatgtaaaagaattattagtgacttaattcatttattccttactgattaactcattggtcatgtttactgtgtcaggcagtatgcagtaaatatacaaacaccattaggtttgctccttgctttcaaggtgcttttagcccggagaggtcttagatgtggaaacaatcacaaacgggtgcttaaagacagactgtccagaaagcagcagaactctcacagaggagcaccagtgtccacaacggtagatcagggggaacttctcagaggaggcaaatgtggaactagagaatgagc

SEQ ID NO: 186517 - DNA, 601 bp, Human
gatatgagaactttttgatggtaggaatttagtcttaaatactttttaacccctgtgcctagcacaatgcttggcaatatagtaaacatttaaaaatatttgccaaagtgaactaaaaatatcttgtttttgttctttacaaatctgctaacatttacctcccagtcaatgctaatcataaccaaagttttaaagagatgtggtgaagttcacatggcagccaaataggattttactattgtacacatactttcctcatttgttcacagggaggctgtgatgaggcaatttaagtaaatgyctaagatttgcagttacggatattagggaaaaaaaatgtaaggaaacctgtggtaacttataaaaactccataaatgcctaattataacatattttcctttaggctagtaaatatggttttgaaaactatgttttaggaacagtcatctctacagtgtcatttccttttcattttgttctgctttcactctttccctaagaccctctcattgactaaagccaactcaggtcccatagtacctcagatcaagctcagcacggcattagggtaaaaactgggactgttctgccgagggagct

SEQ ID NO: 186518 - DNA, 601 bp, Human
tgtaaaatgatgacgttatccatcattttagatgttttttgagctatttccagctataaaattaaatcattccacttgattatttatttctctataaaatttttgtttccaactccttatccattgttctctatggctgtcagactatcttatgtgcagtaagccttgataaatgagtactaattgccaaacaacaaactacagcagaatttactgcttctttgtatcttcagtattttagtgagtagatatggtcagaattctgggtactcctccatcacgggatgcaactattttcacrctcagttttaaaactaaccttctaatctatccatcactttatcacaattctatactagaaaagcaccaggcaaatcttaaatattaatccataggacaagttgttgaatattgggagacccaaaaagctaccctttcccagtcaccttagcactttacccatgcttttaagacagggtttatcatattgcattatggtcattgacttatgtttctgtttttctacttggatatgagaactttttgatggtaggaatttagtcttaaatactttttaacccctgtgcctagcacaatgctt

SEQ ID NO: 186519 - DNA, 601 bp, Human
tctgaatcccttttaatctcaacagtttaagggtctatgtgaatgttaaagcagagatttaaagcaggaaatgtagaactctatttttttaaagttaataccaacggatcaataaattgtcacattgtttacttcaaaatagatgttttgatctgttgctgctatgaaatgtggttcttattctccactaccgcttggtgcctgctgctccacactgaattagcttctccttttcaaatgcagaaaacgcaattatgcctcacttcctgtttagaatcactttgaagtaataaaaaaaagsaggaatggaaatattcacttaggctaatggaaaaagattaaaaaaagagaaagaataactcatctctttatctcccaatcaatccagctatggtaagttgaggtcatttggacaaaggacaggctggccaatttacacaaatattccatttaaaaagagaaatggaggttaaagggactcctatatttttaccacacttctgtgatatcctcaaagctctaagatagcagagcgaaggaatttgaatgccttggccttttcttcttcccattttcctttcttgatttttcatggatatct

SEQ ID NO: 186520 - DNA, 601 bp, Human
aatcccagctactcaggaggctgaggcaggagaatcgcttgaacccgggaggtggaggttgcggtgagctgagatcatgccattgcactccagcctgggcaaaagagcgaaattccatctcaaaaaaaaaaacaaaaaaaacagtaggtcaactggtgaactgtcaaacgctgcagacaagtcacagatggggccttagaaacaacagttcgggtgaggtagtaaggttgaagctggttaagaaggagatacagaaaagactgaaagccatgagtacagacttctgtttctacagttagtcagtaaaagtaagagaaaggcatagaagcagaaggagagaaaggcgggaagagaatttttcagcatggaacatgggtacctgtttgctcctggggaagagggtccacagggaaaaaggactactaaaagtgcaaaaaggggaacagagctgtctttagggggtaggaatataagcacttatttctgtttttctcaatggtccatttttgtttttaaaagtgagaactcaaaaatacatgttaaaaaaatagaaaatacttttaaaaaaacggattctactgatgtcagtaacccaaagaat

SEQ ID NO: 186521 - DNA, 601 bp, Human
tctattgtttctcaggaggacctacagcagagccttaaggaatgctcacatccagagggtgagcaacagtgggagcacttagagaaagagaaggcaggtggggaatgcgggactagaagttaaggaagagagttttaagagtaggtcaactgggctgggcgtggtggctcacgcctgtaatcccagcactttgggaggccgaggtgggcagatcacctgaggtcaggtgttcgagaccagcctgaccaacatggagaaaccctgtctctactaaaaaatacaaaattagccgggcgtggtrgcacatgcctgtaatcccagctactcaggaggctgaggcaggagaatcgcttgaacccgggaggtggaggttgcggtgagctgagatcatgccattgcactccagcctgggcaaaagagcgaaattccatctcaaaaaaaaaaacaaaaaaaacagtaggtcaactggtgaactgtcaaacgctgcagacaagtcacagatggggccttagaaacaacagttcgggtgaggtagtaaggttgaagctggttaagaaggagatacagaaaagactgaaagccatgagtacagacttctgtt

SEQ ID NO: 186522 - DNA, 601 bp, Human
gagtttctgtgcgtgggagtgtgggggagagagagaaagctatttcaaatgaaactcaaaataaacatttatagagatgattaaccacatgttttataatgcctagtataaatgccacctggcccaggaagtggccatctctgctggaagcgctgtctctctttttactctactcttaccacttttactcactgaatctctcacatgacaatgaggcactcactgccgaagggtataggttgtcatgcacagagaacttttcccatttcaccctatcctgtggtgtacccttacagcatcmatccaccttgcaataaatgtgtgtcagattaataagtaaatgaatgatggttttgccttgagttagcctggctgatgaaagccacaaataaccccaaactcagattttaatgaccagtcccatgaaccattattactgctattggcaatgctggcacttactagctataacctcaagtgcctgtggttgggttttttgtttgtttttgttttttgtattgttttggtttgatttggtttttaatctgcgcagtgcctggcacatacttaaatgtcttaaaaatgttcttacacattggtg

SEQ ID NO: 186523 - DNA, 601 bp, Human
atttactcacaggatctcctgattttataaatattctcattaaatgaaatcactttcctgccccacttttcctctggttagtatagaggagcaaaggaagaagaaatgacatgagcaggtataccaaacttaagcatgttatccaatctgatttttcccaaatggccttgttggaaccaggctaatggtcaataacagcagcacatcacagccaagattaaattcctgaaaaggaaatgtgcagagcccgcttgggggtgaaattggtccaaattgatttaagggcacagtcaagtaggayacatcccccacagcatgaagcccagcattttgattaccagcctaggagttaacagaggttcatcctgtccttattctcagaatttgccagtcctcattaggtctgacttcattggaaacaagatagatgcagatctaaatgaccaataaatgttctggtttgcaaggtcatagctgaccacagaggatgggtatggagtttctgtgcgtgggagtgtgggggagagagagaaagctatttcaaatgaaactcaaaataaacatttatagagatgattaaccacatgttttataatgccta

SEQ ID NO: 186524 - DNA, 601 bp, Human
atttatatatgcagaaaccctgaagctatttcatctcaaccaccaatttttctctcacagcaggatgtgtcaagtggagctgatattgtccgggaaaaatggctgactgcacactctttggctcacccagctcgaactcttgcattatgatgtgagttcttcgttgccaaatcaaaacagactgacaaagcatttactagaatattaaggccagtttttcctaaactggaatttccttagctcttaatttgtttatcaactgtccaggcaatcaaaaaaaattcctgcttctagtttttakacaatgatatttcggggggggtggttaattattcagatttgcagctttggttgatatgacagctgcttgttctacttttcattttgctgtcccaggcgcagaatcagcctcactttatttatgtaaggagtccaagacggcagtatgttttgggctaaagtattgtgaataatccctttacttctctattcctcattgcagaacatgcatcggttgtgagtcctgattatatgatttttcataaactttcatgtgttcactctttgcaagttaaacttgccaaattgagggtaacaaacc

SEQ ID NO: 186525 - DNA, 601 bp, Human
ttcattgccactcaataaaaattaaagatatgaatgtaaggaattcttggggaactatttaacacatcaactgtgaaagtcaatatcctacattaacataacaatgccaaatttcccttataaattgacaaagatgctactcctcaaggttaaatggtttaaatttatcaaatcaaacatgcaaaaagagatggtgaagtggtttgtcttgatttgtttttatagcaacagggtctctctctgtggcccaggctagagagcagtggtactatgctgggctcaagccatcgtcctgcctcamacctggctaattttctttcttccttttttctgtttttcagagatggggtctttttatgttgcccagactggtcttgaactcctggcctcaagcgatcctcctgctgcagccttccaaagtgctgggattacagatatgagccaccacacttggccccagttgtgaagttttagatgtatatatgtcccaaatgtatctttcttcattacctgttttgcatcagccacagctaatgttgggtaatttctgattatagactattagtttttgtggattcaaataagaacttctcataagaac

SEQ ID NO: 186526 - DNA, 601 bp, Human
ggccttctgaaactcctagggaagggagatccacataaaaactttgctgcttctggcttgtttcattcttctctgctcttaaaaatggttgtggggaactattaaatgtcactcttatttaaactcccatgtgaattctatttttgtgtttgaagaacaacacactgtttatacgcccaacgtgcctatgaaatgaaaacagatggtgccacctaaagaattgaaggcaaaacatgtaggaagttgatatactttcagaacacagtcacatatactggatgattaaaaattattttaaaartgaaggaaagtgagaagaaccttgttagaagagactgagtagcaacttaactgtcttatattttttagaagcttggtaccaattaacttcattgccactcaataaaaattaaagatatgaatgtaaggaattcttggggaactatttaacacatcaactgtgaaagtcaatatcctacattaacataacaatgccaaatttcccttataaattgacaaagatgctactcctcaaggttaaatggtttaaatttatcaaatcaaacatgcaaaaagagatggtgaagtggtttgtcttgat

SEQ ID NO: 186527 - DNA, 601 bp, Human
tattattatgtagctcaatacatgttggtgttcattattgttattcattacaaatttaaaattaatcttttaattaattcaaagcccaactccaatgttgcctcatctgtgaggtagcctttacttactaccatcgacttgctcttgaagatttttatcattatgagagaagcagtcactttctgttcttttgttgggattgtttgcttctatatcttttccattaggctgttaattctttgagtatgtttcacctgtttgcctctcttttgcatcccacctcccagtctaaatctgtgcrcctaacatttaatagaggttcccgcagaaataagacacattcagggaagcatttccttccaagtgacagaatcaaagaacactaactttaaaaaaattaattatggattttgctgctgttatagcattttatttcatgggcaagttacctaattccccttaatctcaatttcattttctgaaaactagggattgtgatggcactcaagtcctaaaattattgcaatcattaaattaacatatgcaaagtgcttagaacagtgcttggcacatgatgagtaataagtgttagctattgctt

SEQ ID NO: 186528 - DNA, 601 bp, Human
attctggaaaaagtagaaagaaaatgaagaaacagaagaaacatttacacgatgaaaggaaaactgtatgaaaggtagtaacagagtcataggagagtcctgacttcattttaggctaagggaaggcaaggaagtaacattcaatttgagacccaaaggatgagtgggaaagggccagatgaagttaccccatgtagcgtacttaccatgtccatcaattatacatcaggtttctttaacatgttaaatgcaatatgattatagctattatgattctgtttccagtgtacaattgctcatrtaggataaacttcagtttataatttaaaaattatatctatatataatatgtagatattttagtctatatagatatagatatagcctattatatatagatatagtctttaattgtaaactaaaactataagactaaaattataaaactatgtatatgtaaggattcttgggcctgatccaatattttccttctccttaatgctgaatatatatgtattattcaacatatattacacacatatatatatatataaaccaaaattctaaacaatgtatggctatagggagagaattcatgttc

SEQ ID NO: 186529 - DNA, 601 bp, Human
tgctttcttatcgcactgcaaatagaaattaccacaaattttattttggaaataatctcagaaaacataattttttatgtactattaaaacatttactttccaaatattctgtcattcaggagtatggaagtatcgatggcttctttaaaatgaagcaggagggtctggcagagagtatctatgaaataagttcctctgaccttcacgcttaattttctgaatggagtggagcaaattacttcaagcttcacttaacttgcatatgaaatgaaccgtacaaaaatacaagagtgtcaggakaaagttatgctctggtaaatattttgcaaaacagataaaagataatactagagctctgtcctcaaagagttaagcagctaatctaaggaggtaaactctatgtcagcaggatgaactgctcttccctttcctcctcaataaattgcaaatcatctagtccaacatctttaccaccagtgcctgaggctccagaggagccattgccttctcaaggtcacataggtggtgggtgagttaggaccaaatctagaattcctgactccagtaacttctgaagtcattttgttttttatttttatg

SEQ ID NO: 186530 - DNA, 601 bp, Human
taagcagctaatctaaggaggtaaactctatgtcagcaggatgaactgctcttccctttcctcctcaataaattgcaaatcatctagtccaacatctttaccaccagtgcctgaggctccagaggagccattgccttctcaaggtcacataggtggtgggtgagttaggaccaaatctagaattcctgactccagtaacttctgaagtcattttgttttttatttttatggttttattataagaatacttgctaagcacacttaccccctgcattgattaataactctaggatctcaggtkgatccagcacatagaaatatgaattcgtttctatttggacttcatgatatatttacattatcaccttggaatcaccctaacattcaggattgtatcttgttataatcaaaaaggatgttgcatcccctgaacagtcatcagtcagggaagcagaggagggaaagtaatcttgcgaggaagagaaaatactatttaagggacagtcagagaacataatggaattcaaactttctgggaaaacctacatacataaatgtattagtggccatcctaaatgtctttatatctttgaggctttat

SEQ ID NO: 186531 - DNA, 601 bp, Human
acaaagttatagcagtgtttaatggatgaatggtttgtatgtttcatgttgaattaatttttacacttcaatggtatgcatattaactttgaaaaattatatatatacacatatatgtacatatatatgaatataaataaaattttatatgtgaagaagccagaattatgctccttcacataactccctcagactagtaaaatagataaaatctttgtttttaatacagaaaaatgggtcattatttgatggtctgaagaagaaatattgtgactgggatatgaatggcaaaccgtagtayaactatgttcaaaagaatgcctgaaatatatttttaaccatttgactttcaggacagttacagcactacagtacagggaaaaaccaaacaactggaagacaaaatctggattttagtgataggtctactataaattatgcttgttaacttcattccttagtttcctagttttcttttcctcaagtataaaattaagatgcttaggttatccctaatgttcttttaattctgaaactgtacagttctaactgaaacacaaacattcatatgtaacaatgattactttcttggttgcagttg

SEQ ID NO: 186532 - DNA, 601 bp, Human
tatttttaaccatttgactttcaggacagttacagcactacagtacagggaaaaaccaaacaactggaagacaaaatctggattttagtgataggtctactataaattatgcttgttaacttcattccttagtttcctagttttcttttcctcaagtataaaattaagatgcttaggttatccctaatgttcttttaattctgaaactgtacagttctaactgaaacacaaacattcatatgtaacaatgattactttcttggttgcagttgaaaacacgtttcatgaagtttattttgcyttccagcttccatattggattcttaccaatgtactgcagagataagtttagctgacctgtaagttttgcttatataaatgtactttaaatgtgtaaagcaaggataagtaaatacttaaataaaattgggtacccctgtgagctcttaaaagcacaaaagcaatttggacaatttcaagaaaagttactcatactgaatatcaacttgatgttgaagaggttaaactgttgactaatgtcttcgacattgaccttttgattccttgaaatctcatgagtcaaaccaaatcagattttaga

SEQ ID NO: 186533 - DNA, 601 bp, Human
tgaagagaagatacaaaaatagcagtgaaaaatgcatttaaatatttgaagagctattgtatgaaagagggattagattcattctgaattgctaaagagggcagaagagaacaataggtagttattataaagagaccatataaatatgatgactgagagctaaggttctgaaataagattatcttgatgactatgggcatattaacttttttgagcttcagttttcttatctgtaaaataagggatgataatagctcccatttcatagttagcatggaaattgatataacagcaatagtarctaacttttattatacacacaatgtgactggcattattctagggagcataatgtgtatattgataataaaaatattttatgacataggggatagatagcactgatgaatcagaatggttgtccagtgagtcaagagatgctggctcgggcttctgggcaggatatcagctttgcttacctatatttatttattaaacatttaaaataatccttgaagatagatgctaatcttccaactgaggaagctgaggctcagagaatttaagtaactttcttatgggaaccaccaaatggcagagc

SEQ ID NO: 186534 - DNA, 601 bp, Human
aggaaattgaaggttggaaggctaaaacaactggctaagggcacacagctagtacatttgaccccaggttctctgttggagaagcctgtacgtaactcttcatcacttctgccttccatgttacttcctaaaccagataaatagagagattgcccttagaacatctctgctatggcgactatccaggtgcataaccccattctgcactgacaagggataaaatgtccatctttctgttgcacttagcagaagtctggctttgctgatccctgaaacatatctgagtaggcttattgaaaargaccttttaataagaatcatggttagcatgtctgcctattttcttctcataatagaatctggtaccatctgtcagatatttttccccccaggatctttagtgaggaaaattttgacaacatgtggaaaaaatatgatgattttccccttaggaacacagtaaagacaaagtcaaatgcattttgttgttgttgtttttgaatctttaaataaatcccagtgtccagttccaagcagtagtagtcctatttttaggtgtttataaatcttctagctctattttatttcacagattcattta

SEQ ID NO: 186535 - DNA, 601 bp, Human
atatggctggaatcaagccttaaaacatgtttccttttctttttaaacaacaagggaatttcagtcatttctctttgaaacttctactgtagtaatactctataaattctattttattttgacagataaccaagaaattaatttctaatttcttttttttccctagaactgttactaaactgagtcagaagtttaccaaagttaattttactgaaatccagaaactagtcctggatgtggcccatgtacatgagcactgttgcagaggagatgtgctggattgtctgcaggatggggtgargagtcttgcttcttaaaatagaagattttcactcccttttctttctttttgtctcattctaaaagggagaaggttgtttgacttgaattggttacagagtatgtaaactaggtgactccttaaatttgcagaattctcggtagtaaaacttaaaccatcttttgttgatcctggctttcactttagctatacccctttttgtgaaaccaaggctcatctatttcttacttctaaaaaaaccgtgggaacttctcagaaggcttctccatagttacttggaggacgggaggaaactaaggt

SEQ ID NO: 186536 - DNA, 601 bp, Human
aagtaagcaagaagccgaggctgcagaggaggcctgagagtgacagtccctgaggagctggggaagaagtgggaggaggcagcctggcaggcgactgtactactttacttgtttttcttctagaaatatggcatactaggaaaaccaacaagaagtattttgtttttctttgagctcagttttcccattttgaacggacaattttactgtttctcgttgtcatttttaaaaagttaattttttcaatttttggagctcataaccacccttttcctttaaagtggaaacattaatttcagcrtgatatgtaagttggattttgatagctgaataatgggttctaattatctttgctgagaatgtacagaattttcagtcccatgacaggtatatatgtaagctctgcctctctctggccacttaggtgcattgccattttattatctatagactgccctctgaaggtcatagtcagtcactgcagtatgttctgataaagatgattatcattcttacggaatttctcgtggagcagaaagtttgctctccatgttatgataccagttgcaagtgttgtttaggggcaaatttgaatgctaat

SEQ ID NO: 186537 - DNA, 601 bp, Human
agtcccatgacaggtatatatgtaagctctgcctctctctggccacttaggtgcattgccattttattatctatagactgccctctgaaggtcatagtcagtcactgcagtatgttctgataaagatgattatcattcttacggaatttctcgtggagcagaaagtttgctctccatgttatgataccagttgcaagtgttgtttaggggcaaatttgaatgctaatagaaatacatatagcaacatgcatcctattttatttgagcacatttccctcttatttgtaaaggttttcaattraaataacataggatttagcttacaactatggaaagaagaattgaacaaacaggtaagtggaaaggaatgagaaaaggcaaaagtggggagaaagcactaaaacgggagacaagttaaaatttctttttaattgataggtcacgttctcactctatttgcctttaagggaagaaagcaatcaagttaatatgttttccttcattgtatagtatgtaactacggacactattagaggagggatttgtgtagcacttaggacattatacttgataatttccaagggtctttctagatttaaaa

SEQ ID NO: 186538 - DNA, 601 bp, Human
agaaaaggcaaaagtggggagaaagcactaaaacgggagacaagttaaaatttctttttaattgataggtcacgttctcactctatttgcctttaagggaagaaagcaatcaagttaatatgttttccttcattgtatagtatgtaactacggacactattagaggagggatttgtgtagcacttaggacattatacttgataatttccaagggtctttctagatttaaaagtctgattctaacgtagtaataaaaataaaggcccaattttctctttaatattgcctgaagatattactstattattgcattaaaattaaacattcacacattgtttgcactgctaaataaaattatgtaatttcttcttctttccttcctccttcccccatccctctctatttccctttccccttccttctttcctggccttttttccttctttctttgttcccttctccctccctcccctttcttcctttttctaaagctggctttgagatcctttattaaagaataaatctttaaaacttatactttattttccctgttgcaggaaaaaatcatgtcctacatatgttctcaacaagacactctgtc

SEQ ID NO: 186539 - DNA, 601 bp, Human
tcaagaattacctttaagtttacacatccatgcacatctaaatctaattgtttaatagaagcagttcttcagttgcaaaggttctttgcagtagaattttctcagccaggaatgatcttcccccagatatttgcatggcttctttcacttagctgatctctgttctgatatcagctgcctagagagaattttcttgaccacattcaaagttagtggcctctccaccttgggtatcatccttttttctctttttcatctttatttattttcattgatttatcgctaactgaaatgagatggyctatttcttgtttatttgttctgcctccctataatgtgtgcttttcagagggcaggtatttatcttagacatcattgagtccgttctgcttaaagcaatgctagcaaagagtggacactggaaaaatatttgttgaataaatgaatataaagtccgtaattgaaaagtcaaattgagagatgcaggagaaaacaaaaagccattttacaggacaatttgaaggatcacagtctgtattaacagttttgccattcatataattcaaatcatatttgattttcaggtttatttatttgaatt

SEQ ID NO: 186540 - DNA, 601 bp, Human
aggccaccagccaacaaccgcattctactttcactattctttagttgtatcacagtgggaaagcaacttatgtcattaagcttgagttttttcatctgacatttgagaatacaaattataccaccctcatacgacagctgttttaaacaagataatctgcataactcacacagcactagtctgacagataaagtgcacacaaaacatattatttcttattacaagttattactaggtgattaagaaatatctcctaagtaggcaaggtagcaagattctacattaggaaagtcttaaaaayccacaaaattgctcttacttcttttcaattaggatgatatattagctgcaagtgtatacatgtgtatatgtatgtgaataaaaggggtaagtttgtgctattcttaccttcagatagtgattatcaaaagaaaaatggaaagttcaactaaatacacatgggaaacataaaggcagagacatttttgtcctttagaagtgtgtatgtaactggaagcatgtttcaaatagctgacacaaatagctaaatgactatcctcaacatcacatatggaccatctgctactacttgctaaggctt

SEQ ID NO: 186541 - DNA, 601 bp, Human
ttgcctgttctggcaagctttttctattgctctggtctactttctattgctctggtctaagtccaacatgaaaggcttgctaagtgagcagtgcaggcaattagtgctgccagtgcccagataaggggtgtgataactggatgggcaggattcggagatctgggtctttgagtgtagataagacacagttaagaagagcggacaggaaaggatattcctgggggatgaggggagattgccttccactacacataagtatggtcaagtatgaaatagtgttttatccacaacctgcacaackccaggctggtggaacacttggcatgttttcagcctcaatctttctactgaaagtactagacaaggtgtgtgtggtcagtctggtgataggttgatggagtaagggtttaggctctgaaaattctctactaggaaggctgtagaaaaatagcattgcataacagacttctcttgtattttgttttgttttaaatcacaggtttctcattaaccttgtgaagcaaaagccacaaataacagaggaacaacttgaggctgtcattgcagatttctcaggcctgttggagaaatgctgccaagg

SEQ ID NO: 186542 - DNA, 601 bp, Human
gaagtctgctttgctgaagaggtacatgcagctcatttcatactcaaaatacttgctatggaattttctgtagtggataatgaaaggaagaccctacaaatttataactttaaaatattttcagagagatttaaatttcattgagaagcagattgagggattctataagatttaaaaaataatcacattttcttgcttaatattaggaaaatttataatattaaaatatattaatagaattagtaattttaatttatttcctagtagagaaacccataaagtgaatgtgtaaataattgayggtaatttagatagtttctggcctaaaattgatcaattcagctaaatggattaaaggatttaatagcaaattaattgtgcaaacagagtattaggagtctatttgtagaaaatgtttttgaactcatttagaagcttgcttttgtacatcaacagagtagtatttaggagttattttaattacatagtaattttagctggataattagccagattttctttaaccaggggattctacctaacatttaaaaaaattaccttttttcagctttattgaggcatgattgacaaatacaaatta

SEQ ID NO: 186543 - DNA, 601 bp, Human
tattgcccaggctggagtgcagtgggctggtctcggctcactcactgcaagctccgcctcccgggttcaagcaattctcctgccccagccccccgagtagctgggattacaggtgtgagccaccgcgcccggcctgttttattatttatacattcataatttgtgattcttagcaattccaggtgaaacttcaaacttgtattcattaatacttgaacattcacctggaacatgttactaaattgtacttctgcactgttccagccatggataaaaattacagctggatctgcttgaatctttttttttttttcatgaacacctacatttagaaagctaataaattacttgacagagtttgcttgaagaatgttaaaagaacacttctttgggaatttaaaacttaagtgttacctgttttgaatgatttttttttttgtttacataaagagcctgaagaaacttagacacctgatccataaaaatggcacctttttctactttctgaaactcatattcttgattaggtctcattattagaaattttgggttcttcatagagaagtagctttatttctctctcattctaagacatttggtt

SEQ ID NO: 186544 - DNA, 601 bp, Human
ggatgatgaaatagtgtaagaatgatttatatgtgccagagtacatgacagagtttttactgtcttgaagagctacagagttcagaagagaaggggcttagtgaggaaaagttttgtgggagaagtagaattcaagttgaatactaaagaacttcagtaagtacagataaaatggagtgtattctaggcagtggaatggacaaaaaaatgaaaacatggacatataatgaacttgacatactcataaattggtgaagaaagtattagattatagatctacattttgaggaatgctgagtawgaggcagggagctttgagtttcatgtaagagaaggtaagatataaacaggaatacaatgataaattgggctgaaatgtagatttcctgactcccaattcttctccttagtgtagacagagatatacagtcatgcactgtataagaacgttttggtgaatgacagattgcatatacaacagtggtcctgtgctagtgtaagcaaacctattaagaacttcagataggtccttcaggaggtattccagaagaaggcattgttaccataggagatgacagctccatgcatgtgattgcccctt

SEQ ID NO: 186545 - DNA, 601 bp, Human
gttacagtaagctacggttaatgtattactgatgaaagaaaattttgtttatataaatttagtgtagcctggatgggcacagtggctcacgcctgtaatcccagcactttgggaggccaaggcaggtggattacctgaggttagaagttcgagaccagcctggccaacatggtgaaaccctgttcctactaaaagtgcaaaaattagccaggtgtggtggcaggcgcccgtaatcccagctactcaggaggctgaggcaggagaatagcttgaacccacaggtggagcatgcagtgagccragatcgtgccactgcactccagcctgggtgacaagagcaagactccatctcaaaaaaaaaaaaattagcctaagtatacagtgcctttgaagtctacaatagtgtacagtaatgttgtaggccttcacatttctcacactgattcacccagaccaacttctagtcctgcaagctccgtttgtgataagcaccctgtacagatgtaccattttttatcttttatattttatatcttttatttttactgtaccttttctatgtttggatatgtttcgataacaaatacttaccgttgtgtta

SEQ ID NO: 186546 - DNA, 601 bp, Human
ttattctgtgtccatatccttcagtttgtagtgacagatgaaagaagcaaagatgaaaatcgagaaataattttgagtgaaacattttaatttgaagcacagttgtcccttggtatcgatggggaattggttccaggaccccttcaggtaccaaatccacggatgcttgagtcccttatataaagtggtatagtatttgcatgtaatcgacaaatatcctcccatatactttaaatcatctctagattacttataataccttatacagtgcctgcccatcacttgactcttatgggttcarcataggagtcagcatgcagcaaattcaagctttacttctgggacttggggatttttttcccccaaatatctttgatctgcagttggttgaatccacagatgctgaatctttggatacagaggcccagttgtaactatgatccaagaatttgttatttattatgagagaatttattataatgactgcgatggtagtttataacttataaactctaccatatttgggaaattcacagttacaaacatttacctatgaagggggagtgagtagtcattccttcattttttacaaataagctga

SEQ ID NO: 186547 - DNA, 601 bp, Human
cagatctgcatcagattaccataaataggcagctattctttctttttttccacagttcattgtattcctaccatttccaaatagaagtttatggttttaaattactgatgttaagtacttgtttggaaggaatttatagttaaactagttataataatttatacctgtcaagctctttcatatatagtacatattttatctctcattagtttctgtaagctcttgagagaaaggttcttttttatttccaccttttaagttcaggggtacatgtgcaggatgtgcaggtttgttacatagstaatcgtgtgccatggtggtttgctgcacacatcatcccatcacccaggtattaagcccagcattcaccagctgttcttcctgatgctcttcctcctcccacccccaaccctctgacaggccccagtgtgtgttgtccccccaaccaccgatgtgtccatgtgttctcatcatgtacctcccacttacaaatgagaacatgcggtatttggttttctgttcctgtattagtttgctgaggataaaggcctccagctccatctatgttcatgcaaaggacatgatcttgttctttatggct

SEQ ID NO: 186548 - DNA, 601 bp, Human
tgttgcccagactggagtgcagtggcatgatctcggctcactgcaacctctgtctcctgggttcaagtgattctcctgcctcagcctcctgagtagctgggactccagtcatgtgccaccatgcccggctaatttttgtatttttagtagagatgaggtttcactatgttggccagctggtcacgaacttctcacctcaagtgatccacccgccttggcctcccaaagtgctgggattacagacgtgagccactccgcctggcctaattccagagaaaggttcttatatgttttatgctayagtcccatagtatgggactactactatgtagtaattttcagttctgctgaaaatgctgtagtcgttactacgtagtaggcgcagaatatttgtttaatgagtgattctctattaaagggtcataaatttgaaaggtaaaggttaagaacaatttctctttagagttgtacagattaaaggaagtgaacttttttttttttttttgtgagatggagtttcgctctttctgcccaggctagagtgcaatggcgcaatctcggctcactgcaacctctgcctcctaggttcaagcgattctct

SEQ ID NO: 186549 - DNA, 601 bp, Human
aggcccggtggctcacacctgtaatcccagcactttgggaggctgatgcgggtagatcacctaaggtcaggagtttgagaccagcgtggccaacatggtgaaaccctgtctctactaaaaatacaaaaattagccaggtgtggtggtgcacatctgtaatcccagctacttgagaggctgaggcaggagaatcacttgaaccggggaggcagatgttgcagtgagccgagatcactccattgcactccagcctgggcaatgagcaaaactctgtccccgcctgcctcccccgctccccccmaaaaagattcctttttgctatttattgccctgtttttgatgactatggtggtggttgggttattttggtatttactattaatacagtttataaaagtaaacaaattttcaagcttgcttttatttttgtcatataagtaatttaaatcttatcaaattcagatcacagagttaacttcatgtataacttttcttgctttgtaatatctagattggaggctgaaataaggatttgttctctgttaaaagcagaaagaccttggtaggagcacagggaaaactcagcttgataaagatacca

SEQ ID NO: 186550 - DNA, 601 bp, Human
aaatacaggcacaacataactgtgtagacataattatgtatcacatgtaggtacttatagatatatttatgcagagtatttttagttaacatatctgactgtgacaacaaaatagtcatttagtttgaaaatcatgtgcccaaatatgtgttttgctgtggttaccctggagactttggagttctgccatgtgatttccttaaatccctggaatttttgattgctgagaattcaggaggagttgcccacttgttagtgtgcagggaaatgtgtttttctcatttctagttgaggtcattctttttttttttttttttttaaaccatagcatgtgttccattagttatgaatgtattatttctttagagtcaaaattcacgactcatttctttgaatattatctctgatcctagatgggatcaaaattgccctagatttaggagttttaaaagtttactaggttgtggggaagatgggtttatttttcataaacttgaactagaatgttgacgattataaggactgggacacttcctaaaggtcaaaatattttaaggcgaaagtatgtattctttccttttgcttaatgattgaaagaaaa

SEQ ID NO: 186551 - DNA, 601 bp, Human
aatacagtatttttagtgaaatgatccagaaataattacattttaaacttatgggtaaatggtgctctcagataagggaagaaaaccttggctatgtatgacaactgctttttttatttttttaatatgacacagatttattttttaacagtgggaatgcagataatatgaaagcctaagtttatataactaaactaaaaattaggataagcaaataaattgacatgtaaggaaattttaaggatgatagcagtttttgtttcctgtatattttaaatataatttctgattctttcatttmatctttctctttaacatcctatctttaagaatattttctctcattcttatgtttttgtttgcatgcattctcctcaactattttattaacagctgtttacatagataggaatgagaaaggtggttaacttaaaaaacaaatagcagatacagacctgctaggtaatagtgtgataccgtctctttcagatgaaggttcccaggagaatataatcctagcagaagctctgatatatgtagcttcagtttctccaagagtttaaaagttcctagagaagtcacctagcaagaatgaatcatg

SEQ ID NO: 186552 - DNA, 601 bp, Human
cccagagtaggctgtattgtgtcatcctgggaattcctttctccctacttccattttctcacagtttgtgtttttgatatggtaaagcatgtttttcagtggttttatgagaaagaaaggttggctgagtaaagatagcatgttataaaaattgaatgtatgggccgggtgtgatggctcacacctataatccccacactttgggaggccgaggcaggcggatcacgaggttaggagattgagaccatcctggctaacacagtgaagcccgtctctactaaaaatacaaaaaaattagctrggtgtggttatgggctcctgtagtcccagctactcgggaggctgaggcaggagaatgtcatgaacccgagaccgcaccactgcactccagcctgggtgacagagcgagactccatctcaaaaagtaaataaatacaaataaaaattgaatgtacatgtgccttaacatctagaagatgtacaacaaaaatattaaaagtgattagctatgggtgataggaatataaagggtttttattttattttttatatctgtattttataaatttataatgagaggagccattatataaaattatta

SEQ ID NO: 186553 - DNA, 601 bp, Human
tttgatatggtaaagcatgtttttcagtggttttatgagaaagaaaggttggctgagtaaagatagcatgttataaaaattgaatgtatgggccgggtgtgatggctcacacctataatccccacactttgggaggccgaggcaggcggatcacgaggttaggagattgagaccatcctggctaacacagtgaagcccgtctctactaaaaatacaaaaaaattagctgggtgtggttatgggctcctgtagtcccagctactcgggaggctgaggcaggagaatgtcatgaacccgagaycgcaccactgcactccagcctgggtgacagagcgagactccatctcaaaaagtaaataaatacaaataaaaattgaatgtacatgtgccttaacatctagaagatgtacaacaaaaatattaaaagtgattagctatgggtgataggaatataaagggtttttattttattttttatatctgtattttataaatttataatgagaggagccattatataaaattattagtgtagaaaagggattattcattgagttagctaggtatattttccctagagaagactcaggaaagagaacat

SEQ ID NO: 186554 - DNA, 601 bp, Human
tgtccttttcctctataaacatggaatttcaacacttgaacaaaaacctcagagatcttctgggtctaggccatacttgttacctccccagcccttagtctgttgcttaattctgtttaacatttctcccctcttcctaatggtagtccagcatttacttgaacactttcagagaaaggaagctcaatctcctgaggtaacctgtttacaattaggagtgattgctaaaatattcttctctgtgatgatccaaaatatatcttcctaaaacttttacctagtgatcccgggtaaacacagrttctattctcggaaactagattagcaagtctaattcctgttctattggactgcttcctcttccccatcccccgcacccttcctatttttaagaaaatttccagactaaacaaactatttttctttagccatttattagatggtataactctgtttcctcttcaccatcctggttgttttcttctgggtgagcgctgttatgttttctttacatatagtaaccagaactgattaatatttgtagaggggagaagtgctgtctttgtcctggaagcattctattaatgtcctcagtagaatt

SEQ ID NO: 186555 - DNA, 601 bp, Human
tagaggggagaagtgctgtctttgtcctggaagcattctattaatgtcctcagtagaatttgtcagccattttatactattgagtcatcgaacttctattaaccacctctacttcattctgtctttgtgcttttggttcactttgacacttaagtgggagcgtgggggaggagaagtaatgtttttgtgtgaaatcatcagttggatcaatttccataagacactgggaatggcatttgttaacaagtaaaagatagtgttgtgcatgtaaagatctaagaacttgatatttctatgaaakcacaatgactgagcaatagtcctttgccttagtttttattccattgagtgctaccttaccattgtccatactgtgccattactaattccctaaccatatgctcctcttagtaatagtgagaaaacttgatttgctagtgaggagacctagattccagacccagtttggacattaataagtcaaatggccttgggcacatctacctttctctttttcacttatagaagatctttctataaagaacacaaaaattacttaagttacagccacaaaatttgctaagattactgttttttattg

SEQ ID NO: 186556 - DNA, 601 bp, Human
aaaatttttcttatttataagagatacatgcagatcaaaagagttggaagatcattgatctagactttcagtaagcttcttgatccaatgagtaaaacactgtatctaaggccaggtgcagtggcctataatcccagcccaggcaggaggattgcttaaagccaggagttcaagaccagcctgggcaacatagcaagaccctgtctctacaaaaaaattaaaaattagctgggagtggtagtgcatgcctgcaatcccagctaactcaggaggttgagtctggaggatcccttgagcccaygagtttgaggctgcagtgggctgtgatcgcaccactgcactccagcctcggtgagtgagtgagatcctgtctcttaaaaaaaaaaaatcttaaaaaaaaaatatatatccaaaccatgagtctcaactctaccgagggatagtacttaagtttccaaaggaccatatataggtttaggaaacatcgaatatcaccattgttttgattggttctagttactttatagtttattttaaaatttcaaataatcgaaacggggtcctccacctttccaatataaacaggtagtatgggttttaa

SEQ ID NO: 186557 - DNA, 601 bp, Human
aaccaaagttgagaaatacagacctaaaactttatatctacaagtggtagtttagctttttgaaaatttcttgacttacaagtggccaaaattaaagacctatttaaggaattcagaaagaagttaataagtgataggagatgagaataaaaggaaggggttccatcattggaatgtgatgatgatacgtgatgtttataattgggatataatttttcatatgatgtttttattctgttatttataaaaatagatttttgacatgatttttattgatctcagttatgtgggtccagtatgtttttttttttttaacatcagttttaggttcacagcaaaattgagaggaagctacagagattacctgtatactccctccccaactccatggatagcttcccctgttcttaacatcctcccccagaacggtacatttatgttataatttgatgaccctacattaacacatcataattacccagagtccatagtttacattaaacttcattcttggcttggtatattctgtggcagtatttttattattgattaagtgatagatcagggactccataggaattagcttcatggcttacttctc

SEQ ID NO: 186558 - DNA, 601 bp, Human
gaggaagtgttgtgtttatttcagtggtctgaattctctttacatttacaaagttgcaagcactaaatagtgataagttaattccttctgtgtgaattgacaaaatcttacaggtcagagaaaggcaaccttttttttttttttcattaagggccatagatccagagttagaaaaaaaaaggacacagattaaaaaacaacattaatttgtttcatttcaaaactatcctgtgggtagtttatatggcatgttttaatgttgttgttttagtgagttccaacttggaaggggggtgttccytaatcactatatgtccttaagagaagcatgtaaggatggggcatatgagagtcaagcagtggacacagaaagagccacagaggagctaagtgaattctgagtggcgtattaatgaagggaaacaacacttgtcacagtactatcaactttgagttcagtcttgttattccttgaatttctgatcctttcctcaggccttttcatagctcctgatcttctgtatgtgagaaagtttgtgcagagactcttgtgtgtgggctagttacagcagctactgattaacgtgaaacttttctgtgt

SEQ ID NO: 186559 - DNA, 601 bp, Human
ctgtaaattctagtttctatcattaatatcccatgtaaattttttattcacttatcttcattacttttcagtctaggtattcttatcagaaaagcatagttctttaccttgaatttttacttaaaagtgattatagaatgctaactttgaaacatgttaggagtttttcctaacttgctaggaacaactgtcagggatgtcatgatggatcgccagtcttactgtacaactgtaaatatattcataagtgtttatacagttaaataataatatttgtatagtcactatatagacttaggascaaatatttagccatccattttatcctttatatcagaaaccttattttagttggtagttttgttccaacagatgtaagaaaaaactgataagtaatactgatgcattcaggattgattacatggagtcctgaaaaaaaaattaaactgcagctattttaggttctctaacttcatcgtagtttatagggtaagtaaagggaaggggaaagtgattggtgtggttgtctcccataagaactgatttttttctactgaagcatgtataaagtttatatatgactttttatatttgtttaata

SEQ ID NO: 186560 - DNA, 601 bp, Human
tcctatttttcaaagggatggttttttccccccgcttggctattaaactaacccttttctctgtccttacaattaaattaagaatcctaagtgactagcaataaatagattttgaggtctaagaaattttatattaccagtttatgttatatgtatttatattcataatttattttaagtatagctagtgttagattttaactttgaagtatatctcctgttagtatataacacatttgatcctgaagcaaatccaaccaaatactactagtaaagtaattacacaggtaaatataaaagccaggattattatagttttggtttgtaactcctttttttcctatgtgattggaaagacaaaggcatagaacaataactataaatttatgtgactaagcacatgatatatgaagatgtcatttttgacaatagcataaagggacagagtttataactagtttgttacaaatttaagatatcaaaaattacttgggttagggtttttaggggttttttcccacctttcagtgtgattatgttattcatttgaaatatggtatggttcctttgtttttgggttccattttagagtttctccacc

SEQ ID NO: 186561 - DNA, 601 bp, Human
ttttttcccacctttcagtgtgattatgttattcatttgaaatatggtatggttcctttgtttttgggttccattttagagtttctccacccatccttgttgatctttatttttttttctagtaagtgaaacatttaacactgtaccaaaagtcagaattgcacaaaaaaagtatactcagtagtgcctccccattccttctgtcgttttcatttctttcctacccatccccagtaaatagctaaaaccattactctctcgtttatccatcctgatttttttccttgaacaaatgagcagatacatgtctgttttcatatttcccttttttccttacacaaaagatatgctgtatccattatttggatgtaccatagttgattcaaccacttgcctttatatgggcatatagattgtttccagtattttttttcctttttatttgtttttctattttagaccttggatatatggctccagtattttgcagttacaaacagtgccaatgggaataatcttaagcgagtttattttaatattgttggaattggggtgaattcctggaaatgggattgaggcacgaacacccatatttccttaa

SEQ ID NO: 186562 - DNA, 601 bp, Human
attgctagttttaagagattgagccaggcgccgtggctctcgcctgtaatcccagcacgctgggaggccaaggtggtggatcatgaggtcaggagttcaagaccagcctgcccaacatggtgaaaccctgcctccactaaaaatacaaaaattagccgggcatagtggcggacgcctgtaatcccagctactcgggaggctgagacaggagaattgcttgaacccaggaggcggagctggcagtgagctgagatcacaccactgcactccagcctgggtggcagagcaagattccgtctcaaaaaaaaaaaaaaaaaagagagattaatactttgaaatttttaaagctttgttcattatttttatcctgtgtcctctctgtatatgtacacatggctttggctttgatggaactgatttaacattatattcttgattttcattaagagcaatataataaatacatatacagcaacatttatatttcttaacttataaaatgaacatatggttgtcagaattcaccatagatatataaacacacatagttatatattttgtttaatagctgcattgtgtttcactgtgtaaatacagcact

SEQ ID NO: 186563 - DNA, 601 bp, Human
tttcttaacttataaaatgaacatatggttgtcagaattcaccatagatatataaacacacatagttatatattttgtttaatagctgcattgtgtttcactgtgtaaatacagcacttatttaaacattctcctgctgatgaacatttaggacatttctattgtttcaaacagtgctacataaatatcctaagagtggaattatcgaccatcctggctaacacggtgaaaacccgtctctactaaaaatacaaaaaattagccgagcgaggtggcgggcacctgtagtcccagctactcrggaggctgaggcaggagaatggtgtgaacccagagggcggagcctgcagtgagccgagatagcgccactgcattccagcctgggcaacagcgagactccatctcaaaaaaaaaaaaaagagtggaattatcaaattaaagcatatcctccgcaagtacccttccaggtggaggcatgaatttccactccttccttaaattggttattttattaaattcatgctgttactagatttatctgttacttattagttcagtgtcccagatagtaaaatcttattagtgattctgctcttagata

SEQ ID NO: 186564 - DNA, 601 bp, Human
attttgcctgtgttaggtaatgacagttgtatcctttcaccatggataattgaataatcctgaaacaccaactggagagagtcataacttatttaaagagccctaatgtttacagaatatattctgttattaaacgagtatttgaaaaagatactattttgcttattgatgagagtaaaacaccttttcactttacatgcaggtactcaaaaattgtaaagcaggatgtcagtgaatttgaattctgaacgtcagtttgaagatggtaacatgtttagtatataaatcttttccactcaacccatacattttaattgatattaataattaatatgaataattttataaagaccttcaaatttttttaagtaacattaggttccttattaggagagcatattattacgctgtttttagaagcagtttgacaaatagtgattgtgtttgtttttacaaatggtgaatcagttagaaaaataaaacttcagtttatttagccattatcatttacattaaaacaatatgtttttcaaataatataattggcatcaagtgatacactttttcatacttttagttttgttttaattcaaaatttata

SEQ ID NO: 186565 - DNA, 601 bp, Human
ataattaatatgaataattttataaagaccttcaaatttttttaagtaacattaggttccttattaggagagcatattattacgctgtttttagaagcagtttgacaaatagtgattgtgtttgtttttacaaatggtgaatcagttagaaaaataaaacttcagtttatttagccattatcatttacattaaaacaatatgtttttcaaataatataattggcatcaagtgatacactttttcatacttttagttttgttttaattcaaaatttataatagttgaccataatgctttatyttctttttcattttgctattttatgaaaaatcatggtcgtttttatgtcgtggcaagagtctacttgaaattttttaatatgaatttaccaatatcaaaggaagacactgaggactatactctatctaggaagatcatccaagctgtgccccacttaccttttagacttaaggttggtaagcatgttaacaacagaatagaactgcattcaaatgaaaaataaaatgtaagatccagcggacataggttactgtaataaatacattacattgggaattatttcttagtagtggcgcgaag

SEQ ID NO: 186566 - DNA, 601 bp, Human
tctcgaactcttgaccttgtgatccaccctcctcggacttccaaagtgctgggattacaggtatgagccatggtgcccagccctcaagtgacttttatttgtgctccatccatctgtgattttgagtatttaagttttactaaagagaagcataaaagctgcattcataattcaaatatattttaaaatataaattaaaatctgtaaataaaaattaaaatattttcagtttttaaaaatgtttataaggaaacctttaacttaaaattagaagcaagtctgatcaagaagtctcaagcamaggctgagtagtaatatttaagacaacactgcttactaaagaaaagagttcaaagcaaacataggagcagaatcaaaaaataaatccttttgattataaaaaacaacagaaggacttctgtttatgtctatgtagtttggctgtgtggaacaaaatgtttacccccgttgactggcagaccaaatttcctttttgttctatttatttttctttcagatttatgaccactgccaccaacaagttaggaacagggcacacataactacagttcctaccaggctttgcttgcctgagatcttc

SEQ ID NO: 186567 - DNA, 601 bp, Human
atttatttcaagatgaaggtaagtggtaaacattctaaaagaaagtgtagacagctcttctgttaatttgtgttgctacagtaacaaccacgaatctcagtgtcttaaaatttcttcctcacttctgttacattttggcagctgcaggtcagttgctgtggctctccttcatgtgcccatctgggtctaggatcctgggctagatagagcagcacgtctttgagaaaagggcaatgcttttgaaagcatttgcttgattttggtgaacgttacatctactcgtgatctgttagccacagcrcaggcaaggacaagcccaaagtcagtggagtgggaatgaactcttcctacaggaagtggagagtgaaaaattgtgaaagtaatacaatctatcacctttgcctttatgtaactttacattgtagggggattttaaaagcagattccctaaaggcagaagtaacaaaggaaaaggttaaatggatttgaccatataaaactataaaccccctatttaggaaagtaaaagataaagtagcaaacattttaacaaataatgtcagaagactaatgagttgagggatataaataggcagattct

SEQ ID NO: 186568 - DNA, 601 bp, Human
caggttctcatcttgtgttttcccttccctagccttggaatgagctgtttttccaatgatctctagttcctttattagaaaatggtggccaatatggtgaaaccctctctctactaaaaagagaaaatttagccggggtggtggtgcacgcttgtaatcccagctactcaggcggctgaggcagaagaattgtgcgaacctgggaggtggaagttgcagtgagctgagatggcactactactccagcctgagtgacagagtgagactctgtctcaaaaaaacaaacaaacaaaaaaaaaattatatatatatatacatacacacacacatacaccttcatatatgcacacattcttatttctgtatctttatatatagttggctctgttttccatagcccacattcaagaaaaaaagtaacaatataacaattttttaaataatacaaataaaaaagtaacctagtataacaactatttacatagtatttacattgtattaaatattataagtaatctagaggtgattttaagtatatagggggattcatataggttatatgcaaatataatgccattttatataagggacttgagcatct

SEQ ID NO: 186569 - DNA, 601 bp, Human
aggttctcatcttgtgttttcccttccctagccttggaatgagctgtttttccaatgatctctagttcctttattagaaaatggtggccaatatggtgaaaccctctctctactaaaaagagaaaatttagccggggtggtggtgcacgcttgtaatcccagctactcaggcggctgaggcagaagaattgtgcgaacctgggaggtggaagttgcagtgagctgagatggcactactactccagcctgagtgacagagtgagactctgtctcaaaaaaacaaacaaacaaaaaaaaaaatatatatatatatacatacacacacacatacaccttcatatatgcacacattcttatttctgtatctttatatatagttggctctgttttccatagcccacattcaagaaaaaaagtaacaatataacaattttttaaataatacaaataaaaaagtaacctagtataacaactatttacatagtatttacattgtattaaatattataagtaatctagaggtgattttaagtatatagggggattcatataggttatatgcaaatataatgccattttatataagggacttgagcatctg

SEQ ID NO: 186570 - DNA, 601 bp, Human
atgcatttaagatttattgattttgttgcatgaatcagtagttgggacttatcccagataattccattttatagatatactgtgctttgtttattcactttgaatttcatcccagttatttccagttttagagaaataaagttactatcaacacataaaggtttttatatgaactttccattaacatgagtaaatatctaggagtaggctggttgcatgaaatgtaactaactgtatatttaactttttaaataaactgtccaattgttttccaaaatggctgtaccattttatattcccrccaggaatgtatgagagttcagttgctttgtatccttgccaaaacttgacattgtcaggtttattgtttgtcccccagctctagaactggtataatggatatcttatggttttaacttgcacttcactagtgactttttttttttgagacggagtctccctctgtcatgtcacccaggctggagtgcagtggcaccatgtcggctcactgtaacctctgcctcctgggttcaagagattctcgtgcctcagcctccctgagtagtcaggattacaggcacctgccaccacgtctgatttt

SEQ ID NO: 186571 - DNA, 601 bp, Human
cacataaaggtttttatatgaactttccattaacatgagtaaatatctaggagtaggctggttgcatgaaatgtaactaactgtatatttaactttttaaataaactgtccaattgttttccaaaatggctgtaccattttatattcccaccaggaatgtatgagagttcagttgctttgtatccttgccaaaacttgacattgtcaggtttattgtttgtcccccagctctagaactggtataatggatatcttatggttttaacttgcacttcactagtgactttttttttttgagacrgagtctccctctgtcatgtcacccaggctggagtgcagtggcaccatgtcggctcactgtaacctctgcctcctgggttcaagagattctcgtgcctcagcctccctgagtagtcaggattacaggcacctgccaccacgtctgattttttgtatttttagtagagacagggtttcgccatgttggccaggctggttttgaactcctgacctcagatgatccacccacctcggcctcccaaaatgctgggattacaggtgtgagctactgtgcccagccttcattagtgacttttatgtg

SEQ ID NO: 186572 - DNA, 601 bp, Human
taaataaaaaacagtcgagcagaaagaatttctgaactttaagagagaggtcttttaaaataacccagtcaaacacacactaaaaaggatgaagaaagcctacataggacatcataaagcaaacaaatatttcaattttgggagtgccacaaggagaaaatataggaaaaggcatagaaaacctatttaacaaaataatcactgaagacctcccatgtcttgagagagagatatatatccagatacaggaaggtcatatgtactaaaacagtttatccaaaaaggcctttctaagacacaytattttcaaactcaaaagtcaaaaacaaagaaaaaattcttatggaaccaaaaacagcccaaatagccaaagcattcctgaactaaaagaacaacatggaaggcatcacactacctgacttcaaaatatactacaaagctatagtaaccaaaacatagtattgatataaaaacacatagaccagtggaacagaataaagaacacagaataaatctacttatttacagcaaatgtgccaagaacatacattggggaaaggacactctcttcaatcaatggtattgggaaacctggatatct

SEQ ID NO: 186573 - DNA, 601 bp, Human
ctgaactaaaagaacaacatggaaggcatcacactacctgacttcaaaatatactacaaagctatagtaaccaaaacatagtattgatataaaaacacatagaccagtggaacagaataaagaacacagaataaatctacttatttacagcaaatgtgccaagaacatacattggggaaaggacactctcttcaatcaatggtattgggaaacctggatatctgtgtgcagagaatgaaactagatacctatcaccatacccaaaaatccactccaagtggattaaatacttaaacataasaccccaaactcttagactactagaagaaaacatgggggaaatgcttcctgacattagacttggcaaaaacttcatggctaagactccaaaagcacaagcaacaaaaagaaaaatagttaagtggaaatattaaactaaaaagcttctgaacagcaaaggaaacagagtgaagagacaacctgcagaatgggaggaatatttacaaactgttcatctgacaagggactgataaccaggatatataaggaactcaaccgaacaggaaaacaaacaaaaatcctattaaaaagtggacaaaag

SEQ ID NO: 186574 - DNA, 601 bp, Human
aaaacatagtattgatataaaaacacatagaccagtggaacagaataaagaacacagaataaatctacttatttacagcaaatgtgccaagaacatacattggggaaaggacactctcttcaatcaatggtattgggaaacctggatatctgtgtgcagagaatgaaactagatacctatcaccatacccaaaaatccactccaagtggattaaatacttaaacataagaccccaaactcttagactactagaagaaaacatgggggaaatgcttcctgacattagacttggcaaaaactwcatggctaagactccaaaagcacaagcaacaaaaagaaaaatagttaagtggaaatattaaactaaaaagcttctgaacagcaaaggaaacagagtgaagagacaacctgcagaatgggaggaatatttacaaactgttcatctgacaagggactgataaccaggatatataaggaactcaaccgaacaggaaaacaaacaaaaatcctattaaaaagtggacaaaaggtctgaatagacatttctcaaaagaagacatacaaatggccaagaaatatatttgaaaagctcaacattact

SEQ ID NO: 186575 - DNA, 601 bp, Human
gtctatagatcaaattgtgaagaagtcacatcttagcaatacttagtttttgattccatgaacacaatataatctaatcagcacatagatcctgtacatatcttactggatttatacccaagtatgaactgttttctggtttttttttttgttgtgtgtgggggtggggggacatgtgctatttgaaatggtatattcaattgttcattgctggtatatggaaataaaattggcttctgtatatttaccttttatcctatgaccattctaaatttacttattagttctaggagctttgtcggggggggtgtagattctttgggattctctacacaaattatcatgtcacctacaaatatggacagttttaattatttctaatctgcatgccttttaattttttttccttattgcaatgtctaggacttgtgctatgatgttgaataggagtggtgagagaggacatctttgccctattcttgatcttagggggtgtattagttttctattgctgcatgtcacaaactgccacaaacttactggcttaaacaacacaaatgtattgttttccagttctataagatcagaggccttcattgga

SEQ ID NO: 186576 - DNA, 601 bp, Human
atttttttaaaaactctctttgatttttagtttctgagagttttcatcataaattgttgtttaatcttgtcaaatgcttttccagaatctactgaggtgatcgtgttgtttctcttatttggtctgttattagagtgaattacattcatactccaattttgagatatgcatgcattcctgggatgaacccccaattggtcatgaagtatcatttatacattgctggattcaatttgctaatattttgttgaggatttttatgtctacgtttatggctaatatgggattttagtttctttgycgtgagtttgttattagggtaatgctgaccttataaatgaggtggaagtcttcccttcccttctctttttctggaagagattataatatttgtattatttaagccttatatggttggtagaatttgccagtgaacccacataggcctggagttttctattttgagaattttttttttttttttttttaatagatacgggatcattcagactatttcttcttcagtgagttttggaagtttgtgtttttaagacattggtccatttcttcaaagttatcaaattcatgaccatagagttgt

SEQ ID NO: 186577 - DNA, 601 bp, Human
cagaggttgcagtagcccagatcacgccactgcactccagcctggcaacagagcaagactccatctcaaaaaataaaaaaagatgtcactttttttcttatgatttaaatggtttctgacaagaaatctgtgtgtatataatgctccttttcttcctctgcctctgatttgcagcaattcaaatataatatgcctagggattttccctctcttccctccttcctcccccatccccaccatatttatcttattcttcttgtgtctgtggcttggtgtctgtcattaattttagaaaattctyggccaggtgcagtggctcacgcatgtaatcccagcactttgggagaccaaggcaggcggatcacgaggtcaggagattgagaacatcctggccaacatggtgaaaccccgtctctactaaaatacaaaaaattagctggccatggtggcgcatgcctgtagtcccagctgaggctgaggcaagggaattgcttgaacctgggaggtggaggttgcagtgagtccagattgcaccactgcactccagcctggcgacagagcaagactccatctcaaaaaagaaaaaaaaaaagaaaaaaaa

SEQ ID NO: 186578 - DNA, 601 bp, Human
aaagaaaaaaaaaaagaaaaaaaagaaaagaaaattctcagatatactttcttcaaatatttttccgtcctgtcctccctcttcttctgagattacagttataaatatgttaggatgttggagacggtcacacagctttttgttgttctgtcttcaagttcactgattgtttcctcagctgtgtcagttttacttaccagaacatcaaacatattctttatctccatttccatttgattccttttcataatttccatgccactgctgaaataacccatctgatcttacatgttatccaccrttcctattagagcctttaacatgttagtcatacttaaaatttgtatcaaggctgggtgcggtggctcatgcctgtaatcccagcactttgggaggctgaggcaggaggatagcttgagcccaggaattcaagacctgtttggaaaacataggaagacactgtctctacaaaaaataataaaataaattagctgggcatggtggtgcatgcctatggtcccagctgctggggaggttgaggcaggaagatcacttgagcctgggaggtcaaggctgcagtgagccctcattgtgccactgc

SEQ ID NO: 186579 - DNA, 601 bp, Human
ttttccgtcctgtcctccctcttcttctgagattacagttataaatatgttaggatgttggagacggtcacacagctttttgttgttctgtcttcaagttcactgattgtttcctcagctgtgtcagttttacttaccagaacatcaaacatattctttatctccatttccatttgattccttttcataatttccatgccactgctgaaataacccatctgatcttacatgttatccaccgttcctattagagcctttaacatgttagtcatacttaaaatttgtatcaaggctgggtgcrgtggctcatgcctgtaatcccagcactttgggaggctgaggcaggaggatagcttgagcccaggaattcaagacctgtttggaaaacataggaagacactgtctctacaaaaaataataaaataaattagctgggcatggtggtgcatgcctatggtcccagctgctggggaggttgaggcaggaagatcacttgagcctgggaggtcaaggctgcagtgagccctcattgtgccactgcactccagcctgggcagcagagcaagaccccatctcaaaaatgaaaaatagaagcaaatgc

SEQ ID NO: 186580 - DNA, 601 bp, Human
tattctttatctccatttccatttgattccttttcataatttccatgccactgctgaaataacccatctgatcttacatgttatccaccgttcctattagagcctttaacatgttagtcatacttaaaatttgtatcaaggctgggtgcggtggctcatgcctgtaatcccagcactttgggaggctgaggcaggaggatagcttgagcccaggaattcaagacctgtttggaaaacataggaagacactgtctctacaaaaaataataaaataaattagctgggcatggtggtgcatgcytatggtcccagctgctggggaggttgaggcaggaagatcacttgagcctgggaggtcaaggctgcagtgagccctcattgtgccactgcactccagcctgggcagcagagcaagaccccatctcaaaaatgaaaaatagaagcaaatgctacttttttctgaattgatagttacatgaggatgaagacatcaatggaattacaatgtactgccatttggagttacctaaaaataataatagctaacacatcttcaacatgctaggcactatattgtgtgctttacatatattaactcatt

SEQ ID NO: 186581 - DNA, 601 bp, Human
ctttaagtcagaatgaatcagcagaactcagaattgcctatgtaaaggtattgcaggttttcctctttggttgagttccgtttcaccatgctgtgtcagcagtttgtctgcctaagggacttgtcttgccaaatcttacactatgttgagtggcaagatagagctaattttagtgtaagtcctcaattcctttaactcttactgcggtggagaccatcatttcaaactgtagcgagatgatcgcaaccaaccctgctgtgtgttttgagcaataaaatatctcagccatagcagagcctcycagtcaattagtacatggcagagaaagggtcatatgggatggccagggtacttagaggtctggaaatgtgccagaagttatcagtaacatttagcatgcaaaggaatcaggttgagcacctattatgagcagtccctgacttgaggaatttagagtctacttgggggaaggttgatagacaagtacgtaattttagaagagtatgaaatatgctggaggttaaaatggaatgttatggtagcaccaaggagtggcagctctcaggctggaggagtgtgaaaaggcgtcttgggaaaggtg

SEQ ID NO: 186582 - DNA, 601 bp, Human
taacaaggcagagaggatagttaaagccaacagaggtacctcgattggttggttggtttgagggtgatgtctagctgaaatgggcagtaccagggaacaaacaggttaaatggtgaagggaagagaatgtggcatcagaagagacatgatagatttgaggggctttgggacatacatgtggccatgtctaggaggtagctggatataacctcaggggagagatgggagctagagatagtagacttggtaggtatttttatataaatgttaatgaccaacatggctgtgaatgaggttaccsagggagggtaggtagagtaaggagacagaagctgagaagacaggtaagaggaggggagaagaggaggcacccatgaaggaaattgagaaggagtgattggagaaataggacaatcaggagaatgattaaacagagtttcaaaatgggaaggtgtgatttacagtgtcatctgcagtagagccatctactggcacatgctgtggaataatctaatgaggtaagaggcaaaatttgccctttggatttgccatttgagcagtcaccggtggttggaaagcagcagtttcaatgaaactctgg

SEQ ID NO: 186583 - DNA, 601 bp, Human
caagacagccagagctaaggaggatgtgggatgttcaagaagggcagaggccattatgcagtgcagggcaggggatagtgggagaacgaggagacgagatcagagaggaagcagctgtgcagtcaggcgatgaaggactgtggtccatggtgaggagtgtgggtctgaagccattggatggcagtaagcatggaagagacatggtcagatttctattttatttagccccaaaggtcttagttatggccttagaggtcctttaattacactcctctcagggtgctcctcttttaaaattttstttagtgtttcctctaaaatagccgttattccaggttacagaagattttgaaaagatcactagggtaacgtttcttgtctttccttttttttttttagtgtcaaacaagcattttagatattttttattttgatttttattatccactttattgaggtatgattgatgttagagcaacaattcttaatgtttatcagtccttggaagtctcagaaggtctgaggattgattgtctcttctctgtgtgtgatcagaattatgccaaagcctatattacccataattatatttgctggtgtt

SEQ ID NO: 186584 - DNA, 601 bp, Human
cacaatggttgaaagcatgggtaactctttgatcttgggcaagcttcttaacttcttccttttcttcatttttcctcttcctcctctttctccttttcctcctcctcctccttctcttctaccacctccaccacgaccgtcatcacctatcataaaactcacttttctaaagtttaccattcagtgttttaaaattacattcacaaaattttgcagttatcaccacaatctaattctagaacgttttcatcatccccaagaaaccctgtacccattagcagtcactccccattcccttctkccttaggcccctggtgaccgctaatctacattctgtctccatgcattcgcgttctggacatttcatacgatatgcagccttttgtgactgacctcttttacttagcataatgttttgaggttcatccatgttgtagctgagtaatataccattatttggatatattctaagcttcttaagctttagtttccttccgaagctgtaggttgttgcaaggattagatgagataacatgtggtgcttgcacgtgtttgttgacaatgaattattattacctccgtgaggcagtcactgcgctga

SEQ ID NO: 186585 - DNA, 601 bp, Human
taaaaaggtaattaagttaaaatgaaatcttttgggtggcccttaatttaatattactattgtcatgaaaagagaaagtttggacacagacactagtgtgttggaggaaagaccatgtgaagacacagtgagatggacggcggctgtctgcaagccaaggagagagccctgtgaataaaaccagccctgctgacaccttgatcttggacttctagccttccgaactgtgaggaaatacatttctgttggttaaactaccagtctgtggtactttgtggcatccttagcaaactaatacacygttctaattcacttattgctcacctattgcagtgagacattcagcattaagtgctgcttgttaatgggtaaaactgtttgtcccttatactatgattttcaagtgctgttttgagaaattgtggtttcttttgcatttaggtactttaggatgattggaactgttttggtagttttgaaaaagtgtgtgatgataaagaatcttaagaggcaggtatccccaaagttgctgtaaatattgattgccactgtgctgtgtgcaatatgatgtagtcaaatattgcattgtatatgtcctaga

SEQ ID NO: 186586 - DNA, 601 bp, Human
gtcccaaacaataacttattaaattttcctcttggttctccatagatttatataaagtaagggcttgacatcacatgaactggctcattaagactcttgatggtcatctgttgccagtgagaattgtgttgttttagaaccattttttggatgattcatacactagaatctcatcatctagagtcatttctcctaatcttttaaaattaattataaattagaatccccaaataagaatcctaactatggtttattatgggctatttataaaagtactctctttaacaagtttgttctaatkcttcttccatgatgatatccatgagccttaatataatatttagattgtgtttaaaaacaaaataatctatactggctttttatttatttatttttttgagacggagtttcgctcttgtcacccaggctggagtgcagtggcgcgatctcggctcactgcaacctctacctcccaggttcaagcaattctcctacctcagcctcccaggtagctgggattacaggcatccgccaccacgcccagctaatttttgtatttttagtagagacagtgttttgccatgttggccaggctggtctc

SEQ ID NO: 186587 - DNA, 601 bp, Human
gtcaaacacttgtaaatcgtatgttttggtgattctaagtgatactccttgggtttccaatgaacttcaggtacagagggctgttgttaattgtctttcacatttatgccatgttagatcattgatctgagcaaagccccagtattgtttaatgttttcattatctttatctatctccagtccccatcttattttccctgaccatatcctaatgaggcaaccaacccgatgtgttttacacgatctttttattataggtgttcttaaaaattacagtttgtggacatgtaattttatttamtaaaaatagtgttatgctatagatctctactcaatacaatgtttaaaggtctgtctgtaaacctgtgtacatttttatatctaaccgtggtagagtaccctatattgtgtctctaactgcttcatcccccagggggagatatgtagattccccgtggctctccacaaccacaagccatattataatgtatatgtataaatcaggatgaatagagcccatttatacatatacatatacattggctgtataggccaatgggctttatccatcctgatttatacatgtgcgttataatatggc

SEQ ID NO: 186588 - DNA, 601 bp, Human
gtaattttatttaataaaaatagtgttatgctatagatctctactcaatacaatgtttaaaggtctgtctgtaaacctgtgtacatttttatatctaaccgtggtagagtaccctatattgtgtctctaactgcttcatcccccagggggagatatgtagattccccgtggctctccacaaccacaagccatattataatgtatatgtataaatcaggatgaatagagcccatttatacatatacatatacattggctgtataggccaatgggctttatccatcctgatttatacatgtgygttataatatggcttgtggttgtgttgctggtttattgggccagtgtgtacttaatttgatgaagtacttcaggatcgtcctccagaagggctgcactgatctcctcttgagcaaagcatgatgttcactagagtgttcaaatctcatatttgtttttgggatgaactaaatgactttttttccctaggcatagttactctctgtatgttgggtttgaatgggtgatttcttacagtagacaagaaggtacttgtctgaaagttaaaggagaggagataatgaagtgagaaaaggatgag

SEQ ID NO: 186589 - DNA, 601 bp, Human
ttttatgttagtcatgggttagtaaccttgaataaagacttgaggtcttctctggccaagtgtaagagacgccctgccttgaaaatagtgcttttgaagactcaactttgtatcctagatgctggccatgttccaggtacttaagagtatcatgaatctgaaatctggaaaacaaagggctttatttcaatttttagcaaaataacttcagaaatgtagctattaatttgacacatactttgtagagttacagagtttgcaccaaattccaccatctacagatgaagacccagaaatttartagtggacacttttgtccagggtccccttggggtgtgttgagccctagaacccaggactctggactttcagcccatagctcttgtcattctcctttactaatagggacagtattgcctatagggctcttatatgtgtaagctgtagattatgtatgtggaattattaaatgtaccgtctgtacctaaatatttcagaatatttaaatagtaaagattaagtaaaaagaagaataagtatgtcaaaacattaatgaagattctgggactgagaatatgttttgaggtcttcagtaccagat

SEQ ID NO: 186590 - DNA, 601 bp, Human
attgcagatctagtctgtttatttttctggatgtttgctctctgaagggtaaagcccgtcatgcttaatcatcatttgcatttttttcttaacttctctgctgttcacaaaacaatctaattctttaagcaggtgtgtagtcatgtcccttggttttatctaagtaaaatgagaaaaatcttgttttccaatcaatcatacttgcattttgacatgaaacagcaggtatttgtcaaaattaattgttagataaacctgtataagtgaaaaagagtgggatggctgaaatcatttttaaaartggaaaaaggtgctcagaggatctgaaaaatgttggattggattgtaccttaccttgcaataaaaggagattcacatctatttaaggactcttgcttttcaacattcacatagtgagatataaatgcagggctattttttttaactataagaaagtatatttaaaatttgaccattgataaaactatgacatcccatatgataagttgcagtcagatgcttgcatggtaggtgatatggtttggatctgtggccccaccgaatgtcatgtcgaattgtaatccccagtggtggaggtggg

SEQ ID NO: 186591 - DNA, 601 bp, Human
aaatgttggattggattgtaccttaccttgcaataaaaggagattcacatctatttaaggactcttgcttttcaacattcacatagtgagatataaatgcagggctattttttttaactataagaaagtatatttaaaatttgaccattgataaaactatgacatcccatatgataagttgcagtcagatgcttgcatggtaggtgatatggtttggatctgtggccccaccgaatgtcatgtcgaattgtaatccccagtggtggaggtggggcctggtgggaggtgattggagcatggsggcagacttctcatgcatgggttagcactgtatccccctgggtactgtcctcacaatagtgagttgagttctaatgaaatctggttgtttataagtatgcagcaccaccccccttgcatcctcttcctcctgctctggccatgtgaaatgccggcctcccaccttcaccttccactgtgattgtaagttttttgaggccttcccagaagctgagcagatgccaccatgcttcctgtatagcctacagaactgtgaaccaattaaaccacttttctttataaattactcaggctcaggtat

SEQ ID NO: 186592 - DNA, 601 bp, Human
atttgagtagtaaagaccttgtcttatttctgagaagtcatcaacaacataagacttgtaacaaacgcaccttataactctatgaataattttctcaatttttctctctgagatcgctggcaaagttttgtccaaaaccaaggattcattaaaatggcagcttgtcatgatgaagcaatgaatatcccaagttacttgttcatcctcagtagtgaagttagagacctgttgtcaccaaaccatcatatgaaaagaagatagcaatagatgtttatattagtttctttttcattgtcagaartctttgtacttttgagacatagaagaatagctgttaaatcaaaagcagtttttttgtaaagagataatgtttttggaaaagtgactgctcattataaaatgtcaagtcgatacaaaaagaatacaaagaaaaagtgaaaaacagattcgtattcagaagtaaccattattaatattgttaaacttaattcagagaactctgtatgtatactgatagaaggcttgatagtgtacacatatgagattattctataatgatattttaaatataaatgattaaatttaacaaaatttgaataca

SEQ ID NO: 186593 - DNA, 601 bp, Human
tctttatcaacatagttttgtagattgtcagacccaattgactgcagttagtcttgaattgagactcatttcctagacttggtctctttatttagttccttcctagtttttgctttctaattatgcatcatagttatgaagtgcatatactgtgcatgaaatcacattaggaggaattatacgtggaggaactcatggtctgtgattctaattatgagcaccttcttttggggcttaataaatattaaatttaaaagaaaaacaaatgaaatgaaaggaattggtgaagatcagacaaatmctgtatttctttataacaaaacatattacttgctaaaaaaatcctactaaagttgtgaagaactttgtatggagtcgtttaaaaagaaatgcctcagattgtatatttaagaagagaagaaatttatatactaagacttctttcacttcattctcacctgttataatgttctttttacattgccaagatttattaaatttgtgttttgtttagtaaccacaataaataccaattctttacttaaaataactgggcccatcatgggtctttttagcatggtttctccatacttcctggatt

SEQ ID NO: 186594 - DNA, 601 bp, Human
taaccattctggattccattaagaacattcctaattaatggaaggaggtgaaaatataaacatttacaggagtttggaataagttgatttcaaccgtcatggatgactttgaggggttcaagagttcagtggaggaagtcactgcagacgtggtagaaagacagtaagagaggaacaactagaagtggagcccgaagatgtgactgaactgctgcaatctcatgataagacttgaatggatgaagagttacttaagtggtttcatgagatggaatctactgctggtgaagttgctgtgaayattgttgaaatgacagcaaaggatttagaatattacataaacttggttgggcagagtttgagaggattgactccaattttgaaagaagttctgctgcgggtaaaatgctgtcacacagcatcacatgctacagagaaatctttcatgaagagtcaatcaatgagacaaacttcattgttgtcttatttcaataaattggcacagccactctagccttcagcaaccactgatcactcagttcagcagccatcaacatcaagacaagaccctctaccagcaaaatgattacaacttgctgaa

SEQ ID NO: 186595 - DNA, 601 bp, Human
ccacttcatttttctacccctgtcatgagttaccaaccttggtgtggctttcctggatgtgaatcagttcatttaggacttttctcatatcttctctagtcctaaccattctggttcctggaactgatactgatagtaaattcgccataatggaccatatacagttaatgctagcatttctaccagggttctaaaaatgtctggttttaagattaaattaaaaatagtccctctgaaagacctaaatagaatagtttctctctttttctgtgtcagtctctttgggatttggctgcttctrgaatcttacaaaggttttgcttttgatccaaacactgcaaggcactttgtgaatgtgagtaagatagtctacatgggctgaaaatttaagaccatttaatgaaagttgtctggctgcaggaaaaatgctcatttttacaaattgtcttaaagttctgatttatagatctgttctgcatttttctactaccactggattttattactggcacattatatttaattaggatagaaggaatgtgtgtgctcataattatttaaaatgatttcaggacatatatttagagaatcgagtgtaaat

SEQ ID NO: 186596 - DNA, 601 bp, Human
ttcctagaatgtggcaaaaactggacttggaagagagtagtttcttctgtacaaggttaccagaaggcaaagctgatcatggatcctcttctgttctctgcaatttctctatgtgtgatgcttgctttatagttatgttaataaatattggatgtatcagaaaagaagctggattagcaatagtcaccaactacattcattattagctttgaaatttgttcatcatagcatttcagtgatgtgtaactatgtgcagaagataggccttttttatttggatccagttttccttgtgtttaatttttttttttttggttttatgacatacgggggtaaaactagattgtgaaagtaaccatgattctgtcataaaggaatctcaaaattactggaaacttggagagacactggtagccacaactagaaatgtgttatccacttcatatggtcgagctttaagttaaggggaagaaacgaaacatctttcatcttttatttaaagatttttcttctgataccaccctcctcagaagggaactctcactggcttttaggctgatcaagccagctgagtgagggttctcagcttttatatcacctc

SEQ ID NO: 186597 - DNA, 601 bp, Human
tagcaatagtcaccaactacattcattattagctttgaaatttgttcatcatagcatttcagtgatgtgtaactatgtgcagaagataggccttttttatttggatccagttttccttgtgtttaatttttttttttttggttttatgacatacgggggtaaaactagattgtgaaagtaaccatgattctgtcataaaggaatctcaaaattactggaaacttggagagacactggtagccacaactagaaatgtgttatccacttcatatggtcgagctttaagttaaggggaagaaaygaaacatctttcatcttttatttaaagatttttcttctgataccaccctcctcagaagggaactctcactggcttttaggctgatcaagccagctgagtgagggttctcagcttttatatcacctcaagtctcctaactctttgtttctccactctacaattagcttgcaggcctgcctatgtttcctgtcctcattatactagggttttctaaactttattatggctaatgggaccattacctgagatgcaggagtacctacacatttacatttccactgcaatctctcatatggttta

SEQ ID NO: 186598 - DNA, 601 bp, Human
cctcgatcttttaacgtagcttaaaattcttactgtattgtttacactcaaaggagtgtatattttttagctgaaacaacttttggtatgaaaactattttaggtggtatgagtctattttttttttaaaactttagaaaagtaatggttgaaaaattgttatacttttaaagtcttctgttacaaaaagaaaagaaatataagagcaagcataattgtaggatacaagcttatgtttatatgaatgtattgagtttaaattttgtgtctgcattaccacttacagtaattatctagtgartttaaaatatcttatgtgtataaaaggacaaaacagagaagcttctaatggaaagagggagcgggcacgatgcttcactgtggcttcatggagccttgggcataacaatgtcactacgctcgaggctccatgaagttgagagtctccgcagtgacagcattggttgtcattaaatgaatgaaatgtgtacctggaaggaaggggtggtaggagacttcttggatgaatgtcagcgctcatttaggtgtgattagggctcccagtactgagaacttaagtactttcaagcagcagataatc

SEQ ID NO: 186599 - DNA, 601 bp, Human
gggcataacaatgtcactacgctcgaggctccatgaagttgagagtctccgcagtgacagcattggttgtcattaaatgaatgaaatgtgtacctggaaggaaggggtggtaggagacttcttggatgaatgtcagcgctcatttaggtgtgattagggctcccagtactgagaacttaagtactttcaagcagcagataatcagatgactgactttgcatgagaaatatgggcatttgtggtactccttttctagatatcatttaatttttctactgtttgtttaacttctgttccagtcccaatttgaacacatatggaagtaacttacatgttttactactgagaattgaattagggtatttgtgctactgtttacttaggaacaaagatgtatggcaaggtgcatggctagtcaccacctgacaagttcagtgtcttgcagtgaatgtgatctcatagcttcctgacttccacaacttacactgctgactcctcttgcccagatccacctactgatgttatgcactgagagagcctaaggcacctactcaaggctttcctaaaacagtggctgtattagtccattttcactctgcta

SEQ ID NO: 186600 - DNA, 601 bp, Human
cactacgctcgaggctccatgaagttgagagtctccgcagtgacagcattggttgtcattaaatgaatgaaatgtgtacctggaaggaaggggtggtaggagacttcttggatgaatgtcagcgctcatttaggtgtgattagggctcccagtactgagaacttaagtactttcaagcagcagataatcagatgactgactttgcatgagaaatatgggcatttgtggtactccttttctagatatcatttaatttttctactgtttgtttaacttctgttccagtcccaatttgaacacwtatggaagtaacttacatgttttactactgagaattgaattagggtatttgtgctactgtttacttaggaacaaagatgtatggcaaggtgcatggctagtcaccacctgacaagttcagtgtcttgcagtgaatgtgatctcatagcttcctgacttccacaacttacactgctgactcctcttgcccagatccacctactgatgttatgcactgagagagcctaaggcacctactcaaggctttcctaaaacagtggctgtattagtccattttcactctgctaataaagacattccc

SEQ ID NO: 186601 - DNA, 601 bp, Human
cctggtttatgtatgtctgttgtcctggcacaattattaatatgcctcttttcatttccacaaatgccctagtttggatgataaattatatggccatccagttgttaggccttggtgcttgctactattcatctagacttttttttacctagttctgctggtgaagaaatgctgtgtgggcctctaggttccttcagacaagcttgttctcagcaactcactcaatttcctagttagaaataaactgagtgcttaatacaaaatttcagagaatacagattttaaaactagaaaggacttccagagactggtagttcaaccactttttacaatgaagtaaatgattttaagtcatgtagaaaaaatgatttcctttgtggtccaatgtatatcttttctagtagccttcctcatagcccaaggcccagttagccacgtcgtcttgttctgaacaattgttttctttgatcagcctgcccttaaacttttctgaccagaattactccaaagagaagcatatttttgtttgtttgtttgtttgttttgttttattctgagacagagtcttgctctgtcgctcaggctggaatgcagtggtgtg

SEQ ID NO: 186602 - DNA, 601 bp, Human
gctgagattataggcatgagccaccgcgtctggctggttctttgtttaaagtaaggggttcaagttattttccaaaaaaactggatctactcttcttggttaatagctttcctagatactagggaatcttggtacctaacttttccaattattagaatccttggcttctccatatggaacttccttgtaatggaagatataaacttttgggagttttgaccacatggctgtttatgtgtctacttacattagaaacatgaatctcatattcaaggattccaacaaatacacacacacacasacacacacacacacacacacacagacacacacagacacacgtctatacacatacatataaaactttcctgaggtaaatctctttttgtgaatttccaattcctaaatataatagcagctctgcttgtatagttgctgatgattgtgaaattctttgaacatagatttctaaaagatatttgtgataaatcctgaaattaggacagtttagacaatgtttcagtgacaaacatgaaatctgagacttcagcactgtaaaatgttatctcttccccacactgcgatatagtgcaagttgagt

SEQ ID NO: 186603 - DNA, 601 bp, Human
acaaatacacacacacacacacacacacacacacacacacacagacacacacagacacacgtctatacacatacatataaaactttcctgaggtaaatctctttttgtgaatttccaattcctaaatataatagcagctctgcttgtatagttgctgatgattgtgaaattctttgaacatagatttctaaaagatatttgtgataaatcctgaaattaggacagtttagacaatgtttcagtgacaaacatgaaatctgagacttcagcactgtaaaatgttatctcttccccacactgygatatagtgcaagttgagtagctcttttagacagttcttctccaaatcatgatgaaagggtctaggctgcattcatatttctgttatgccatctggagcatgtggcttccagggttgccatggaagagagggcttagataatcctgcagggattttagtggtcacactagaggggcagacatcacttccttcatgtctcattagccatgatccattgtcttggccctaacctaactgcagcagaacctgcaaaatgtggtcttatcaggatgccaggaaggggaaaatgaaatagcattt

SEQ ID NO: 186604 - DNA, 601 bp, Human
tcttacatgttcttcatattttgagtaaaatcatatttagtctcattctagagttcctagagttttcaccactttagtggtgcagattcaccatgaagggcagagtgagtgggttcaagagtttccttgttctagttcttccactttctttcactggcttgaacttccatcctacgtttattcatttacttataaaggtcactcctctttcaacagataacctgcatgagaagcatgggagtagccagagaatacagcttttctgtagcttcagtgattgaaaaaagatgtttattttagratttaggatgttcagagtttgcccacaagttgttagcatcttcagaaccaaacatccaattggctgatcaacaaagtaaaatgccagtttatatttgggtccgcaattgctaaatagatgagtattagcatttcagaacattctgtttccaacaggaaattgtattaggactacagaaagcagaggtggaggaaaggacaactcatcttcaggcatgtggagacatagattaccggttccttcctggctgggtggggctggagacaccactgcacaatcaactattcccttctccctttt

SEQ ID NO: 186605 - DNA, 601 bp, Human
acaatttagtttcaagtgtagaattatccttcagtacacatttggtttgtgattttaatgggaaacatgtctaaagtttaagcattggcttcctttctgtgttggaaaggttgtccttcatcacacacaggacatacgcaggacatacccaggaggcccccagttactctgttgactggtgctcaacacccctttccagccctcttcactggattatttttagaatgcatcagatgcagctctcaaaatgatgcaaaatcattgagtcctcccatttttcagctaaagaagtagtgtcacrgtttcctaacaagaaaacctactatgaggcaaaattatagaaaatcagaatagcagaatagggcatgagctgaggaatcttctgctttagcccttcatttttgcataagaagaaataaagacccaagtttagagcatacagctggcttagagtgggacctactcttgtccttcagttcccattaggattaaatgagttaataccattatagtccttataacagtacctgtgccatagtaagtggtcagcaaatgcgagttatcacttgtcattattcctagtgatagagcccaaacagga

SEQ ID NO: 186606 - DNA, 601 bp, Human
cattaataagacactccaaatctgatatcagttgtaactaaaacttaaaaggtatttcaactctagcaaaagaaattgtgttcactgcagtttgtttttgtgttcactgcttttctctctttcatgacccattttcttcaaacagctcatatacccaaacttacgtgcttcatagataatgaactaacagtctgttttttatgtgtctgtatttatgtacatcagaaaaacccaagatgatatggtgcacactattttatatcaagattttttaaatgtagcaaaattttaaatattttarcatatattaagtaatcttctaaacctttaatttttaaaaatttcataatattatttctaattcatttgttataatatgtttaaaaatgccatggtgatagacattttgactctttccaatctttcactatccgaataacttcaagggaaggccttccagatacgttttgaatacatcccttataattgcttcagaattaattctgagaaaggaattttctgggtcaaagagttggtacaattttttaacactcttcatatatattaacaatttttatttctgaaagtttgtataaattca

SEQ ID NO: 186607 - DNA, 601 bp, Human
tgtccagtgtatgagtaagggagggtgggccctgcagaagtcagtcagagtctggccgaggtgctgtattggagtcagggtattttcagacacacgggtctgcctgtcttcccttttctgagtgtttccccacctctttctgcttcctttcctttatttttctcattccctcttcttttagtaatattttaatgaagttttcagactattttttaaatctattttcccttcttttttactgcctctcagcttgccataattgggtttaaaaattcgtgtttgtattgtttctaaccagagrtaacttaaagtttgtatttccactcctatactaaaaatgactcttttacttgcgtgtacactagaattttttccctagtctttgaattaatagccagttttttaaaaagtttcttaccactgcataaataataatttaagcaataacaaggaaaacagaactatccacactaaatcacttaaattagatccaggattatcagttatttgaattttgagtataaagttgaaattattattaatcattcaaaatattgaccttcctggcaacattcggagtacattatagaatatgaaagga

SEQ ID NO: 186608 - DNA, 601 bp, Human
ctattggttctatttccactaaaatgagtagaatcaaacagttcctgttgttattactattattattattatcattattattttttatagaggcagggtctttctacattgcccaggctggtctcaaactcctcctgggcttaagcaatcctccctccttggcctcccaaagtgctaggattacaggcatgagccatgatgcctgtccagttcctgttattagattagtaataccagagaactggatctttttttccctacaagttgtaatcactagactcacaaagttattatccccagmcatttctggttaggaagtattttaaaagatggacatggcttcaatgtgtcagtatatgaagaggaagcctggtaggttccaatgggattctgagcttggaaaccttgtggagcagagttattatttgagcatgatatggcttgtggagtgttcagctatgtgcaagtagcaggctgagaaaggtagggagcatactaggatttttaatttcctgtgactagccaataacttccacttatcagatgctccatttctgttgaatttaattaactgacagttttggatccgaaaatgctgatg

SEQ ID NO: 186609 - DNA, 601 bp, Human
ctcaagatcttactttgcagtggtctgaagtgttaccaaataatatttttccatagtactctttaaaaacttggtattaatttagtaataaaaaaatcagaaaatcctctaatactgctagtactaatattaaattggaagctaccaaattgtttataatgtttaatataactacacaatttagctattaaaactttcttatgatgataaacatcagagattggatgttgcctgaagtctcatttaagtttaaaaaaatacagtgattcaaggccaggcacgatggtgcatgcctgtaatmccagctactcaggaggctgaagcacaagaattgcttgaacctgggaggtagaggttgcagtgagctgagatcatgccactgcactccagcctgggcgacagagtgagactgtctttaaaaaagaaaagaaaagaaaagcagcccttcactgtacacacacacacacacacacacacacacacacacacacacacacacacacacagttgtccttgaactgcacgggtccacttatatgtagacttttttcaaccaaacacagtatttgtgggatgcaaaacctgtgcatatagagggctg

SEQ ID NO: 186610 - DNA, 601 bp, Human
tgtagttattatttgactttgaaaactacattcatatattgcttctaaaatgtttttaaagttaatttttaaaggtaagaaaacaaataagatattgtataattttccattaaaaatgattataaacaaacttttggagtctctcttcagtcaagtggaagtccttattctataacaacatctgaaaagtacctgtactcctacaatacatacttaagaaatgtatgttttattaattaccttggtgtcattgttttttaaagccttttctccttcattcaatttaacacacacatgcttrttataaaaaagttgaaaaattgcctagtcttatttgcaactttatataggaggagtttctagggttattaatacagtgcacatatatgcccatccttgcatttctttttgctttatggaagcacccaaagaattaatcataatgcataaaatacaaccaatcaatgaaacctgctttccagggtggagagcactgttactaccatggaagcatcagaggcgtcaaagactccaaggtggctctgtcaacctgcaatggacttcagtaagtgggaatctcattggcattttattcattgac

SEQ ID NO: 186611 - DNA, 601 bp, Human
cctgagttttgaagttttaagttgcacatgccaggcccatgtacccgtaaaggatagtaaaagacatcaaacataggttttctgaagcaaatcctagtccttcccagtctatgaaaagagcagagaggatattttgttttgtattagccagcctccttactttaaactagctttcatagaagtcattatatgaaaaagatacttgcacacacacatttatagcagcacaatttgcaattgcagaaatatggaaccagcctaaatgtccatcaatcagcaagtagataagtaaaatgtgatacacacacacacacacacacgcacacgcaccatggaatactactcagccataaaaaggaatgaaataatggcattcacagcaacctggatggaattggagactattactataagtgaagtaactcaggagtggaaaaccaaacattgtgtgttctcattcatatgtggaagctaagccatgaggacacaaaggcataagaatgatacattggactttggaggctcgggaaagtggaaggtggtgagtgataaaacacattgggtacagtgtacactacttgggtgatgggtgcacctaaat

SEQ ID NO: 186612 - DNA, 601 bp, Human
tctttagggatttcaaatttagataaaattgggctgggcgtggtagctcacgcctataatcctagcactttgggaggctgaggtgcgcagatcacgaggtcaggagtttgagaccagcccagccaatatggtgaaaccctgtctccactaaaaatacaaaaattagctgggcgtggtgacgggagcctgtaatcccagctagtggggaggctgaggcagaagaatcgcttgaacctgggaggcagaggttacagcgagccaagattgcacctttgcactccagcctgggcgacagagcgaractccatctcaataaataaattaattaattaattaattttgaaacagctaacagttagataggctactgataataaaagctgaacagacaaacttttattgtcttggttatggcgatgtatgtatgaatatggggtaaatttcaaagttgatgcagaaaagttttaaagggttggtgtttgaataaacctctgtcattttcaactagtaactataaaaattatcaggtaatgaagacagcccacttagataaagacattttgattaagtaaaatgttatttatctcactccagtaaggaa

SEQ ID NO: 186613 - DNA, 601 bp, Human
ataaaattgggctgggcgtggtagctcacgcctataatcctagcactttgggaggctgaggtgcgcagatcacgaggtcaggagtttgagaccagcccagccaatatggtgaaaccctgtctccactaaaaatacaaaaattagctgggcgtggtgacgggagcctgtaatcccagctagtggggaggctgaggcagaagaatcgcttgaacctgggaggcagaggttacagcgagccaagattgcacctttgcactccagcctgggcgacagagcgagactccatctcaataaataaatwaattaattaattaattttgaaacagctaacagttagataggctactgataataaaagctgaacagacaaacttttattgtcttggttatggcgatgtatgtatgaatatggggtaaatttcaaagttgatgcagaaaagttttaaagggttggtgtttgaataaacctctgtcattttcaactagtaactataaaaattatcaggtaatgaagacagcccacttagataaagacattttgattaagtaaaatgttatttatctcactccagtaaggaaagataatctgtgtacagcaaaa

SEQ ID NO: 186614 - DNA, 601 bp, Human
ataatgatcagtgtgctttttttcaccttagtttgacatatattatcagtgccactgtttcttcatgtaatattttaaaacatactcccattgaaataagcataaaattttgatactaatttttcctttctgcagctatggaaagaggtgaccagtggccctttctctctgaattacagtggttgaaaagaaggaagagagcagtgaatgtgagtgtggcattgagccttgggtgggcctattttactcaatgaagtcatgtgcctatcaccccacattatctaagtgtacctaaaacagktcagattttggggactgttgtttaaaaatgaaaacaataaacaaaaaaccctatgatttgagccttaacacactgctttttattgatctctttctgttagtgattcaaactgattacggtagtctctgaaccctgacgtcatctaaagaacgtgttgttttagctctgttttctacgtgttttctgatgataattgcagtgcgttttattttctatttaaagtacagcagacttttctttctatatggcttatatagtgtcatataaaacatttctgttaataaaaaatctagagagagg

SEQ ID NO: 186615 - DNA, 601 bp, Human
gtgggcctattttactcaatgaagtcatgtgcctatcaccccacattatctaagtgtacctaaaacagttcagattttggggactgttgtttaaaaatgaaaacaataaacaaaaaaccctatgatttgagccttaacacactgctttttattgatctctttctgttagtgattcaaactgattacggtagtctctgaaccctgacgtcatctaaagaacgtgttgttttagctctgttttctacgtgttttctgatgataattgcagtgcgttttattttctatttaaagtacagcagayttttctttctatatggcttatatagtgtcatataaaacatttctgttaataaaaaatctagagagaggagttaggttttgaaatgttggctaatcatacatatttatattactttcagattaaaaactctgttacaccaaactttaaagctgtatgtgtttttcagaacacaatgaatttatttgactattagcaatataacagtttctaaataaaaatcatgtaattgtataatcaactactgttatatacttcacatgtattgataaacgtataggggctttgtaattgaaattatgt

SEQ ID NO: 186616 - DNA, 601 bp, Human
gctggccctactcagagaatgccttgaaactagaaatttaaaaaaatagtgacttaatttatatttaaacttttaagtttctactttaatggatgttttccattaactatcagtttaattgtgttgaatatcaatagaatacctcttacttttgtatacacatttattttctgttccagttgcctttaaatatattgcttgagatgttagtaagaagcaaaatttatcagaacacatataatttaagagaggtcctttttggtggaaaggaaagccagatgtgtaggcagtcattttagamagtaaaggctaaaatatgagtttctgaaggactttaatttgcttgaaaccccaagatagtttttttatctgaattatttttgttgattggaacattgagattttttttcccagctgattctcaatcttgagcattgtggcatgttgtgaaattatggcttttgaagcctaagcttttttcaacatccattatataaatacttttagagtagtagaaataataattaagatatattcaatgtctttgaatgcacaaagtgcattctcaaatagctgttaatctatagaatctgttctcaaa

SEQ ID NO: 186617 - DNA, 601 bp, Human
gtggtggctcacgcctataatcgcagcactttgggagtccaaggcgtgtggatcacttgaggtaaggagttcgagaccagcctggccaacatggtgaaaccccatttctactaaaatataaatatatatatacacacacacacatatacatacacatatacatatacaaaaaaaattaaaaaattagccggaggtggtgacatttacctgtaatctcagctacttgggaggctgagacaggagaattgattgaacccgggaggtggaggttgcactgagccaagattgcaccactgcactycagcctgggcgacagagtgagactccgtctcaaaaaagaggaaagcttttatttttgagtggtaataatgcctaaaatagaaattgcctaagatttctactatttaaagaaatagtacttcttggctaatagaactaaatatattccttttgctttaagacagagttacattctaatccataatagtcccaaatacgtatgacattttataagaattttttttttgagagctgaaaaaaattttttgaggtatgctttctatgagatgaaggttgtttttaaatttgattgccacttcag

SEQ ID NO: 186618 - DNA, 601 bp, Human
tacattctaatccataatagtcccaaatacgtatgacattttataagaattttttttttgagagctgaaaaaaattttttgaggtatgctttctatgagatgaaggttgtttttaaatttgattgccacttcagtagtatatcagaacttactggatcaaagtacttaaattcacatgttgaaagtcaaactgaactagaataattaatacatttatttctgaatatgtggggatttgctgctgggctttaggataatcatctcactgagagtactcatcttacaatctttatactatackatccagaatagttattttgataattctcaccttcgggttgaaaaaccaaattctaatcttattttttttcaaaagacagttttcttaaggattgcatgtgttcaggaaggaaaagcaaccattttaaataaagattgttttaaactgatcagaaatgtgaaagtaagttttgttataaatggtgattgcatatttttctttatatgcaaaattagttctaattcatgcaggaaatagaaacattctgcctacatttgcattcaagcttatccctttaattcagagtgatttaacgttggc

SEQ ID NO: 186619 - DNA, 601 bp, Human
gactcactgatcgtgcatgtttgacccagtgttttcctcctgcacctgtcctgttgtataccctcagatttacaaggagcagctcaacaccagggttgtcctggtggctgtagagacctggactgagaaggatcagattgacatcaccaccaaccctgtgcagatgctccatgagttctcaaaataccggcagcgcattaagcagcatgctgatgctgtgcacctcatctcgtacgtactcatttcagcctttagtgtagtctttggtctgacatttatccttatcccttttttggttcakttaagttaaatatcagaaaatagtgacttgaacaagatttctgtgggttcctttgtctgttagataagaagcatggagttaggatatcccatgctgggatgctgatggttctgtagtcacaatatctacctttagagcccataacttccatcctcaagatcaactcacaatctaggatgcctgctggccctccagccttcattactggcagcgggcatgacatgtggggagaagggcaaaagggtactccttccagccgagctgactgctgtaaagcaggtttcctgaaagcttgcacat

SEQ ID NO: 186620 - DNA, 601 bp, Human
aataccggcagcgcattaagcagcatgctgatgctgtgcacctcatctcgtacgtactcatttcagcctttagtgtagtctttggtctgacatttatccttatcccttttttggttcagttaagttaaatatcagaaaatagtgacttgaacaagatttctgtgggttcctttgtctgttagataagaagcatggagttaggatatcccatgctgggatgctgatggttctgtagtcacaatatctacctttagagcccataacttccatcctcaagatcaactcacaatctaggatgccygctggccctccagccttcattactggcagcgggcatgacatgtggggagaagggcaaaagggtactccttccagccgagctgactgctgtaaagcaggtttcctgaaagcttgcacatgtatgtttcatgaacaaatcatttgctaggtgttagtcacatgggccacacctagctacaagagaggctagcaaaatgtagtccttttagatgaactattcagttgagtttctactactaaggaaaaagggttctatactttctttttaatataataagctattctcttccccagtcatggc

SEQ ID NO: 186621 - DNA, 601 bp, Human
catcttaagatactgacaggctctacttagggaactgagaagatttgtggtaacaattaagaaataataactagctttgtgcactctctcaaatgtctcccacacactttcaactctgaaaaacagtatggtcttccaatggcagtggcacaagtattatcgcagagcctggctcaaaaccttggaatccaatgggaaccttctagcagaaagccaagtatgtacactgaccttcttactcattttcatgtgccattctgtctgtataatgcatgtccagtcaataaataaatatttttcwttccagtcattatagtttaattgtagtatatctccttcctctaaaatatttagaaaataagcaacttaaggtaatttttaatctgtttaggttgtaaaaatttccctttcaaaatccataaaatcatacccagtttctccgggaatgagtcagctctttctcacactgcagaatgtggggctgggggcagggaatactctcacactcagggttctagcagctgagcagacgtacaaggtgctagataaagcctccatcacaagcttagtgagatcacagttggattgggaaatagcttag

SEQ ID NO: 186622 - DNA, 601 bp, Human
ctcagcctcccgagtagccaggactacaggtgcccaccaccacacccggctaatttttttgtatttttagtagagatggggtttcactgtgttagccagtatggtctcgatctcctgacctcatgatctgcccacctcggcctcccatagtgctgggattacaggtgtgagccactgcgcccggcctaaaattctttatttctttgtgacttgtttgtttaggtagctatttcattggttctaaactttgagtttaaaaaatccatttggaagtctatctttgcatatacctctctctctmtatataggtatatatagatagatgtatacctctctctatatatatacgttgatatatattgctctctctatcgatatatcgatagagagagaggcatagaaaagagaaacaggaaaaaattaatgaagagaagagcccatcacaatatcaatatgtcagtttctggtatcgaagttaagttgtaattgtttttaagtgattatgtacacttctgttttagattgctctctttcactaaaccttttagcatagtgttcattcaagtctcttgctcatcctcacttcaactctaacaaattg

SEQ ID NO: 186623 - DNA, 601 bp, Human
atggggaaaccgcccccatgattcagtcaccttccaccaggtaggtccctccctcaacagtggagagtagaactcaagatgagatttgggtggggacacagagccaaaccatgcagggcctgactaatttcttgacttttgtttttttttgagtggtttgtcctcttgggacattagttccttatgaatatcagcgagccaaaaaatcacccaaggtatttatggataccataaatacacatacgtgtttataatgcattgtctctttacctggagagggccacattgtcaattggcatckcgtcaaactttgtgtatatagtgtcacaatcccttattcgtgtattcttaattcagaaaactgaaaattttcagaagtgttttttatgtttgtggaaaacacatttgacagtaaaacttgtcctaaactgaaaatatttatacctcataaggtaaatattcataagtcttgttgcagaaatattaactgattatagggtgtgtcccaggcccctcaggactattatatagaatatggtaaatgcatcgtacttctctaaacttcagcaaagctggaagtctcaaactcaccagcttcaaa

SEQ ID NO: 186624 - DNA, 601 bp, Human
ccttcctggaagtggaaggaggatcagttctttctcaggtgaatttagtggaaggcagcgcttccttgaggtgtgttcagctgctggagatggagtcagtttctccctctcatatttagggctcagagcatttgggttggagtgtgctgctccagccttcatttaaggtgtagtgattatgcccagagaaatcctgcccccctccccactgcccctggaatgggaagcaggcatgtttctcataaacagtcaactacctttacagttgctctataatatagtttatctggcaagcaagttsatggcaccagtagactagattattctagaaattatactcttctattgccctaggaatgactgagagatttctgtatatccatacatgtgtcttatgcttgcagacacttgagatttcttttcagtgagaatgatggtcttggatttctagcaacattttttcccctaagtttacttgcatttacttgattgtacatatcacatttggctatgactgaagcatatttatctttttgacagtttttatggcttctcagctgtcttgagacaagttagcaaattagatatctgtgagtcttat

SEQ ID NO: 186625 - DNA, 601 bp, Human
tagtggagctaattggaggagaattgcctgctaaaaattaagctttctcggccgggcgcggtggctgacgcctgtaatcccagcactttgggaggccgaggcgggcagatcacgaggtcaggagatagagaccatcctggctaacacggtgaaaccccgtctttactaaaaatacaaaaaattagccgggcgcggtggcgggcgcctgtagtcccagctactcgggaggctgaggcaggagaatggcatgaacccgggaggcggaggttgcagtgagccaagatagtgccactgcagtccrgcctgtgtgaaagagcaagactccgtctcaaaaaaacaaaaaggaaaaaaaaaataaagctttctatttgctattgaagtcctttcatagaagatcttactttggtgacaagtatggcaggaaggaatctatccttgtttaaagtaattaattctttcccagaatatttgcttactgttgtataaatgttctcatttggaatatgcatgccacgtgtggagagaatatgaatgaccagcaggtaaggctcttcgcttactcacgtgaagtgttttctctaggaatgctatggattatgct

SEQ ID NO: 186626 - DNA, 601 bp, Human
aaattgttgaatagaggggagacaatttctgtggtctttttaataatatgacctacttataacatttttcttcaaaacttaccctaatttattttagacctgaacataaaagctagtgctcatattttcccattgggcttttaaaatcccctgtaaaggcaagaaagtgagataggaaagtaacatatgaatgcacactcatatgtgtatatacatggtttgtgtgtgtgtgtggacagacacagtcttccatctacagagaccaccagttatttttgaaaactcattttaatcttccctkttctcatatatataacctctaatatttcttataaccatagaattacataattttatgattttgtttcaatattagggggtattatgcattatggtatttagaagtttctagcttatttctccttgcttcatgtccccaaccagattataaattgcttgagggcaatgggctctttccttcaccttttacccacaccctcctcaaataaaatgctttgtatacaaaaggcattccctggcattactaaaggtaattcgtatgaatttattaaaatttgattgtctgtgtttagcaaaagaa

SEQ ID NO: 186627 - DNA, 601 bp, Human
atgagatatcttggggatgggactcaagtctgaccatgaaagtcatggatgtttcatatacactttatacacatcgcctgaaggtaattttatgtaatattttaagtaattttgtgcattaaacaaagtttctgtacattgaaccattgaaccctcagaaagcaaagatatcactatctcagccacccatgtggacaatcagtggttgtttggcatcaccatcattcctgactctgaatctgtatgctaccaataggcaattactttcttgtacttattcacacctaattacttaacagtaaaaaaaaaaaaattggacatgcattaagacattgaaaaaataatatgttcaccaagcagcacagtaacatcacccagataactgtatcagctgttgaaaaatagcaacaatgaaaatggcaggctttcagtcaccacttatgatgccgtgttttaaacctttgaaaaggttactgtaggatgtattttactttttttttttttaagaaacatcagaagcagtagagggaccaggaagtgggtcctctacggataagggggcattctgctggatggctttttaaaatgtttcctccagagt

SEQ ID NO: 186628 - DNA, 601 bp, Human
aacctgtacatattttaaagctttcagtatagattgcacatgtgaatatgctttgttttatgttttattttgcttggttttctggttatttctagctctttaccatacctttattttaggaaagtttggtgtggttttcttttttttttttttggcaggaggggcctaaatctttttttcttcctaatttctccttcataattagttatctttatatgatttatacccaactaattgagttttcttttctggtccttatatcttaaacagtacactcacattgatgaagcactaatgtgcygttttcaaacattttaaagccacgaaactatttattagacaaaatttggatggatgcccaatgtagaaaataaggaataagcagcactactctggttaaagtgggattgggagcagaagtccacctttcttaattctccattgccgtgtctgtcccacagatgtagccctggcttcatggcctatgtggtttggcatgatcttcttcccattaagcttattgccacataattaatattgccctctaaaattccttctttacataatgtttatgtttttaatttacctattttatgtgttt

SEQ ID NO: 186629 - DNA, 601 bp, Human
tatgtggtttggcatgatcttcttcccattaagcttattgccacataattaatattgccctctaaaattccttctttacataatgtttatgtttttaatttacctattttatgtgtttaatttatacatattatgtctttatttgtcattcaaatgagtatttgttgagggcctactgtgttaagcactgctgtaaatgctgggacatggccttgctcttgtggaacctacattctgctgggtatagaaaggcaagtaaataaaaaatcagatggtggtaagtacaaagcataaaataagrcaaagtggaaagagtatagggtaggatgtgatagatagggtgatcaaatatttctttctggaggacatggcatggaagcagagacacaaataagaaggagcttgtcagtaaatagtgagtacagaagcttaacttctccatgaaatggaatgaaagcaaggatagctggagaatagtagaaacaaaaaggaagtcaagaatcagggcaggtagggacatgtaggccatggaaagaattttagatttcattctaccttcattttaattctgacattattttaaaagcatttccccatactg

SEQ ID NO: 186630 - DNA, 601 bp, Human
tagcttaatgtgagggctaaaagttatctttaagatcccagttcaggctatagcaacaggttactgacaaaattgggtccagaaggacaatgtatggcacggggagcaatggaaaatgcatggtttatgtgggtaggcttgcttataaaagaatggcagaactgtggcggaatgcctagttcttcttcccaagcttatcattggtcagtcactccacctcccaatgatggaagtgagtaaggagtaggggagctggggttacactgagttccttaaccagaagaaaaaatgaggagagagraagaagggttcctaagtaacatttttgtaaaggtgttgatatatattatttgaaattcaattcagatggaccctcttaaagaaatggtacagtgaaatatgttcaggccgtgttttcatgatttttatgcatatctgtttcttacatttcaatatataaataggtttttttgcaattttctgtaatataatgacaaagtatgagaattgtaggttctgtgtttaatgacgtgtattgacaatactgatacactgtttcagagttatatttttagctttgtagaatactactgtttttatg

SEQ ID NO: 186631 - DNA, 601 bp, Human
gagaatgatgatttccagtttcatccatgtccctacaaaggacatgaactcatcatttttcatggctgcatagtattccatggtgtatatgtgccacattttcttaatccagtctatcattgttggacatttgggttggttcccaagtctttgctattgtgaatagtgccacaataaacatacgtgtgcatgtgtctttatagcagcatgatttatagtcctttgggtatatacccagtaatgggatggcttggtcaaatggtatttctagttctagatccctgaggaatcaccacactgrcttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcacaaggtttttttctaactgaaacatcacaaaagtaaaatctgataaattaattttagatcctgatgtgctttttctaatagcaatattgctt

SEQ ID NO: 186632 - DNA, 601 bp, Human
tctaatagcaatattgcttttgcattactgttgactgtggttgtgttagttttatttattttttaacattacaaatctatttatttatttttccataagtgtttggggtacaggtggtatttggttacatgagtaggttctttagtggtgatttgtgagattttggtgcatccatcacccgagcagtatacactgcaccatatttgtagtcttttatccctcacccccctccccaattccccccaagtccccaaagtccattgtatcattatcatgtctttgcgtcactacttagctaccwcatatcagtgagaacatatgatgcttggttttccattcctgagtgacatcacttagaataatagtctccactctcatccaggtcactgcaaatgctgtaaatccattcctttttatgactatgtagcattccatcatatatatatatgtatgtatgtacatacacacacactacagtttctttatccactcattgattgatgggcatttgggttggttgatggtcatttggggtggttccatgattttgcagttgtgaattgtgctactataaacatctgtgcgcaagtatcttttttga

SEQ ID NO: 186633 - DNA, 601 bp, Human
gttttccatagtggcggtactagtttacattcccaccagcagtgtagaagtgttccctgttcactgcatccacgccagtgtctactgtttttttatttttttattatggccattcttgcaggagtaaggtggtattgcattgtgattttgatttgcatttccctgatcattagtgatgttgagcatcttttcatatgtttgttggccatttgtatatcttcttttgagaattgtctatccttagcccactttttgatgggattgttttttttcttactgatttgtttgagttcattgtagrttctggatattatttctttgttagatgcatagattatgaagattttctcccattctttgggttgtctctttactctgctgacttttccttttgccatgcaaaagttctttagtttaattaggtcccaactatttatctttgtttttattgcatttccttttgggttcttggtcatgaaatctttgcctataagccaatgtctagaagggtttttcaatgttttcttctagaatttttatagtttcaggtcttaggtttaagtccttaatccatcttgagttgatttttctttaaggtgag

SEQ ID NO: 186634 - DNA, 601 bp, Human
ttgaagtcccccactattattgtgttgctgtctatgtcctttctcttccttccttccttcctttctttttttttgagatggagtttcgctcttgttgcccaggctggagtgcagtggtgcgatctcggctcactgcaacctctgcctcccaggttcaagtgattctcctgcctcagcctcccaagtagctgggattacaggcaggtgccaccatgcctggctaatttttgtatttttagtagagacagagtttcactatgttggtcaggctggtctcgaattcttgaccccaggtgatccrcccgccttggcctcccaaagtgctgggattacaggcgtgagccaccacgcccggccaacatttcttaggtcattagtaattgtttggtaagtgtggtagctccagtgttaggtgcatatatgtttaggattgtgatattttcctgttggacaaggccttttaccattatatactgtccctctttgtctcttagccactgttgctttaaagtttgttttgtctgatataagaatagctactcctgcttgcttttggtgtccatttgcttggaatgccttttccacccctttactttaagtt

SEQ ID NO: 186635 - DNA, 601 bp, Human
cctttctcttccttccttccttcctttctttttttttgagatggagtttcgctcttgttgcccaggctggagtgcagtggtgcgatctcggctcactgcaacctctgcctcccaggttcaagtgattctcctgcctcagcctcccaagtagctgggattacaggcaggtgccaccatgcctggctaatttttgtatttttagtagagacagagtttcactatgttggtcaggctggtctcgaattcttgaccccaggtgatccacccgccttggcctcccaaagtgctgggattacaggcrtgagccaccacgcccggccaacatttcttaggtcattagtaattgtttggtaagtgtggtagctccagtgttaggtgcatatatgtttaggattgtgatattttcctgttggacaaggccttttaccattatatactgtccctctttgtctcttagccactgttgctttaaagtttgttttgtctgatataagaatagctactcctgcttgcttttggtgtccatttgcttggaatgccttttccacccctttactttaagtttatgtgagtgtttatgtgtcaggtgagtctcctgaag

SEQ ID NO: 186636 - DNA, 601 bp, Human
atttggcttggctctctagcttgactcagttccaggtaaagtcggaaacttttcctgcaaacagaccttcagcttctccagcgggggtgtgtgttcccacttccacaattggggcactcacagtatttgggtgtctcctgggtcctgcaggagcagtctgcttccttcagagggtctgtaggtcctcttgggattgctagtttgttcttgcagtccatctggagctaaaattcacagtgcaggcctccgcatgctgccctgtccggagctgcaatctagtcctgcctcctgtccgccatgrtcccgatcactggttgcataaggttaagagtgagtgaatgattaatgatagttgattaatgagataatgattgcattttgagtggctctggatggattaaagaaaccacagggatttctgctcttgtgtagttgtgtatttctgctttttactgctgatcccttgaatactcaccagattgaaaagctgtggcgaatgaaacatttatgagagtcagttattctttagaaaggtgtagaaccaaagcatttgccttggaatgtttgttaggaaattactgcttcttaggaatgctaaatt

SEQ ID NO: 186637 - DNA, 601 bp, Human
ctgactctgtgtgcctcacatgtgtgctcctgtccccagggccgctgctacaatggcgagtgcaagaccagagacaaccagtgtcagtacatctggggaacaagtaggtcgcacctccttgcttggcggttacacataccattttctcttaatagtgttcttctctgccagtcttgctgagagagatgcacagcttggagtgatgttttaaaaaaatctagaaaggatgagaataaagagaactgtgaatcttagtcacaaaaactatagaaaacaactgcttaagttgggtacttgtcaraactgagcagtgccatttaatggctgtggctctcagagaaggggtgttgcattcatttgcaaagattgggttgagtacagtgtgattatccagccacttgtgtgatttattttgtaccttggttttaacatttgaccccctttttttccattaacacacacacaagttagctttctggtttttaccgcaggaaaataccagacttattttttaaattttgtcatttactgtctcacttcaaagtgaagagatgcatgtacttcctgagatgcagataggtacatggctgtgattcttagt

SEQ ID NO: 186638 - DNA, 601 bp, Human
gagagagatgcacagcttggagtgatgttttaaaaaaatctagaaaggatgagaataaagagaactgtgaatcttagtcacaaaaactatagaaaacaactgcttaagttgggtacttgtcagaactgagcagtgccatttaatggctgtggctctcagagaaggggtgttgcattcatttgcaaagattgggttgagtacagtgtgattatccagccacttgtgtgatttattttgtaccttggttttaacatttgaccccctttttttccattaacacacacacaagttagctttctgktttttaccgcaggaaaataccagacttattttttaaattttgtcatttactgtctcacttcaaagtgaagagatgcatgtacttcctgagatgcagataggtacatggctgtgattcttagtacattccgtaaaagttcacgtgcatatcctcttcctgacatttacagtgcctctccaataatatcagttcatgagggccagacggggggaagaatgagaaatgcgtctgcctttctagccaaggctgggttcaccccaaaggaaaagaaagcacacagaatgagaacagggctctggc

SEQ ID NO: 186639 - DNA, 601 bp, Human
atcgcttgagtccaggagttcaagaccagtctggacaacatagtgagtcctcatctctattttttttttaagttgtgaaatgtataaacataaaaataaataacaaataaatatacattttaccaaataattatgaagtgaactcccatgtcactcctacatgggtcaagaaataaaacattgcagcatcccagaaatagtgcagataccttcatcctgacttttgtggcagtcactttcttgcttttctttagagttttactgcctgttttcatccctaatgcttcatgtattattttgkattttgcttctcaagtccagcattttaagagttttctgtggtgtgtatagctgtctgttgttcatttttattatttatttgtttcacttttataaatgcacaaatgaatgaatatactatactttagttctccattctgtgttgatgaacatttagtttgttttcattttttggctgttaggaaccatgctgctatgaatattcttgtatatgtaacctagtgcacatttgtacctctttctgtaaggcctgtacataagtagaaaatttgctaagtcataggggatcttatcattgtta

SEQ ID NO: 186640 - DNA, 601 bp, Human
atcacctaccaatgatatatgatcaaatgtttttgtttagaaagaaagataatattttaaaaatttgaatcaatgtggaccgaatcgttttgattttttgagcttgattcctcctgtctggtctgtttgttttctttacacatgttcagtgatgtgttctgtggattcttactctgtaccaatcttactcgagctccacgtattggtcaacttcagggtgagatcattccaacttccttctaccatcaaggccgggtgattgactgcaggtaacatattaaatattagaagacctaataarccatgagaattacaaatttcacaaaatgaaatttcaaaaaaatcagaaatcaaagatttttctagtttttacaagaggaaagttaatttagattttattatcacctttcatattgacagtcacttaaaaagaaacaaagttgtatattgacttgcagcttacatttgctcaaaattatactagttagtagtaatatggccttctttgtcatcataattttaggagtagaattatggtgttcattctaacccattattaaagttttaagcattagagtatgccactattttgaacactgtg

SEQ ID NO: 186641 - DNA, 601 bp, Human
tttagattttattatcacctttcatattgacagtcacttaaaaagaaacaaagttgtatattgacttgcagcttacatttgctcaaaattatactagttagtagtaatatggccttctttgtcatcataattttaggagtagaattatggtgttcattctaacccattattaaagttttaagcattagagtatgccactattttgaacactgtgtgtgtatttattttgtgactgaaaagaaaaagaatttaagctatagtttatgaagtgtatgtctggtttggaagatggcttaacaartacctaatcatatatagaaaatatttattaaaatagtatgtataccgataagcaaacatttgatatccagttgtctgtgagtacaaggcatgtagatatgaggcttatttttgtttagtcggggagtcatattatattccaaataggtattgttcccttcaaagtagttataattcgaagatactattctcttactcaatggtattgttgttgctcaaaacacttttgggcttccccctgcagaattgccttcagcgtctgcaaacttttacttttagtatccttagagtaccatatctt

SEQ ID NO: 186642 - DNA, 601 bp, Human
ataatatgctatacagaagtgtagcccaggagcaatagactagaccatctagcagtgtaggtgtatagtaggctataccatccaagtttgtgtaagctcattctatgacatttgcacaaagacaaaattgactaatgacacaattcttagaatattatccccatcattaagctaggcatgtctgtaaatatcaatagaaaataactgatttgtttatgtttttcaattatggataatcagatcttctgaagtaagaataataattttcaaaatatttttcatttgctgtttttgttcatcrtctgcttttttctaccatgctacatctgaaagccttggagagctaatgatatatttgcttcttttgttctcatatagatacttctctcctttagtcttaatgttgggtcttgaaaacacgtgaagatttagaatatactttgtgcaaatgacatttttcttgttgatgtgtactgtaataatgataatgaaagagtgtttctttttcatgctcttttattaaggaaaggtagggaaaggggaagaagaagaggagtaagaaaatgctaggagaaatccacatccactgacagcctcttcg

SEQ ID NO: 186643 - DNA, 601 bp, Human
tttagtcttaatgttgggtcttgaaaacacgtgaagatttagaatatactttgtgcaaatgacatttttcttgttgatgtgtactgtaataatgataatgaaagagtgtttctttttcatgctcttttattaaggaaaggtagggaaaggggaagaagaagaggagtaagaaaatgctaggagaaatccacatccactgacagcctcttcggttttgtgaagagcaagcctcattcatggaatgatgttctaagtgtggtgcaaatagttatatgggtatctttcttgttttagtggtgcycatgtagttttagatgatgatacggatgtgggctatgtagaagatggaacgccatgtggcccgtctatgatgtgtttagatcggaagtgcctacaaattcaagccctaaatatgagcagctgtccactcgattccaagggtaaagtctgttcgggccatggggtaagtaggtatcaatgtgacagctggaaccttcatggtctggcatggtcacagtgactggactttaatttcagccattctcctagccaacatggtgaaacaccatctctactaaaaatgcaaaaaatagctgggcgt

SEQ ID NO: 186644 - DNA, 601 bp, Human
ttgttgggcagggaaagtgccaccaagtgagtttggtgttggacgtggtaacggtgaggtcatacaaggcactggtgatttatgtctcctggccttttatctccagcagtgcttttgagcccactgtctattaatttattgaagtaagtgtatatgtttttaaagtgggttcctagaaacagttacttctgaacaaagtagaaaaaagtatcttatcagacatttgtatacttatgtaatatcatgattcaatttaatttaagaataacatgaataattcaatttaagaataataataaataataagataaataattgaagaatttcttccttttactctttttctttaattaatgggaaaaaatgttacacaatttgatctatgcattattaccttgtgtctagtgatcaagaccatgggaaactttaaaaagaaattccaaatagcttttaaagcttcctccctgcccccgtgtctcttttacatttatcactattattctacaaaatacagtgaaaatgccatatctgttcctttttcttcacaggtgtgtagtaatgaagccacctgcatttgtgatttcacctgggcagggacaga

SEQ ID NO: 186645 - DNA, 601 bp, Human
cacccccccaaggatgaaggacccaagggtttgtgtgattttggtttcaattcatggaatactgaattcgttgacactgttccaatgcaccagtataacattctaattgacttaagaggagacacataagaatatctgtttttgcctttaaagtatataatttatgttactgccaaattaaggattctgatatatcatatttttaaaatgtgtttgaattacttcttagtctagaactgagattgggaagaagtaaatatacacattttctttaatacagtattctttttctctttaaacmttattctctttctgtagtcacaaattattttgcagttcgtctaagctatgccatttttctaatagatcaaatctttttggctgacatgaggctctggttacttttcaatgttggaatctctccggaaggaagttgtcaccttacaagctctttttgaacattcttttgactaggaaggagttggaattcttcatagaactttcattcttcaaagaaaatgtgagagatctggacctttgttttaatcagtcattaagaggagagaaattagaattttgggattagaaagagactcagggg

SEQ ID NO: 186646 - DNA, 601 bp, Human
gctatgccatttttctaatagatcaaatctttttggctgacatgaggctctggttacttttcaatgttggaatctctccggaaggaagttgtcaccttacaagctctttttgaacattcttttgactaggaaggagttggaattcttcatagaactttcattcttcaaagaaaatgtgagagatctggacctttgttttaatcagtcattaagaggagagaaattagaattttgggattagaaagagactcaggggccacctaggaccactctctattttcgcagatgagaaggcccagamcctgaggtcaggtcacttactatagtcacccaggtagtgagagacaaggccaggatcaggacctaagtcctaagtgcctgatctcagactcttgttctcttcccatccattatatcatcttttttttttttttttttttttttgagacaggatcttgctctgtcacccaggtaagagtgtagtggcacaatcatggctcactgaagcctcaaactgcaaggcccaagaatcctgccaccatgcctggctaattttttattttttgtagagacaaggtgtcactatgttgtccaggctggt

SEQ ID NO: 186647 - DNA, 601 bp, Human
gtggcacaatcatggctcactgaagcctcaaactgcaaggcccaagaatcctgccaccatgcctggctaattttttattttttgtagagacaaggtgtcactatgttgtccaggctggtcttgaactcctggcctcaagtgatcctcccgccttggcctctcaaagttctgggattataggtgtgaaccactgcacccgcccctcttacatcatctttttttttttttttttttgagacagagtctgactctgtcgaccaggctggagtgcagcggtgtgatcttggctcatcgtaacctstgctgcctgggttcaagagattctcctgcctcagcctcctgagtagctgggattacaggcacctgccactgcgcctggctaatttttgtatttttagtggagatggggtttcatcatcttggccaggctggtcttgaactcatgacctcataatccacccaccttggctgggattacaggtgtgagctaccgcgcctggcctcttacatcatcttataatgtagtctgtgttatcaggagtatggtaatcatttttcattattctcccgattctcaacccctcatacaattttcaaagat

SEQ ID NO: 186648 - DNA, 601 bp, Human
attaaaactcagaggtgctcaagataagccttattgggcctggctcagtggttcgcgcctgtaatcccaagactttgggaggccgagggcaggtggatcatctgaggtcaggagttcgagaccagcctggccaacatggtgaaaccccatccctactaaaaatacaaaaattagccagacacgatggcacatgcctataatcccagctacttgggaggctgaggcacgagaattgcttgaacccaggagacagaggttgcagtgagccaagatcgtgccactgtactccagcctgggtgayagagtgagacactgagccccctactcatcccccaaaaaagaggccaggcacggtggcttacacctgttatcccagcactttgggaggcccaggcaggcggatcacctggggtcaggagtttgagaccagcctggccaacatggtgaaaccccatctctactaaaaatacaaaaattagccgggcatggtggtgcgtgcctgtagtaccagatactggggaggctgaggtaggagaatcgcttgaacccaggaggtggaggttacagtgagccgagatcgtgccattgtactccagcctgg

SEQ ID NO: 186649 - DNA, 601 bp, Human
ttgaaagacaagaaataagatctcaaagcacaaaccatgtgagcaaggattttttaaaaaagatttttgtcacattatttattttttctacgttgttcatttcacatgcaaaaaccctttcttaagtttatttttaattttttatattttttaagcctagtccttctctcaacttgtttccactgaaatcattatagaaaattattttgctttgttctacaaggacagaatgtattttaactctgtttaaaagacctagaattctctcctgttacagggagacccacatcaagtaccccarttattgtctgtatgtagacacattctcaaggtgcttactatagaatacagtggaacttttctcatttgatagtttacatcaccattgtaagaaggaagagaaactgggacataggtaatgttttcagtgatatgtatgggcagatattcctgggaagctttggtcagaccttttcatcacaaccacactcatcaaatcagaaatgaaaagggccttagaaagaattcagtctagaccccttgttttacaaatgaagaaactaagttagttttcagggttaacaaagagtgagaggcagag

SEQ ID NO: 186650 - DNA, 601 bp, Human
catttcacatgcaaaaaccctttcttaagtttatttttaattttttatattttttaagcctagtccttctctcaacttgtttccactgaaatcattatagaaaattattttgctttgttctacaaggacagaatgtattttaactctgtttaaaagacctagaattctctcctgttacagggagacccacatcaagtaccccaattattgtctgtatgtagacacattctcaaggtgcttactatagaatacagtggaacttttctcatttgatagtttacatcaccattgtaagaaggargagaaactgggacataggtaatgttttcagtgatatgtatgggcagatattcctgggaagctttggtcagaccttttcatcacaaccacactcatcaaatcagaaatgaaaagggccttagaaagaattcagtctagaccccttgttttacaaatgaagaaactaagttagttttcagggttaacaaagagtgagaggcagagccaataatataacataatcaccttatcttgagccaaatgcttttttctgttattccatactcctgttttgaagttgaatagtgaggctaggcacagt

SEQ ID NO: 186651 - DNA, 601 bp, Human
aggctaggcacagtggctcacgcctgtgatcccaacactttaggaagctgaggtgggcaaattgcctgagcccaggagttccagaccagcctgagcaacatggaaaaaccccgtctatataaaaaaataaaaaaattagccagttgtggtggcatgtgcccatagtcccagctacttgggaggctgaagtgggaggatcacctaatcccatgaggcagaggttgcagtgagccaagatcacaccactgcactccagcctgagcaagagagtaagacccttctcaaaaaaaaaaaaaaaaaactgaatattaagttattctgctagttctcatagcacaatagtaaacagaaagtgaaacaataaccaggtagtaatcaagcttattaactgatccattattgtcagtgatgctttttatggaattagataagaaaggaagtattatattattatcatttagtatttttaaaataatagttttgaagtcttattttctgaggtattaaccttgaggagtatttagtgtttacatttaccttttgcaatatatccttttggtgactgtcttcgtcagtgcacaaatctttgattttatagttt

SEQ ID NO: 186652 - DNA, 601 bp, Human
agcaagtaaacaaaaatgaaaacattctgctaggtaataaacagattccacaaacacattatactgaaaagtaagtgtatcaaagagttagggagcaaagttaagttcctaataaaaggattgtgttgtcagctagaagctttaagcgttccatctccaggtttggtaggatgagaaggaaaataagatatatcatcgtgtgtccagcatagttccttgaacaaaaaaaaaggtatttagtaggtaatgaatgaattaatgaataaattacagaatagataaattagtgtagaagtagaatttttttcaatgagatgataaattctttgtagctatgaaaagcagctgcaacctttgttttcaaatatgtcccctataaaaatccacccacccgtgagctactcagttaatttatgtcaaggtgatgcacaagttcctacttgccaaaacaaagttcagcactctctaaaggaagagaacaaaagcaaagcagaatcgacaaaaagaaaatcttcacatctttaagagacaaccatgttcagtacaatgacaaagaatcaaatggcactttacatgtatttgcaggatactgtgtcactca

SEQ ID NO: 186653 - DNA, 601 bp, Human
acagttctggagattactagtctggagataattcgtaagtataattatttgctatttgaactgaaagcctttgggtttgagttcaatgtaaatgtttaaaaagaaattcctttagaatcagaagttgaaaatagtttgtacaaaagattgttctaaatgctgctattgggaatccctcctgataccaggtttttatttctagaagaaaagttggtaaggtaacctgaacaatttgagggcatgtcaactttttgattaaaggaaaatacagtaactactcagggaaaatactatattttcytaatgtcacatttctttaggtgtactagtgagtagtttagatgtagaagtatcatactatacgtgacctgcccaagtataaatgagaaatacagctatgctctaagccctgaccttgtctgccattctttaaagttctttccttaaactattatttcctctgaaataggtggtaaaaagcatgaaaatgtgtgcatgtatgtgaatgtgtgcacatttgtgtgtgtgaagtgataataaagatgtatcaagattattataatctgaaaataatactgatttaaattacatacttcctttt

SEQ ID NO: 186654 - DNA, 601 bp, Human
acttgccgattttcaactaagctaaattctgcatttgcttaactaacctgaacctgtgtccactctcctttgagtgtactgtcttactgtgcactctgtttttcaactttctagatataaaaaatgcttgttctatagtggagtaagagctcacacacccaaggcagcaagataactgaaaaaagcgaggcttttttgccaccttggtaaaggccagttcactgctatagaactgctataagcctgaagggaagtagctatgagactttccatttttcttagttctcccaataggctcctycatggaagaggccttcctgtaataattttcacctaatgaattagcagtgtgattatttctgaaataagagacaaattgggccgcagagtcttcctgtgatttaaaataaacaacccaaagttttgtttggtcttcaccaaaggacatactctagggggtatgttgtgaagacattcaaaaacattagctgttctgtctttcaatttcaagttattttggagactgcctccatgtgagttaattactttgctctggaactagcattattgtcattatcatcaccattctgtcatcatcatc

SEQ ID NO: 186655 - DNA, 601 bp, Human
tctgtttttcaactttctagatataaaaaatgcttgttctatagtggagtaagagctcacacacccaaggcagcaagataactgaaaaaagcgaggcttttttgccaccttggtaaaggccagttcactgctatagaactgctataagcctgaagggaagtagctatgagactttccatttttcttagttctcccaataggctccttcatggaagaggccttcctgtaataattttcacctaatgaattagcagtgtgattatttctgaaataagagacaaattgggccgcagagtcttcytgtgatttaaaataaacaacccaaagttttgtttggtcttcaccaaaggacatactctagggggtatgttgtgaagacattcaaaaacattagctgttctgtctttcaatttcaagttattttggagactgcctccatgtgagttaattactttgctctggaactagcattattgtcattatcatcaccattctgtcatcatcatctgattaatattgtggattttccccctctgcttgcatcttcttttgactcactctggaagaaatgtcaagaagagaaggttcgatcctactcagc

SEQ ID NO: 186656 - DNA, 601 bp, Human
gaagggaagtagctatgagactttccatttttcttagttctcccaataggctccttcatggaagaggccttcctgtaataattttcacctaatgaattagcagtgtgattatttctgaaataagagacaaattgggccgcagagtcttcctgtgatttaaaataaacaacccaaagttttgtttggtcttcaccaaaggacatactctagggggtatgttgtgaagacattcaaaaacattagctgttctgtctttcaatttcaagttattttggagactgcctccatgtgagttaattaytttgctctggaactagcattattgtcattatcatcaccattctgtcatcatcatctgattaatattgtggattttccccctctgcttgcatcttcttttgactcactctggaagaaatgtcaagaagagaaggttcgatcctactcagcaaggccccatctgaatcagctgcgctggatggacaccgccttgcactgttggattctgggtatgacatactcgcagcagtgttactggaactattaagtttgtaaacaaaacctttgggtggtaatgactacggagctaaagttggggtga

SEQ ID NO: 186657 - DNA, 601 bp, Human
ccttgcatccttcttgcaatcctgctatagatggagggcatcagtctgttctcagccctgtgttggcatgagggatagaagataagacacccagatcctgccctctgggagtttatactctatatgggaagaagaaacaaattgttttagaaagatcattctgaattccaggctgaagtttttgggagccagttgagtggtctagatagtaagagttaaaggagtctctaaatggaaaaaagctctattgttgtttcatcttttggcattattgtacctgtggctcagcagatcccagagwataaggtcattatgtgtgaaaagatttaaaagtttgttcatttaaagctcaacatataccagtagtttggtgaagctaccaagttatgccaaatcttcaatagtgatgtagttatatcacgatgggggagatatccccattctctctttcctgccagcctacctttgagttttgagttcaattttggatcccacattgtcagatccaatgtgaggaacaatgagggcctatacagagaggagtgacatgagtgatgaagagtttggaaagtatgaaacaaagagcattcaacacaattat

SEQ ID NO: 186658 - DNA, 601 bp, Human
aggctggaggatcacttgaacctaggaggtcgaggctgtggtgcactatgatcatgccattgcactccagcctgggcaacagagcaagaccctgtctctaaaacaaaacaaaacacaaaacaaaacacaaaattcactgattggtcaacagaggggatttgtctgtaaggatgaaccagataatgtttaaggaatttaaaggaagagaaaaaatagacttcctgtataaaaagtaaaatttggatagaatggaaagggttgggcttactgagtagtggagaatcagtgtgagcaaagctgyagaggtagtaagaaatatagtgggttggtttggttagacagggactgtggtagaaaaccacagaacaaaaagttggaaaggaaagtggggcccaggctgagatatgtatacttgttgaaccaggcaactgtaggttcttgagcaaagacaacgaccatgatgtaagtatctgaaatttggttacatccagaagtgtcactgacctgtaaaggatcaaaattttatttgtctaacctgagaatacagccatgttcctgggggtgaatgaggcctagtggcatcctgatcactgtcccaggg

SEQ ID NO: 186659 - DNA, 601 bp, Human
ggtcgaggctgtggtgcactatgatcatgccattgcactccagcctgggcaacagagcaagaccctgtctctaaaacaaaacaaaacacaaaacaaaacacaaaattcactgattggtcaacagaggggatttgtctgtaaggatgaaccagataatgtttaaggaatttaaaggaagagaaaaaatagacttcctgtataaaaagtaaaatttggatagaatggaaagggttgggcttactgagtagtggagaatcagtgtgagcaaagctgtagaggtagtaagaaatatagtgggttkgtttggttagacagggactgtggtagaaaaccacagaacaaaaagttggaaaggaaagtggggcccaggctgagatatgtatacttgttgaaccaggcaactgtaggttcttgagcaaagacaacgaccatgatgtaagtatctgaaatttggttacatccagaagtgtcactgacctgtaaaggatcaaaattttatttgtctaacctgagaatacagccatgttcctgggggtgaatgaggcctagtggcatcctgatcactgtcccagggcctggccagaaaactggggaatggatg

SEQ ID NO: 186660 - DNA, 601 bp, Human
gtatacttgttgaaccaggcaactgtaggttcttgagcaaagacaacgaccatgatgtaagtatctgaaatttggttacatccagaagtgtcactgacctgtaaaggatcaaaattttatttgtctaacctgagaatacagccatgttcctgggggtgaatgaggcctagtggcatcctgatcactgtcccagggcctggccagaaaactggggaatggatgaagaaggtgatgtaacccaagatctataaattcttggatatctttgttatatgctcctcatccttttttttttttttttgttacatcctgctgagttgctttgtcaatgaggggaggaataaaatgttctttttagaggaatgttaccacaacaaaaagctcatcagcacaaactgttccgaaataacacaaaaactgttaccctgctcttctctgcgccagtggtgagctgttctttttcagtatagtttttgccttgccttggtttccactgctctccctgcaatctcaggcctcacatggttagagaggcctgctggtctaggtttgcatgatcaatcacaagctaccttcctgagagagaaagtaccaaaatgtg

SEQ ID NO: 186661 - DNA, 601 bp, Human
atggaatgtgaactgtttctgcccttatccagagtaaaatgggtcacaactttgtctaaaggaacacttctgcagccgtagtcaaaggtgtgcacagtgagattgaatattccatagatatacaagatgtaacatgtgggccaggtgtggtggctgacacctataatcccagcactttgggaggccaaggcaggaggactgcttgaggccaggagttcaagaccagcctagtcaacatagtgagaccttgtctctataaaaaaataaacaagtatgaaaaaaaaaaaaaaagggccgggcwcggtggctcacgcctgtaatcccagcactttggaaggccgaggcgggtggatcacgaggtcaggagattgagaccatcctggctaacacggtgaaaccccgtctctactaaaaatacaaaaaattctccgggcgtggtggcgggcgcctgtagtcctagctactctggaggctgaggcaggagaatggcgtgagcctgggaggcggagcttgcagtgagccgagatcgcaacattgcactccagcctgggtgacagagcaagactctgtctcaaaaacaaaaaaaacaaaaaaacaaaac

SEQ ID NO: 186662 - DNA, 601 bp, Human
cttgggttctgatgaaggacctgagatttttataagtcatcttaaaagccttgctgattactcaagagccttagtagaagtctgaaggggtgctctattgaggcctcatgtattcagcctcctactggtaacttttctgcataactggactgtaaccccagttacagatcttttaaaatttttgccatttctgaagtaagtctttattcctacagattattgtgactagagtgttaacttttcgttgtatgaatcaaagcatgtcttcagggcctcttgcactattaccccagtacctagrttcctatatacattcttatgattgcctcttatagttatcttcttatagttttatctcttctttgattcattttcatttcttttttttatagacacatttattcagcatcacgatcaaactattacatttagcaatcaacagcatgagtaaaaaaaattatctacactaaaactctttgttggcatgctttacattttccacagaaaagaaactaaaataacctgttatacaattagtcacaaatacagtcctacttttttttttgcctatacacattaatattgtctaaaacatgtcttc

SEQ ID NO: 186663 - DNA, 601 bp, Human
atggtgcccttcttgcagagctggcagggagttctaccaggctggcagtatgagaattcatgacctgtgttctgttcaaacttctggtggggtttgctccatgggcaaaagatttgttgcagtgggatggtactgttaggttgtccttaacagtatgagttgggcagacaagggcctacctaagaccattgtccccttgactggaccagactttttgagagcagtgctattttcttttctggagcctacatggcaaatcagggcatttattcagtcattaaacaaattcttatttaatacrtattaaagccaggcactattcgaaggctagggattccacagtgtacaaaacagataagatccctgcttttagggagcttgcgttctagtgatctgtatgtcacaggtgattaagtgataagaaaactttgaaattaggcagaactgtgatcagattatagtagtctagtgactttgcctttggttttctcagggtaaagtggtagttaatgattcctaccattgcagcgttgttgtcaggattaagtgagaaaagtgctgtttaaagttcccaacacaaagaattctcaaaactcgacaa

SEQ ID NO: 186664 - DNA, 601 bp, Human
ctggcatcaggttcccgatgccaccatttggcttcagcgctcccaccatttggctttagctcatgctactagttcatgttatgctgtatttccttaatctatgctatagccaccccaaacagaatcagagctaagggagctaaactctgaggggagcagtcagcaggttcacttgcaatatctaaagtgccaggaggaacttggactttataggtagtagtatatagggagagagtaggaagcccagtgctgtggttaatatgggccaaattagatgaagattaagtagctgggttatttkcagatgttattaccataattaataataattatattcccttttgtgctctgggcctcactttcttatattcagatagctgtagacaacccttaagtgttctgcctctagtttctcccggaaagcccatgttgtacatgctgccagtgatcttcctaacctacatttgggttctgtgtctcctgcatgatttccttttcctgtttcctttaacttcctgtacctaccactccatctctttaaatccgattttagcctttcttttctttgtttttcattgaaatatatttttaaaagagtcag

SEQ ID NO: 186665 - DNA, 601 bp, Human
cttcagcgctcccaccatttggctttagctcatgctactagttcatgttatgctgtatttccttaatctatgctatagccaccccaaacagaatcagagctaagggagctaaactctgaggggagcagtcagcaggttcacttgcaatatctaaagtgccaggaggaacttggactttataggtagtagtatatagggagagagtaggaagcccagtgctgtggttaatatgggccaaattagatgaagattaagtagctgggttatttgcagatgttattaccataattaataataattrtattcccttttgtgctctgggcctcactttcttatattcagatagctgtagacaacccttaagtgttctgcctctagtttctcccggaaagcccatgttgtacatgctgccagtgatcttcctaacctacatttgggttctgtgtctcctgcatgatttccttttcctgtttcctttaacttcctgtacctaccactccatctctttaaatccgattttagcctttcttttctttgtttttcattgaaatatatttttaaaagagtcagggtcttgctctgtcctctaggctggagtgca

SEQ ID NO: 186666 - DNA, 601 bp, Human
ccatctctttaaatccgattttagcctttcttttctttgtttttcattgaaatatatttttaaaagagtcagggtcttgctctgtcctctaggctggagtgcagtggcacaattatggctcactgtagccttgagctcctggactcaaatgatccttctacctcagcctcccaagtaggtaggactacaggtgtgcaccaccacactaggctaactatttttgtagagacagggtcttgctatgttgccaagtctggtattgaactcctggtctcaagcaacccctcacctcagcctcccragttgccggggattacaggtgagagccactgcaccttggctacctttgttaattctctggacatacctcctaccgcttcggtctggctccaatcttctttgtcttataaacattttatgtttatttccagtcccctttctttgctcaggtagttctccttacctggaattaacctcttgtgcccctccctgcacccctagccctgtctgtatcaatcttagttgtcctctagaatgtgccagcttcattttatatgaaccttccctgactttcccattcctactgatcttcctcatctca

SEQ ID NO: 186667 - DNA, 601 bp, Human
tttaaatccgattttagcctttcttttctttgtttttcattgaaatatatttttaaaagagtcagggtcttgctctgtcctctaggctggagtgcagtggcacaattatggctcactgtagccttgagctcctggactcaaatgatccttctacctcagcctcccaagtaggtaggactacaggtgtgcaccaccacactaggctaactatttttgtagagacagggtcttgctatgttgccaagtctggtattgaactcctggtctcaagcaacccctcacctcagcctcccaagttgcyggggattacaggtgagagccactgcaccttggctacctttgttaattctctggacatacctcctaccgcttcggtctggctccaatcttctttgtcttataaacattttatgtttatttccagtcccctttctttgctcaggtagttctccttacctggaattaacctcttgtgcccctccctgcacccctagccctgtctgtatcaatcttagttgtcctctagaatgtgccagcttcattttatatgaaccttccctgactttcccattcctactgatcttcctcatctcaatactaa

SEQ ID NO: 186668 - DNA, 601 bp, Human
ctctgtcctctaggctggagtgcagtggcacaattatggctcactgtagccttgagctcctggactcaaatgatccttctacctcagcctcccaagtaggtaggactacaggtgtgcaccaccacactaggctaactatttttgtagagacagggtcttgctatgttgccaagtctggtattgaactcctggtctcaagcaacccctcacctcagcctcccaagttgccggggattacaggtgagagccactgcaccttggctacctttgttaattctctggacatacctcctaccgcttyggtctggctccaatcttctttgtcttataaacattttatgtttatttccagtcccctttctttgctcaggtagttctccttacctggaattaacctcttgtgcccctccctgcacccctagccctgtctgtatcaatcttagttgtcctctagaatgtgccagcttcattttatatgaaccttccctgactttcccattcctactgatcttcctcatctcaatactaactcccatagtacatagtctctatcgctcgatttagcacttaattagaaattgccttgctttgtgccctaatg

SEQ ID NO: 186669 - DNA, 601 bp, Human
ttgtcttataaacattttatgtttatttccagtcccctttctttgctcaggtagttctccttacctggaattaacctcttgtgcccctccctgcacccctagccctgtctgtatcaatcttagttgtcctctagaatgtgccagcttcattttatatgaaccttccctgactttcccattcctactgatcttcctcatctcaatactaactcccatagtacatagtctctatcgctcgatttagcacttaattagaaattgccttgctttgtgccctaatgattttgattgtattgttttktctataactttgtgttcctgcactaatactggcattattaaagcacaactcatcagattacttctaccatgtgccaagccaagctgattacatataaagttttgtttaatccttaaccactctgtgaactaggtgttattaactccattttagagatgataaaactataaatgagtggcttacttttgcttgtttaattaatctaaactctgctctgtcattcaatgctcccaccatttggctttagctcatgctgctagttcatgttatactgtatttccttactctatgctatagcca

SEQ ID NO: 186670 - DNA, 601 bp, Human
cccaccatttggctttagctcatgctgctagttcatgttatactgtatttccttactctatgctatagccaccccagacatgctcttcatatcttatcactgtgcccctgttccagataaatccttatcctggcatttctctgcttcccactttgcctgtaaaaatcaagccaggtttggtggttcatgcctataatctcagctacttggttgagacaggaggatcgcttgaggccaggagttctagaccaggctgggcaacataacaagaccccatctctttaaaaaaaaaaaaaaaaaacccacacatttcagtgcaatgcctggaacaaaacaacaacaacaacaacaacaaaaaaaaacaaatagaaacaaaaggaaaaagaaatttcatttgtccaccaaggcctagatcagggtttcggaacctcagcattattgatattttgggccagatagttctttgttgtggggagctgtcttgtacattgtaggatgtttagtagcattcctagcctctacatactggatgccagtagcaaacctttccccttcccccttccagtttgacaaccaaaaatattgccagttactattgtca

SEQ ID NO: 186671 - DNA, 601 bp, Human
ctctatgctatagccaccccagacatgctcttcatatcttatcactgtgcccctgttccagataaatccttatcctggcatttctctgcttcccactttgcctgtaaaaatcaagccaggtttggtggttcatgcctataatctcagctacttggttgagacaggaggatcgcttgaggccaggagttctagaccaggctgggcaacataacaagaccccatctctttaaaaaaaaaaaaaaaaaacccacacatttcagtgcaatgcctggaacaaaacaacaacaacaacaacaacaamaaaaaacaaatagaaacaaaaggaaaaagaaatttcatttgtccaccaaggcctagatcagggtttcggaacctcagcattattgatattttgggccagatagttctttgttgtggggagctgtcttgtacattgtaggatgtttagtagcattcctagcctctacatactggatgccagtagcaaacctttccccttcccccttccagtttgacaaccaaaaatattgccagttactattgtcagttgtcaattttcaaactgccccttgttgagaactactggcctagattaaatgtt

SEQ ID NO: 186672 - DNA, 601 bp, Human
tatgctatagccaccccagacatgctcttcatatcttatcactgtgcccctgttccagataaatccttatcctggcatttctctgcttcccactttgcctgtaaaaatcaagccaggtttggtggttcatgcctataatctcagctacttggttgagacaggaggatcgcttgaggccaggagttctagaccaggctgggcaacataacaagaccccatctctttaaaaaaaaaaaaaaaaaacccacacatttcagtgcaatgcctggaacaaaacaacaacaacaacaacaacaaaaamaaacaaatagaaacaaaaggaaaaagaaatttcatttgtccaccaaggcctagatcagggtttcggaacctcagcattattgatattttgggccagatagttctttgttgtggggagctgtcttgtacattgtaggatgtttagtagcattcctagcctctacatactggatgccagtagcaaacctttccccttcccccttccagtttgacaaccaaaaatattgccagttactattgtcagttgtcaattttcaaactgccccttgttgagaactactggcctagattaaatgttgct

SEQ ID NO: 186673 - DNA, 601 bp, Human
gaatgcccaaaggctatgtagtagagcaaaagtatgtacttataaagcaagaaagatagtttcaggtatacttttgccaattattagttgtttgactttggaaagtttctctctctctctgtctctttcttttctttttgtttcttttttcttttcttttctttcttttttgttttgaaatagagtcttgctctgtcacccagcctggagtgcagtggcatgctcatagcttactgcagcctcaaactcctgggctcaagcaatcttccaactacagcctcctgagtagctgggactacatggtgcacgccactatgcccagttaatttttgtattttttgtagagacggggtttcgccatgttacccaggctggtctcaaaactcctgggctcaagcaatctctgcccacctcagcctcccaaaatcctcggatcgtaaacatgagccaacgcacccagcctggaaaattttcttaaactctgtgaactttcatttccttaccgtcaaattagtcagtaattcctaccttgaaagattatggcaaagatgaaatgaaatcatgtatatcaagtacccagcctatggtctagtttatagta

SEQ ID NO: 186674 - DNA, 601 bp, Human
aatgcccaaaggctatgtagtagagcaaaagtatgtacttataaagcaagaaagatagtttcaggtatacttttgccaattattagttgtttgactttggaaagtttctctctctctctgtctctttcttttctttttgtttcttttttcttttcttttctttcttttttgttttgaaatagagtcttgctctgtcacccagcctggagtgcagtggcatgctcatagcttactgcagcctcaaactcctgggctcaagcaatcttccaactacagcctcctgagtagctgggactacatrgtgcacgccactatgcccagttaatttttgtattttttgtagagacggggtttcgccatgttacccaggctggtctcaaaactcctgggctcaagcaatctctgcccacctcagcctcccaaaatcctcggatcgtaaacatgagccaacgcacccagcctggaaaattttcttaaactctgtgaactttcatttccttaccgtcaaattagtcagtaattcctaccttgaaagattatggcaaagatgaaatgaaatcatgtatatcaagtacccagcctatggtctagtttatagtag

SEQ ID NO: 186675 - DNA, 601 bp, Human
tgcccaaaggctatgtagtagagcaaaagtatgtacttataaagcaagaaagatagtttcaggtatacttttgccaattattagttgtttgactttggaaagtttctctctctctctgtctctttcttttctttttgtttcttttttcttttcttttctttcttttttgttttgaaatagagtcttgctctgtcacccagcctggagtgcagtggcatgctcatagcttactgcagcctcaaactcctgggctcaagcaatcttccaactacagcctcctgagtagctgggactacatggagcacgccactatgcccagttaatttttgtattttttgtagagacggggtttcgccatgttacccaggctggtctcaaaactcctgggctcaagcaatctctgcccacctcagcctcccaaaatcctcggatcgtaaacatgagccaacgcacccagcctggaaaattttcttaaactctgtgaactttcatttccttaccgtcaaattagtcagtaattcctaccttgaaagattatggcaaagatgaaatgaaatcatgtatatcaagtacccagcctatggtctagtttatagtagca

SEQ ID NO: 186676 - DNA, 601 bp, Human
tttctttttgtttcttttttcttttcttttctttcttttttgttttgaaatagagtcttgctctgtcacccagcctggagtgcagtggcatgctcatagcttactgcagcctcaaactcctgggctcaagcaatcttccaactacagcctcctgagtagctgggactacatggtgcacgccactatgcccagttaatttttgtattttttgtagagacggggtttcgccatgttacccaggctggtctcaaaactcctgggctcaagcaatctctgcccacctcagcctcccaaaatcctsggatcgtaaacatgagccaacgcacccagcctggaaaattttcttaaactctgtgaactttcatttccttaccgtcaaattagtcagtaattcctaccttgaaagattatggcaaagatgaaatgaaatcatgtatatcaagtacccagcctatggtctagtttatagtagcagtatttctacttctttaactcgtactaccattgctatgatgtactaggcttgtgctgtgtactcttgcatatgctgtctcatataatccttacaagaaatctctgagacagacagtaatttttttct

SEQ ID NO: 186677 - DNA, 601 bp, Human
gacagggtcttgctctgtcacccaggctggagtgcagtggcgtgatctctgctcactgcagcctccatctcctagggtcaagtgattctcatgcctcagcctcctgagtagctggggctacaggcatgcaccaccacgcctggctaatgtttttgtgtttttagtagagaaggggtttctctgtgttggccaggctggtctccaactcctggtttccagtaatcggcctgccttggcctcccaaagtgttgggattacaagtgtaagccaccatgccctgcctctatctccatttcccctrcctccaactttgatagagatgcagtggtgctttgaagtctgaagtaccatggttgctggaagcagatccgtggttagctaactgacagcgaggttgcctcagttcctggggaggtatagatgacttttgagaatgtcagactgaagagtcctggagcattctcttttggagaatttctccctctttccctctttttattccttccttttccttttttgtagttagtactgcttctggggaagttaagatgtcaaagaatctgtgggacaaccctggtggcaattccctcttacccatata

SEQ ID NO: 186678 - DNA, 601 bp, Human
tcatgtttccaggaaaacccgacggtggcttgctttgacagatagggaaattctttctcactaagcaggctgttgttttccttcccccctctttgttattgagtctgctttgtcttttctggatggtaatcctgtcgatgacagggatgagatatatttgtaagacttgtttgtatagatgtctatatatgtgtatatgtctatatgtgcctttgtgtttgtgttttttttgtatgtgtgtatacatcattttgtgcttgtgtgggtatgtgtctttctgcatttagatgtgtctgtgtawgacaagaagtggagggagaagaggaacactgagccaaggaagtaggggctgaaagaaagcccataaatgaggttgaggatcaaggagcaggttagggacaaagggtttggcctgaggtataggacacaggacctggaagtaaaagcagagccagaaatgtaatcagcagcccaaagatgctgtcagtctaggcagaatctgggccccacagagtggtaggcagaatgcaggtatcacctagcagccaggaatggtcaagctagcagagagagaaaagccatgcttcagaaattaaaaact

SEQ ID NO: 186679 - DNA, 601 bp, Human
ttctattgcatggacataccagttttgtttagcattcatcaatttatagacatctggtttgtttcactttttggctataatgaaaactgctgctatagacatgtataagtttttgtgtggacgtgtgttttatgttttgtttggatgtatacttttatttctcttgggtacatacatatgaatagaattgctgggtcatatggtaactgtgtttacctgttttaggaactgccagagtattttccatataaaaatggttcaagtggctaaaccatttttacattcctgccagcagtgtatragggatctgttctctccacatgctcatcaacacttgttattgtctgactttttgattacagtcatcctagttggtataaagcaatatctcattatgattttgatttacatttctctgatgactaatggtattgaacatcttttcatgtgcttaatggttatttgtatatcttctttagagaaatattttctcagatcctttgctcatttattttattttttattatttaaaaaaatttccatcttcattttatattcacggggtacatgtgcaggtttgttacaagagtatattgcgtga

SEQ ID NO: 186680 - DNA, 601 bp, Human
ggatcacctgaggtcggggttcaagaccagcctgaccaacatggagaaaccccatctctactaaaaatacaaaaaaattagccggtcatggtggcgcatgcctgtaatcccagctacttggaaggctgaggcaggagaatcgtgtgaacctgggaggcggaggttgcggtgagccgagatcgtgccattgcactccagcctgggcaacaagagtgaaactccatctcaaaaaaaaaaaaaaaaaaaaaagaaaaaaaaaaaaattctccaaactgctttccacagtggctggactaatttrcattcccatcaactgtgtataagtgttttcttttctctgcagccttgccaacatctgttttttggttttttttttttttttttttttagtttttaataataactttgcgtcctggtatggtggctcatgcctgtaatcccagcgctttgggtggcgggtggattgcctgaagccaggagttcgagaccagccagggcaatgtggcagaacttggtctctacaaaaaaaaaaatacaaaaattagctaggcatggtgatgtgtgcctataattccagctactcagaaggctgagacatgag

SEQ ID NO: 186681 - DNA, 601 bp, Human
aaggctgaggcaggagaatcgtgtgaacctgggaggcggaggttgcggtgagccgagatcgtgccattgcactccagcctgggcaacaagagtgaaactccatctcaaaaaaaaaaaaaaaaaaaaaagaaaaaaaaaaaaattctccaaactgctttccacagtggctggactaatttgcattcccatcaactgtgtataagtgttttcttttctctgcagccttgccaacatctgttttttggttttttttttttttttttttttagtttttaataataactttgcgtcctggtatggkggctcatgcctgtaatcccagcgctttgggtggcgggtggattgcctgaagccaggagttcgagaccagccagggcaatgtggcagaacttggtctctacaaaaaaaaaaatacaaaaattagctaggcatggtgatgtgtgcctataattccagctactcagaaggctgagacatgagaatggcttgaacccagtaggcagaggttgtagtgagccgagattgggccactgcactttagcctgggtgacagagtgagactctgtctcaaaaaaaaatttaaataaaataaaaaaccttt

SEQ ID NO: 186682 - DNA, 601 bp, Human
aaaaaaaaaaaaaaaagaaaaaaaaaaaaattctccaaactgctttccacagtggctggactaatttgcattcccatcaactgtgtataagtgttttcttttctctgcagccttgccaacatctgttttttggttttttttttttttttttttttagtttttaataataactttgcgtcctggtatggtggctcatgcctgtaatcccagcgctttgggtggcgggtggattgcctgaagccaggagttcgagaccagccagggcaatgtggcagaacttggtctctacaaaaaaaaaaayacaaaaattagctaggcatggtgatgtgtgcctataattccagctactcagaaggctgagacatgagaatggcttgaacccagtaggcagaggttgtagtgagccgagattgggccactgcactttagcctgggtgacagagtgagactctgtctcaaaaaaaaatttaaataaaataaaaaacctttacttatttttaaattgggttgtctttttggtattgagttgttaaagttctttatatattttaggtacaaatcccttatgagatacgtgatttgaaaatattttctcccattc

SEQ ID NO: 186683 - DNA, 601 bp, Human
agtagaacaaaaaggaccttagaggttagtagactacaatgtcttgtcttaactatctccattcctaacctcttgacacatggactttatatagcaagcacttagaaaatatccgttttctacctcctctataggtcttccttacatatgagggatcagcatcactgtaatagtgggccctaggattgtacgttcttttagtatctttaatccttcttaaaacatattacacacacacacagacaggagagcttattttgtgccaggcactattctaaggtatttagttgaatttactcawttatgcttccctcaacatgagggttgttaggttttgtgctactatcttcattttacaaatgatgcaagttatacactgaaactaagtggtggaacgaggattcaaacccaggcagccaggtctagaatcaaactctaaagtatcatgttacattgaatccaagctagtgtaactctctggctcctggctaaatatctttcttttagataggctgacaatttggggacctttttctttcttctattcaatagacaattatgtcttgactagctattgtaagctaagctctctgctacatgt

SEQ ID NO: 186684 - DNA, 601 bp, Human
tgtcttaactatctccattcctaacctcttgacacatggactttatatagcaagcacttagaaaatatccgttttctacctcctctataggtcttccttacatatgagggatcagcatcactgtaatagtgggccctaggattgtacgttcttttagtatctttaatccttcttaaaacatattacacacacacacagacaggagagcttattttgtgccaggcactattctaaggtatttagttgaatttactcatttatgcttccctcaacatgagggttgttaggttttgtgctactrtcttcattttacaaatgatgcaagttatacactgaaactaagtggtggaacgaggattcaaacccaggcagccaggtctagaatcaaactctaaagtatcatgttacattgaatccaagctagtgtaactctctggctcctggctaaatatctttcttttagataggctgacaatttggggacctttttctttcttctattcaatagacaattatgtcttgactagctattgtaagctaagctctctgctacatgttataggacaaactcgagagacactccttcagttatttaataacc

SEQ ID NO: 186685 - DNA, 601 bp, Human
gcaagttatacactgaaactaagtggtggaacgaggattcaaacccaggcagccaggtctagaatcaaactctaaagtatcatgttacattgaatccaagctagtgtaactctctggctcctggctaaatatctttcttttagataggctgacaatttggggacctttttctttcttctattcaatagacaattatgtcttgactagctattgtaagctaagctctctgctacatgttataggacaaactcgagagacactccttcagttatttaataaccacacactctgctctgtgccrggccctcggcttggagatggatttatggagctaaattaattattcatttatgtattccagaaaatttacaagatgctggtgaagaataaatgataaataaaatatagtctctatttttgagttgcttagggagagtaagagggggataatgtataccctgagaactaagggaacaaataggatagggcaatgaactcacctgggagagatctagaaaacttcacagaaggcagtgactttttatttaatagacaaagagtgggagaaagcattttaaatggagcaccttgtgcaaaatct

SEQ ID NO: 186686 - DNA, 601 bp, Human
cataggtgggaattgaacaatgagaacacatgacacaggaaggggaacatcacactctggggactgttgtggggtggggggaggggggagcgatagctttaggagatatacctaatgctaaatgacgagttaatgggtgcagcacaccagcatggcacatgtatacatatataactaaccggcacattgtgcacatgtaccctaaaacttaaagtataataataataataaaaaagattattctagtgtctaatatggtagatagactgacagaaaagagactagacgtacaaagataagygagaaatgactgctgtatccctgccttgagcaacagcttctgatctcagtggaaacagatatttcactcatgaaacgtacatgtcctagaactctgtaaatgacatttagagctattgtacctgaaatatggtatgcttccttgctagatgttcaagaggtaaataagagttggtaaacttttcagatctggaacatgtgacttatgggtttgatatggcttggttctgtgtccccaccaaatctcgtgttgaattgtaatccccagtgctggaggtggggctgttaggagtgattggat

SEQ ID NO: 186687 - DNA, 601 bp, Human
ccatccagattgctgtacccaaaggtgtgctgctcttcttctggctttatgtcagtgaattctcttctctggtggatcaagctggctgggcctattttgtagaaattatagagagatgtctcccctcttctctgctcccactctcactacttcactactgcttgacacttgggatgggtttatgccatgtgccacctcctgggagatcatttttctgggcgcatggaactaaatatacttactgacagctggtagcttggctctttgtagaactattgagctgtatagttctagccaatgytgcattccccatggtaaggcaggactcttggggagcctccttaggtattcctgagagaagagctgcttgttctaagtctgaaatagtaaatccctttggtgggatccaaaagctgcctgtttagctttgttatcacctttcgttacttttaaactttgtcttaaatcagactttagctattagctggatgtgggacagtgttcaaagtaagatgtggtaatgcctacttcaagtatattgaacatcaaagttacagctcaatataatattcttgggtgctagtacccagcttgtggctgg

SEQ ID NO: 186688 - DNA, 601 bp, Human
ccgttgagggtatatggtttggcaggggagatagacatctaataagactgataaaggtattcataggcactatgggagcacagaagaagtcacctttgatcaagaatctttttctgttactttcctgtccttatctcactctccttccaataataatctcaattaatatctgaattgtgctttcaaactcagtactttagtgtacaacaggaattacaaactgtgcccctgaagggtcagagggcattgtaagtgagtaatgtgggctgtataaatgcatgtgcataagtctgtgagtggkgagagctgtgggaaaatggagagcccacacctcttcagaaggagcagctctggcagactgttgccatgtagtcatgtactccaagagcagttctaagagataggggattgagacctccatagctcctttagcaccaactccccaacctttaagataccccaaattgtataacatatatatattcatactcatatataatatgaattatacatattttatatatagtcataggccacataaggacattcagtcaacagtgggccacatatgcaatgtggttccataagattataatatatt

SEQ ID NO: 186689 - DNA, 601 bp, Human
cctgcagattagtgatattgagcatatttttcacatatcttttggacttttttttttcttttttctctgagacaaggtctcgctctgtcacccaggctggagtacagtggcatgatcacaactcactacaaccttgatctcccaggctcaagtgatcctctgacctcaggctctagcttcagcctatagctgggaccacaggcataaaccaccacacctggctaattttttttttttaattttttgcacaggcggagtctccctatgctgcccaggctggtctcaaaatcctgatctcaastgatcctcccactttcgcttcccaaagtgccgtgattacaggcatgaaccactgtgctcagtcttgtttgtcttcttttgagaaatgtctagttagatctttcacccattttttaatctgattttttttctattgagttgttcgagttccttatatattctagatgttaaccgcttgtcagatgtataatttgcagatgttttctcccattctgtaggttgtctcttcacttttcattgtttccattttattttgatttaatcccatttatctatttttgtattttgttgcctatggtgg

SEQ ID NO: 186690 - DNA, 601 bp, Human
ataagctcatcagcgtggaggacctgtggaaggcatggaagtcatcagaaggtaataggcagcctggtcatcaatcctagttgtgggaaggtttagagaagagagaagcagcaacttggccttagaagaacatgtatataaaatgcttagtaaagggcaaattattgaagttattctacatatagtcactaaaaaagactgaatatagtcactctgctgggcatgggggaaggttctccagagttggcgtttttcttcattaggatactttttgaattctatcctattcctacccctttcstcacccacctaaccctggcataggaatcttccaggttctgctgctttatctccagagatagggagcttgctggtctcttgaggcagcccctttcttctctagcttcccacttagtcccagctctgctgagtcctagacaattcaaagattgggtgagggtacagacagactctctcctcttctataccatcttgattgaaagcttttctataccattttggttgaaagctcctgagtcttcttttttccaggttaagtagccctacttcttgaagaaaacattttctcagcctccttctt

SEQ ID NO: 186691 - DNA, 601 bp, Human
actacaattcatgcattaccatggccttctcaggtttgataattaactaggactactcagagaattcaagaaagccctatacttatgattacaattttattataaaagttacaaatcaggaccagccaaaagaagaaatttatagggcaagatattggagggtcctgaatatggcacttttgtgtcctctccttgtggaatcaggacacatctccatttccagcacatcagagtgtttgccagccaggaaactcaactgaactttggtgttcagtgtttttcttagggtttcattacataggcaagtttgattgaattcttaggcacatgattgaacttaatatccagctccctttttctccataaaggttggattggtatcaccaggctcagagccccaatgttctagtcacgtggttgatttttatagtgaccaccccccatcctgagtcatcttatcagcctgaactcatgtgtgatccaagggacccaccaggaataataaagacattcctatcactgggaatattccaaaagttcagtgggtacctcccagtaacccaggacaaagatctgccaaattctttattatacaacattg

SEQ ID NO: 186692 - DNA, 601 bp, Human
ttgcctaatgactaacaatgttgagcatccttttatgtacatgtttccattcatatctcttttttggtagagtatctgttaaatcttttgtctgctttttattgggttgtttttctaaattgagttttgagaattctttatatattctccatttaagtcttttatcaaatatatactttgctaagattttctccagatctgtggcttgtcctatcagtcttttaacagtgtcttttgaagagcagaaagttgtaattttgacgaagtccagtttatcaatttgttttttaacagatcatgsttttggtattgtatctaataaatctttgcctaacccaggatcacacaaagatttctttctgtttctttctagaagttttgtagttttatgttttacatttaggtctataattcattttgtattaatttttatatgtggtgtgaaatatggaacttacttctttattgtgcttacacgtggtcccaattgttctagaaccgtttttagaaatgctgttcttttcttcattgcattgccacacctctcatcttttgtcaaaaatcagttgtttaagctgagtgcagtagcatacactgtagt

SEQ ID NO: 186693 - DNA, 601 bp, Human
gtggcttgtcctatcagtcttttaacagtgtcttttgaagagcagaaagttgtaattttgacgaagtccagtttatcaatttgttttttaacagatcatggttttggtattgtatctaataaatctttgcctaacccaggatcacacaaagatttctttctgtttctttctagaagttttgtagttttatgttttacatttaggtctataattcattttgtattaatttttatatgtggtgtgaaatatggaacttacttctttattgtgcttacacgtggtcccaattgttctagaaccrtttttagaaatgctgttcttttcttcattgcattgccacacctctcatcttttgtcaaaaatcagttgtttaagctgagtgcagtagcatacactgtagtcccagctattcaggtggctgaggtggggtgggtgggtgaaaactgcttgagcccaggagttggagtccagccagggcagcatagcaagaacctgtttctaaaaaacaagcaaacaaaaatgcctcaagttgtttgtataagtgtgagtttatttttggactctattatgatacgctgatctatctgtctgtctttatgcc

SEQ ID NO: 186694 - DNA, 601 bp, Human
ttttgaagagcagaaagttgtaattttgacgaagtccagtttatcaatttgttttttaacagatcatggttttggtattgtatctaataaatctttgcctaacccaggatcacacaaagatttctttctgtttctttctagaagttttgtagttttatgttttacatttaggtctataattcattttgtattaatttttatatgtggtgtgaaatatggaacttacttctttattgtgcttacacgtggtcccaattgttctagaaccgtttttagaaatgctgttcttttcttcattgcrttgccacacctctcatcttttgtcaaaaatcagttgtttaagctgagtgcagtagcatacactgtagtcccagctattcaggtggctgaggtggggtgggtgggtgaaaactgcttgagcccaggagttggagtccagccagggcagcatagcaagaacctgtttctaaaaaacaagcaaacaaaaatgcctcaagttgtttgtataagtgtgagtttatttttggactctattatgatacgctgatctatctgtctgtctttatgccagtaccatgctattttgattaccatagaatta

SEQ ID NO: 186695 - DNA, 601 bp, Human
tataagtgtgagtttatttttggactctattatgatacgctgatctatctgtctgtctttatgccagtaccatgctattttgattaccatagaattataataattctttcaatcaggtagtgttagccctccaactttgttctttttcaagttattttggctgtttcaggtccttgaataaacctgtcaatttctacaaaaaagcctggtgggattttgaataggattgcattgaatctatagatgagtttgagagaactgacatcttcaaaatactgatgttctttcaacccataaacaragtacatctctccatttatttaagagatacactttctctgggtactattttttggtctttcacatttagaactttcacatcttttgtcagatttatcactaagtagttcatagttttttatgctgttgtatatggtattttttaaaatcatggtaaaatacatataacaaaatttactatgtaaatggtattttaaaataatttctgattgttgcttatatacagaaatgtaattgatttttatatattgattttatattctagacatgaagtccttgcccatgcctatgtcctgaatgg

SEQ ID NO: 186696 - DNA, 601 bp, Human
agaaatgtaattgatttttatatattgattttatattctagacatgaagtccttgcccatgcctatgtcctgaatggtaatgcctagattttcttctagggtttttatggttttaggtctaacgtttaagtctttaatccatcttgaattgatttttgtataaggtgtaaggaagggatccagtttcggctttctacatatggctagccagttttcccagcaccatttattaaatagggaatcctttccccattgcttgtttttctcaggtttgtcaaagatcagatagttgtagatatgyggcgttatttctgagggctctgttctgttccattgatctatatctctgttttggtaccagtaccatgctattttggttactgtagccttgtagtatagtttgaagtcaggtagcgtgatgcctccggctttgttcttttggcttaggattgacttggcgatgcgggctcttttttggttccatatgaactttaaagtagtttaaactaaaaatgtatattctatgaagtgctaaactcatttagtagatttcatcacatttttttccatagacagtcatgtttatctgccaataaagaca

SEQ ID NO: 186697 - DNA, 446 bp, Human
cacactgtctcggaaaaataaataaataaaataaaataccaaaattatatatatatataatgttggctgtgggttttttgtagtgcctctctactcctagtttgctgagagcctttatcaggcatagatactggattttatcaaakgagttttctgtgtctattgagatgattgcatggtttttctgtttgtttgttaatttgataaattacagtgactgagttttgagtgtaaagctaaccctgcattcttgggataaatccccttggtcataatgtattatcctttcactgtattgttggattagatttgctaaaattttgttttaaatttttatgtctttgttcatgaaggatactggtttgtagttttcttaaaatgtctttgtttttggtatcaggataatgtttgtctcataggatgaattatgaagtattcctcaagtt

SEQ ID NO: 186698 - DNA, 601 bp, Human
gtgggttttttgtagtgcctctctactcctagtttgctgagagcctttatcaggcatagatactggattttatcaaatgagttttctgtgtctattgagatgattgcatggtttttctgtttgtttgttaatttgataaattacagtgactgagttttgagtgtaaagctaaccctgcattcttgggataaatccccttggtcataatgtattatcctttcactgtattgttggattagatttgctaaaattttgttttaaatttttatgtctttgttcatgaaggatactggtttgtagytttcttaaaatgtctttgtttttggtatcaggataatgtttgtctcataggatgaattatgaagtattcctcaagtttttttgaagagttcatgtagaattggtattattttttcttaaatatttgatagaattcagcagtgaagctaactgagcttagagttttctttgtgggaaggtttttaattatagtgtcaatttctttaataggtataaggctgttcaggttatctatttcttgagtgagcttaggtactttgtgtctttcaagaaatttgtctatttcacctgtgttgtcaaa

SEQ ID NO: 186699 - DNA, 601 bp, Human
ttctttactgattggtcttattagatctttgttaattttacagaaccagtgtttggttttattgatttttctctggtttctatttcattgatttccactttgatctgtattattttctttcatctgctactttggatatcatttgctcttttattttttagtttggtaaggtgaaaactaaggtcaccagtatgagacctttcttcttttctaatacagaatttagtgctgtaaatctcccttaactactgctttagaggcatgtcccaaattctggtgtattgtgtttttttttttttttcctcttttccaactgatttattagtagcgcagacgaataaaaatacctagagtgaagacacaattaatggcaaatgttctcctattactttttttcctgatataatcttcaataacttagtatcccttaataatatgttctaatttgagagattctttttgccctggaaatgcatacctttaaaatctgttttagaccttagatccatccattattggtttatcattatattggatgaaatgttgtgcttttttttttgacttagctcaaaatattttatatttcctttttgacatcttt

SEQ ID NO: 186700 - DNA, 601 bp, Human
actttatgtgacttgaagcctttaaaaaattttaagatttttttctttcatgtcctaggacatggtctatcttgttaaatatcccatgtgcacttgtatgtgttctgttgggtggagagttctataaatgtcaatcaggtctgtttttgttgttttgcttttttttttttttttcaacttttaagttccagggtacatgtgcaggatgtgcaggtttgttatataggtaaatgtgtgccatggtggttttctgcacagataacccgtcacctaggtgtttagccctgcagccattagctgytcttcctgatgctttcgctcctcccactcccctgacaatgtatgttgttccccctgatgtgtctgtgtgttctcatcgttgagctctcacttgcaagtgagaacatgcactgtttggttttccattcttgcgtgaatttgctgaggataacagcttccaactctattcatgtccctgcaaaggacatgatctcgttccttttcatgggtgcatagtattccatggtatatatataccacattttctttatgcagtctttcattgatgggcatttgggttgattccatgtctttgctattg

SEQ ID NO: 186701 - DNA, 601 bp, Human
acctccgcctcctgggttcaggcaattctcctgcctcagcctcctgagtagctggaattacaggtgtgtcccaccatccctggctagtttttggatttttagtagagacagggtttcaccatgttgactggtctcgaactcctgacctcaagtgatctgccttcctcaacctcacaaagtactggaattacaggcgtgagccactgcatccagcctgcatacttgttctatcaattgttagagaggagtatttaagtttccagttataactgtggatttgcctatttttccttgtagtttytggttcacgtattttgaagctctgttactaggtgcataaagatttaggatgattatttcttagtgattaactgaccccttcaacattatgaaatgaactgctttatccttcgtggtaatctttgctctgaaatctactttgataaaaatatagctgtcttttgactgttgttagtttggaatgtctttttccatccctctacatttaatctatttgtatttttatatttaaagtacatttcctgtaggtgcatatagttgggtcctatatatatatatgtatattttgcaatgtgacaat

SEQ ID NO: 186702 - DNA, 601 bp, Human
ctcttgggttcaagagattctcgtgccccagcctcctgagtagctggaataacaggtgcatgccactacgcccagctaatttttgtatttttaatagagatggggttttgccatgttggtcaggctggtctcgaactcctgacttcaggtgatccgcctacctcggcttcccaaagtactggtgttacagatctgagccactgcactgggcctactttcaagatatattataacatgtcacatgtagtataagaagcttccagtagcacatataccctaaaacttaaagtataataataawaaaaaaaagaagcttccagtagtgtattttcatttccctctctcaagcttagattttaatccttgcactgtggcttggaaattcaaggccataagctggggcaattgtataacttccctcatttgtttcctatctctcaagagtcattgtcctttgtaggctgatgtccagtgtcctgaaaaccattatttcatatatgttgtcttttttgggaggggtaattttaattcaggagggagggtaaattccatctctggtacttcagcttaccctgaaacagaagtgtcagctgaatcttct

SEQ ID NO: 186703 - DNA, 601 bp, Human
attattcttggcccagcctagctctactgctatgtatctttcacttggttccagatctgacgaggtctttgcttacatttttcagagttttcccatttttctctcatacatgaaacaaacaagttagggcatcaaatttctgggtgtaagaaatattctcaaatggaagttggagaaataaagatactgttaaaaatgttacaagtaaatacctgtatagcaataaatagtaatcatgttattttgaaagaataaatactggctttcctattggtcggataacccttcagcttgtgtaggrgtagcgataagcttagatcacaactgctgtctcatttgagactcaacagaataagatatccaaagcttagtaatttttgatgaaaaaaaattatagaaaatgttggctctgtgtggtgactcatgcctgcaattccagccctgtgagaggatcacttgagccccagaggttgaggctacagtgagctatggtcatgccactgtacttcagcctgggtgacagaatgaaaccctatctctgaaaaaaagaaagaagctgggcgtggtggctcatgtctgtaatcccatcactttgggaggc

SEQ ID NO: 186704 - DNA, 601 bp, Human
cagtggcgtgatcttggctcactgcaacctctgcctcccaggttcaagtgattctcctgcctcagcctcccaagtagctgggtttgcaggtgcccacgatgacgcccagctaattttttgtatttttagtagagatggggtttcatcatgttggccaggctggtcttgaactcctgacctcatgtgatctgcctgcctcggccttccaaagtgctgggattacaggtgtaagccaccgtgctcagccctgatggtattttatatcttgagagtttatttatattttaatgctgtagttctstgttattccttatctacctctgtggtattggccctagaaggtagtgtttttctcctataatttatgtaaacatttctgtgttaaaaatttactgagtaccttctatatactaggcattgtgctagatgagtttagcatacaaggtccatgcttatttctctgatctacttgttttccatcattccacaccacatctcctctggaagtgcactgctttattggcagttcctaggaaatgttgttctttttcatcccatggtgctttcatatatgctgtttcctctattcatctttctcatt

SEQ ID NO: 186705 - DNA, 601 bp, Human
gcccctatctcttcacagcccttagcacactaaatgcaaagatctgttccactgccggttttcccatcagactactggagtgcagcattttatatgattttatctcttaatacttagcacagggcctggcccagagtaggaatgcagcacacaaaaatgtgtccttgactgtttgattgtgtgatcttagataagttgtttggcctacccaacatttcatagcacctaggttctcttactactctgcagccatgctgccagacttctctaatctgtctctactaaccttgtggtttctctmttggtggtctttaatagcatgtcctgttgggccctgggagacctggtttttgcctggtagcctagtgagcctatcacatgaggcctaggccagattatttttgcaatgatggttcagggtttgataatgacatcagattagaaaatgaagacctttacctcactgtagtcccagatgagaagctgctagtgggaaccagaaggaagctacttaaagagacaattcacagttccaggtcacacactatctttaggaagggccactttggaaggatttgatagctgccttggagtgctgtta

SEQ ID NO: 186706 - DNA, 601 bp, Human
tgtttttttgtaatatatcctaaaataaaaaatcagtgttctaaaatgccaggggtttggcagtctttaataactttagtttttgtagctacctcagaataaaacaggaggttttattgatttttacatgaaaattgttcttaatcataaaaggtctgttcctttctataaaacatagtatggagaccagggtatatctttactacccaagatgctaactggacaccagtttctgggattctttgtggatatgtgtcattagtactttttaatttttttatacctcccccctttacctccrtaagtagtctgtgggggtaagtgatacttttttgtgagaaaacataatataaatactgatgggatggacaacaagtgatccaggacccacagattgccatcatttgttcattcgaagaagatactagaggtggtatttatgttgtacttatttttatctcattgtttaatttttatgtgtgttttacaatctatctaatgttagtaaatgaatctaatttataaacacatatacgtatattggcaatgtgtgtacaaagctttttttttacaggtagattatgtcattaaaaagattgga

SEQ ID NO: 186707 - DNA, 601 bp, Human
tagccttctctgattcggtgtagcattgtttgtcattttgcccagaggtgtagtctttgatctggctaggggccacatggacaggctcaggggatgggagacttatgacattaggacattgactcttgcttgcatgtcctcctgggatttggacatatgagtcatttggagtctgtatctgtactaagctctccttgccaaattctgcagcctgtcactgatagccacagctctctgtacttgctgttgccttcttcctcactctggcccagggattcttcctatcttctctttggaatgagaaaacagaacaagacttttaacttttaggtgcttgaaccttggggacagggagccctgatatatcagctggtctgttgaatgagatcttcatgctggaactcagggttgctatctgagatacagatgttatagaggatacagctcatcctggcttgttttgttcagactatagtgactccaggtggacaccatgctgccaaaccctacctagatagggcatctgcctaggtaacagaatgatatatgcagataaaaacaacaacaacaaacaaaccaaaacaatcttgaggtttggtct

SEQ ID NO: 186708 - DNA, 601 bp, Human
tggtggcaaaagtgaaccatgttcattatagtgctatcagatagatcgtaataggtgatcctgttatactacattagtctctctggggatgcaccaattgggacagttcttgtctgaattaaactaaaagacagtttatatcttttagtgggtaatatttgtctttttgaattgcaattatgaatgtatattttgtgtaaaaacatcagtttgacctctgggttcttttgtattaaaatatttaaatttgagatatattattgttatgaagtacattatgtcctaaaattccaggaaaatrcagttgagccttaacaacacaggggttaggggtgctgactgtcccttttcccccatgtagtcagaaatccacttgcaacttttgactccctcaaaattgaactattaatagcttgttgaccagaagacttaccaataacataaacagcctattaacacatattttatatgttatatgtattatatactgtattcttacaataaagtaagagaagaggaaatgttattaagataatcataaggaagagaaaatatatttactgtttattaagtggaagtggatcatcataaaggttttcat

SEQ ID NO: 186709 - DNA, 601 bp, Human
cattatagtgctatcagatagatcgtaataggtgatcctgttatactacattagtctctctggggatgcaccaattgggacagttcttgtctgaattaaactaaaagacagtttatatcttttagtgggtaatatttgtctttttgaattgcaattatgaatgtatattttgtgtaaaaacatcagtttgacctctgggttcttttgtattaaaatatttaaatttgagatatattattgttatgaagtacattatgtcctaaaattccaggaaaatacagttgagccttaacaacacagrggttaggggtgctgactgtcccttttcccccatgtagtcagaaatccacttgcaacttttgactccctcaaaattgaactattaatagcttgttgaccagaagacttaccaataacataaacagcctattaacacatattttatatgttatatgtattatatactgtattcttacaataaagtaagagaagaggaaatgttattaagataatcataaggaagagaaaatatatttactgtttattaagtggaagtggatcatcataaaggttttcatcctcatcttcacattgagtgggc

SEQ ID NO: 186710 - DNA, 601 bp, Human
atattattgttatgaagtacattatgtcctaaaattccaggaaaatacagttgagccttaacaacacaggggttaggggtgctgactgtcccttttcccccatgtagtcagaaatccacttgcaacttttgactccctcaaaattgaactattaatagcttgttgaccagaagacttaccaataacataaacagcctattaacacatattttatatgttatatgtattatatactgtattcttacaataaagtaagagaagaggaaatgttattaagataatcataaggaagagaaaatakatttactgtttattaagtggaagtggatcatcataaaggttttcatcctcatcttcacattgagtgggctgaggaggaggaggaagaagagagattagtcttgctgtctcaggggtggcagaggcagaaaagatagagaaggtaggaagggaggtgggagaagcaggcacactcagtataccttttattgaaaaaaaaatccatgtataaaattcatgtataaatggacccaggaagttaaaacctgcattgtttaaaggtgaacggtgtcactgtaactattttgcatcaacacactta

SEQ ID NO: 186711 - DNA, 561 bp, Human
attgtcttttttttttttttgagatggagtattgctctgtcactcaggctggagtgcagtgacgcaatctcggctcactgcaacctctgcttcccgagttcaagcgattttcctgcctcagcctcccgagtagctgggactacaggcatgcaccaccacgcctggctaatttctgtgtttttaatagagacgaggtttcaccatgttggccaggatggtcttgaactcttgaggtcagatgatccacctgccttcgcctcccaaagtgctgggattacagtcatgaaccactgcctggccrtaaattatctttttttatctgttttgcaacagtctcactccgtcactcaggctagagtgcagtggcgtgatcatggctctctgcaggctcaatctcccaggctcaagtgatcctcccacctcagcctcctgaggagctgggactctaggtgtgcaccaccacacctggctaattgtccctgtttgcagatgacatgattgtatgtttagaaaaccccatcgtctcagcccaaaatctccttaagctgataagcaacttca

SEQ ID NO: 186712 - DNA, 601 bp, Human; identical to SEQ ID NO: 26610

SEQ ID NO: 186713 - DNA, 601 bp, Human; identical to SEQ ID NO: 26611

SEQ ID NO: 186714 - DNA, 601 bp, Human; identical to SEQ ID NO: 26612

SEQ ID NO: 186715 - DNA, 601 bp, Human; identical to SEQ ID NO: 26613

SEQ ID NO: 186716 - DNA, 601 bp, Human
atataatgacagtgggttattgtagacatgtagagtgcatgaactgattaatgaacatctttgtattattgaatgaccaaggaggactaagtgggttttcactgaagcagtagacacactcaggcctaagaaagggtggtctcttcagccagggtctagttgagagaattaggttgttcagtctctacagatctatgtggtaggaacggccagcctgtaatcctttttctaattctaagttaaccaagggggagcaaaaagtagtgagatttcttggaaaactattttcaaccaaacaggmtcttagggcccacttcctgccctttgggaatggctggcctcgatttagggtgccagcagaagaatgctattgaaccaggaaacagtccagagaagcagctggcaggcaaggtcagaggccatataacatttccctgtctgtgaatatggcttggctaatgtgcaagttgatgtctcaatacaagtggatccatactttttgaaagtatgaaacagagcaacctgggagaagactaatgtttccacttcctttgccaccttttttttgggggagtggagggttctaggacacattttactc

SEQ ID NO: 186717 - DNA, 601 bp, Human
gctaggctacttttgcagaggttctcctctgtcaccaccatgcaaggggaagctttcagcagcctgaaagtcttccttagccttgtaatatatattatcaagctttatctgtatcaaaatcagatttatcatgtctgaaaggatacagtagaaactgcaggttaaagcagtcaaggattttatctgaaaaaatcagctagcatgggaaccagaatgctggggacatggtactgggtccaggatatcagaaccaacaagaggggccctggtggagcaggttggactgataccaggacagggrtattcttctcttaggcttattgcatgtagcccatgtgctgcatgtgatctaacttaaggaaggccagagatcagcaggaaaactatcttcctgagataggcagaacacaggtactgaagctaagaatatacttcacactgactgggatacttataataataatagtttttaaaaatggaaaacttgtgttggcgagggtatagagaaattgaaaccctgtatattgctggtgagaaggtaaaacggttcagctactgtgtaaaatagtctggtggtttctcagaaattagacacagagtt

SEQ ID NO: 186718 - DNA, 601 bp, Human
aagaatagataaattggacttcaccaaaataaaaaagttttatacttcaaagaatgtaccaagaaagtgaaaagacaacccacaaagtggagaaagtattggcaaacatttttctgacaaggctctactatccagaatacataaaaaattcttgctaggtacggtggctcatgccagtaatcccagcactttgggaggctgaggtgggcagatcacctgaggacaggagtttgagaacagcctggccaacatggcaaaaccctgtctctactaaaaaaatacaaaaattagccgggtgtgrtggcacatgactgtaatcctagctactcaggaggttgaggcataagaattgctgaaacctgggaggcagaggttgcagtgagccaagatcgtgccactgcactccagcctgggtgacagggtgagaccctctctcaaaacaaacaaacaaacaaaaaatggacaaaggatttgaacatattatttgtatagtccacagttcaatggccaatatacacctgaaacaatgctcaacatcattatcagggcaatgcaaatcaaaactacaatgaggtaacactttttacccactaggatataa

SEQ ID NO: 186719 - DNA, 601 bp, Human
cagtaggaattgaagaatgggaatgggattataatgggaagaagcagattattagtaaggcatagattagactcttgatttgcctattctctcctctttttctacacaatgattcatagactcacttagtggtgtggggtacagcctagggctctgcgggagggacccgacaattcttacatctactgcttcagctacttcttctttctcaaactccacatctatattcttaattatctcctggcatgtccatctgagtatctccaagacacctcaaagtgctgtcatttacacctacacrttcgatctcgttagtaaccacacattctatctctgtagtaactctaatgcattttacagctgaggaagctgaggtctagataggggaagtgaattatataacaaattggggcagaggcaaacatagaaccaggcttcccaacacatagtgtgggatgcctcccttggtagcacaagaatttctctacacggacccttgtgtttaatcttaaggcctggttatttggccttggggtattcactgccctgatggcaatgccactatcagcttccaggatattgtgtgggggaaaactcaggc

SEQ ID NO: 186720 - DNA, 601 bp, Human
atttgtatatttaagtggagtcaaaactagttgaaggaatccagtggtactgataggtggaacagtattaccttagagggagggagtgactgttagatcttatccttggccttggttattcagtattcttattcatgacttggatgagaatatgaagctgggcaaaataatagatctggttccaaattgaactggataaggtagaataagaaaccaaatgaaataactaggctcaatctgcatacccaccttaagtatttgaggtactggaagtgctcgttgcatggagtcttgtttgaayaaggatacctttgacttttggtaagaatataaaggggatattgaagttgagaaaccctaggaaaccaagattaaaagtcattaacaaacaggggagacaaagaataccccaggctctggtagtggctctggaggaggcaggtgtgttccaggaagtaaggcaactcactgtgctgcagaaatagctccccttggaacctgaaagacaggagagtgatggcttacgtatggctagacttgtagcctgcctggaggctaggggatggccgctagaggaccctcaattttctttcagagagcc

SEQ ID NO: 186721 - DNA, 601 bp, Human
tcagcctttctgtgaggagctatgatggtaactcttcttgtcaaactataggcatcagtatcatatggtttctttttctggtgtcttgaccttcccttaacttggtggctctacctgggtccttttggatttccaccagccccatgtccttactatgtccaaggatcatgccagtcctacctccttctctgctgtttaagggcaacttgctgtgcacagagggtcattagccctggcataactcccttttttccctctttctctgactcccacatccagggctcctctgagcccacagcamaacctagacagaggatgcaggagtagctgtctccttcttatagtgcccctttcaagtcttttgtgctgtggcacagagcccagatctggtataccaggaacaatgttagttccagaaatgcctctctcctgattggctaagtttttaggatgtggcttttgctttttatcttgtggtgtcatttcttgtttaacatttaaattttgctctggacaatgggcattctttgaaccccagctggtggctggggccctcgtggttcactgaattgctaccaggtgttctctgaaaatagctctg

SEQ ID NO: 186722 - DNA, 601 bp, Human
gtgcccctttcaagtcttttgtgctgtggcacagagcccagatctggtataccaggaacaatgttagttccagaaatgcctctctcctgattggctaagtttttaggatgtggcttttgctttttatcttgtggtgtcatttcttgtttaacatttaaattttgctctggacaatgggcattctttgaaccccagctggtggctggggccctcgtggttcactgaattgctaccaggtgttctctgaaaatagctctgcccctcaatttctggtaggtataatgtctcatccatatgaatktattcatgctatcctgttctagagtctctggatttcacagtagcctagaaatgttctccatagattgagacttctggacctttccctgatctgtgccaagaatggcctggtagtccaggatacctagttcctacagtgacttcagtcctacagccagaactgaggcttctggtgacattgctttatatcctttataccagtcatctccatttacctactgtggaactttagaattgcttaccctgtatgacagaagccactacatcttggcatatgggctcatccagcccagagatggct

SEQ ID NO: 186723 - DNA, 601 bp, Human
cctttcaagtcttttgtgctgtggcacagagcccagatctggtataccaggaacaatgttagttccagaaatgcctctctcctgattggctaagtttttaggatgtggcttttgctttttatcttgtggtgtcatttcttgtttaacatttaaattttgctctggacaatgggcattctttgaaccccagctggtggctggggccctcgtggttcactgaattgctaccaggtgttctctgaaaatagctctgcccctcaatttctggtaggtataatgtctcatccatatgaatgtattsatgctatcctgttctagagtctctggatttcacagtagcctagaaatgttctccatagattgagacttctggacctttccctgatctgtgccaagaatggcctggtagtccaggatacctagttcctacagtgacttcagtcctacagccagaactgaggcttctggtgacattgctttatatcctttataccagtcatctccatttacctactgtggaactttagaattgcttaccctgtatgacagaagccactacatcttggcatatgggctcatccagcccagagatggctggggc

SEQ ID NO: 186724 - DNA, 601 bp, Human
ttttaggatgtggcttttgctttttatcttgtggtgtcatttcttgtttaacatttaaattttgctctggacaatgggcattctttgaaccccagctggtggctggggccctcgtggttcactgaattgctaccaggtgttctctgaaaatagctctgcccctcaatttctggtaggtataatgtctcatccatatgaatgtattcatgctatcctgttctagagtctctggatttcacagtagcctagaaatgttctccatagattgagacttctggacctttccctgatctgtgccaaraatggcctggtagtccaggatacctagttcctacagtgacttcagtcctacagccagaactgaggcttctggtgacattgctttatatcctttataccagtcatctccatttacctactgtggaactttagaattgcttaccctgtatgacagaagccactacatcttggcatatgggctcatccagcccagagatggctggggcatattgagaaggcactagttctctcctcttcactgcatcttaagaaagtgtgatttaataagcatcctgtattgctgtaaggcctctcatttcaa

SEQ ID NO: 186725 - DNA, 601 bp, Human; identical to SEQ ID NO: 26614

SEQ ID NO: 186726 - DNA, 601 bp, Human; identical to SEQ ID NO: 26615

SEQ ID NO: 186727 - DNA, 601 bp, Human; identical to SEQ ID NO: 26616

SEQ ID NO: 186728 - DNA, 601 bp, Human; identical to SEQ ID NO: 26617

SEQ ID NO: 186729 - DNA, 601 bp, Human
gatgagatcaaccttgctaagcaggaagcccagcggctgaaggagctgcgggagggtactgagaatgagcggagccgccaaaaatatgctgaggaggagttggagcaggtaggagagtccacaaattcctggacaccttgacgggtgggtaaagggcaggggcccagggtctggctagaaagttacatgtgtgaggaatttgaaatatgatccaaagactatgttctagagtcactggactcttaccaacaataagagttcaagttgtaaaaaatagtcactatgggccaggcacagtggytcatgcctgtaattctagcactttgggaggccaaggcaggtggatcacctgaggttaggagatcaagatcagcctggccaacatggtgaaagcccatctctattaaaaatacaaaaaaattagccgggtgtggcggcgggcacctgtaatcccagctacttgggaggctgaggcaggagaattgcctgaaccccggaggtggaggttgcagtgagtggagattgtgccattgcactccagcctgggtgacaagagtgaatctctgtctcaaaaaaaacaaaaaaagaaagaaagaaaaaa

SEQ ID NO: 186730 - DNA, 601 bp, Human
cttttttttttttttatttttcaggtcaaaaagttttctaatttttattgtggttccttttttgggacatggttatctagtatattgcttgattttcaaacatgtgaggactttttaagttatttttcttttgctgatttctagtttaatttcactaagatcagagaacatatgctgtgtgggtgtagtcctttgaaacttgttgagacttggtttgtataaaaaaacaactaagcaattcagttaaaaggcaaagattgtcagattggattaatgccaaaactcaattatatgctgttcrtaagagacacattttaaatataagaacacaaaaaaaggttaaaggaaaaggatatgagaaaagatatatgttacaaaataaagcagcaaaattaagcaggagtagctatatattgatataatatttatattaatataaaataggatttaggtcatgaagtattgacctaaagcagttgctaagtgaaataaagcaagggtagctatatattaatataaatgtaatatttacattaatataaagtaaactttaggtcaagaagtattactggactccaaaaatagatatttcataattata

SEQ ID NO: 186731 - DNA, 601 bp, Human
ttacaaaataaagcagcaaaattaagcaggagtagctatatattgatataatatttatattaatataaaataggatttaggtcatgaagtattgacctaaagcagttgctaagtgaaataaagcaagggtagctatatattaatataaatgtaatatttacattaatataaagtaaactttaggtcaagaagtattactggactccaaaaatagatatttcataattataagtggatgaattcaatttaatatataacagcccttaatttggatacatctaatgatgtagtctaaaatatrtaaagcaaatattgactgaactaaaatgatactagacaaattttataatcaaagttagagattttaatatgcttctctcaataagccaccaacagcatccataaggatataaaaaatttaaaaacatggttaataaatttgaattccttgacacatatagaacactttgcctaactctagaatatacattctttttagcacttatatatctcttaaaatatacttctgctccattctctcctctccttctgagaatctaatatttatgttagatcttttaactgtattccacatgtctct

SEQ ID NO: 186732 - DNA, 601 bp, Human
caacagcatccataaggatataaaaaatttaaaaacatggttaataaatttgaattccttgacacatatagaacactttgcctaactctagaatatacattctttttagcacttatatatctcttaaaatatacttctgctccattctctcctctccttctgagaatctaatatttatgttagatcttttaactgtattccacatgtctcttatgctcagttctgttcttttttctctctgtgctttggtttggttattttctattgatctatcttttaagttctttaattctgcattctrctgtaagcattctggtgtttaacccatccagtgggttcctactctcagacaatgtatttttcaattctagaatatccactttactcttttataggttctagttccctgtccagaatttctatcttttatctattgtatccatcttttcctgtatttctcttaacatagcaatcataattattttgaagtccttgtcttataattcttacatctggatcatttatgggactgcttatttttcctcttgattattagtcatattttttgccatttatgtctaataatttatttttattacat

SEQ ID NO: 186733 - DNA, 601 bp, Human
ggttaataaatttgaattccttgacacatatagaacactttgcctaactctagaatatacattctttttagcacttatatatctcttaaaatatacttctgctccattctctcctctccttctgagaatctaatatttatgttagatcttttaactgtattccacatgtctcttatgctcagttctgttcttttttctctctgtgctttggtttggttattttctattgatctatcttttaagttctttaattctgcattctactgtaagcattctggtgtttaacccatccagtgggttyctactctcagacaatgtatttttcaattctagaatatccactttactcttttataggttctagttccctgtccagaatttctatcttttatctattgtatccatcttttcctgtatttctcttaacatagcaatcataattattttgaagtccttgtcttataattcttacatctggatcatttatgggactgcttatttttcctcttgattattagtcatattttttgccatttatgtctaataatttatttttattacatgctggacagtgtgtataaaaaaacaatagaggctccag

SEQ ID NO: 186734 - DNA, 601 bp, Human
tccttaaactgcttttaatatagaacttgatcataaattttcagacttggtatattagtctctaaggtatctagtcttcatttagagctataaaaccaggaatgggctatttttaggttttttttttcagggaacagaaaccaagtgaagattggcactctcattgcctcttaaaggaataaaggtgttctgtccctagctgaggccctcctggcctatcttagctgtggagaggacctcaggcttgctatgggatgtttacctcattggctgaagctggggataataagactgctttcartgcatcttctctgggattctgttcaggtaggagaattggagatcacttatgctggtagcttggatgagacagcaagaaactcagtgtacataatgtctgtatgtactttcaagtcttttacactttagtgctttgtgactgcctcattgtgtgctccctgcagagaagtcggttatttctacttatacattggtcctctcatgtcttggcttctgttggcaatgcctgtgttaggtgtgggcatgctcattatcttcccaccttttacagagttcttttcaaagcccacttgctctactc

SEQ ID NO: 186735 - DNA, 601 bp, Human
tgggctatttttaggttttttttttcagggaacagaaaccaagtgaagattggcactctcattgcctcttaaaggaataaaggtgttctgtccctagctgaggccctcctggcctatcttagctgtggagaggacctcaggcttgctatgggatgtttacctcattggctgaagctggggataataagactgctttcaatgcatcttctctgggattctgttcaggtaggagaattggagatcacttatgctggtagcttggatgagacagcaagaaactcagtgtacataatgtctgtaygtactttcaagtcttttacactttagtgctttgtgactgcctcattgtgtgctccctgcagagaagtcggttatttctacttatacattggtcctctcatgtcttggcttctgttggcaatgcctgtgttaggtgtgggcatgctcattatcttcccaccttttacagagttcttttcaaagcccacttgctctactccctgagagaatcatagacgcagtctctgggctagagaagactttggagagcattcaggacaatgcccttctgaagtaccaatcatttttcagttctctctga

SEQ ID NO: 186736 - DNA, 601 bp, Human
atgtctgtatgtactttcaagtcttttacactttagtgctttgtgactgcctcattgtgtgctccctgcagagaagtcggttatttctacttatacattggtcctctcatgtcttggcttctgttggcaatgcctgtgttaggtgtgggcatgctcattatcttcccaccttttacagagttcttttcaaagcccacttgctctactccctgagagaatcatagacgcagtctctgggctagagaagactttggagagcattcaggacaatgcccttctgaagtaccaatcatttttcagktctctctgacatgagctcttcacataactcccatgacagggaactcattctctcctgagatcaccccttcactgatagtttggatttgcatgggagaaagtccttcctcacactgaattaagagccggtttaggaagcacagggtcacacaaccagttaagcgacagaccagggaccagaactagattttcagattcctgaccagtgctttttctgtcacactgtgatgtcttgaagtctaagcacagaccctgactcttggtaagatgattcactagctgacctgttcctgaagagatc

SEQ ID NO: 186737 - DNA, 601 bp, Human; identical to SEQ ID NO: 26618

SEQ ID NO: 186738 - DNA, 601 bp, Human; identical to SEQ ID NO: 26619

SEQ ID NO: 186739 - DNA, 601 bp, Human; identical to SEQ ID NO: 26620

SEQ ID NO: 186740 - DNA, 601 bp, Human; identical to SEQ ID NO: 26621

SEQ ID NO: 186741 - DNA, 601 bp, Human; identical to SEQ ID NO: 26622

SEQ ID NO: 186742 - DNA, 601 bp, Human; identical to SEQ ID NO: 26623

SEQ ID NO: 186743 - DNA, 601 bp, Human; identical to SEQ ID NO: 26624

SEQ ID NO: 186744 - DNA, 601 bp, Human; identical to SEQ ID NO: 26625

SEQ ID NO: 186745 - DNA, 601 bp, Human; identical to SEQ ID NO: 26626

SEQ ID NO: 186746 - DNA, 601 bp, Human; identical to SEQ ID NO: 26627

SEQ ID NO: 186747 - DNA, 601 bp, Human; identical to SEQ ID NO: 26628

SEQ ID NO: 186748 - DNA, 601 bp, Human; identical to SEQ ID NO: 26568

SEQ ID NO: 186749 - DNA, 601 bp, Human; identical to SEQ ID NO: 26569

SEQ ID NO: 186750 - DNA, 601 bp, Human; identical to SEQ ID NO: 26570

SEQ ID NO: 186751 - DNA, 601 bp, Human; identical to SEQ ID NO: 26571

SEQ ID NO: 186752 - DNA, 601 bp, Human; identical to SEQ ID NO: 34662

SEQ ID NO: 186753 - DNA, 601 bp, Human; identical to SEQ ID NO: 34663

SEQ ID NO: 186754 - DNA, 601 bp, Human; identical to SEQ ID NO: 34664

SEQ ID NO: 186755 - DNA, 601 bp, Human; identical to SEQ ID NO: 34665

SEQ ID NO: 186756 - DNA, 601 bp, Human
tggggtctttattccaactgatgttcccaaataaccatctgtattcgtctttcctaggagtatattaaagcaccttttggtttatgttaattgtgatgcatttagtattaataaagaggtatttaaaaatgttcttgggacttttttcgttatgtttctgcttaggaaataatttgggcctggtcttctgataatcaaggtacagctaaagtaatctgtgctaataatatcagcatgggatggatgcttaatttttgtttaatgacaaagcaagcaagaaaagtaggctaaaaattctcartgcagggccagtatagttttataatgatacgtaagaaccaaactgagaagagattaaaataagtgatcaatagacattttgatcttcaaatatatagtaggtgggttgatcaagaataaatcttcaggaaatatttcttaccttcaaataatataagaaaaaaaggttcatgtaagtttgctgtcaaaattctaagatcagatcctagaaaacatttaatattaactactcttatctaccaggattcagcatgtaggattggacattttgaaacttagtttcatactgttatctgaagac

SEQ ID NO: 186757 - DNA, 601 bp, Human
tattaaagcaccttttggtttatgttaattgtgatgcatttagtattaataaagaggtatttaaaaatgttcttgggacttttttcgttatgtttctgcttaggaaataatttgggcctggtcttctgataatcaaggtacagctaaagtaatctgtgctaataatatcagcatgggatggatgcttaatttttgtttaatgacaaagcaagcaagaaaagtaggctaaaaattctcagtgcagggccagtatagttttataatgatacgtaagaaccaaactgagaagagattaaaatargtgatcaatagacattttgatcttcaaatatatagtaggtgggttgatcaagaataaatcttcaggaaatatttcttaccttcaaataatataagaaaaaaaggttcatgtaagtttgctgtcaaaattctaagatcagatcctagaaaacatttaatattaactactcttatctaccaggattcagcatgtaggattggacattttgaaacttagtttcatactgttatctgaagacagggaaaaatttaaaatgtgataactgattttcagctaaatccaataaccaaagccaagata

SEQ ID NO: 186758 - DNA, 601 bp, Human
atttcttaccttcaaataatataagaaaaaaaggttcatgtaagtttgctgtcaaaattctaagatcagatcctagaaaacatttaatattaactactcttatctaccaggattcagcatgtaggattggacattttgaaacttagtttcatactgttatctgaagacagggaaaaatttaaaatgtgataactgattttcagctaaatccaataaccaaagccaagatatcctaggcacagttaaagctaatgtaagtatttgtgagtctcctgctgcttacttaatgagaaccctttgktactctattttgtagattgatcccagagttttttgcgttgttacttcaagagattatatgaaagctaatgtttaactttttgttgtttcaaatttggaaataaaattttaaagtgatattacagttagaatgtgatatgctttagaaaatgaaaacaatgatttctttgcttaagtatctggaatatatagttcatcaaggtttgcaaatccttcttttagattgcaagctgtatgaagtggggaccctgattccagcacccagctcatgtttggcacacagcgggcttgaatatacatt

SEQ ID NO: 186759 - DNA, 601 bp, Human
cctccatcaccttttatgagcgtcaaggaggttagagatcttcaggaaactagtaaatatagagatctgatcagtatacaagtttgatggtgcttgtgtgaattaactttaaggaagtttggaaaaaggaaaatgttcaccattcttaaatggcctttcagtttcttttaggttaaactattttaagaagtaaaaaggaatacttattctgaggtacaagtgggctcattcagtgttttttttgagcacctgtatactcaaggtggaccaggcgtctgtgagttgtgcctctgcacaaccsatagaagataacacagaagatagtcgcttgccctgagggcaatagagaattgggagcttgaagaacagcataaagggatgtgaggctgcaagatcggctttgggaggactggagaaaaagacagtaaggtcagcaggtcagggagactggattattgaagaattgatgacaaaagacagtaggtcagcaggtcagggagactggattattgaagaattgatgacaaaagacagtaggtcagcaggtcagggagactggattattgaagaattgatgacaaaagacaggaaatgtacagtt

SEQ ID NO: 186760 - DNA, 601 bp, Human
caacattttcattggcaatctgacttattttcctaaagaatttatgatgaaactgctccagtcctgactaacttagtcttttacagtctcagcagaagcaaaagctctttgaaacctcctttctccccgctccctaactttcttacccctgctggggctctttctttatgcttccatatttctttggagagctgtaaagaattacagtgtggactttgatgtcaggggacttgagctcaaatcctgaggcttcttatttttagctgagtgtccctgggcaagtcaattaacttctctctayctcccaaattcatcacctatgaaatgacaataatgtgatgattaaatgaggtggtaaatataaagttcttaattcaatatgtggcaacaattattattacctcattatggtatttcccactgttggtctacagataaatctatagacaaaatacaatcccggacaacaagaagctcctatagctcctgtagcttcttgtgctctaggattgtattttgtttatatatattttttaatcctgaatgtctagtattatgcttgggacatagtggccactcagtgaatatgtttgaataaatg

SEQ ID NO: 186761 - DNA, 601 bp, Human
tttatgatgaaactgctccagtcctgactaacttagtcttttacagtctcagcagaagcaaaagctctttgaaacctcctttctccccgctccctaactttcttacccctgctggggctctttctttatgcttccatatttctttggagagctgtaaagaattacagtgtggactttgatgtcaggggacttgagctcaaatcctgaggcttcttatttttagctgagtgtccctgggcaagtcaattaacttctctctacctcccaaattcatcacctatgaaatgacaataatgtgatrattaaatgaggtggtaaatataaagttcttaattcaatatgtggcaacaattattattacctcattatggtatttcccactgttggtctacagataaatctatagacaaaatacaatcccggacaacaagaagctcctatagctcctgtagcttcttgtgctctaggattgtattttgtttatatatattttttaatcctgaatgtctagtattatgcttgggacatagtggccactcagtgaatatgtttgaataaatgaaatttctcaaataggcaaaaatgcatatcataaaacaaa

SEQ ID NO: 186762 - DNA, 601 bp, Human
tgtttccttctcattaattactggaattgccgtgagtccgttgctctgtgaacgtttctctttctttgaacattcaggatatggtgttttgtaagtgatctaacagccagctttttctaataaaacatggcctaagagaagagcctgtttgtgttactagtgtcttttatgattttcaaatgatttacccacttctttaactgtccctagatgagtaatctttgaagggtagggtggcacatgtggagtattaaagagatggctgttaagcaaagataaatgaattacttatgataatacrccgtggaacaactttccactactggtaaatattttgttttctacagaaatctctttactatcaaatcattgctaaacatcatagttctataataatcccctcatttgaagacatttcatttcaaacaaaggctcattattttaaaatggatgcaaattgtttattttctaaataagcctaaatataacttaaattcaggttgctaaaaaacctcttcctggccgggcgtggtgtctcacacctgtaatcctagcactttgggaggccaaggcgggcggatcacgaggtcgggagttcaga

SEQ ID NO: 186763 - DNA, 601 bp, Human
tcgcaccactgcactccagcctgggcgcagagtgagactctgttaaaacaaaaagacctccatgttggtcaggcttgtcttgaacttctgacctcaggggatctgcccgcctcggtctcccaaagtgctgggattacaggcatgagccactgtgcccagccccccaaaatttcttgctgtggttatgcatgtcaaggtaattagaaggaacaataattatcgcatttatttgctcaatgtaggcaactcctcatatgttcagatcccaaagtgatgctgactgattggacctatccaattyctcttcctatacaggcgaaagtatttaaaatcataaaatctttccttcactatgcagctgctagtcactgccattgtgtaatgttttctccaagaaatagcttatttctagaactctgctcaaaatttgcacaaatcataacctttagccatgagttcagggtagtgaaacttcaatataaagatcagattgtcaccttcctgacccaggtcttgaataccctttttccttttctttttttagccaagtggtaatttctaaaacaacctttcttcatagctattataaaatattactgtg

SEQ ID NO: 186764 - DNA, 601 bp, Human
aagtggtaatttctaaaacaacctttcttcatagctattataaaatattactgtgtggcattccacactgaaattaactttccaagatgaaaatataggccttttttaaatagaactaataatttcaatgtaatttagggactatttaatgaacacctactatgtccatgccattttactttacctgttggtcaccctttgaggcaatgccattgcgttccttgaaatgtgttatttcatttttttgctttggattcactctttcacacacgttgagcttatattgcatactgtataaccrgtggatacattacttgattctgcgtaatgcctgctgcatatgatgcaggggttgaaggcttctctatcttattcttaatgtagcaaacacaaagacaatatctgtaggggaaactactgaaaatgttaaagacatttgcaaaatgaaatactttttgtcctttttgtgttttagttgcagtgctggacatctgattttaaagtacaacagtcctattcaaacattttcatttgtctcagatcttgacattgttcagcacagattttttttctttaagtttactagaggaaaccagtctta

SEQ ID NO: 186765 - DNA, 601 bp, Human
aggggttgaaggcttctctatcttattcttaatgtagcaaacacaaagacaatatctgtaggggaaactactgaaaatgttaaagacatttgcaaaatgaaatactttttgtcctttttgtgttttagttgcagtgctggacatctgattttaaagtacaacagtcctattcaaacattttcatttgtctcagatcttgacattgttcagcacagattttttttctttaagtttactagaggaaaccagtcttattcattgtgggaactcagtaaatgttaagccagattttcaacataaycagcatcaggggaattaatttaatgcacttttggaaactgcattaactccacaaaatcaacaagacctttatagagctcacacaaagagaaatcagctgctacatgtattttctcaagagtcaaattcagttttgagaaaatgctaaagccataaaaatatagagatagataaatctcatgtgaatactattacatagatatataatgaatgatactatgtagctaaatagactgaaatacgatctagacatataggttttatttagggttcgatgatggcaagataattgtgaatgcag

SEQ ID NO: 186766 - DNA, 601 bp, Human
ttaatgttccaccctaggctggtcgtgtttcttgttctggtgttttctatattgagccctggttctgtgttgccttcagtctactcagtgagatgcaggtcctcattctgttcttgcatttaacattaatttctccatacaatgggtcagactcagtacttaaaatacggagacttcctcctctggaagaatttttgccgccatttcttgattccaaatgtatgagctgcagaaaactttagaggtgttgaacatgtgcaaaatacctgataaaaatgcttctatgtgttaatgcataggwagaattctataaactttcctcaaattagcctccttcaaattagaataacttttgggttgaatgttattaaatacttagaattgtctccccattgtccataatgggttagtttcagtattccactggtcagtgtagcattgggattagtagcatttttatattttcatatgtatgagtaacacacatttttactctacttgtcaaacccatttcaatttctaatttcctctccactagttaactatggagtgaacatgagaaacttcattagaagagtatattcattttactcatgtgtct

SEQ ID NO: 186767 - DNA, 601 bp, Human
actcagtgagatgcaggtcctcattctgttcttgcatttaacattaatttctccatacaatgggtcagactcagtacttaaaatacggagacttcctcctctggaagaatttttgccgccatttcttgattccaaatgtatgagctgcagaaaactttagaggtgttgaacatgtgcaaaatacctgataaaaatgcttctatgtgttaatgcataggaagaattctataaactttcctcaaattagcctccttcaaattagaataacttttgggttgaatgttattaaatacttagaatkgtctccccattgtccataatgggttagtttcagtattccactggtcagtgtagcattgggattagtagcatttttatattttcatatgtatgagtaacacacatttttactctacttgtcaaacccatttcaatttctaatttcctctccactagttaactatggagtgaacatgagaaacttcattagaagagtatattcattttactcatgtgtctaaattgttaggttgtatgttgaggacaactctaggtttctctccagcagtgggaaacatgaactatgtgatatttttaatat

SEQ ID NO: 186768 - DNA, 601 bp, Human
caccaggcatttggaaattccaggtagaaatgctttcaaaccaggccacatttggaaatcaaactctgagtagtagagggctgtaaacgaaatactgcatctttcatttctgtataggttattatatttgtagcgcgaatgtacttatttaacaataataactaagtgcctcctatatgagtgacattctgcagattgaagaggtatttcaaaagggaacaagaaacaacagtattttaccaagtactttgtatgaaggtattgactctaattcttcagggagttataagagagtggtctrcagtggagggctttcagaaggaggtggagctttgagcaggacttaaaagatgcataaggtatggaaagtcaaagagaggactttattctaagctagtaaaaaatcattcacatttcttgtgtctttttcttcattgttctgaatgtgtgacatataagcattcaagatacattgtgccagataattatgttccattaacatgtgaaattttcatctacagaaaatttttgtttagagaatgcagttttgggggtgctgtgctttggggctgatttccctcatcaagacggtaaaactatt

SEQ ID NO: 186769 - DNA, 601 bp, Human
gcttatcgtagtataagctccatcccaaattgttttattgtcttggtgagggaaatcagcctcaaaggacaacaccccaaaactgcattctctaaaatgaacattttctctagatgaaaattttacatgttaatggaacataattatctggcacatatatagtctgttataatatatcacatatataaataatatatatataaatcaaacataatacagttatatagtatataattataagtagaattatattaagcatatactagattatattgtaattagcaacaattgattactaatrcttttcctccctaggtagctattattgagcactctctagtaagccatggaatataaagatgttatgtaattttgattttgttaggctaatttccagcagttaagtatagttcaattagtgttctgttttgactatgtaattcaaaaactatgttttgtaaaaactcacaaaaataagaacaagaacaaaaaaagcaatgtcatttgagttattgaaggagaattcagcccatagattttctccatgctttggcagctgttttagagcattcatccagctgcatttgtctaacacttgaat

SEQ ID NO: 186770 - DNA, 601 bp, Human
taagttgagcttcagagagacattaaacaacctgcccaaggttttgaagcccaggaggcttggaactcattttctgatacacagttggacactcttcttaaagtatttcccataacaatgtacacagttggagaaatgaacataactatttcttactggtcatggagggtcatgagctgtttatgtgaactgaagtctgtgagggcattactggaatgtaacttatcagttatgttttcaaatccttagagcagaacttcttgacctgtgtgctgtaaatggctatgggtgtgccggaggyggatagacagggcctagggtggcaaaaaaccaggaaagcattgaaataaatcactccagcacactgtaagtacctacagaaaatgttatttttcttggcagtagaatccactctctaagaagaaacaagcttttgttggaagactgctctgataaactttttggagggctgggccttcaggaaggctgaggacctaaagtggataaaaaggagagggtatgtagagagtcagagggtatgtagagagtcagagagagagaagagaaagacttaagggctggtggctcaagagaaactttg

SEQ ID NO: 186771 - DNA, 601 bp, Human
aactcattttctgatacacagttggacactcttcttaaagtatttcccataacaatgtacacagttggagaaatgaacataactatttcttactggtcatggagggtcatgagctgtttatgtgaactgaagtctgtgagggcattactggaatgtaacttatcagttatgttttcaaatccttagagcagaacttcttgacctgtgtgctgtaaatggctatgggtgtgccggaggcggatagacagggcctagggtggcaaaaaaccaggaaagcattgaaataaatcactccagcacrctgtaagtacctacagaaaatgttatttttcttggcagtagaatccactctctaagaagaaacaagcttttgttggaagactgctctgataaactttttggagggctgggccttcaggaaggctgaggacctaaagtggataaaaaggagagggtatgtagagagtcagagggtatgtagagagtcagagagagagaagagaaagacttaagggctggtggctcaagagaaactttggggaaacagaaataatggatggggacatcagcagatctacagtgctccataatgatttgtgga

SEQ ID NO: 186772 - DNA, 601 bp, Human
gtcagagggtatgtagagagtcagagagagagaagagaaagacttaagggctggtggctcaagagaaactttggggaaacagaaataatggatggggacatcagcagatctacagtgctccataatgatttgtggagtaaattactttgggagatgggatgaagtgctttaattttgctttgagttagggactggtaaaatccaagattgcccaaggaaggactgttccatataagttacaatacagttatgaaaacttattagcaaagatcagatacctactataccacagtgcttctgygaatagattcaagtaattttttgaatttaagcccggcatctcccacatgactgaccatttaggaatcctggtcctaagagaacatgaccattgggagtgggcctctgggaagggtgttgtggtgtgcaagggcaaccctcagttgtgtgcaccacgcagaatgaatcatgtgttgtgtcgctggaagttaagggtgaataatataaataactaaaaatgggtgaggtttcctgttaaaaaaacatactcgtgttgatctgttcatgtgtctacattacatttcaatgtgattcagtaggg

SEQ ID NO: 186773 - DNA, 601 bp, Human
gactggtaaaatccaagattgcccaaggaaggactgttccatataagttacaatacagttatgaaaacttattagcaaagatcagatacctactataccacagtgcttctgtgaatagattcaagtaattttttgaatttaagcccggcatctcccacatgactgaccatttaggaatcctggtcctaagagaacatgaccattgggagtgggcctctgggaagggtgttgtggtgtgcaagggcaaccctcagttgtgtgcaccacgcagaatgaatcatgtgttgtgtcgctggaagtyaagggtgaataatataaataactaaaaatgggtgaggtttcctgttaaaaaaacatactcgtgttgatctgttcatgtgtctacattacatttcaatgtgattcagtagggaggatttcttgggcccagtagttcgagaccagcttgggcaaaatagcaagattctgcccctattaaaattttttttttatgtgaaaaatgttacttgtgctgaaggggatcacatatttgttgagaatgttttccaaaccaacaatcatcacacaatttctcaaaggactttatttccaggtttgtgaa

SEQ ID NO: 186774 - DNA, 601 bp, Human
tgaggcaggagaattgcttgaacctgggaggtggaggttgcagtgagatgagattgtgccactgcactccagcctgggcaacagagccagattctgtctcaaaaaaaaaaaaagataagggagattattaaaaacaataagatagacggaaatataatatttaaggttagagaagaaggctgagtgtggtggctcactcctgtaatcccagcactttgggaggctgaggcaggacaatcacttgagctggggagtttgagaccactcagactcacttgagaccagcctgagcaacatggcraaaccctgtcgccacaaaaaaaaaaaaaaattacaaaatgttagccaggtgtggtggtatgctcctgtagtcccagctactcaggaggctgaggcgggaggatggcttgagcccaggaggttgaggctgcagtgagccatgatcacagcactgaactccagcctgggtgatagaatgagaccttgtctcaacaaataataaaaattaaaataaaaataagaaagtgaagccaactgaaaacaaaaagtattaaaacacagagaaagttagaaaataaagtttaaagatgaaatagaaagg

SEQ ID NO: 186775 - DNA, 601 bp, Human
ggctcatgcttgaaatttcagcactttgggaggccaacgtgggaggattgcttgaggccagaagtttgagaccagtctgggtgacatagcaagaccgtgtctctaccagaaaaaaaaaaaagaaagaaaaattagccaggcattgtggtacatgcctatagtcctggctactccagaggctgaggtgggaggattgcttgagcccaggagttggaggctgcagtgggctatgattgcatcactgtacacagcttgagcgacagagcaagtcctcatttctaaaaaaaaaaaaaaaaaaaamaaaaccccactaaggttttaatgttatcttgtacattcatactaaataatttagaggctggtaacaaaaagaatattgttctggtctcaattaattaattattctaattaatacataaacttattttattaattgcttatttacatcagatataatattagtaaaagattgataagagcatgtaccagtgacaattttctgagacattaagatttttctttatgtttaggactattagcctacaactgctaatatatacacatatatacacacacatatacacatgcatacacatataca

SEQ ID NO: 186776 - DNA, 601 bp, Human
acgtaagatttatgtgcgggtaaaatgaaatagcacatgtaatgtgctgagcacagttaatggcacacaacatacacttaatgaataatagaaattattattatttcccaaactgtattctcctctcattatttcttgtcttgtggaacatctgccttcctgagtggaggagggtttatgtgtgggggaacatgaaatacttttggaaagattgagtgatgccacaatatatgaggccctggaagctggacagaggaatttagacacaatggtgggttacaggggcttctgcagtcttgtragcatagaatgattctgtggaaagtggtgttgtaataaaattagttattttaatattaagccagatgtgtttaaagtaggggtcgggaggctgggcaaaaggctgatagagtaatactggcataatttgatgaggacctggaaaggtgtggtgacaatggaatgaagaggaaaggataattagggaaaggtgataaatggacagattattttattttttatatcagttctttcttcagaaggttgtgagatatttccatcaaaaatatatatttaataaaaatgtaataaagcttcttta

SEQ ID NO: 186777 - DNA, 601 bp, Human
gaatgtaaaatgccagactcttcttctgtttttctggatttgaaacaatcgaacactgggaaatatctgatcctgaactaaaatgcaggcacaccaaatttgaactcagattgaaaaagttaacactgggaatcaactagaaattaacggtgattatgaagaatattttgattgctatttgattctttcatagctctgtaaaacttatgtaagcaagctattaaaaaacaaaagctgaaggcgactgttttatgatgtgtgtatcataaaggaaaccatcaccacctgtcattgaaaccargaaaggctcatgtcaactaaatgtgaaaagaaaacagtgtaagaaattaaaaaaaaaatcatattcttgaggccatgaaacacatgttccagaaaacagtttattagaattgcattaagtaaaaattaatgtctgcacactgatggggaagcagtgtggagtggtatggaaaatgttagagcagtctatttttgtaaaatctggaagttggaataaataatcattggggccccagctctaaaatcctactaccactattaatgtgacaatgatttaatttttgaatgaaatttaaattgt

SEQ ID NO: 186778 - DNA, 601 bp, Human
actgggaaatatctgatcctgaactaaaatgcaggcacaccaaatttgaactcagattgaaaaagttaacactgggaatcaactagaaattaacggtgattatgaagaatattttgattgctatttgattctttcatagctctgtaaaacttatgtaagcaagctattaaaaaacaaaagctgaaggcgactgttttatgatgtgtgtatcataaaggaaaccatcaccacctgtcattgaaaccaggaaaggctcatgtcaactaaatgtgaaaagaaaacagtgtaagaaattaaaaaraaaatcatattcttgaggccatgaaacacatgttccagaaaacagtttattagaattgcattaagtaaaaattaatgtctgcacactgatggggaagcagtgtggagtggtatggaaaatgttagagcagtctatttttgtaaaatctggaagttggaataaataatcattggggccccagctctaaaatcctactaccactattaatgtgacaatgatttaatttttgaatgaaatttaaattgtaacatatgccatggggaatgtgttttctggcttgctaacaacatgaaaagagga

SEQ ID NO: 186779 - DNA, 601 bp, Human
ctgataaatctagatgccactctgttggagaaccagcactgccggcagctggggttagtgcactgactgagtgaggcatgaggcctgctcactgatgaaacttcttgttagggctgttagtgtggtcagctagcagctggcttggggtgaactcttttccataggcagcctcatacttcttgagccggtccactatcttctgggcttcatacagatccacaaagcagaaaggccctccaagacaaggtgggaagctgagcccgaagacggctccaatgtctccctctgcaggtgtggccargatcccctcttgcgggcacgtgactgcctcattcacaaatcttgtcagcaggcggaactggatgtcttcatctgaggagacttcagacttaggaggcatcttcagacttgctaaaataccgttcatgtcagaattcaaattcttattcttcacactctcctgatagatggaaaagcccttcccagactggcgacctaggaagcccttggacaccatctatgtcagtagttctgggtttccacctccaaactgctccccaaaggctttgcccagatctttggccacatgtttcgctacatc

SEQ ID NO: 186780 - DNA, 601 bp, Human
ctcattcacaaatcttgtcagcaggcggaactggatgtcttcatctgaggagacttcagacttaggaggcatcttcagacttgctaaaataccgttcatgtcagaattcaaattcttattcttcacactctcctgatagatggaaaagcccttcccagactggcgacctaggaagcccttggacaccatctatgtcagtagttctgggtttccacctccaaactgctccccaaaggctttgcccagatctttggccacatgtttcgctacatccacgccaacttcatccaccagtgtggcrgcacccacaggaaggccaaggcttgtggtcagggaatccagcttctttgggtcaactccttcctggaggattcagatgacttcagacatcatgggtgcaagacacctggtggtatagaagccaggtccatccttaaccacaatgatgaccttcccctgcttgagaccgattgctacagttgaagcactggtgtctttggaagtcttcttggttgtgatcatctccagcagctgcatcttgtctgcgggagagaagtagtgcctgccaatcaccttctcaggtcttttgctgacagcagcg

SEQ ID NO: 186781 - DNA, 601 bp, Human
gcctttgattctttggtcattgcaagctctccgaatttctgagattcagagagataaccagcatcgctcccttgctcaattccagtctttaccacatcaattattttcagaggtgtgggataaagggaaagccctttagtccgctttcacactttttcttccacttttttgtaaatctgttgcctgacaaatggaatagtcatggcatacgctgttaatttttccactaatcccttgtctctctttggagagatcttcttatcagctagtcctttgggaaagtaattgcaacttcttctargtatttgattgtccattcctctggaagttttagtcctggtcgcagagattccaccaattggtcaaccagtcccattttctttgccctgtctgcacggatgtttctgccagtcagcatcatgtcaaaagcagcaggcacacccaccattttgggcagcctttgtgtgcctcctgctcctggtaagatccccagcaagacttcaggagcaccgaatactgtttttctgtcttttgttgctattttatattggcataaaatggcaggatccactgatggcagtcacaacaggctttatggact

SEQ ID NO: 186782 - DNA, 601 bp, Human
tcagaggtgtgggataaagggaaagccctttagtccgctttcacactttttcttccacttttttgtaaatctgttgcctgacaaatggaatagtcatggcatacgctgttaatttttccactaatcccttgtctctctttggagagatcttcttatcagctagtcctttgggaaagtaattgcaacttcttctaggtatttgattgtccattcctctggaagttttagtcctggtcgcagagattccaccaattggtcaaccagtcccattttctttgccctgtctgcacggatgtttctrccagtcagcatcatgtcaaaagcagcaggcacacccaccattttgggcagcctttgtgtgcctcctgctcctggtaagatccccagcaagacttcaggagcaccgaatactgtttttctgtcttttgttgctattttatattggcataaaatggcaggatccactgatggcagtcacaacaggctttatggacttttcaagtttctcaaatgttctctgtgcttcttgtggtatctgtgttacttcttgaggggtcttgcaagtggctaaaatgttgatatcagcacctacaataaagca

SEQ ID NO: 186783 - DNA, 601 bp, Human
gccctttagtccgctttcacactttttcttccacttttttgtaaatctgttgcctgacaaatggaatagtcatggcatacgctgttaatttttccactaatcccttgtctctctttggagagatcttcttatcagctagtcctttgggaaagtaattgcaacttcttctaggtatttgattgtccattcctctggaagttttagtcctggtcgcagagattccaccaattggtcaaccagtcccattttctttgccctgtctgcacggatgtttctgccagtcagcatcatgtcaaaagcmgcaggcacacccaccattttgggcagcctttgtgtgcctcctgctcctggtaagatccccagcaagacttcaggagcaccgaatactgtttttctgtcttttgttgctattttatattggcataaaatggcaggatccactgatggcagtcacaacaggctttatggacttttcaagtttctcaaatgttctctgtgcttcttgtggtatctgtgttacttcttgaggggtcttgcaagtggctaaaatgttgatatcagcacctacaataaagcagcctggctttggtgagataaggat

SEQ ID NO: 186784 - DNA, 601 bp, Human
acgctgttaatttttccactaatcccttgtctctctttggagagatcttcttatcagctagtcctttgggaaagtaattgcaacttcttctaggtatttgattgtccattcctctggaagttttagtcctggtcgcagagattccaccaattggtcaaccagtcccattttctttgccctgtctgcacggatgtttctgccagtcagcatcatgtcaaaagcagcaggcacacccaccattttgggcagcctttgtgtgcctcctgctcctggtaagatccccagcaagacttcaggagcrccgaatactgtttttctgtcttttgttgctattttatattggcataaaatggcaggatccactgatggcagtcacaacaggctttatggacttttcaagtttctcaaatgttctctgtgcttcttgtggtatctgtgttacttcttgaggggtcttgcaagtggctaaaatgttgatatcagcacctacaataaagcagcctggctttggtgagataaggatggcacttctgatttgatcactagcccagatttcattcataacttccgtgaactctgaatgcagctgtttgtttattca

SEQ ID NO: 186785 - DNA, 601 bp, Human
tgaatggggagagttaatttaaataactatcacatcccctttgactccatagttaatatgggttctggtcagcaaagcaaaggaccctgtaaaattgcggcgtatataaccttgggagcggaggatcctgaaggcagagaagtggctgaggctgccaatcgcccggtagaccaccatgttgagctgaagagaacagcagtggagagcgcttctctttaatttcattcttatcttttgtattagctttttaaatgtattataaccaaggagaatacaaatgaactgacttcacagtttttcyctcagatttcagaattgtactgttcttaagctccctcctaaaacttgtctcttttattaaatattttaatatttaatggctgaaaatctttgtggtcattattactttgttgcagctttattgagatggaattcacataccaaatagttcacacaattaaaagtaaaattcaatggtttatagtagatccacagtgttgtgcagccatcaccacaattttagaacatttatatcatcacctcaaaaagaaccccatacccattagcagttattcctcattttcccaattcctcccaatcc

SEQ ID NO: 186786 - DNA, 601 bp, Human
tgaaggcagagaagtggctgaggctgccaatcgcccggtagaccaccatgttgagctgaagagaacagcagtggagagcgcttctctttaatttcattcttatcttttgtattagctttttaaatgtattataaccaaggagaatacaaatgaactgacttcacagtttttccctcagatttcagaattgtactgttcttaagctccctcctaaaacttgtctcttttattaaatattttaatatttaatggctgaaaatctttgtggtcattattactttgttgcagctttattgagatrgaattcacataccaaatagttcacacaattaaaagtaaaattcaatggtttatagtagatccacagtgttgtgcagccatcaccacaattttagaacatttatatcatcacctcaaaaagaaccccatacccattagcagttattcctcattttcccaattcctcccaatcctgctccaacaactctaggccaccagactaatcgactttttgtctctgtagatttgcttattctagacatttcatataaatcaaattgtgtgatatgtggtcttttgtggccgactcctttaacttagc

SEQ ID NO: 186787 - DNA, 601 bp, Human
atattttgatgttgttttgatttgcatttccttgatggctaatgacattaagcatcttttcatgtgcttattgaccatatgtatatcttctttggagaaacttccattctttttttttttttgagatggggtccggctatgttgcccaggctggtttcaaattcctgggctcaagggattctcccacttcagcctcccaaataactcaagtggattgctgggattacaagcatcatgccgggcttcaattttttctttttttttttttgagatggagtctcactctgttgcccaggctggmgtgcagtggtgtgatcttggctcactgcaacctccacctccgaggttcaagcaattctcctgcctcagcctccagagtagctgggattacaggcatccaccaccacacctggctaattttttatttttttattttttagtagagacggggttttgccatgttggccaggctggtcttgaactcctgacctcaggtgatctgcctgcctcggcctcccaaaatgttgggattataggcatgagccaccgcgcccgacccaactttttttttttttttaaagagacggagttccgctgtgtc

SEQ ID NO: 186788 - DNA, 601 bp, Human
gtctcactctgttgcccaggctggcgtgcagtggtgtgatcttggctcactgcaacctccacctccgaggttcaagcaattctcctgcctcagcctccagagtagctgggattacaggcatccaccaccacacctggctaattttttatttttttattttttagtagagacggggttttgccatgttggccaggctggtcttgaactcctgacctcaggtgatctgcctgcctcggcctcccaaaatgttgggattataggcatgagccaccgcgcccgacccaactttttttttttttttaaagagacggagttccgctgtgtctcaaactcctgggctctggggatcctctcacctcagcctcccaattagctgagacaacaggcatgtggcactgcacctggggctgtctattcattttaaaatgggcaatttatcttattattgttgagttgtaagagctccctacgtatcctggaaccaagccccttatcagatatacaatttgcaaaaatcttctcccattctgtgtgttgtctccttactttcttgatagtgtcctttcaagtacagaagttttacattttgatgtggtccaat

SEQ ID NO: 186789 - DNA, 601 bp, Human
aggtgatctgcctgcctcggcctcccaaaatgttgggattataggcatgagccaccgcgcccgacccaactttttttttttttttaaagagacggagttccgctgtgtctcaaactcctgggctctggggatcctctcacctcagcctcccaattagctgagacaacaggcatgtggcactgcacctggggctgtctattcattttaaaatgggcaatttatcttattattgttgagttgtaagagctccctacgtatcctggaaccaagccccttatcagatatacaatttgcaaaaatsttctcccattctgtgtgttgtctccttactttcttgatagtgtcctttcaagtacagaagttttacattttgatgtggtccaatttatgtattttttcttgtgtttcttgtcctctttgcgtcatatctaaaaaaccattgcgtaatctaaggtcacaaagatttacacctacgttttcttctaagagtgttatagctttaactctcgcatttaaatcttgatccattttgagttaacttttttatcggataagtagagggtccactttccttcttttgcagatggatatcccattgtcc

SEQ ID NO: 186790 - DNA, 601 bp, Human
agcctcccaattagctgagacaacaggcatgtggcactgcacctggggctgtctattcattttaaaatgggcaatttatcttattattgttgagttgtaagagctccctacgtatcctggaaccaagccccttatcagatatacaatttgcaaaaatcttctcccattctgtgtgttgtctccttactttcttgatagtgtcctttcaagtacagaagttttacattttgatgtggtccaatttatgtattttttcttgtgtttcttgtcctctttgcgtcatatctaaaaaaccattgcstaatctaaggtcacaaagatttacacctacgttttcttctaagagtgttatagctttaactctcgcatttaaatcttgatccattttgagttaacttttttatcggataagtagagggtccactttccttcttttgcagatggatatcccattgtcccagcacaacttattgaaaagactgttattaaaaaaaattccatccctcagcatattttcacaagtcatgaatttcataagtgagtagaggcaactcaaagatagcaaacaacttgattaatatcattggctaataaagggcac

SEQ ID NO: 186791 - DNA, 601 bp, Human
ggaaagaaaagaaaggttacaaaggggaggggaccatatctgtgtttacatttgttcctttcctcaaatggaaggtagaataatgtattagaagatattttaaatattaatatctaactgaaacctgatattagagaatgagaaaattttgctgaaaattaattttattttcttttaatttatggtgttactataccttttagatttaggaaggcagaaagactgtgtgtgtgtgtgtgtgtgtttgtgtgtgtgcacttgcactttggggttccctttctatggatgtttcaggatctgwggataaaggatcacagtctagcagaaagctgggtttcaggggacgtcaaaggtaatttcatgactatattagtagataaatcgaagaccagagagcatgctgaatggaggacatttacatagtctttccaatgctaaaggaaatagggaagtgattatttcaaaattacctagaggatcttgagcatagtatgacttaagataaaaatctcattgtttctgagagttggcctctttctcctctccagatgaaatattttttcctttttttctcctccgtggaaagaaattattaattaaa

SEQ ID NO: 186792 - DNA, 601 bp, Human
tgtattagaagatattttaaatattaatatctaactgaaacctgatattagagaatgagaaaattttgctgaaaattaattttattttcttttaatttatggtgttactataccttttagatttaggaaggcagaaagactgtgtgtgtgtgtgtgtgtgtttgtgtgtgtgcacttgcactttggggttccctttctatggatgtttcaggatctgaggataaaggatcacagtctagcagaaagctgggtttcaggggacgtcaaaggtaatttcatgactatattagtagataaatcsaagaccagagagcatgctgaatggaggacatttacatagtctttccaatgctaaaggaaatagggaagtgattatttcaaaattacctagaggatcttgagcatagtatgacttaagataaaaatctcattgtttctgagagttggcctctttctcctctccagatgaaatattttttcctttttttctcctccgtggaaagaaattattaattaaaacaaaaagacattgttggaaagggaggttttttagtcgcctaagagaggtgctattagtacttgtttatttaaaaattgactt

SEQ ID NO: 186793 - DNA, 601 bp, Human
agcagaaagctgggtttcaggggacgtcaaaggtaatttcatgactatattagtagataaatcgaagaccagagagcatgctgaatggaggacatttacatagtctttccaatgctaaaggaaatagggaagtgattatttcaaaattacctagaggatcttgagcatagtatgacttaagataaaaatctcattgtttctgagagttggcctctttctcctctccagatgaaatattttttcctttttttctcctccgtggaaagaaattattaattaaaacaaaaagacattgttggaragggaggttttttagtcgcctaagagaggtgctattagtacttgtttatttaaaaattgacttttggtcaaactaaactatacaactttttctttttcaatccttcttccctccatccctcttcctttctttcttcctcctactttttgcccttcctccttccctgatcccttgttttatttagtttatgtcattccacagagctcacagttaccacctggtaggtacccttgacattctacacagttggtaaatcagtgtcataccagttgctaaataattggccaggaatagccttta

SEQ ID NO: 186794 - DNA, 601 bp, Human
aaccaaaaataaaatccatgaaggatctagaacttttaaggctatgtaattcatattttaagcctttactgtttcataaattatttaaataatttgaggaattactattgaagagagtcttaatctgtcaaattgatcagattggatttatcttgaaaacagttctgcatctttggataaaaatctattttattccaaagaaagctttttttatggcaaataaaagcaaaggtatacatttttaataatcttatgataaataggatgatctgctttaaagaagagtaagtttatagagtcrgagtatacttgtacacacctcaaagtcaaacgtttgaaaaatgaagtttgttatgattctaagtgtagtttcgaatgtaagaaaaagttaaaagtgtgatgcagtcaggaagcttggaatattctcctgcataaattatatgtgttaacagccttagcagtattctcttgtaggccacttggctccatctttaaggtagtttgatgaatattgactggtctgcaaaatttgacttaagaaatgttgagccaaagtatcctggataacgtagatatagagataaagtaatatatatatata

SEQ ID NO: 186795 - DNA, 601 bp, Human
gagataaagtaatatatatatatacacacacacacacatacacacacacacatatttacatatatacacatatgtacttatttacagtgtatataaaaaataatttagaagaatgcatccagaaaccaaattgagcttgaaaagtaccacctcacatgaccgcagggacagctggttattgtcttaggatatatttgcattttgaagtgaactttagtgacattacaaaatgccagattggaaaaacagccattatttaaaaaaaaaaacaaaatataattagcaccagatgaatgagttktctcataatcacctcattattacaaattaattccaaatgaatatgtttgaacagggcattggttttgaatctttaatttatctcctccttagccttgctgctgacaaatcataaatagatataattaatgaaaatgttaatagtgccggtctccagaatatctctagatcactgaccttctgattggtggaaaaacctttggagaatgatctttacaggattccatggcagtgagttaatctatttttctctacatgggggcagcagacgaggtgagtttcttcctctgtcatttgtagg

SEQ ID NO: 186796 - DNA, 601 bp, Human
tttacatatatacacatatgtacttatttacagtgtatataaaaaataatttagaagaatgcatccagaaaccaaattgagcttgaaaagtaccacctcacatgaccgcagggacagctggttattgtcttaggatatatttgcattttgaagtgaactttagtgacattacaaaatgccagattggaaaaacagccattatttaaaaaaaaaaacaaaatataattagcaccagatgaatgagttgtctcataatcacctcattattacaaattaattccaaatgaatatgtttgaacarggcattggttttgaatctttaatttatctcctccttagccttgctgctgacaaatcataaatagatataattaatgaaaatgttaatagtgccggtctccagaatatctctagatcactgaccttctgattggtggaaaaacctttggagaatgatctttacaggattccatggcagtgagttaatctatttttctctacatgggggcagcagacgaggtgagtttcttcctctgtcatttgtaggatctactgttattctctggagagctattgtgtcagaacggatttggattatttt

SEQ ID NO: 186797 - DNA, 601 bp, Human
ttaaaaaaaaaaacaaaatataattagcaccagatgaatgagttgtctcataatcacctcattattacaaattaattccaaatgaatatgtttgaacagggcattggttttgaatctttaatttatctcctccttagccttgctgctgacaaatcataaatagatataattaatgaaaatgttaatagtgccggtctccagaatatctctagatcactgaccttctgattggtggaaaaacctttggagaatgatctttacaggattccatggcagtgagttaatctatttttctctacaygggggcagcagacgaggtgagtttcttcctctgtcatttgtaggatctactgttattctctggagagctattgtgtcagaacggatttggattattttttaaaactactgctacctagagggtaattttattaaattcctttatcatttggattaaatacagcaaaatgaaaccagctcctcctgctcagaggagctgtcaccacaatctttaatattttcttagcattatttcctttaaagtatgctttgggacaattaataatgactaatacttaaattttcactatgagtaaaagct

SEQ ID NO: 186798 - DNA, 601 bp, Human
gaatatgtttgaacagggcattggttttgaatctttaatttatctcctccttagccttgctgctgacaaatcataaatagatataattaatgaaaatgttaatagtgccggtctccagaatatctctagatcactgaccttctgattggtggaaaaacctttggagaatgatctttacaggattccatggcagtgagttaatctatttttctctacatgggggcagcagacgaggtgagtttcttcctctgtcatttgtaggatctactgttattctctggagagctattgtgtcagaacrgatttggattattttttaaaactactgctacctagagggtaattttattaaattcctttatcatttggattaaatacagcaaaatgaaaccagctcctcctgctcagaggagctgtcaccacaatctttaatattttcttagcattatttcctttaaagtatgctttgggacaattaataatgactaatacttaaattttcactatgagtaaaagctttttggtaaacatttattatatattccatgtcttccttttattctctaattatttcacctattcacctaattattttgtagct

SEQ ID NO: 186799 - DNA, 601 bp, Human
aaatgttaatagtgccggtctccagaatatctctagatcactgaccttctgattggtggaaaaacctttggagaatgatctttacaggattccatggcagtgagttaatctatttttctctacatgggggcagcagacgaggtgagtttcttcctctgtcatttgtaggatctactgttattctctggagagctattgtgtcagaacggatttggattattttttaaaactactgctacctagagggtaattttattaaattcctttatcatttggattaaatacagcaaaatgaaaccarctcctcctgctcagaggagctgtcaccacaatctttaatattttcttagcattatttcctttaaagtatgctttgggacaattaataatgactaatacttaaattttcactatgagtaaaagctttttggtaaacatttattatatattccatgtcttccttttattctctaattatttcacctattcacctaattattttgtagctcaagtgtataatttaaatgatgtagaaatatagagatcaaaattaatacaaatacatttatatagtgatgtgttacatgttatatttgtcaca

SEQ ID NO: 186800 - DNA, 601 bp, Human
cctttaaagtatgctttgggacaattaataatgactaatacttaaattttcactatgagtaaaagctttttggtaaacatttattatatattccatgtcttccttttattctctaattatttcacctattcacctaattattttgtagctcaagtgtataatttaaatgatgtagaaatatagagatcaaaattaatacaaatacatttatatagtgatgtgttacatgttatatttgtcacaaatatagcatatatttgtttgtctagtacatatatagtatatacagtacatatatattacatacatacatatagtacatatttgtgtagtacacaggtatagtgcatatatatatatatttgtcacatatatagaagtcctgtgtcttccttttaggtaacatgggagaatgtaagtttttgttttcggtccaagaatgacacagatttttttgtttgtttagttagttttctttaggatctagatcccccagaggtaaacactaaatataaaaccgggaattagaagctggccttgggttctgcagttctaggcatggcgttaacgtttttcttaaaacttaaggcccagactacac

SEQ ID NO: 186801 - DNA, 601 bp, Human
tttaaagtatgctttgggacaattaataatgactaatacttaaattttcactatgagtaaaagctttttggtaaacatttattatatattccatgtcttccttttattctctaattatttcacctattcacctaattattttgtagctcaagtgtataatttaaatgatgtagaaatatagagatcaaaattaatacaaatacatttatatagtgatgtgttacatgttatatttgtcacaaatatagcatatatttgtttgtctagtacatatatagtatatacagtacatatatattacatacatacatatagtacatatttgtgtagtacacaggtatagtgcatatatatatatatttgtcacatatatagaagtcctgtgtcttccttttaggtaacatgggagaatgtaagtttttgttttcggtccaagaatgacacagatttttttgtttgtttagttagttttctttaggatctagatcccccagaggtaaacactaaatataaaaccgggaattagaagctggccttgggttctgcagttctaggcatggcgttaacgtttttcttaaaacttaaggcccagactacacaa

SEQ ID NO: 186802 - DNA, 601 bp, Human
ttaaagtatgctttgggacaattaataatgactaatacttaaattttcactatgagtaaaagctttttggtaaacatttattatatattccatgtcttccttttattctctaattatttcacctattcacctaattattttgtagctcaagtgtataatttaaatgatgtagaaatatagagatcaaaattaatacaaatacatttatatagtgatgtgttacatgttatatttgtcacaaatatagcatatatttgtttgtctagtacatatatagtatatacagtacatatatattacwtacatacatatagtacatatttgtgtagtacacaggtatagtgcatatatatatatatttgtcacatatatagaagtcctgtgtcttccttttaggtaacatgggagaatgtaagtttttgttttcggtccaagaatgacacagatttttttgtttgtttagttagttttctttaggatctagatcccccagaggtaaacactaaatataaaaccgggaattagaagctggccttgggttctgcagttctaggcatggcgttaacgtttttcttaaaacttaaggcccagactacacaag

SEQ ID NO: 186803 - DNA, 601 bp, Human
tgctttgggacaattaataatgactaatacttaaattttcactatgagtaaaagctttttggtaaacatttattatatattccatgtcttccttttattctctaattatttcacctattcacctaattattttgtagctcaagtgtataatttaaatgatgtagaaatatagagatcaaaattaatacaaatacatttatatagtgatgtgttacatgttatatttgtcacaaatatagcatatatttgtttgtctagtacatatatagtatatacagtacatatatattacatacatacrtatagtacatatttgtgtagtacacaggtatagtgcatatatatatatatttgtcacatatatagaagtcctgtgtcttccttttaggtaacatgggagaatgtaagtttttgttttcggtccaagaatgacacagatttttttgtttgtttagttagttttctttaggatctagatcccccagaggtaaacactaaatataaaaccgggaattagaagctggccttgggttctgcagttctaggcatggcgttaacgtttttcttaaaacttaaggcccagactacacaaggaatcttc

SEQ ID NO: 186804 - DNA, 601 bp, Human
ttattctctaattatttcacctattcacctaattattttgtagctcaagtgtataatttaaatgatgtagaaatatagagatcaaaattaatacaaatacatttatatagtgatgtgttacatgttatatttgtcacaaatatagcatatatttgtttgtctagtacatatatagtatatacagtacatatatattacatacatacatatagtacatatttgtgtagtacacaggtatagtgcatatatatatatatttgtcacatatatagaagtcctgtgtcttccttttaggtaacaygggagaatgtaagtttttgttttcggtccaagaatgacacagatttttttgtttgtttagttagttttctttaggatctagatcccccagaggtaaacactaaatataaaaccgggaattagaagctggccttgggttctgcagttctaggcatggcgttaacgtttttcttaaaacttaaggcccagactacacaaggaatcttcccgcctgcactcccctgccagctcagctacttccctactcctgcgccaactcaaccgtaacagtagctgagacgaaagcattgctctgaagtaa

SEQ ID NO: 186805 - DNA, 601 bp, Human
aattatttcacctattcacctaattattttgtagctcaagtgtataatttaaatgatgtagaaatatagagatcaaaattaatacaaatacatttatatagtgatgtgttacatgttatatttgtcacaaatatagcatatatttgtttgtctagtacatatatagtatatacagtacatatatattacatacatacatatagtacatatttgtgtagtacacaggtatagtgcatatatatatatatttgtcacatatatagaagtcctgtgtcttccttttaggtaacatgggagaatttaagtttttgttttcggtccaagaatgacacagatttttttgtttgtttagttagttttctttaggatctagatcccccagaggtaaacactaaatataaaaccgggaattagaagctggccttgggttctgcagttctaggcatggcgttaacgtttttcttaaaacttaaggcccagactacacaaggaatcttcccgcctgcactcccctgccagctcagctacttccctactcctgcgccaactcaaccgtaacagtagctgagacgaaagcattgctctgaagtaaggtgtaggg

SEQ ID NO: 186806 - DNA, 601 bp, Human
gtgttacatgttatatttgtcacaaatatagcatatatttgtttgtctagtacatatatagtatatacagtacatatatattacatacatacatatagtacatatttgtgtagtacacaggtatagtgcatatatatatatatttgtcacatatatagaagtcctgtgtcttccttttaggtaacatgggagaatgtaagtttttgttttcggtccaagaatgacacagatttttttgtttgtttagttagttttctttaggatctagatcccccagaggtaaacactaaatataaaaccrggaattagaagctggccttgggttctgcagttctaggcatggcgttaacgtttttcttaaaacttaaggcccagactacacaaggaatcttcccgcctgcactcccctgccagctcagctacttccctactcctgcgccaactcaaccgtaacagtagctgagacgaaagcattgctctgaagtaaggtgtagggaagctttctggcttccttaataaagttacacacgatcttctaagcttggcgatggagggagaaggcacatgggagggtcttcaccgatcctctggccctgactct

SEQ ID NO: 186807 - DNA, 601 bp, Human
tgcagttctaggcatggcgttaacgtttttcttaaaacttaaggcccagactacacaaggaatcttcccgcctgcactcccctgccagctcagctacttccctactcctgcgccaactcaaccgtaacagtagctgagacgaaagcattgctctgaagtaaggtgtagggaagctttctggcttccttaataaagttacacacgatcttctaagcttggcgatggagggagaaggcacatgggagggtcttcaccgatcctctggccctgactctgcctacccttcattcattcacctgcmcctctgggggctctgggcggtgaccactgccactattgggctagctagtggtgggggcactgctccccttaatgctctggcccctaggggagacacaaaatattgttttaaatttccagtagtgtagctcatggcaggctgaggcacttacacaaaagggtgctggaggctttagggtaacacagtagaaatcatcaaagggagaatatgcggtagacaatttaggctcttcaacataacttgcttgatctccagaggccccaaactctgctcatgccaggctttgcacatgccgtttcc

SEQ ID NO: 186808 - DNA, 601 bp, Human
ggctagctagtggtgggggcactgctccccttaatgctctggcccctaggggagacacaaaatattgttttaaatttccagtagtgtagctcatggcaggctgaggcacttacacaaaagggtgctggaggctttagggtaacacagtagaaatcatcaaagggagaatatgcggtagacaatttaggctcttcaacataacttgcttgatctccagaggccccaaactctgctcatgccaggctttgcacatgccgtttcctctgcttggactggtcttccccatcattgcctggctatyttcttctcaattactagatttcacagtaggggttccgccttcttgattcccccggcctgggttatataggtttgtcctagatagtgcggtggccccacatatgcctcctcatcaacctgttttacagttgtttatcctgttaggccataagctcagtggcaccagggaccttctctgtctctctcagcactgtattctcatcagcttggacagtgcctggcacacagtggggactcagaaaatattttcgaatgtgtcaatgagtccatgaatgaatggaatttggtaaaaaagagaatt

SEQ ID NO: 186809 - DNA, 601 bp, Human
ccccatcattgcctggctatcttcttctcaattactagatttcacagtaggggttccgccttcttgattcccccggcctgggttatataggtttgtcctagatagtgcggtggccccacatatgcctcctcatcaacctgttttacagttgtttatcctgttaggccataagctcagtggcaccagggaccttctctgtctctctcagcactgtattctcatcagcttggacagtgcctggcacacagtggggactcagaaaatattttcgaatgtgtcaatgagtccatgaatgaatggmatttggtaaaaaagagaattctgacctccagcttctctttatcttatgagatgctttcttcactgtaatcttgcaggactggagttaggttttatttagaaagctggcaggtttatttacaaaagatgcaaataaaccactgggcttaggggacagaaagaaagagccattttcttagactagaaaataatatggaatggattagggggcagaagaaggaatgggtgagtggggtggaggaatggcaacagataagatgttgatggttataaaaattgggaaactgtccaattctcctta

SEQ ID NO: 186810 - DNA, 601 bp, Human
cagtaggggttccgccttcttgattcccccggcctgggttatataggtttgtcctagatagtgcggtggccccacatatgcctcctcatcaacctgttttacagttgtttatcctgttaggccataagctcagtggcaccagggaccttctctgtctctctcagcactgtattctcatcagcttggacagtgcctggcacacagtggggactcagaaaatattttcgaatgtgtcaatgagtccatgaatgaatggaatttggtaaaaaagagaattctgacctccagcttctctttatcytatgagatgctttcttcactgtaatcttgcaggactggagttaggttttatttagaaagctggcaggtttatttacaaaagatgcaaataaaccactgggcttaggggacagaaagaaagagccattttcttagactagaaaataatatggaatggattagggggcagaagaaggaatgggtgagtggggtggaggaatggcaacagataagatgttgatggttataaaaattgggaaactgtccaattctccttagtttagactttaaaaaaaatgagtaaatttcctagaagtcaagt

SEQ ID NO: 186811 - DNA, 601 bp, Human
gttccgccttcttgattcccccggcctgggttatataggtttgtcctagatagtgcggtggccccacatatgcctcctcatcaacctgttttacagttgtttatcctgttaggccataagctcagtggcaccagggaccttctctgtctctctcagcactgtattctcatcagcttggacagtgcctggcacacagtggggactcagaaaatattttcgaatgtgtcaatgagtccatgaatgaatggaatttggtaaaaaagagaattctgacctccagcttctctttatcttatgagakgctttcttcactgtaatcttgcaggactggagttaggttttatttagaaagctggcaggtttatttacaaaagatgcaaataaaccactgggcttaggggacagaaagaaagagccattttcttagactagaaaataatatggaatggattagggggcagaagaaggaatgggtgagtggggtggaggaatggcaacagataagatgttgatggttataaaaattgggaaactgtccaattctccttagtttagactttaaaaaaaatgagtaaatttcctagaagtcaagtgtagccat

SEQ ID NO: 186812 - DNA, 601 bp, Human
aatatggaatggattagggggcagaagaaggaatgggtgagtggggtggaggaatggcaacagataagatgttgatggttataaaaattgggaaactgtccaattctccttagtttagactttaaaaaaaatgagtaaatttcctagaagtcaagtgtagccatatgaaaatatttggactaagttaaatataattcccttggtattattgaattgcctttgacttggagacagagctattcattatagagcagtttctaagagcctgggcttcacagagattatctcttttcattcaacratgtaatgaagtaggaattatacttctattttacagatgaagaaatagactcagagagtttaattgactttaggattgtaaaactacaaacagtagaactggcagccattcattcattccacaaatatttattggcagtattttttttttttatcattagctttgtcttttttgatggtagaaaatgcatttcatttagaactatgattttagcccagagaaagtgatgtagaaaaaagcactaagttaactagatcatatcagtataaatgtgaagcctcaccattttactcatccaaa

SEQ ID NO: 186813 - DNA, 601 bp, Human
cttctattttacagatgaagaaatagactcagagagtttaattgactttaggattgtaaaactacaaacagtagaactggcagccattcattcattccacaaatatttattggcagtattttttttttttatcattagctttgtcttttttgatggtagaaaatgcatttcatttagaactatgattttagcccagagaaagtgatgtagaaaaaagcactaagttaactagatcatatcagtataaatgtgaagcctcaccattttactcatccaaaagtgtctagggccttaagttcasttccttttattacaactttaatattttgtctgtcttaaaaaaaaaaaaaagacattaaatctccagcccctggtatcgtgcttggaacatggtgggtacttaataaataatttgtagtgaatgggaaaattgagaaccattagtcattttctattcagtattaacaaagtctgacttacttttttgtttttgttctgtgtgggcacatttcactgagtgcaacttatgaaggacctcaagatcaaattcatgtcgtactcttggaattgaattctgacaggtggactgagagttttttgt

SEQ ID NO: 186814 - DNA, 601 bp, Human
atctccagcccctggtatcgtgcttggaacatggtgggtacttaataaataatttgtagtgaatgggaaaattgagaaccattagtcattttctattcagtattaacaaagtctgacttacttttttgtttttgttctgtgtgggcacatttcactgagtgcaacttatgaaggacctcaagatcaaattcatgtcgtactcttggaattgaattctgacaggtggactgagagttttttgtcctctaagccttcattctaagacagatgacaccaatgtaggtagttattcagaataatrgactcaggaatttaataagggtgttgtttaaaacgcaaatatcaccaaccagtggtaaagcaaacacattctgtgtgaatgagtacagcccactgattgacattcaagacccattggaaaaatcaggagacacaagagtgggaagagtgcagattggagcagctatccaaaaatacagaaggccagaaggtggtgagaaaaatgtcagacaacagattgtggagaaaaataaacaagccaagaaaagtcctatttggccttaagaggcagatggtgacaggaagtgttcagtgaggagtg

SEQ ID NO: 186815 - DNA, 601 bp, Human
gagaaccattagtcattttctattcagtattaacaaagtctgacttacttttttgtttttgttctgtgtgggcacatttcactgagtgcaacttatgaaggacctcaagatcaaattcatgtcgtactcttggaattgaattctgacaggtggactgagagttttttgtcctctaagccttcattctaagacagatgacaccaatgtaggtagttattcagaataatagactcaggaatttaataagggtgttgtttaaaacgcaaatatcaccaaccagtggtaaagcaaacacattctrtgtgaatgagtacagcccactgattgacattcaagacccattggaaaaatcaggagacacaagagtgggaagagtgcagattggagcagctatccaaaaatacagaaggccagaaggtggtgagaaaaatgtcagacaacagattgtggagaaaaataaacaagccaagaaaagtcctatttggccttaagaggcagatggtgacaggaagtgttcagtgaggagtgattgtgctgaaaatcacaaagtctataaaattatccatctgtagtttgaggtttttggggaaaattaaaactc

SEQ ID NO: 186816 - DNA, 601 bp, Human
gtctgacttacttttttgtttttgttctgtgtgggcacatttcactgagtgcaacttatgaaggacctcaagatcaaattcatgtcgtactcttggaattgaattctgacaggtggactgagagttttttgtcctctaagccttcattctaagacagatgacaccaatgtaggtagttattcagaataatagactcaggaatttaataagggtgttgtttaaaacgcaaatatcaccaaccagtggtaaagcaaacacattctgtgtgaatgagtacagcccactgattgacattcaagayccattggaaaaatcaggagacacaagagtgggaagagtgcagattggagcagctatccaaaaatacagaaggccagaaggtggtgagaaaaatgtcagacaacagattgtggagaaaaataaacaagccaagaaaagtcctatttggccttaagaggcagatggtgacaggaagtgttcagtgaggagtgattgtgctgaaaatcacaaagtctataaaattatccatctgtagtttgaggtttttggggaaaattaaaactctttgctagcattacagggaagggtgatagcacacaaa

SEQ ID NO: 186817 - DNA, 601 bp, Human
acagatgacaccaatgtaggtagttattcagaataatagactcaggaatttaataagggtgttgtttaaaacgcaaatatcaccaaccagtggtaaagcaaacacattctgtgtgaatgagtacagcccactgattgacattcaagacccattggaaaaatcaggagacacaagagtgggaagagtgcagattggagcagctatccaaaaatacagaaggccagaaggtggtgagaaaaatgtcagacaacagattgtggagaaaaataaacaagccaagaaaagtcctatttggccttaagaggcagatggtgacaggaagtgttcagtgaggagtgattgtgctgaaaatcacaaagtctataaaattatccatctgtagtttgaggtttttggggaaaattaaaactctttgctagcattacagggaagggtgatagcacacaaacagaatattaagtaagtgtgtatttgtgtcaggataatagaaatgagagatgcgttattccattagaatagaagttttgtttacttagagattgtgaccaaaattataaaacgtgttttgttttgcataaaagcagttgaacttgtattaaat

SEQ ID NO: 186818 - DNA, 601 bp, Human
gtgaggagtgattgtgctgaaaatcacaaagtctataaaattatccatctgtagtttgaggtttttggggaaaattaaaactctttgctagcattacagggaagggtgatagcacacaaacagaatattaagtaagtgtgtatttgtgtcaggataatagaaatgagagatgcgttattccattagaatagaagttttgtttacttagagattgtgaccaaaattataaaacgtgttttgttttgcataaaagcagttgaacttgtattaaatctgttctttccacatttttgatgtaagwaagaattctcccaagaatgttaatagattgctaaggtagcaatgataattttctaactgaaggaatgtactaaacatttttttccattagagagtttttttggaatgggatatagaaaatgacaaatcacaatgctaactttaaagcaaagaattttaatttgaaagttgagaaaatatagcagggaaaactaatcatttggaatagtatgagataatttgaaaaaaatattataaatattttaagatagatgtggttgaacatttagaattgggaatcattttttgatagtttgggacc

SEQ ID NO: 186819 - DNA, 601 bp, Human
aaagtctataaaattatccatctgtagtttgaggtttttggggaaaattaaaactctttgctagcattacagggaagggtgatagcacacaaacagaatattaagtaagtgtgtatttgtgtcaggataatagaaatgagagatgcgttattccattagaatagaagttttgtttacttagagattgtgaccaaaattataaaacgtgttttgttttgcataaaagcagttgaacttgtattaaatctgttctttccacatttttgatgtaagaaagaattctcccaagaatgttaatagrttgctaaggtagcaatgataattttctaactgaaggaatgtactaaacatttttttccattagagagtttttttggaatgggatatagaaaatgacaaatcacaatgctaactttaaagcaaagaattttaatttgaaagttgagaaaatatagcagggaaaactaatcatttggaatagtatgagataatttgaaaaaaatattataaatattttaagatagatgtggttgaacatttagaattgggaatcattttttgatagtttgggacctagttttctgtgcttaaattttaattc

SEQ ID NO: 186820 - DNA, 601 bp, Human
aaatattttgtttttggcctttttgctgaactctgaattctaatggctgtccagtttgtttatttatttctttattttatcatctccattttacaggtgatgtctagtttattttttctgttttttttctgagtgtactatataaattgtatacagtgttggtactttatatttttaagtttatatatcgtaatttattcctatgcataattgaatagtagagaatttctagtatactgttacatagtatgtcttttccctgattttaatgggaatggcatttctgtgctcatatgcataktcaagcattcaaataaccattcttctgaagttgcagattaggtactttaagcatttggaataattagtttttattaaatgtcattttgatttaagataattttttatttataggatactaaaagtaaactttggagcagatttttaaaacacacatttctactttctgacattttacttaggttttcatatgtatattcataaaggaaattggcccgtacttctctattttatataaattttatcacacttagaattagagttgtaatttattttcaggaaataatttcattatgatcta

SEQ ID NO: 186821 - DNA, 601 bp, Human
cctttttgctgaactctgaattctaatggctgtccagtttgtttatttatttctttattttatcatctccattttacaggtgatgtctagtttattttttctgttttttttctgagtgtactatataaattgtatacagtgttggtactttatatttttaagtttatatatcgtaatttattcctatgcataattgaatagtagagaatttctagtatactgttacatagtatgtcttttccctgattttaatgggaatggcatttctgtgctcatatgcatagtcaagcattcaaataaycattcttctgaagttgcagattaggtactttaagcatttggaataattagtttttattaaatgtcattttgatttaagataattttttatttataggatactaaaagtaaactttggagcagatttttaaaacacacatttctactttctgacattttacttaggttttcatatgtatattcataaaggaaattggcccgtacttctctattttatataaattttatcacacttagaattagagttgtaatttattttcaggaaataatttcattatgatctacatatttgttaatgtcg

SEQ ID NO: 186822 - DNA, 601 bp, Human
tactttatatttttaagtttatatatcgtaatttattcctatgcataattgaatagtagagaatttctagtatactgttacatagtatgtcttttccctgattttaatgggaatggcatttctgtgctcatatgcatagtcaagcattcaaataaccattcttctgaagttgcagattaggtactttaagcatttggaataattagtttttattaaatgtcattttgatttaagataattttttatttataggatactaaaagtaaactttggagcagatttttaaaacacacatttctaytttctgacattttacttaggttttcatatgtatattcataaaggaaattggcccgtacttctctattttatataaattttatcacacttagaattagagttgtaatttattttcaggaaataatttcattatgatctacatatttgttaatgtcgtgagaaatagctcaatttgggcctgcattgtagtggaaaattatacttcttaaagctctgcctgattattagttacttccttttaactgcctaaggctgatccaatagcaagacacaaacctactgagtgtgcagtagtaaattt

SEQ ID NO: 186823 - DNA, 601 bp, Human
gttacatagtatgtcttttccctgattttaatgggaatggcatttctgtgctcatatgcatagtcaagcattcaaataaccattcttctgaagttgcagattaggtactttaagcatttggaataattagtttttattaaatgtcattttgatttaagataattttttatttataggatactaaaagtaaactttggagcagatttttaaaacacacatttctactttctgacattttacttaggttttcatatgtatattcataaaggaaattggcccgtacttctctattttatataawttttatcacacttagaattagagttgtaatttattttcaggaaataatttcattatgatctacatatttgttaatgtcgtgagaaatagctcaatttgggcctgcattgtagtggaaaattatacttcttaaagctctgcctgattattagttacttccttttaactgcctaaggctgatccaatagcaagacacaaacctactgagtgtgcagtagtaaatttctcattttctgtagtaggatttggagtcttcgttgctgtgctctataggttaaaaacaacacatgtattgaaaggt

SEQ ID NO: 186824 - DNA, 601 bp, Human
tttacttaggttttcatatgtatattcataaaggaaattggcccgtacttctctattttatataaattttatcacacttagaattagagttgtaatttattttcaggaaataatttcattatgatctacatatttgttaatgtcgtgagaaatagctcaatttgggcctgcattgtagtggaaaattatacttcttaaagctctgcctgattattagttacttccttttaactgcctaaggctgatccaatagcaagacacaaacctactgagtgtgcagtagtaaatttctcattttctrtagtaggatttggagtcttcgttgctgtgctctataggttaaaaacaacacatgtattgaaaggtatacttttaggacctacgtgcctggccatagcctggccatagctcctggtcctcctgtgggcagagaaggggccaaatcttagttggtatctcttctatgtttggtcagcaaataacctctgcctctattccacctgctggacttgacatttgtaacttttgtcttctgtgtcttgctgacagagatagggctcattcctagattggtgaattgcttgctctcctccaagttgtc

SEQ ID NO: 186825 - DNA, 601 bp, Human
ctctccttgaggattcaaagtacatattaacataagaaaagatctgagaagttttaaaataacagggaaaacttttgaagtttattcaatgattaaaagaacttaaaaataaagaacttatttgtgtagaggaaggctttttcttggcacagttattaaaattctctggaatagattttaatttttttcttaacaccaatttaagaagtgctagtctatttcatcattatcattatcactttaaataaagagcttaggaaattacttactcaattcatcgttgttctttcatctcatttaktattttttaaatatattttaattattttttatctatttaaggaattcttctctttacaataaaaaattgtttggttcctttatttttatatttaagcaggaaagcaggaaaagaattaaagttatggcattatctctgagtaaccctttgaacaatcctaaagctttttatatttagcaatctcattattgctattgtaaaccagagtatctgagataagtctcagtcaatttaggaagtttattttgccaaggttaaggatgtacctgtgacacagccttaggaggtcctgatgacatt

SEQ ID NO: 186826 - DNA, 601 bp, Human
agtttattcaatgattaaaagaacttaaaaataaagaacttatttgtgtagaggaaggctttttcttggcacagttattaaaattctctggaatagattttaatttttttcttaacaccaatttaagaagtgctagtctatttcatcattatcattatcactttaaataaagagcttaggaaattacttactcaattcatcgttgttctttcatctcatttattattttttaaatatattttaattattttttatctatttaaggaattcttctctttacaataaaaaattgtttggttcmtttatttttatatttaagcaggaaagcaggaaaagaattaaagttatggcattatctctgagtaaccctttgaacaatcctaaagctttttatatttagcaatctcattattgctattgtaaaccagagtatctgagataagtctcagtcaatttaggaagtttattttgccaaggttaaggatgtacctgtgacacagccttaggaggtcctgatgacatttgcacaaggtggtcagggcacagcttggttttatacattttaggaagaaatgagacgtcaatcaatatgtataagatg

SEQ ID NO: 186827 - DNA, 601 bp, Human
ttcttggcacagttattaaaattctctggaatagattttaatttttttcttaacaccaatttaagaagtgctagtctatttcatcattatcattatcactttaaataaagagcttaggaaattacttactcaattcatcgttgttctttcatctcatttattattttttaaatatattttaattattttttatctatttaaggaattcttctctttacaataaaaaattgtttggttcctttatttttatatttaagcaggaaagcaggaaaagaattaaagttatggcattatctctgartaaccctttgaacaatcctaaagctttttatatttagcaatctcattattgctattgtaaaccagagtatctgagataagtctcagtcaatttaggaagtttattttgccaaggttaaggatgtacctgtgacacagccttaggaggtcctgatgacatttgcacaaggtggtcagggcacagcttggttttatacattttaggaagaaatgagacgtcaatcaatatgtataagatgtacactggggccaggtgcggtggctcacgcctgtaatcccaacactttgggaggccgaggcg

SEQ ID NO: 186828 - DNA, 601 bp, Human
atttaagaagtgctagtctatttcatcattatcattatcactttaaataaagagcttaggaaattacttactcaattcatcgttgttctttcatctcatttattattttttaaatatattttaattattttttatctatttaaggaattcttctctttacaataaaaaattgtttggttcctttatttttatatttaagcaggaaagcaggaaaagaattaaagttatggcattatctctgagtaaccctttgaacaatcctaaagctttttatatttagcaatctcattattgctattgyaaaccagagtatctgagataagtctcagtcaatttaggaagtttattttgccaaggttaaggatgtacctgtgacacagccttaggaggtcctgatgacatttgcacaaggtggtcagggcacagcttggttttatacattttaggaagaaatgagacgtcaatcaatatgtataagatgtacactggggccaggtgcggtggctcacgcctgtaatcccaacactttgggaggccgaggcgggcggatcacaaggtcaggagatagagaccatcctggccaatatggtgaaaccccgtc

SEQ ID NO: 186829 - DNA, 601 bp, Human
ttggttcctttatttttatatttaagcaggaaagcaggaaaagaattaaagttatggcattatctctgagtaaccctttgaacaatcctaaagctttttatatttagcaatctcattattgctattgtaaaccagagtatctgagataagtctcagtcaatttaggaagtttattttgccaaggttaaggatgtacctgtgacacagccttaggaggtcctgatgacatttgcacaaggtggtcagggcacagcttggttttatacattttaggaagaaatgagacgtcaatcaatatgtrtaagatgtacactggggccaggtgcggtggctcacgcctgtaatcccaacactttgggaggccgaggcgggcggatcacaaggtcaggagatagagaccatcctggccaatatggtgaaaccccgtctctactaaaaacacaaaaaattagccgggcgtggtggcgggcacctgtagtcccagctactcgggaggctgaggcaggagaatggcgtgaacttgggaggcggagcttgcagtgagccgagatggtgccactgccctccagcctgggcgacagaacgaaactctgtctcaaaa

SEQ ID NO: 186830 - DNA, 601 bp, Human
caggttagttacatatgtatacatgtgccatgctggtgcgctgcacccactaactcgtcatttagcattaggtatatctcccaatgctatccctcccccctccccccaccccacaacagtcctcagagtgtgatgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttaaaaaaatcyctactgtccttattatgtccacttgacctgttgtaagcaggtggaggtgggttgctttcttctgtaattgtgtttgattattgcctacttagacttctaaaggtttttgccatatataacttcttgctgcatttttttttagttatttactcactagatattttgccttttcaaattatgaagtggtcctttcacctaaatactgcttaaaaaatattaaagtcaattttgcataattagcttaccttacttgttttttattttggggtttgtttgatatgcatgtacatactctgtttt

SEQ ID NO: 186831 - DNA, 601 bp, Human
tctcccaatgctatccctcccccctccccccaccccacaacagtcctcagagtgtgatgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttaaaaaaatccctactgtccttattatgtccacttgacctgttgtaagcaggtggaggtgggttgctttcttctgtaattgtgtttgattattgcctacttagacttctaaaggtttttgccatatataacttcttgctgcatttttttttagttatttactcactagatattttgccttttcaaattatgaagtggtcctttcacctaaatactgcttaaaaaatattaaagtcaattttgcataattagcttaccttacttgttttttattttggggtttgtttgatatgcatgtacatactctgtttttttttttaagtctttccgtgtcattttatgtatatctatcagacattgtagaattagttattttctcataatgtct

SEQ ID NO: 186832 - DNA, 601 bp, Human
ccaatgctatccctcccccctccccccaccccacaacagtcctcagagtgtgatgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttaaaaaaatccctactgtccttattatgtccacttgacctgttgtaagcaggtggaggtgggttgctttcttctgtaattgtgtttgattattgcctacttagacttctaaaggtttttgccatatataacttcttgctgcatttttttttagttatttactcactagatattttgccttttcaaattatgaagtggtcctttcacctaaatactgcttaaaaaatattaaagtcaattttgcataattagcttaccttacttgttttttattttggggtttgtttgatatgcatgtacatactctgtttttttttttaagtctttccgtgtcattttatgtatatctatcagacattgtagaattagttattttctcataatgtcttagg

SEQ ID NO: 186833 - DNA, 601 bp, Human
acaacagtcctcagagtgtgatgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttaaaaaaatccctactgtccttattatgtccacttgacctgttgtaagcaggtggaggtgggttgctttcttctgtaattgtgtttgattattgcctacttagacttctaaaggtttttgccrtatataacttcttgctgcatttttttttagttatttactcactagatattttgccttttcaaattatgaagtggtcctttcacctaaatactgcttaaaaaatattaaagtcaattttgcataattagcttaccttacttgttttttattttggggtttgtttgatatgcatgtacatactctgtttttttttttaagtctttccgtgtcattttatgtatatctatcagacattgtagaattagttattttctcataatgtcttaggcttttttcttttgataggaaaatataaatgac

SEQ ID NO: 186834 - DNA, 601 bp, Human
tcctcagagtgtgatgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttaaaaaaatccctactgtccttattatgtccacttgacctgttgtaagcaggtggaggtgggttgctttcttctgtaattgtgtttgattattgcctacttagacttctaaaggtttttgccatatatawcttcttgctgcatttttttttagttatttactcactagatattttgccttttcaaattatgaagtggtcctttcacctaaatactgcttaaaaaatattaaagtcaattttgcataattagcttaccttacttgttttttattttggggtttgtttgatatgcatgtacatactctgtttttttttttaagtctttccgtgtcattttatgtatatctatcagacattgtagaattagttattttctcataatgtcttaggcttttttcttttgataggaaaatataaatgacatattga

SEQ ID NO: 186835 - DNA, 601 bp, Human
cctcagagtgtgatgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttaaaaaaatccctactgtccttattatgtccacttgacctgttgtaagcaggtggaggtgggttgctttcttctgtaattgtgtttgattattgcctacttagacttctaaaggtttttgccatatataayttcttgctgcatttttttttagttatttactcactagatattttgccttttcaaattatgaagtggtcctttcacctaaatactgcttaaaaaatattaaagtcaattttgcataattagcttaccttacttgttttttattttggggtttgtttgatatgcatgtacatactctgtttttttttttaagtctttccgtgtcattttatgtatatctatcagacattgtagaattagttattttctcataatgtcttaggcttttttcttttgataggaaaatataaatgacatattgat

SEQ ID NO: 186836 - DNA, 601 bp, Human
atgttccccttcctgtgtccatatgttctcattgttcaattcccacctatgagtgagaatatgcggtgtttggttttttgttcttgcgatagtttactgagaatgatgatttccaatttcatccatgtccctacaaaggacatgaactcatcattttttaaaaaaatccctactgtccttattatgtccacttgacctgttgtaagcaggtggaggtgggttgctttcttctgtaattgtgtttgattattgcctacttagacttctaaaggtttttgccatatataacttcttgctgcatttttttttagttatttactcactagatattttgccttttcaaattatgaagtggtcctttcacctaaatactgcttaaaaaatattaaagtcaattttgcataattagcttaccttacttgttttttattttggggtttgtttgatatgcatgtacatactctgtttttttttttaagtctttccgtgtcattttatgtatatctatcagacattgtagaattagttattttctcataatgtcttaggcttttttcttttgataggaaaatataaatgacatattgattaccataattat

SEQ ID NO: 186837 - DNA, 601 bp, Human
tgcggtgtttggttttttgttcttgcgatagtttactgagaatgatgatttccaatttcatccatgtccctacaaaggacatgaactcatcattttttaaaaaaatccctactgtccttattatgtccacttgacctgttgtaagcaggtggaggtgggttgctttcttctgtaattgtgtttgattattgcctacttagacttctaaaggtttttgccatatataacttcttgctgcatttttttttagttatttactcactagatattttgccttttcaaattatgaagtggtcctttyacctaaatactgcttaaaaaatattaaagtcaattttgcataattagcttaccttacttgttttttattttggggtttgtttgatatgcatgtacatactctgtttttttttttaagtctttccgtgtcattttatgtatatctatcagacattgtagaattagttattttctcataatgtcttaggcttttttcttttgataggaaaatataaatgacatattgattaccataattatcatgtttgattttattatttttatctttattttttattactgtttgctttctattctgtat

SEQ ID NO: 186838 - DNA, 601 bp, Human
aggtgggttgctttcttctgtaattgtgtttgattattgcctacttagacttctaaaggtttttgccatatataacttcttgctgcatttttttttagttatttactcactagatattttgccttttcaaattatgaagtggtcctttcacctaaatactgcttaaaaaatattaaagtcaattttgcataattagcttaccttacttgttttttattttggggtttgtttgatatgcatgtacatactctgtttttttttttaagtctttccgtgtcattttatgtatatctatcagacrttgtagaattagttattttctcataatgtcttaggcttttttcttttgataggaaaatataaatgacatattgattaccataattatcatgtttgattttattatttttatctttattttttattactgtttgctttctattctgtattttgcaataaagtccagtttttaaatttttatttatttgtatttgtatttatttatttttttgagatggagtctcgctctgtagcccaggctggagtgcagtggcaccatctcggctcactgcaagctccacctcctgggttcacgccattc

SEQ ID NO: 186839 - DNA, 601 bp, Human
gccaaattaaaataatggatcattttcccacactgaaaaatattctctaggggaatgtctttcaactctagaattttaagctctattcttagtggtttcatatctataaatactgttccttcaagaaggatatgaagcaagctttatttctgtatttctaaaaagtaaaattgaacgttagattattggaacaattatttttactgaattatagtttaaggttagcctttgttatatataatgatttattctgtttaaacaggaaaaatgttaagtccagcctccagctatggtgattaartcatctcagttgctgtgtgacatctacttcttgtttctttccttgctatttaatacttaaagtgtggtgccccacttgtttgccaggagcagtatcacatcagactctgctgttaacaaggtccccaggtgattcatatgcacattaaagttcattttgcacctcttttggcattgactttactttcagtggcctattttatgtaatgtaaaattgtgtaggctgcctccaattattttagaagtaggaaaaggcaaatgtcttttgtgtctgtttgaagtaggctatttctggattaaa

SEQ ID NO: 186840 - DNA, 601 bp, Human
atataatgatttattctgtttaaacaggaaaaatgttaagtccagcctccagctatggtgattaaatcatctcagttgctgtgtgacatctacttcttgtttctttccttgctatttaatacttaaagtgtggtgccccacttgtttgccaggagcagtatcacatcagactctgctgttaacaaggtccccaggtgattcatatgcacattaaagttcattttgcacctcttttggcattgactttactttcagtggcctattttatgtaatgtaaaattgtgtaggctgcctccaattmttttagaagtaggaaaaggcaaatgtcttttgtgtctgtttgaagtaggctatttctggattaaagaaatacacatgcacactcaccggtttgagaaaattcagaaaagtacaaataatttgacacggttaaccctttgttacaatctcaccaatacactacaatgtagcagtctctcgtgaggtatcagccagagttttttgtctcacaaccaagaaaattaaggagcatggacacaaagggtgaggttggagcaaaagtttagtaagtgaaagaagaaagctcttcgaggcagagagc

SEQ ID NO: 186841 - DNA, 601 bp, Human
atgttaagtccagcctccagctatggtgattaaatcatctcagttgctgtgtgacatctacttcttgtttctttccttgctatttaatacttaaagtgtggtgccccacttgtttgccaggagcagtatcacatcagactctgctgttaacaaggtccccaggtgattcatatgcacattaaagttcattttgcacctcttttggcattgactttactttcagtggcctattttatgtaatgtaaaattgtgtaggctgcctccaattattttagaagtaggaaaaggcaaatgtcttttktgtctgtttgaagtaggctatttctggattaaagaaatacacatgcacactcaccggtttgagaaaattcagaaaagtacaaataatttgacacggttaaccctttgttacaatctcaccaatacactacaatgtagcagtctctcgtgaggtatcagccagagttttttgtctcacaaccaagaaaattaaggagcatggacacaaagggtgaggttggagcaaaagtttagtaagtgaaagaagaaagctcttcgaggcagagagcgggcctgaaagagagttgctgtttttatagtt

SEQ ID NO: 186842 - DNA, 601 bp, Human
acaaaagtggatataatacttctcaatattttccattggatctcctctagcaatagggaagggtgatttagaatctctgtgaatctcaggctgtagtccaaagcacccatacattgcacatttgatatttaatttagatgtaatttcttcttgaaaaaaatgtgaatttgtattgcattctgtaatgtataaataatgttgtttattacttatgagtgaaatggacactatctttaagttctatttcagattatgcatttttatgctgtattttcatctctctctctctctctttctttcytcttttatttcttttttatagacaagcttttgctctgtcacccagtctgcagtggagttgtgagagcatagctcactgcagcctcaaacttctaggctcaagacatcctcctgccttagcctcctgagtagctgggactatatagacacatgctgctatgcctgactaattttaattttttaaatgttaatttttaaacttttttcattttttgtaggggtctcactttgttgactcatctcaaactcctgggctcaagcaatcctcagcatcccaaagtgttgggattataggcatgag

SEQ ID NO: 186843 - DNA, 601 bp, Human
caatagggaagggtgatttagaatctctgtgaatctcaggctgtagtccaaagcacccatacattgcacatttgatatttaatttagatgtaatttcttcttgaaaaaaatgtgaatttgtattgcattctgtaatgtataaataatgttgtttattacttatgagtgaaatggacactatctttaagttctatttcagattatgcatttttatgctgtattttcatctctctctctctctctttctttcctcttttatttcttttttatagacaagcttttgctctgtcacccagtctgsagtggagttgtgagagcatagctcactgcagcctcaaacttctaggctcaagacatcctcctgccttagcctcctgagtagctgggactatatagacacatgctgctatgcctgactaattttaattttttaaatgttaatttttaaacttttttcattttttgtaggggtctcactttgttgactcatctcaaactcctgggctcaagcaatcctcagcatcccaaagtgttgggattataggcatgagccattgtgcctggctgtcctgtattttcttaaactccttgtcaaggttta

SEQ ID NO: 186844 - DNA, 601 bp, Human
tgtagtccaaagcacccatacattgcacatttgatatttaatttagatgtaatttcttcttgaaaaaaatgtgaatttgtattgcattctgtaatgtataaataatgttgtttattacttatgagtgaaatggacactatctttaagttctatttcagattatgcatttttatgctgtattttcatctctctctctctctctttctttcctcttttatttcttttttatagacaagcttttgctctgtcacccagtctgcagtggagttgtgagagcatagctcactgcagcctcaaactyctaggctcaagacatcctcctgccttagcctcctgagtagctgggactatatagacacatgctgctatgcctgactaattttaattttttaaatgttaatttttaaacttttttcattttttgtaggggtctcactttgttgactcatctcaaactcctgggctcaagcaatcctcagcatcccaaagtgttgggattataggcatgagccattgtgcctggctgtcctgtattttcttaaactccttgtcaaggtttaagtactccaatatagaagcaaccaaataattgaattgttgc

SEQ ID NO: 186845 - DNA, 601 bp, Human
cttcttgaaaaaaatgtgaatttgtattgcattctgtaatgtataaataatgttgtttattacttatgagtgaaatggacactatctttaagttctatttcagattatgcatttttatgctgtattttcatctctctctctctctctttctttcctcttttatttcttttttatagacaagcttttgctctgtcacccagtctgcagtggagttgtgagagcatagctcactgcagcctcaaacttctaggctcaagacatcctcctgccttagcctcctgagtagctgggactatatagrcacatgctgctatgcctgactaattttaattttttaaatgttaatttttaaacttttttcattttttgtaggggtctcactttgttgactcatctcaaactcctgggctcaagcaatcctcagcatcccaaagtgttgggattataggcatgagccattgtgcctggctgtcctgtattttcttaaactccttgtcaaggtttaagtactccaatatagaagcaaccaaataattgaattgttgctcaaagaaaaaagacttactgtaatgggagataattttccctttgacatcacagc

SEQ ID NO: 186846 - DNA, 601 bp, Human
tctattgtttctgccatataaggtaacattcacaggtttcagggattagggcatggatatctgttgagaggccattttttcagcctaccacactaatctttactctttctgttaatcaattgtgtcactctcctgtcctgtgttacttatctattgccacatatttaaccacccctgcaactcagtggcttaataacaatcatcatttgatttttttcataactctgttggtcagcaatttgggttgggctcagctggaaagttcttcagcaagtcttttctgaattcacttagaagctgyctggttcaagcaggagcttcacttacgtctgactgttggtactagttgtcagccaggccatgtggactcggagttatgattctttgggggcaattaggttaacaattttctgtgtctcctatttttaataattttggaaatccaagtttatacaaaaacattcccacttattggaaaaattctttgcttttttaaacatactttaaaaattattgctgggtgcggtggctcacacctgtaatcccagcactttgggaggccaacacgagtagattgcttgagcccaggagtttgagacca

SEQ ID NO: 186847 - DNA, 601 bp, Human
attcacaggtttcagggattagggcatggatatctgttgagaggccattttttcagcctaccacactaatctttactctttctgttaatcaattgtgtcactctcctgtcctgtgttacttatctattgccacatatttaaccacccctgcaactcagtggcttaataacaatcatcatttgatttttttcataactctgttggtcagcaatttgggttgggctcagctggaaagttcttcagcaagtcttttctgaattcacttagaagctgcctggttcaagcaggagcttcacttacrtctgactgttggtactagttgtcagccaggccatgtggactcggagttatgattctttgggggcaattaggttaacaattttctgtgtctcctatttttaataattttggaaatccaagtttatacaaaaacattcccacttattggaaaaattctttgcttttttaaacatactttaaaaattattgctgggtgcggtggctcacacctgtaatcccagcactttgggaggccaacacgagtagattgcttgagcccaggagtttgagaccagcctgggcaacatggtgaaaccctgtc

SEQ ID NO: 186848 - DNA, 601 bp, Human
gggattagggcatggatatctgttgagaggccattttttcagcctaccacactaatctttactctttctgttaatcaattgtgtcactctcctgtcctgtgttacttatctattgccacatatttaaccacccctgcaactcagtggcttaataacaatcatcatttgatttttttcataactctgttggtcagcaatttgggttgggctcagctggaaagttcttcagcaagtcttttctgaattcacttagaagctgcctggttcaagcaggagcttcacttacgtctgactgttggtrctagttgtcagccaggccatgtggactcggagttatgattctttgggggcaattaggttaacaattttctgtgtctcctatttttaataattttggaaatccaagtttatacaaaaacattcccacttattggaaaaattctttgcttttttaaacatactttaaaaattattgctgggtgcggtggctcacacctgtaatcccagcactttgggaggccaacacgagtagattgcttgagcccaggagtttgagaccagcctgggcaacatggtgaaaccctgtctctacaaaaataca

SEQ ID NO: 186849 - DNA, 601 bp, Human
cagcctaccacactaatctttactctttctgttaatcaattgtgtcactctcctgtcctgtgttacttatctattgccacatatttaaccacccctgcaactcagtggcttaataacaatcatcatttgatttttttcataactctgttggtcagcaatttgggttgggctcagctggaaagttcttcagcaagtcttttctgaattcacttagaagctgcctggttcaagcaggagcttcacttacgtctgactgttggtactagttgtcagccaggccatgtggactcggagttatgaytctttgggggcaattaggttaacaattttctgtgtctcctatttttaataattttggaaatccaagtttatacaaaaacattcccacttattggaaaaattctttgcttttttaaacatactttaaaaattattgctgggtgcggtggctcacacctgtaatcccagcactttgggaggccaacacgagtagattgcttgagcccaggagtttgagaccagcctgggcaacatggtgaaaccctgtctctacaaaaatacaagaattgggcaggcatggtggtgggcacctgtagtccca

SEQ ID NO: 186850 - DNA, 601 bp, Human
acttcaggaaaagaaaaaaaatgagacaatgatttaagttaaatgtttgaatttagacaccaaggttgaagaatgctggcacagtccagaggaaatgaatgatggaatgggactctggacaaggcctctgccaccacctcagtattactgaccttacctttccaggagaagctctgacctcggtggttgctcatgaccagatttctgctcttgtcttttccaataaactcgtctcacctggatggagactttgtgatcatacctaagacagttcttcagcagcctgagccccattcctagrgactttccaatgtgtcctctgccttttgcctttcttatcatagatctcctgatactgacctataagctgcattttactaaggttcaggagctgtgtggtttgagttaccttcacacctatcactgcctgtgctggtaaggcttcctgtcttaatgtgatacctccgttttccactgtccacacgtacgtgatgccacctgggttagcctggcatttgtttttacatctgctttctcccactccagctataggttaggtgtgttagtactacaaaattgatcttgcgaaaaaggcgaaagg

SEQ ID NO: 186851 - DNA, 601 bp, Human
agttcttcagcagcctgagccccattcctagagactttccaatgtgtcctctgccttttgcctttcttatcatagatctcctgatactgacctataagctgcattttactaaggttcaggagctgtgtggtttgagttaccttcacacctatcactgcctgtgctggtaaggcttcctgtcttaatgtgatacctccgttttccactgtccacacgtacgtgatgccacctgggttagcctggcatttgtttttacatctgctttctcccactccagctataggttaggtgtgttagtacwacaaaattgatcttgcgaaaaaggcgaaaggaccggcagaactgacgtccttttgtacatgagaggaaaggagaaagggagagagggcagaaattatgtttagggcacaaactatgtttagggcactaggccaggtagtttccatatagactctcactttatatagctctctaggaagcaggtgtgaatagctcccttaagtaaggacacatagttaataatagggggagattttctgaaaaagaccaggcattttccaccacaacttgctgcttcctgatgagtttggaacatccccag

SEQ ID NO: 186852 - DNA, 601 bp, Human
agccccattcctagagactttccaatgtgtcctctgccttttgcctttcttatcatagatctcctgatactgacctataagctgcattttactaaggttcaggagctgtgtggtttgagttaccttcacacctatcactgcctgtgctggtaaggcttcctgtcttaatgtgatacctccgttttccactgtccacacgtacgtgatgccacctgggttagcctggcatttgtttttacatctgctttctcccactccagctataggttaggtgtgttagtactacaaaattgatcttgcraaaaaggcgaaaggaccggcagaactgacgtccttttgtacatgagaggaaaggagaaagggagagagggcagaaattatgtttagggcacaaactatgtttagggcactaggccaggtagtttccatatagactctcactttatatagctctctaggaagcaggtgtgaatagctcccttaagtaaggacacatagttaataatagggggagattttctgaaaaagaccaggcattttccaccacaacttgctgcttcctgatgagtttggaacatccccagtggacagattctggttt

SEQ ID NO: 186853 - DNA, 601 bp, Human
atgtttagggcactaggccaggtagtttccatatagactctcactttatatagctctctaggaagcaggtgtgaatagctcccttaagtaaggacacatagttaataatagggggagattttctgaaaaagaccaggcattttccaccacaacttgctgcttcctgatgagtttggaacatccccagtggacagattctggttttttctgtatatattatataatcatggtaattgaaattaagtactgaagaacttttggaactttttggcagagatatctgaaagctgatttgattttygttgaagtatgaagacagtaaaatatggtaaagtgtgataaggagccacagagtaataaaaatagctaaatgtatgagaaaagatctgaagggaaggaagaatattaaaggctttacagaataaagcagacattcctatgtgtgttaatagagaacataggtaacaagacaagagagatgagtgtagtagatgggaaaacaaaaacatctctttcttttcctcttaccccaccctacaccccaattaaaaaaaaaacccaccaccaaatgaaacaatccatgtaagacaagcaatattaa

SEQ ID NO: 186854 - DNA, 601 bp, Human
aagacaaagacactcccaaaacatatttcaagtactcagaaaatgaaaagctgatgggtgaagcaagacctatttgcccttgtctctcttcataccatgttttgtgagcatagctacattcttgccattgtgccgggcactgatgacggatgtgctaggcaagaagacactgcacaaagagctgaaaagaattgcaggattttaaaatcatttttgtgtgtgtgtgtgagacagggtcttgctctgttgcccaggctggagtgcagtggcacaatctcagctcaccgtagcctccacctcycaggctcaaataatcctcccacctcagcctccccattagctgggactacaggtgtgtgccaccatgcctggctaagttttttaatttttttgtagagatggcgtttcactattgcccaggctggtttcgaactcctgggctcaagcaattctcctgccttggcctcccaaagtgctgggattatagacatgagccaccatgcctggtgaattaaataatttttaataaaacttttcaatagtcacaacaatttcagagagtagcgtaagaatgtgagtatcctccttttccctcagtaat

SEQ ID NO: 186855 - DNA, 601 bp, Human
tttttcttttggcatcttactttcagcacctaaagaactcggtggaacgatgagcactaatatggcacctggcacattgagcactgtatttaataagcttttgatggatatgaggttctggaagtaagaaagagggaagctgccagtgtgaagggtatatgcaggaagaggagctaccacaatacctggtagttgagtgcgtgataacacaacatctgccatagcttggtttgtttgacccctccaaatctcatgttgaaatttgacccttagtgttggagatggggcctaatgggaggtrtttatgtcatgggggcagatccctggtgaatgtcttagtgccatccttactgtaatgagtgagttttgctcttagtcccctcaaaacctgttgttaaaaaaaagcctggcacctcccttcttttgctctggctttctctctcaccatatgatctctgcacatgctggctcccctcaccttctgccatgagtggaagcagcctgaagccctcaccagaagcagatgctggtggcatgcttcttgtgcagcctgcaaaaccatgagctgaataaacctcttgtctttatgaattacccagcc

SEQ ID NO: 186856 - DNA, 601 bp, Human
aaatctcatgttgaaatttgacccttagtgttggagatggggcctaatgggaggtatttatgtcatgggggcagatccctggtgaatgtcttagtgccatccttactgtaatgagtgagttttgctcttagtcccctcaaaacctgttgttaaaaaaaagcctggcacctcccttcttttgctctggctttctctctcaccatatgatctctgcacatgctggctcccctcaccttctgccatgagtggaagcagcctgaagccctcaccagaagcagatgctggtggcatgcttcttgtrcagcctgcaaaaccatgagctgaataaacctcttgtctttatgaattacccagcctcaagtattcctttatagcaacacaaatggactaagataacatctttgaagctagtttgccaaagttataggaaaaaagatggaaaagcaagagtctcaaataagttatacagcctcaatgaaatgataaaggaccatgactttgcatataatggctttctgagaaagttgaaatgctaatgcctttcaggctacagaaaaactgactttggaaaagaattcagagaagcaaaagaagaagagat

SEQ ID NO: 186857 - DNA, 601 bp, Human
tatgtcatgggggcagatccctggtgaatgtcttagtgccatccttactgtaatgagtgagttttgctcttagtcccctcaaaacctgttgttaaaaaaaagcctggcacctcccttcttttgctctggctttctctctcaccatatgatctctgcacatgctggctcccctcaccttctgccatgagtggaagcagcctgaagccctcaccagaagcagatgctggtggcatgcttcttgtgcagcctgcaaaaccatgagctgaataaacctcttgtctttatgaattacccagcctcragtattcctttatagcaacacaaatggactaagataacatctttgaagctagtttgccaaagttataggaaaaaagatggaaaagcaagagtctcaaataagttatacagcctcaatgaaatgataaaggaccatgactttgcatataatggctttctgagaaagttgaaatgctaatgcctttcaggctacagaaaaactgactttggaaaagaattcagagaagcaaaagaagaagagatgaaagcttgagtttgtgtttataagagcagatatgtaaccaatttattagtggaacat

SEQ ID NO: 186858 - DNA, 601 bp, Human
attcagagaagcaaaagaagaagagatgaaagcttgagtttgtgtttataagagcagatatgtaaccaatttattagtggaacatgttatgggttattatatcataggaaaataattataaatatgatgtaaaatattaattcctgaaagttttggaaagtaaaatagaattttttctgtgtaataagttagtataattcttagccaggatatgaggactatgacctcttatgtgcttttgtagttctgtgattccataaaagatgtagaagggaagtaaaaaataacattacacataaayttgaacatgttttgtttatcgtatataataatacgtgtgctgacatttatttactttatgtttcttgtacattttaaatatcaatccatgccattttatagcaaaatctttgattcttcacttcctgttgtgaatcagttccaagaaggctttaccctatcactccattaaagactataatcttcatcactgtttagatcaccagtggccaccttctggctaaatacagtagtaattggacacacagttgaccctacggaccatgctttccttcatagaacactttttaacctggttgcc

SEQ ID NO: 186859 - DNA, 601 bp, Human
ggattacccagtgaagtctaggtgcttatatatccttcttcatagggaagtgtgaaagtgagatcctggggaactagtcatgaggactgctgttctctatgttgtctcctttctcagacaggtccttctctcagaagaataaattcccacaaaagtccttaattgagtgttattggtctggctggggtcacatgctcatatctgaaacagttgctgaggtcagagatgaagaatagtgattctaagccctgggtcagatggactgagagtgaagaagaaaatcatgatgccgtgcctcaaygcaggagaaattaattctggtccagcaaaagcttcacatgtcccctctggacaccatttaagtaatattttcagcatattttttcagagcctgcatcctgtattaaatcagctctgttctgtcattgtcccagatcctgtatctgcaactgagtttcttgttgtcaaagggaatggaagttgaaaggggattaaagtgaaaccctttgggtcaaacacttattaaacagcagctcaggcagtctgccagatcctgaagagataaagatgaagagggaaggcacagttgtggctcttgaga

SEQ ID NO: 186860 - DNA, 601 bp, Human
tgcttatatatccttcttcatagggaagtgtgaaagtgagatcctggggaactagtcatgaggactgctgttctctatgttgtctcctttctcagacaggtccttctctcagaagaataaattcccacaaaagtccttaattgagtgttattggtctggctggggtcacatgctcatatctgaaacagttgctgaggtcagagatgaagaatagtgattctaagccctgggtcagatggactgagagtgaagaagaaaatcatgatgccgtgcctcaatgcaggagaaattaattctggtycagcaaaagcttcacatgtcccctctggacaccatttaagtaatattttcagcatattttttcagagcctgcatcctgtattaaatcagctctgttctgtcattgtcccagatcctgtatctgcaactgagtttcttgttgtcaaagggaatggaagttgaaaggggattaaagtgaaaccctttgggtcaaacacttattaaacagcagctcaggcagtctgccagatcctgaagagataaagatgaagagggaaggcacagttgtggctcttgagatcattatatctaatgacctcaa

SEQ ID NO: 186861 - DNA, 601 bp, Human
tctatgttgtctcctttctcagacaggtccttctctcagaagaataaattcccacaaaagtccttaattgagtgttattggtctggctggggtcacatgctcatatctgaaacagttgctgaggtcagagatgaagaatagtgattctaagccctgggtcagatggactgagagtgaagaagaaaatcatgatgccgtgcctcaatgcaggagaaattaattctggtccagcaaaagcttcacatgtcccctctggacaccatttaagtaatattttcagcatattttttcagagcctgcrtcctgtattaaatcagctctgttctgtcattgtcccagatcctgtatctgcaactgagtttcttgttgtcaaagggaatggaagttgaaaggggattaaagtgaaaccctttgggtcaaacacttattaaacagcagctcaggcagtctgccagatcctgaagagataaagatgaagagggaaggcacagttgtggctcttgagatcattatatctaatgacctcaattagatataatgaaatgaggacatataaatatgcaaattcaggacaatataatatttgctatgatatcctcat

SEQ ID NO: 186862 - DNA, 601 bp, Human
agacaggtccttctctcagaagaataaattcccacaaaagtccttaattgagtgttattggtctggctggggtcacatgctcatatctgaaacagttgctgaggtcagagatgaagaatagtgattctaagccctgggtcagatggactgagagtgaagaagaaaatcatgatgccgtgcctcaatgcaggagaaattaattctggtccagcaaaagcttcacatgtcccctctggacaccatttaagtaatattttcagcatattttttcagagcctgcatcctgtattaaatcagctcygttctgtcattgtcccagatcctgtatctgcaactgagtttcttgttgtcaaagggaatggaagttgaaaggggattaaagtgaaaccctttgggtcaaacacttattaaacagcagctcaggcagtctgccagatcctgaagagataaagatgaagagggaaggcacagttgtggctcttgagatcattatatctaatgacctcaattagatataatgaaatgaggacatataaatatgcaaattcaggacaatataatatttgctatgatatcctcatgcattgggtatgatgggagg

SEQ ID NO: 186863 - DNA, 601 bp, Human
tctgcaactgagtttcttgttgtcaaagggaatggaagttgaaaggggattaaagtgaaaccctttgggtcaaacacttattaaacagcagctcaggcagtctgccagatcctgaagagataaagatgaagagggaaggcacagttgtggctcttgagatcattatatctaatgacctcaattagatataatgaaatgaggacatataaatatgcaaattcaggacaatataatatttgctatgatatcctcatgcattgggtatgatgggaggaaagacagtcagccaatctgggagcartctgggagcagagtgtggggtgtggagagaattcagggaaggtgttctagaggagctaacatctgagctgaatcttgaagtttgagtaagagtttctggatgtagaaggggaggcatctaggcagaaggaacagaatgaacgcacatatggagaggagacagagcatggtgtgtgacgagctgctgataatttaacattgcttcaggatgaggtgtgaatcagaaagtgtctggaggggtggaagagactagatgttggcactcaacataagttgcctagtgtttagattaagttcagat

SEQ ID NO: 186864 - DNA, 601 bp, Human
tcttgttgtcaaagggaatggaagttgaaaggggattaaagtgaaaccctttgggtcaaacacttattaaacagcagctcaggcagtctgccagatcctgaagagataaagatgaagagggaaggcacagttgtggctcttgagatcattatatctaatgacctcaattagatataatgaaatgaggacatataaatatgcaaattcaggacaatataatatttgctatgatatcctcatgcattgggtatgatgggaggaaagacagtcagccaatctgggagcaatctgggagcagagygtggggtgtggagagaattcagggaaggtgttctagaggagctaacatctgagctgaatcttgaagtttgagtaagagtttctggatgtagaaggggaggcatctaggcagaaggaacagaatgaacgcacatatggagaggagacagagcatggtgtgtgacgagctgctgataatttaacattgcttcaggatgaggtgtgaatcagaaagtgtctggaggggtggaagagactagatgttggcactcaacataagttgcctagtgtttagattaagttcagatatgaatgaatttag

SEQ ID NO: 186865 - DNA, 601 bp, Human
aaacagcagctcaggcagtctgccagatcctgaagagataaagatgaagagggaaggcacagttgtggctcttgagatcattatatctaatgacctcaattagatataatgaaatgaggacatataaatatgcaaattcaggacaatataatatttgctatgatatcctcatgcattgggtatgatgggaggaaagacagtcagccaatctgggagcaatctgggagcagagtgtggggtgtggagagaattcagggaaggtgttctagaggagctaacatctgagctgaatcttgaagtwtgagtaagagtttctggatgtagaaggggaggcatctaggcagaaggaacagaatgaacgcacatatggagaggagacagagcatggtgtgtgacgagctgctgataatttaacattgcttcaggatgaggtgtgaatcagaaagtgtctggaggggtggaagagactagatgttggcactcaacataagttgcctagtgtttagattaagttcagatatgaatgaatttagactttatcctgtgagaattaaggagatcttgaaggcgcttacttaggggaaggatatctgtggatgaa

SEQ ID NO: 186866 - DNA, 601 bp, Human
gaagagactagatgttggcactcaacataagttgcctagtgtttagattaagttcagatatgaatgaatttagactttatcctgtgagaattaaggagatcttgaaggcgcttacttaggggaaggatatctgtggatgaatattttagaaaaatcactctggcgattgtgtggaggaggcaagatcagttctggaggtgggaggacagacagtttaggagactattttaacagacccagtgggagatgatgagggtagtggatgggagaatgttcagaagggaatgagtatgagcaataytggcgaagtttgataaatggagttatgtgagggagttgttttgcagcacggggctttcctggatatgagtcctcaggttaggaaggccattttggtctagagaaagtgacaggtatatttggtagtacaaaaaagcctttgaggaaagagtaggggaaacaattggtcatctatccttctttatttgaggcacaatttccccctccattggtgtattttatcaacatgtattcattgagaatctcctatatgattgtcactgtgctgagattctaactatgaacaaagcgatcataaccc

SEQ ID NO: 186867 - DNA, 601 bp, Human
gacagtttaggagactattttaacagacccagtgggagatgatgagggtagtggatgggagaatgttcagaagggaatgagtatgagcaatactggcgaagtttgataaatggagttatgtgagggagttgttttgcagcacggggctttcctggatatgagtcctcaggttaggaaggccattttggtctagagaaagtgacaggtatatttggtagtacaaaaaagcctttgaggaaagagtaggggaaacaattggtcatctatccttctttatttgaggcacaatttccccctccaytggtgtattttatcaacatgtattcattgagaatctcctatatgattgtcactgtgctgagattctaactatgaacaaagcgatcataacccttgctcctgggtcctacagtttagtgggaaagacaaatggataatttgaatgggtcatttcaaacacgatgagtgttacaaagtcactaaaattaacatggttttaaaaagatgaaacagatctaatgcagtggaagagttcatcgtgacttccaggctagtgggtagtaaggattgtaaaggctaatgccagcttctttgactgggg

SEQ ID NO: 186868 - DNA, 601 bp, Human
gatgatgagggtagtggatgggagaatgttcagaagggaatgagtatgagcaatactggcgaagtttgataaatggagttatgtgagggagttgttttgcagcacggggctttcctggatatgagtcctcaggttaggaaggccattttggtctagagaaagtgacaggtatatttggtagtacaaaaaagcctttgaggaaagagtaggggaaacaattggtcatctatccttctttatttgaggcacaatttccccctccattggtgtattttatcaacatgtattcattgagaatctyctatatgattgtcactgtgctgagattctaactatgaacaaagcgatcataacccttgctcctgggtcctacagtttagtgggaaagacaaatggataatttgaatgggtcatttcaaacacgatgagtgttacaaagtcactaaaattaacatggttttaaaaagatgaaacagatctaatgcagtggaagagttcatcgtgacttccaggctagtgggtagtaaggattgtaaaggctaatgccagcttctttgactggggcaatactttatatggactgattttggatttcttggca

SEQ ID NO: 186869 - DNA, 601 bp, Human
atctggagaatgaagcaatttgaggaagtggctcctatagatcctgaactccttaacaggccagattaatagcacttggtggaccttggctttcctgtgacatagtacgtcccagtgactccatttgctacagagtggagccatcatttgaatttccatcacggcctgtctctggagcagaccactgtggtactggggttttgggggctctctcaagccagcttcatagactcgctaaccttattttacaagtagcattctagaaccagtcattataactttcagggtgggcattttccaygagatcctggttccaattacgcctaattatttgttatgtcctatttgggttttctttttacagatctttaagaaattttcctttggctctgagttgagtcaaaatgttgagttcaactttcatcctaagcaagatagagggcatgaattatggttgaggacttatgcatattttgaccaaatgaaaatgaccactgttgctccagcccaattgctgctactctagattgtgaatgcagatatagtcaaaatgactttggtaaatgcttctaatcatgactgattatctttttggctggta

SEQ ID NO: 186870 - DNA, 601 bp, Human
attatggttgaggacttatgcatattttgaccaaatgaaaatgaccactgttgctccagcccaattgctgctactctagattgtgaatgcagatatagtcaaaatgactttggtaaatgcttctaatcatgactgattatctttttggctggtagaggaagtaggaatgcattcatattttgtatgaaaggtagcgttctttttgtaaattcttgctatttaaataactttttgggtttgtcaaaaccttttcaaatttttccagttaaagtttcttcctacagcaagacggtgagtttgttttttttttttgttttttttttgtttttttttttttgagacagggtctagctctgtcacccaggctggagtgcaggagtgtgatcatggctgactgcagccttgaacttctgggctcaagcaatcctcccaccttggcctcctgagtagctgggactacaggtggatgctaccatgcccagctaattttgtaattcttttgtacagacagagtcttgcgatgttgcccaggctagtcttgaactcctcggttcaagtgatcctcctgcctcagcctctcaaagtgttgggattacaggca

SEQ ID NO: 186871 - DNA, 601 bp, Human
tggggtttggatcatttttgagggttccctgggaatcatgcgaaggggcaggcagtagccattggagatttctcctttgtagaagccacagcacagcatagggcaaatggcatttgctgagtagcttctcctttttcttctctttcttctctgtctcctctccttctcatctccctattccaacatcctatcaaattgctaattctgtggagcatttattaaatgccagccactattctaaggtcctttaatagattatttcatcttcccagtgattctattgtattgctttgctaaggcyaccataacaaaataccacagactgggtagctttaaccacaaacatttattttttcacagttctggagactggaagtctgagatcaaaggcaggcaggtttgttttctcctgaggcctctctccttggcttgcagatggccgcctcctcactgtatcctcacatggccctttctgtgtatctgcatcactagtgtctctttctgtgtccaattttctcttcttataaggacaccagtcaggttggattaggtgcatcccaatagcctcattttaacttaactgcctatgtaaaggccttat

SEQ ID NO: 186872 - DNA, 601 bp, Human
gaaactgaggcatggagtaaccttgcccaaagtttaacagctggtaaatgatgtaacacagatagacatctcaccagtctgacttcaaagcttgcatttttaaccattagaaggggtactgcattttcttaaattggcaacacatttgggtttgaaactaattagaaaaagatatcattgaccaggcgcagtggctcacgcctgtaatcctaacactttgggaggccaaggcaggcgaattgcctgagctcaggcattcgagaccagcctgggcaacatgatgaaaccacatctctactgaaaaaaaaaaattaaaaaagaaaagaaaaagatatcaccatgagaggtagatcattgcagcattggaggtgatctgcctccccaggtggggagactgtgtacagctattgctgccccagcttctgccgttcttcatatgcttgtcaactgcactgtctccaaagttcctaccagctcagccatattcttcctccctgccctcaatgcgtcttccccagttttatctgggagtgaaacttgtggtggttagagagattcatcttgggctgtggcaatcttcagttgcacaaaccgtgtgaat

SEQ ID NO: 186873 - DNA, 601 bp, Human
tcccaggtagctaggattacaggcatgcaccaccacacttggctaatttttgtatttttatagacacgaggttttgccctgttggctgggctggtctcgaactcatgacctcatgtgatctgcccgcctcgaactcccaaagtgctgggtgtacatgtgtgagctattctctttcttctaaaaatatgtaaatttattttccctttttttgttttttttttcttttaggcacagcagaatttattctactttattggtatttttttgttttattggtgttatttatccttcataccgcatmtttaattgttttttaaaatactaatttcgcttttagcttttaaaatttctactcctaccttcttttggctggttttggtattttctttgaatttgaaaaaatgaaagaaatgacaaagaaagttaacagcttttaaaaataatggcaataacaagttagatacagaagtagaaaaatgttcttttcacaattgtatagccaggaatagatttaacaaaaaaggtgcaactcccacatgaagaaagatgtacttattgacaggacttgaataaatacaaattaaattcacaagaagatgta

SEQ ID NO: 186874 - DNA, 601 bp, Human
cagaatttattctactttattggtatttttttgttttattggtgttatttatccttcataccgcatatttaattgttttttaaaatactaatttcgcttttagcttttaaaatttctactcctaccttcttttggctggttttggtattttctttgaatttgaaaaaatgaaagaaatgacaaagaaagttaacagcttttaaaaataatggcaataacaagttagatacagaagtagaaaaatgttcttttcacaattgtatagccaggaatagatttaacaaaaaaggtgcaactcccrcatgaagaaagatgtacttattgacaggacttgaataaatacaaattaaattcacaagaagatgtaaaatcatgaaaataacagttcttccaaaattaatatttgacttaataaaattccaaccagaattttatttttttaagcaaaaatattattttcggttcatttgaaataataaatgttttagaattccagaaaatatgttagaaaagagacttatattggagcactagtcctactggctattaatacatggttctaagattcttttagcaaaacagcttgatatgaagtctggaa

SEQ ID NO: 186875 - DNA, 601 bp, Human
ttaagaaatatttttatggccaggagtggtggctcacacctgtaatcccagcactttgggagaccgaggcgggcagattacctgaggtcaggatttcaagaccagcctggccaacatggcgaaaccccgtctctactaaaaatacaaaaattagccaggcgtggtggcgcatgcctgtaatcccagctacttgggaggctgaggcaggagaatcacttgaatccaggaggcagaggttgaggtgagctgagatcacgccactgcactccagcctgggcgacagagggagactctgtctttaaaaaaaaaaaaagaaaagaaaagaaaagaaaagaaatatctttattttttcagtaacaaattaaccttagcttacagtaactttttttacattataaatttaaaattttttgactcttttgtaatcacacagcttaaaacacagaagcattctatagctgtacaaaaatcttttctttctcttatatcctattctataagcctttttgtattttaaaaatttttgtatttttctactttttaaattctttttttaaaaaaacaaggacacaaacacacagattaacctaggcctacacag

SEQ ID NO: 186876 - DNA, 601 bp, Human
acacccatagcaatgggctgccttactgtgtcatttttgatcgtcagtccactatccagtgaattattgcatattcataagctagaatgtggacagtcagggaaggccagcatggaagaggtaaacacctgaaacttgattatggagacagagtcagagggtagtgatgttctttggttgtggtgctacatcgtgggttgctgagttccagtactgctgtgaataagctctgtggtataggggaagatatttaaactcctgatgccctaggttttctcatctgtaaaacgcagatgaaaakagttcctacttcttagcgtgtgtttgtgtgcacacaggcacatgcacctgtgtgtatttgagtgtatattaaatgaattaatacacagcccttggaaaagtccccaccacagggtaagcccaaaagtacatgaaggccattattatgattatcaagaccaatcctcagattctaggtctaataagatagtttacttttggcatgattagcctatgattaccaatgtcataatgctaatgcctgcatttataccatgagtttaaagaaggataagatcaggtcgaggttaataaccatttg

SEQ ID NO: 186877 - DNA, 601 bp, Human
acttttggcatgattagcctatgattaccaatgtcataatgctaatgcctgcatttataccatgagtttaaagaaggataagatcaggtcgaggttaataaccatttgaattctgacatgtttgtgacacaataatgttcacgggtgacaccaaaaatgttgaattataatttgctttcttgaatcccggtttattttaggaggggcctaattttttgtgtgactcctgttaattttcatgactgtccttgttgctctgttgtctgtgtcttttcctgtcttggatgttggggagatgagygatatgtagataggagaggtgagtgtgagggcagaagtgtggttggttgagtgttgaagagagagtaacagacccgtaaagaaaaccacagtatttcctacccttgatgctgagatatgcgatgaatatatctatctgttgatagagctgtttaggtttttgtttatttgtttgggtttcgtgcaatttcatgtaaaatttttctggtaattttttgttatttaattatcttcccagaagagaaattcttttttttttctgggtttggggcacattgctttatctttttctgagttgtta

SEQ ID NO: 186878 - DNA, 601 bp, Human
gttgacattttgagatagtagataaagtttacttgggacacacatgaaattaaaggtgattcgttagtgtttagtaactgtctttatttcttcatttttttgttttatattttatttagcaaaacatcttaatattatttttagtttggagtgtttgtagaatatttaaataaacattaaaaaattcctaagggaagggacaggtgaaatactaatacaaacaaaaactgttacaaaatcagaaatgtcaagattttggggggctactgtgtatctgtttatctacttgatcttatatgcrattttgtctttcatttcattactcttcttcattgggaagaaaaaatcctctcaaggtcctatctcagtccctgaagaaataaataaaaaagagtagcagaagatggatgagattgagtgggaggtaaaattagaatggttgcaatcagtaaaaatcttgaaagtactttagtgagagaaccataaacaaaatatgatagtgcatatcctataagatccatgattactcataatttattcacaagtacattaaaaatgtaaaaccatgcataattatttaatgtataattaaaatttaaat

SEQ ID NO: 186879 - DNA, 601 bp, Human
gaggttttattattatttatttatttatttatttatttacttgagacagagtctcgctccgttgcccaggctggagtgcagtggtgcgatctctgttcactgcaacctccacctcccaggttcaagtgattctcctgcctcagcctcctgagtagctgggattacaggcacatgccaccacggctggctaatttttgaatttttagtacagacggggtttcaccatgttggtcaggctggtctcaaactcctgaccttgtgatccacccgcctcggcctcccaaagtgctgggattacagkcgtgagccactgtgctcggcccagaagaggttttaagaagacaatttacagaaaagaaaaccgaggctaggggttattgttcaaggttaaatatacaatgttagttctgaaatcaaacccaagtttgtctcccctaagccacgtaccgcccccccaacccccgttttttttttcgttttttttaaacaatactatattgctacatgccactttggtcctcttgcagtaaggaagggcatataaaagtgccctgtttgtctgggatcagaaaacaagcctgtgtaggcccagagagacaaa

SEQ ID NO: 186880 - DNA, 601 bp, Human
caccacggctggctaatttttgaatttttagtacagacggggtttcaccatgttggtcaggctggtctcaaactcctgaccttgtgatccacccgcctcggcctcccaaagtgctgggattacagtcgtgagccactgtgctcggcccagaagaggttttaagaagacaatttacagaaaagaaaaccgaggctaggggttattgttcaaggttaaatatacaatgttagttctgaaatcaaacccaagtttgtctcccctaagccacgtaccgcccccccaacccccgttttttttttcrttttttttaaacaatactatattgctacatgccactttggtcctcttgcagtaaggaagggcatataaaagtgccctgtttgtctgggatcagaaaacaagcctgtgtaggcccagagagacaaatatggcttgttgtcacatgtgtgcaagagctaaagtggatctcacagaaggagagggcagaatgatagatactagaggttgggaagggaaggtgagaatgaggagaagttagttaatggacacagttagctagaagaaataagttctaatattcaacactaccgtcggtaaatta

SEQ ID NO: 186881 - DNA, 601 bp, Human
ttgttcaaggttaaatatacaatgttagttctgaaatcaaacccaagtttgtctcccctaagccacgtaccgcccccccaacccccgttttttttttcgttttttttaaacaatactatattgctacatgccactttggtcctcttgcagtaaggaagggcatataaaagtgccctgtttgtctgggatcagaaaacaagcctgtgtaggcccagagagacaaatatggcttgttgtcacatgtgtgcaagagctaaagtggatctcacagaaggagagggcagaatgatagatactagasgttgggaagggaaggtgagaatgaggagaagttagttaatggacacagttagctagaagaaataagttctaatattcaacactaccgtcggtaaattatatgtaataatttattgtgcatttcaaaatagctagaagagaagaattgcaatgtttccagcacaaagaaaagataaatgtttgaggtgatggatatcctagttacccaaattcgatcattgcatattgtatacatgtatcaaaatatcacatgtatgtataattatatatttatgtacaactatgatataccattaaaaaa

SEQ ID NO: 186882 - DNA, 601 bp, Human
ctaccgtcggtaaattatatgtaataatttattgtgcatttcaaaatagctagaagagaagaattgcaatgtttccagcacaaagaaaagataaatgtttgaggtgatggatatcctagttacccaaattcgatcattgcatattgtatacatgtatcaaaatatcacatgtatgtataattatatatttatgtacaactatgatataccattaaaaaaagaaaataaacctgtgtataggcatatgctgatatttattgtgactcttatttctgttttctgattctgacttataaatgtstagaataaggttctttaaatttgtaaaatctttgtacatttttgtgatttgttttttgggttttttttgcaaatgtgggggaagatcattcatagttttgtttaaattgaattttcaaaaaaggccataacccacaaattgttaagagccatcccctaactcagcctgtaccttcatggccctcagctgttgaaattcccaccagtctgctggcatcattgcatccctcccaattactagattttcccagtgccttcttcccagatcattccttctcaatcctgccctggcatcagaatc

SEQ ID NO: 186883 - DNA, 601 bp, Human
cacctcggcctcccaaagtgctaggatgaaggcatgagccaccatgcctggccaattttcttattttctttctttctcattttctttccttctttttctttctttttccttccttccttccttccttctttccttccttccttccttcctttctctctctctctctctttctttctttctctctctctttctttctttctttttcagggtctcactctgtcacccaggctgagtgcagtagcatgatcatggctcactgcagtctcaacctcccaggctcaggtgatcctcccacctcagkctcctgagtagctggaaccacaggcttgcaccaccatgcccagctaatttttaaattttttgtagagacagggttttgccatgttgcccaggttggtctcaaactcctaggctcaagtgatcctcccgccttggtttcccaaagtgctgagattacaggcatgagccaccacacccagcttcaattttctttacaaactttgaacaaaaggagatacttcatgaacgtcctcttgtggaatgatctcctggagggagacccaaagcagcccagtcctcccacaagagactcatcatcatc

SEQ ID NO: 186884 - DNA, 601 bp, Human
atgcataattaagattacaaaatgattctgtaatatgtctctgcagaataattctgtaatatattccatcttgactgcccattaaaaatcagatgaagtgagatttcacttttaagatatcatgttgatttggttgttttctaaatttcactctgaaggaagaagcaagaagagagaatataatgctgtcatttcttttgcaatcattttttgttcctttgccttttcttggtttcctttctccacttttttctttactttttcctcatttcttctgtaagtgagtaatctgtttttgtarccatcctaccccctcgtgttgtttattggacccctggtgacttgcatttcctttaggaatatgcccagcatttttaggctgctaaaatatgagccaattaatgatgttcttattgacgaggtctaggaaacttgtagggttcagtttctgcaagaatgatttacagtctataataggttagaatgtcaaacaaggggaaacaattagtagcactaatgttttaaccccaggtttatcactgagggaggatcattgatgaagaggcccatctgttccaaagatgtttccaacttgcttgta

SEQ ID NO: 186885 - DNA, 601 bp, Human
tggacccctggtgacttgcatttcctttaggaatatgcccagcatttttaggctgctaaaatatgagccaattaatgatgttcttattgacgaggtctaggaaacttgtagggttcagtttctgcaagaatgatttacagtctataataggttagaatgtcaaacaaggggaaacaattagtagcactaatgttttaaccccaggtttatcactgagggaggatcattgatgaagaggcccatctgttccaaagatgtttccaacttgcttgtatagcagtttgtaaatcaaatcagtgcrgtgattgtgaggcttatatagccacttgtttgtcaatttttaaaaatcactgcttttgtgcacatttcatcatgatatctttgaaaaatggggttttacctgtggaaattacactattgtttttcagcattatgttcagtttattacatgtaccaggaacacgtgttttgaaattgtcaccagctccaagaattatgtaatcagtgagttaaatatataacttccaaatgaattagtgcacctatattttggcaaaaatttgttgttggaggaagaatagattcatcccagagtaagttt

SEQ ID NO: 186886 - DNA, 601 bp, Human
cagcactttgggagggctgggtgggggggggcggggcagatcatgaggtcaggaggagttcgagaccagcttggccaatatggtgaaaccctgtctgtactaaaaatacaaaaattagctgggtgtggtggcgtgcgcctgtactcccagctactcaggaggctgaggcagaagaattgcttgaacctaggaggcgggactgcagtgagccgagattgtgccactgcactccagcctgggcaacagagtgagactctgtctcaaaaaaaaaaaaaaaaaaaaaggaaaatgaattagtgargaaagtaagatgatgtaaaaacaaccatccccagtgtcctgagggtagtgcttctagccgctttccccgctcccccaccccgttgctaggagagagatgagttaacacacagggacgtgtacattataccagccggatccacatacctggcagctgcaacctgttaaacctgtgtttttttcttctgtgtaaacactataaacaggaaggcaaacgtcatccatttacgcagaagagaaaattgatgatgaaaaactgtcactgctttgcttaaaaaagtctaaggtaaagaacgtattg

SEQ ID NO: 186887 - DNA, 601 bp, Human
tgtttttttcttctgtgtaaacactataaacaggaaggcaaacgtcatccatttacgcagaagagaaaattgatgatgaaaaactgtcactgctttgcttaaaaaagtctaaggtaaagaacgtattgactcagagagggccattcaaaatctaaagtcttcaattttattgctatttctgtattaaggattctgaaggcaaaatttcttcagaatctgttgtttagactttacaacaaaaatagctttggggagctgcttgcctggagaggttttgtggtgactatggaaattaatcttsttgatgggaaatcagctgttcaccatactgctgccttcattcccaaagaagagtttccattcctacctggaatggctagagcctgttggctagagcaatgagccattgaggcctcctgatattccacccgggtgcagcctccttgaagctgcctcaagcccccttcagttactcctttattcccttcactgctccagaagggttttcaagcatctgcagctgcacctctgtctcaagggcaagctctactgtcagccacgctgctgcaaggatgggattgaaaagcaagaccattcattt

SEQ ID NO: 186888 - DNA, 601 bp, Human
gggaatggcgcagcctgtggcagaactagggggagcatgctctatcccaaagcattcacattcgaacacaaaatatactgtgctagctaaaccagacatctgggggcaagtgtggcttagtgactatgggtttgttgtttcttctttaattgattaaaaaaagatttaaacacagagaagttataaaaattttcagtgtaattaggggttgtgggccaagctttattgagtgacatgaagcttcaaagttgttttggggaagggagcaggaccaaaatgccttcttagtgcaactttttcaaaaaaaacttgtgaagccagcttctaatattcccctggctacttgctctctctctctaatgggctgcagcagtttctcctgtgcctcaatcaaatgaatacatcacataaatgagggtataaactgcatgagtttacagaaaggaagaaggttattattacctttgaaatcagaagccaagaaaacatctcttctcacacctcctcatctcttctcttactttctgggcaagtccctaggggtaattttattagagactctccctcaaagtaaaaactgaggggggtataaatagccccg

SEQ ID NO: 186889 - DNA, 601 bp, Human
ttttctgtcttatagatttttatccctcacagtctaaggtatctaaacttccatgacttaaaatatgtgggaaatatatctatatcatgtgatataatttaacagtaaaacaagaaaattcacattataaaatgaaacaaatataccgaaaatttattagttttccagattgtaccattagttaaatgaagagtttaaacgggagagaaattcctcaaatcataaagccctagaacttttgttctaggttcatattttttcatgaagactataagagggagacatgttattagtctataaygcatgttaaattcattttaagcttctaatctttagttattcttctaaatatttaaaaaataggttgctgtgatttacagaggcaatgaatattttacttaaatctaattatagaatgatatgctttgaaataggtcatttataactagtgaatatatattgtgaaatttgataaatatctctttatattattaacatttaaaatattattcatcgaacatattttcaaaatacttatgacaagtacagtgatgcatctcttaataatggggaagcattctgagaaatgcaatgttgggtg

SEQ ID NO: 186890 - DNA, 601 bp, Human
tgtatctaaacatagaaaaggtacagtgaaaatacagcataaaagataaaaacagtacctttggacagggcttttaccatgaatggagccagaagttgctctgggtgagtcaatgagtgagtggtgagtgaatgtgaaggcctaggacattactgtacactactatagaatttataaacactgtacactcaggttacactaaatttataaaaactatttttcttcctgcagtaataaattaaacttaccttactgtaactttcttttttttttgagatggagtctcactctgtcaccaggmtggagtgcaatggcatgatctcggctcactgcacactccgactccctggttcaagctattttcctgcctcagcctcccaagtagctgggattacaggcacgtgccatcatgcccagctaattttttatatttttattagagacggggtttcatcatgttggccaggatggtcttgatctcctgacctcatgatccacccaccttggcctctcaaagtgctgggattacaggcgtgagccactgcacctggccaccttactgtaacttttttactttataaacttttaaactttaaaaacc

SEQ ID NO: 186891 - DNA, 601 bp, Human
ggacattactgtacactactatagaatttataaacactgtacactcaggttacactaaatttataaaaactatttttcttcctgcagtaataaattaaacttaccttactgtaactttcttttttttttgagatggagtctcactctgtcaccaggatggagtgcaatggcatgatctcggctcactgcacactccgactccctggttcaagctattttcctgcctcagcctcccaagtagctgggattacaggcacgtgccatcatgcccagctaattttttatatttttattagagacggggtttcatcatgttggccaggatggtcttgatctcctgacctcatgatccacccaccttggcctctcaaagtgctgggattacaggcgtgagccactgcacctggccaccttactgtaacttttttactttataaacttttaaactttaaaaaccttttggactctttgtaataacacttagattgaaacacacaacacattgtacagctgtccaaaaatcttttctgtctttatatctttattctacaagcttttttctatttttaaaacttttttaaagcattttaatggtttctta

SEQ ID NO: 186892 - DNA, 601 bp, Human
cttctcaaattctcaatcttccagagtgacctcacacacaaattattgctcttttgcttaaaaaaccttagcagctctccactgcccagaagataaagtgaaaacttaatgtgatggttaagtatggagactctagaggtaaccaccttggtgtaaatcatggcttcatacttgctgtgtgaactttgtaaagttatttgacctctctgtgcttcaggttcttcatctgtaatatggaagtgataatatctacctcataggataaggattgaatgagttaatacatataaagtacttgaarccaggacctggaacttttattaccatttcagtgtaattttttggtactctctgttatgtagctcagggctaggtggacacatttacatatccactaaacatttggtgcatctttgaaccaatattgtcatcagtcacttggaggacaaattgagcccatcttggaggaaaggtgaagaactgctgtcagcagccctctattccttctctattgttctgggtatttctgctttcatatgtcccctacatgtagtgtctttcctaagtgagagctcgcaaagtaccatttctccatttcatt

SEQ ID NO: 186893 - DNA, 601 bp, Human
aatgtgatggttaagtatggagactctagaggtaaccaccttggtgtaaatcatggcttcatacttgctgtgtgaactttgtaaagttatttgacctctctgtgcttcaggttcttcatctgtaatatggaagtgataatatctacctcataggataaggattgaatgagttaatacatataaagtacttgaagccaggacctggaacttttattaccatttcagtgtaattttttggtactctctgttatgtagctcagggctaggtggacacatttacatatccactaaacatttggtrcatctttgaaccaatattgtcatcagtcacttggaggacaaattgagcccatcttggaggaaaggtgaagaactgctgtcagcagccctctattccttctctattgttctgggtatttctgctttcatatgtcccctacatgtagtgtctttcctaagtgagagctcgcaaagtaccatttctccatttcattctagttgctgggtcattccagcagctcttggcccctggaagctgccggctggtttattccttaagctggcttcgataccctatagactcaactcataccaactcttt

SEQ ID NO: 186894 - DNA, 601 bp, Human
gaggtaaccaccttggtgtaaatcatggcttcatacttgctgtgtgaactttgtaaagttatttgacctctctgtgcttcaggttcttcatctgtaatatggaagtgataatatctacctcataggataaggattgaatgagttaatacatataaagtacttgaagccaggacctggaacttttattaccatttcagtgtaattttttggtactctctgttatgtagctcagggctaggtggacacatttacatatccactaaacatttggtgcatctttgaaccaatattgtcatcagtyacttggaggacaaattgagcccatcttggaggaaaggtgaagaactgctgtcagcagccctctattccttctctattgttctgggtatttctgctttcatatgtcccctacatgtagtgtctttcctaagtgagagctcgcaaagtaccatttctccatttcattctagttgctgggtcattccagcagctcttggcccctggaagctgccggctggtttattccttaagctggcttcgataccctatagactcaactcataccaactcttttgtgctcctaaacataccattttctaac

SEQ ID NO: 186895 - DNA, 601 bp, Human
gaagccaggacctggaacttttattaccatttcagtgtaattttttggtactctctgttatgtagctcagggctaggtggacacatttacatatccactaaacatttggtgcatctttgaaccaatattgtcatcagtcacttggaggacaaattgagcccatcttggaggaaaggtgaagaactgctgtcagcagccctctattccttctctattgttctgggtatttctgctttcatatgtcccctacatgtagtgtctttcctaagtgagagctcgcaaagtaccatttctccatttyattctagttgctgggtcattccagcagctcttggcccctggaagctgccggctggtttattccttaagctggcttcgataccctatagactcaactcataccaactcttttgtgctcctaaacataccattttctaacaattttatgtcttcagatgagttgctgctccaactgtctagaattctcttgtctttccttccatgccactccctctgtgaagtcatcctctactcttcaagacagattcttttttcacatgttcttcatctatacttccagtatgggcttactgttacatcc

SEQ ID NO: 186896 - DNA, 601 bp, Human
gaagttatcccccctcaagagattgctcagttagatttttgctggggcttgtctgaataaatgtgggctatttctgtatccttgaggtaggactgactaggttgaagttattagttaaacatttaggtaactttccagaagaaatagagctattagagggaaagatgaatttagagactgggtaaatattaatcaggcacccatcttggaaagcatatttttgcccaaaagagtgtgaatcttttcttttggaaggaggaggtgccatttgccccattatgtggcagaatttggaggagatttcagagaaggagattagcacagagtaggcagctcttaaatcccaaagggaaatttataattttactcctccaggagtttctcttagctttgtcttgtcaatgacttggaagccagccagagcagagagccccttcagctcaaggccattaggcattgggactctgtcccagagccctttggccctcagggcatccaatttccagtagctaagcttgtggcagagggggcaagctgtgctaggcttcctctcatttgtcccattggggcagtttgccttccagtggcctggcttcccaca

SEQ ID NO: 186897 - DNA, 601 bp, Human
gagaaaaaaaaggaaaaaggaaaacaaaggcatcccctcttactttcctgttatcctagataagcatctcccattcatccttagggttctggaatgaaccagtcttaccgtgtacccattaccttggttccatctcatcacaattacccacttgagaacagaagagatactagagtaaacagtgggacccttgttcatccttgggactctggaataaccgttcttactgtatacccctaacctttccttcatctgttttaatggtaatctgttaacctagaaccaaccttcatgtctgtcmtatgggtcttttgtgactgcaaccttgggctggcctatgtccttgtctccatgacattatggtgactctcactcagagcattgtagcaacaaaatgattgtctcttttttcagatttccttcccatgttctttaagtagatgagaagcctgtttttcagctaactgccacaagatggctggatttccctcccttcgaatatgaccttgaaggtcttggtgcatgttaagaagggcatggaagtgattagagaaatggaggctatgggaggaagtgagataaatactcatggaaagctttc

SEQ ID NO: 186898 - DNA, 601 bp, Human
atcctagataagcatctcccattcatccttagggttctggaatgaaccagtcttaccgtgtacccattaccttggttccatctcatcacaattacccacttgagaacagaagagatactagagtaaacagtgggacccttgttcatccttgggactctggaataaccgttcttactgtatacccctaacctttccttcatctgttttaatggtaatctgttaacctagaaccaaccttcatgtctgtcatatgggtcttttgtgactgcaaccttgggctggcctatgtccttgtctccawgacattatggtgactctcactcagagcattgtagcaacaaaatgattgtctcttttttcagatttccttcccatgttctttaagtagatgagaagcctgtttttcagctaactgccacaagatggctggatttccctcccttcgaatatgaccttgaaggtcttggtgcatgttaagaagggcatggaagtgattagagaaatggaggctatgggaggaagtgagataaatactcatggaaagctttcatatgcgagtgaaacggcaacatttatttgccctcttaacataaagtagtaa

SEQ ID NO: 186899 - DNA, 601 bp, Human
gactgcaaccttgggctggcctatgtccttgtctccatgacattatggtgactctcactcagagcattgtagcaacaaaatgattgtctcttttttcagatttccttcccatgttctttaagtagatgagaagcctgtttttcagctaactgccacaagatggctggatttccctcccttcgaatatgaccttgaaggtcttggtgcatgttaagaagggcatggaagtgattagagaaatggaggctatgggaggaagtgagataaatactcatggaaagctttcatatgcgagtgaaayggcaacatttatttgccctcttaacataaagtagtaacctccggaggacttgaggcttgaggtaagaactcacaagtggcaaaggaagaattttccctcctttcaaaggagtgttaactcaaaaaaagcaaataagtgagatccttaaagggccacagtgaggacctatgcagacacacaaagtacttaaaaagtcactggaaaacagccctggagggtaacagggacaaaaagtatacaataaatcataagggctgggattccaatttgtatctatcctggcaatgcgccaccagacag

SEQ ID NO: 186900 - DNA, 601 bp, Human
gggggagccagaaaggcggcaggctggggtaaccccaggtgaaagagggcagtcctgtgtggtaaaccacgagggctgagacagaaatggaaaacttctggaagcggagtccccatattagcctacaagctttccccattgcttgcattgacttgcttgtgctgtctttgttaaatctgagaaatgaagaaaataattccttccacctatcatagaagaatggtgaaatcaactcaggttgacaggatatttgattgtcaactttgtgcaagcaccattatttctagccagcactaccttcttctccagctgaacctgaatatttgcataatctctagattagatgtttttgtatttctagcttaggcaatacttatttaaaagaggcatgttcatggtactattttttaataagagcttttgtttaaaacaaactcagtgtgacttcttttcataaaggtaaattaaagaaaaatacatgaaaatgaaagattagtccctttttggaacataagcaagatttgtttactttacactaaatctttagtaaacttacttcataatcatggggtgatattgcctatgtctggttcatcacctt

SEQ ID NO: 186901 - DNA, 601 bp, Human
ttttggaacataagcaagatttgtttactttacactaaatctttagtaaacttacttcataatcatggggtgatattgcctatgtctggttcatcacctttttccatttttgtctgtaagtgtgagacagtgttttgacccagcttggtacaaaatatatagtaggcagttcattaatgttattatacattcctcttccctcttccccttctcagcctaatatctgtatttgtatcccttatagaggttcttaaatgtcaagatttattcttctgtttggtggaacagggaatcaaatcakattaatagaaaatagaaatgcagattcctcctcctttgtatagctgtgagaaaaaaaaaaaagaaattcatattcccacataagctgatccaggcctggggtgtgtgtgcttcaggagggggtggtgggaaggaagttcattcttgcaaagccctccagatgctggaggtagctgagacacatccactcgctcgagatccatgctctccttgttcttctgaacttctctgaataaaaagctctctcttgctctcccagacttccttctctaagtcgtttgtcatcggctcttgagctctt

SEQ ID NO: 186902 - DNA, 601 bp, Human
ctaatatctgtatttgtatcccttatagaggttcttaaatgtcaagatttattcttctgtttggtggaacagggaatcaaatcagattaatagaaaatagaaatgcagattcctcctcctttgtatagctgtgagaaaaaaaaaaaagaaattcatattcccacataagctgatccaggcctggggtgtgtgtgcttcaggagggggtggtgggaaggaagttcattcttgcaaagccctccagatgctggaggtagctgagacacatccactcgctcgagatccatgctctccttgttcktctgaacttctctgaataaaaagctctctcttgctctcccagacttccttctctaagtcgtttgtcatcggctcttgagctcttcagcctggtcacctccactgttatctgggctcagtacatgagccttggcctgaaagcagagtcaattaaaatatacccagccatttattaagtttaccctgactttaatagctagagttgtgaagaaaactgaataaatagagcttcaacataatttaagaaccaaagacatctaattatagaacatcatatttgagctgtatttataatctttaa

SEQ ID NO: 186903 - DNA, 601 bp, Human
ttaaatatataattatagtacacaggggtctcaggatttagtcagactaaaagattctgttaatagtcaaagggaaatttagtttaatttatcaaattgtagaatttgcttgcttttgaacatactggtaacatgcatataagcaattgtgtatgatgtaagaactagtaataggctaaacctgatagcttcacacaactttgtgtatttagggctgtatctttcaatttgtttcaagaacagtttcttttaaaagttttttattgcaaaattcatattttattacaaaaattaaaacatrcaaataaggagaaagaagaatccattaccctacaatcttcagtgaacaccattaacattttgatacgtacctttcaaaattattttttatggctgtatcaacctgtaaatatatggtgcatactgtgcaagccattctgaacacttttaggtggataacaaacacaggaatacagtctgccttggcatggctttgcctcctaactcccactaaaaccaaccctccctctcagagagtattttccttacccccgacagatgggccatgggtacttccaacttctttatttttactactctt

SEQ ID NO: 186904 - DNA, 601 bp, Human
aacataaatatcttaatgctctgtattttaattacaaaatttgaaaggcacatgacacacttagaaaatatttatagtgtgtaggtcagagctaattttttttactaaacaactcttgcaagtcaaaaagaaaagctatgcatttctcccagcactttgggaggccgaggcgggcggatcacgaggtcaggagatcgagaccatcctggctaacacagtgaaaactcgtctctactaaaaatacaaaaaaattagccaggtgtggtggcaggcacctgtagtcccagctacgcgggaggckgaggcaggagaatggcgtgaacccgggaggcggagcttgcagtgaaccaagatcgctccactgcactctagcctgggtgacagagtgagactccgcctcaaaaaaaaaaaaaaaaagctatgcatttcaatagaaaaattagttaaaccatataaatatgtcacagaagaataaatagaaataatctctaaatataaaaaacttctagttttattagttaattaaaataatgcaaactttaaaaattctattgtcattaatcaaagtgacacactttaaaacacataataattccattgt

SEQ ID NO: 186905 - DNA, 601 bp, Human
aaatagttgaaatatgaccagctttcagttttttcctttacctttcctatgtcttttctgtcaagtgatcataccaatgattattaaatttataatccttttaatctctcatctgaacagcttgctcctgagaccaaggctgtcattcattggattatggatattccttttgtgctttctgccaatctccatggaggagaccttgtggccaattatccatatgatgagacgcggagtggtaggtattctttctgcttctcttattggttcaaagtttataacactgtacaaggttttatargatgatttctgtaattttttttaaggaactgaacattaagtgatttttgcctgaagaaagaactatgtttaacaggaagctctcctaatcatttcatatggtgttggcatatctatttggcagaaaaggactcactttttcaataggttaggtgaagagaaacgtgatcttgacagtacctagccaacagaaagggagaaaacacacgtcataaacttgggtcactcttggacactgataaagtggagagattacagaagttgtgtaggttcatgtagaagatggcttaaacatgggggc

SEQ ID NO: 186906 - DNA, 601 bp, Human
aaggaactgaacattaagtgatttttgcctgaagaaagaactatgtttaacaggaagctctcctaatcatttcatatggtgttggcatatctatttggcagaaaaggactcactttttcaataggttaggtgaagagaaacgtgatcttgacagtacctagccaacagaaagggagaaaacacacgtcataaacttgggtcactcttggacactgataaagtggagagattacagaagttgtgtaggttcatgtagaagatggcttaaacatgggggcagcctcttggtgcttgatcaggrtccctgtggatctctacatgtgtcttattgtgttgacacagttttgcatttggaactgtttctggtggtgtcagggaggggaagtggtgctttggctttctctaactagttttagttaagcttcagacaaagcaagctttagccagacagatattttcaaattgttttttgttgctccagggaatttcctgctttggatctattttctggggcctttgaagagttagctttttgtaaaaacaggatgattagtttgtttttttttttttaattttagattcggggtacctgtgtaggttt

SEQ ID NO: 186907 - DNA, 601 bp, Human
tctatggcccacctggaaaaagaaaatttgttagggtaataagcaacattagctaattgaagggtattggtatgtttaatatgcttaattttgttgaattatgtgctgagaaaaatattctttctgatttttttctttctgatacatgttaattctgtttttatttatattttgcattttatccagatcagacttagtactctttccccaatagcttcagaaatatgatctatgtcaaatttaggatttagagcatgtctagtacatcagatgggaagtaattttatactttagtttttawaaaaactttaatgacttcttggaattcctttttgaacaaatagtgtattgtcaacaaaatataaagtaatctatatcagttaaatactgataataacattattaacaatagtaataatgttagttaacgattacgtctcgcttaactaaacagtcaaaggaagctccgttagtcttcagttctgtatatagtgaataacattcatgtcttaggtcaggttttctagaagcagagcctgagatagggatttgggtacttgtaatttattaagggattactttttaggacaaaccctgtagg

SEQ ID NO: 186908 - DNA, 601 bp, Human
aacaaaatataaagtaatctatatcagttaaatactgataataacattattaacaatagtaataatgttagttaacgattacgtctcgcttaactaaacagtcaaaggaagctccgttagtcttcagttctgtatatagtgaataacattcatgtcttaggtcaggttttctagaagcagagcctgagatagggatttgggtacttgtaatttattaagggattactttttaggacaaaccctgtagggaagtgagggaagcagggcaaggaaggggatagagctaaacagggttgtggtstcaggcaaagtccagccttggcctgagccattggaagaagcctggagcataaattaggggcaggtttgtctccccttgagagaaagggaccagcctttggtggctccatatctgtcagccattggttgtggggtgccagcaggaattgggggtgagagatagcatgatgtaactcccaagccaggtgggagattctggctcccatcagcaattctctggaaaaggggtgggggggtagctgtgagctctaacagccaacacctgcagcagtttgggtctggatgccctgcctccataaaa

SEQ ID NO: 186909 - DNA, 601 bp, Human
agttaaatactgataataacattattaacaatagtaataatgttagttaacgattacgtctcgcttaactaaacagtcaaaggaagctccgttagtcttcagttctgtatatagtgaataacattcatgtcttaggtcaggttttctagaagcagagcctgagatagggatttgggtacttgtaatttattaagggattactttttaggacaaaccctgtagggaagtgagggaagcagggcaaggaaggggatagagctaaacagggttgtggtctcaggcaaagtccagccttggcctragccattggaagaagcctggagcataaattaggggcaggtttgtctccccttgagagaaagggaccagcctttggtggctccatatctgtcagccattggttgtggggtgccagcaggaattgggggtgagagatagcatgatgtaactcccaagccaggtgggagattctggctcccatcagcaattctctggaaaaggggtgggggggtagctgtgagctctaacagccaacacctgcagcagtttgggtctggatgccctgcctccataaaagcaatctggtgggcactaacagcat

SEQ ID NO: 186910 - DNA, 601 bp, Human
gcaaagtccagccttggcctgagccattggaagaagcctggagcataaattaggggcaggtttgtctccccttgagagaaagggaccagcctttggtggctccatatctgtcagccattggttgtggggtgccagcaggaattgggggtgagagatagcatgatgtaactcccaagccaggtgggagattctggctcccatcagcaattctctggaaaaggggtgggggggtagctgtgagctctaacagccaacacctgcagcagtttgggtctggatgccctgcctccataaaagcaayctggtgggcactaacagcatcctctgctaatttgagtcagatttaaattaaaattgttctgaatgcagaatattctctttggtgctatttgaagtattgttatcattatatcttgtatgtaattcaactcagggattgttgaattagcatatagtgtgaaaggaaattaaattctaggaccccaaattcatttagctaaagggaaaagtcaagctgggaactgggtcacacaaacctgcctccccattttggttcctaaataagatgattacaagatgaaagggtacacgcctcccccat

SEQ ID NO: 186911 - DNA, 601 bp, Human
tgccctggtttgtgtaccttttacttggttcttgattcagaagactagcctgtgtagagttttaggctccttgtgcatattttgactttccatttggtgttttggcagggatgcaagacttcaattaccttagcagcaactgttttgagatcaccgtggagcttagctgtgagaagttcccacctgaagagactctgaagacctactgggaggataacaaaaactccctcattagctaccttgagcaggtaaacacagtccccagcataaaaatgcaaggtttacaagcattcaaacctgkcctacaatggtcttgtaagaggagtccaggagaatccgtctggtgcagaatgaggatgccatatttggaaggcaggtgtcagcagtgtttcagttaggcttttatttgtcataggttttgtggctcaggactattcaccaagaactgactaaactggagagtatacagaaaagacgtagactctcgtttctgtttgtattattctaagcaagggcaatcctaggactctctcccaccctgatcaccgtgaggcatcccaggcagagccagaacaaaagtaaggcaagcgaggcacctgaa

SEQ ID NO: 186912 - DNA, 601 bp, Human
cttagcagcaactgttttgagatcaccgtggagcttagctgtgagaagttcccacctgaagagactctgaagacctactgggaggataacaaaaactccctcattagctaccttgagcaggtaaacacagtccccagcataaaaatgcaaggtttacaagcattcaaacctgtcctacaatggtcttgtaagaggagtccaggagaatccgtctggtgcagaatgaggatgccatatttggaaggcaggtgtcagcagtgtttcagttaggcttttatttgtcataggttttgtggctcakgactattcaccaagaactgactaaactggagagtatacagaaaagacgtagactctcgtttctgtttgtattattctaagcaagggcaatcctaggactctctcccaccctgatcaccgtgaggcatcccaggcagagccagaacaaaagtaaggcaagcgaggcacctgaatggaaaatttaaggaggattttaatcttaggggcatgcaagtacaggattagcacttgagagtgagtgtctctttaagttttgagctgtacaagcctcatctttctcaccctagactcaactgcatca

SEQ ID NO: 186913 - DNA, 601 bp, Human
aagagactctgaagacctactgggaggataacaaaaactccctcattagctaccttgagcaggtaaacacagtccccagcataaaaatgcaaggtttacaagcattcaaacctgtcctacaatggtcttgtaagaggagtccaggagaatccgtctggtgcagaatgaggatgccatatttggaaggcaggtgtcagcagtgtttcagttaggcttttatttgtcataggttttgtggctcaggactattcaccaagaactgactaaactggagagtatacagaaaagacgtagactctcrtttctgtttgtattattctaagcaagggcaatcctaggactctctcccaccctgatcaccgtgaggcatcccaggcagagccagaacaaaagtaaggcaagcgaggcacctgaatggaaaatttaaggaggattttaatcttaggggcatgcaagtacaggattagcacttgagagtgagtgtctctttaagttttgagctgtacaagcctcatctttctcaccctagactcaactgcatcacaggtaataataataataatgagttatgtttgtcatttactatttcccaggcattata

SEQ ID NO: 186914 - DNA, 601 bp, Human
cttcaaattttatcctgaatgtggccatttacacctaaagtcaagtagagtgatgttagtttcatgtgccaacaaatagtccagaccaatctgttaaactaatttgacataaaaaagctgttaaataaacatttaagtatttatatgtgtatatgtacatataaacatatacatataaaatcaacactttttttaaagtaaaaccaggagttgaatccagtttctttctccaccattgcaaggctctgttgcagtggtccctatagcttgctatggcctcctttgaataaaggctgctctaaaaaaaaaaagaagaagaagaagcaaaatcagcataggaattcttttacacatgtcaaatatccatatactgtaataccttaccagggactgtcgtggaatagatccactgatgtcagatggtgattaaagagcactcattccactggattctttttaaatcaatggattcctgctgcatgttagcttaaaaaggtattttccaacaacaaaaactaaggataagcagtccacgatgactctagaacaactttggtgggaacccctacagaatgtctcctttgaggagagccgtatttgg

SEQ ID NO: 186915 - DNA, 601 bp, Human
tctattttcagccaaaataatgttaatagatttaatgcaaaagcagtcacagtatatatctttttatccagaatgagctaatattaacaggcttttattatgatatccttgttaattgacagtagccatataatgaatacacaggtgaccaaaattgaaagagagtaagttatgaaatgcactaagactagaactttacacatattggagcaggacgagctgcagacaaaacccctcagacaccgagttaaagaaggaagggctttattattcagccgggagcatcgtcaagactcatgtygcaaaaacccagctccctgagtgagcaattcctgtccttcttaagggcttacaactctaagggggaccgcatgagagggtcgtgatcaattgagcaagcagggggtacgtgactgggggctgcatgcaccagtaattagaacggaacagaacaggacagggattttcacagtgcttttccatacactgtctgtaatctatagataacataaccgattaggtcaggagtccatctttaactaccaggcccagggtgtggccccgggctgcctgcttgtggatttcatttctgccttttagt

SEQ ID NO: 186916 - DNA, 601 bp, Human
ctattttcagccaaaataatgttaatagatttaatgcaaaagcagtcacagtatatatctttttatccagaatgagctaatattaacaggcttttattatgatatccttgttaattgacagtagccatataatgaatacacaggtgaccaaaattgaaagagagtaagttatgaaatgcactaagactagaactttacacatattggagcaggacgagctgcagacaaaacccctcagacaccgagttaaagaaggaagggctttattattcagccgggagcatcgtcaagactcatgttkcaaaaacccagctccctgagtgagcaattcctgtccttcttaagggcttacaactctaagggggaccgcatgagagggtcgtgatcaattgagcaagcagggggtacgtgactgggggctgcatgcaccagtaattagaacggaacagaacaggacagggattttcacagtgcttttccatacactgtctgtaatctatagataacataaccgattaggtcaggagtccatctttaactaccaggcccagggtgtggccccgggctgcctgcttgtggatttcatttctgccttttagtt

SEQ ID NO: 186917 - DNA, 601 bp, Human
tgactgggggctgcatgcaccagtaattagaacggaacagaacaggacagggattttcacagtgcttttccatacactgtctgtaatctatagataacataaccgattaggtcaggagtccatctttaactaccaggcccagggtgtggccccgggctgcctgcttgtggatttcatttctgccttttagtttttccttctttggaggcagaaattgggcataagacaatatgaggagtggtctcctcccttaatatgacactttttaaaatgatttggaaggtactaaaatctttttttkgggaagcaaacaagacattaattttcacttatctatttagggaaaagcagaataaaatgcacaaaaaattcagtggccttttgtgcatgtcttgattcttaaacaatgggggtctacggtatttgctggaaaataaagagatgcttgatatgaaacatatttaaggccatttctataaatttataggtcatattaattttttggttatttttgaccttcacagatacaccgaggagttaaaggatttgtccgagaccttcaaggtaacccaattgcgaatgccaccatctccgtggaagg

SEQ ID NO: 186918 - DNA, 601 bp, Human
atttttcattttaccaagttcccaggtttgcacccaagtttgaaaatcactgacttaggtaaatgggagattgaatggactagggtgcccagtgtattctaagtctttagaaatctaaatttctaactaggacctcagagatcctacaagggctacctttggcccacactctgtgaagattctctgaccagcaggtcttcacctggcaagaatcaaaacatgatggctgtatgttctgaccctgctgcttggggaattcatctgtctttttacctgtgttgctcctgatgtgattagaagrtctatgatcgtacgaggtttattagacaatttaacattgatatctataaagtagctataagaaatgaagcctgtaaagagagtttcacaccctattcaataaaatttcattaaattccctatatatttactttaaaaatcgagaatcaaaaaaggtgaactgagctagactgggtattccttagatggcataattatgcattgtgtaattctgcatatttcatgtgctttgtgatttgatattctgccttcctacagcaaaggatggtgattactggagattgcttatacctggaaacta

SEQ ID NO: 186919 - DNA, 601 bp, Human
cgcccaggctggagtgcagtggcacgatcttggctcactgcaagctctgcctcccgggttcaagaaattctcctgcctcagcctcctgagtagctgggattacagcgtgcgccaccgtgcccggctaatttttgtatttttagcagagatgtggtttcaccatgttggtcaggcgggcctcgaattcttgaccttgtgatctgcccacctcgacctcccaaagtgctgggattacagacgtgagccaccgcgcctggccagttacatctttttatgaggagaagagactggggcaagaatkttgttgaattatatctgtcttcaaagctattaaatcaaaggacatttcaaacataaggcttttgaattttgcttttgaattttttccccctgaaaatatcttttgtttattgcaagagattttatttcaggatttactttaattcaggtggctggattgagtgtatactgaaactgctcttatttttttatttcaatttaaaaaaacacatgcagtttgataataatatgttcttgattttctcttttaggttgattttgaactggagtcattttctgaaaggaaagaagaggagaagga

SEQ ID NO: 186920 - DNA, 601 bp, Human; identical to SEQ ID NO: 22187

SEQ ID NO: 186921 - DNA, 601 bp, Human; identical to SEQ ID NO: 22188

SEQ ID NO: 186922 - DNA, 601 bp, Human; identical to SEQ ID NO: 22189

SEQ ID NO: 186923 - DNA, 601 bp, Human; identical to SEQ ID NO: 22190

SEQ ID NO: 186924 - DNA, 601 bp, Human; identical to SEQ ID NO: 22191

SEQ ID NO: 186925 - DNA, 601 bp, Human
attgggaaatgtagtcttgagggggcactgcatgacgtgtggttttcatcttccgcaggcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagcgccccgcctcgctcggctgcccccgccccttcccggcccccctcgccgcgcgtcctccaaaaaataaaacyttaaccgcgggctctgccttgatcttccttccttccgcctccagggacccaggctgcgcacgcttgacctctcctgaacctaacatggtccccaccgccagctgctcagccctcagaatgcccatctcccagcccccaaccccttcctcccgaggacacaggagccgggaccccaggcaccttttccctcccacagacccaagagcctgggccttccccgctcaaggcccaagagacctctgtgaggcacctgaatctagaccttcagacacttctgggaagaacctggattctgggtcc

SEQ ID NO: 186926 - DNA, 601 bp, Human
ctggagcccactgggggattggggtggcaggagatgaggtcagagaagcaacgggggccagttcacgcagggccttggggccacggtgaggactttggctttgattctgaggtagaatcactggaaggttttcaattgagaagggatgtgatccaattaatattttgaaacaatcactctggctgctgtttggagaatagactggaagatgcaagattgaaaacaaagataggctgggcgcagtggctcatgcctggaatcccaccactttgggaggccaaggcgggtggatcacttgagrtgaggagtttgataccagcctggccaacatggtgaaacctccctctactaaaaatacaaaaatgagcttggcatggtggtgcatgcatgtaatcccagctacttgggaggctgaggcaggagaattgcttgaactcaggaggtggaggttgcagtgaggcgagatctcgccactgcattccagcctggacaacagagcgaaacttgaaagaaagagagaaagagaaggaaagaaagaaagaaagaaagaaagaaagaaagaaagaaagaaagagagagagaaaagaaaacagagatgggt

SEQ ID NO: 186927 - DNA, 601 bp, Human
catgcctggaatcccaccactttgggaggccaaggcgggtggatcacttgaggtgaggagtttgataccagcctggccaacatggtgaaacctccctctactaaaaatacaaaaatgagcttggcatggtggtgcatgcatgtaatcccagctacttgggaggctgaggcaggagaattgcttgaactcaggaggtggaggttgcagtgaggcgagatctcgccactgcattccagcctggacaacagagcgaaacttgaaagaaagagagaaagagaaggaaagaaagaaagaaagaaakaaagaaagaaagaaagaaagaaagagagagagaaaagaaaacagagatgggtgggaaagttgtagatagctgggcaagaaagggtgacaatgagagttgtgacagtgatggcagtgaggagtggacaactggagctatctttgaacgtagagctaagaagacttggagatggctgaatgtgtgagggaaagaaagggaaaggatgatttaggtttggggcctgagcatcagggtgaatgagagagagaggaaaaaaaaggcagctgctctttattccttaagattctttactcctggccg

SEQ ID NO: 186928 - DNA, 601 bp, Human
aggccaaggcgggtggatcacttgaggtgaggagtttgataccagcctggccaacatggtgaaacctccctctactaaaaatacaaaaatgagcttggcatggtggtgcatgcatgtaatcccagctacttgggaggctgaggcaggagaattgcttgaactcaggaggtggaggttgcagtgaggcgagatctcgccactgcattccagcctggacaacagagcgaaacttgaaagaaagagagaaagagaaggaaagaaagaaagaaagaaagaaagaaagaaagaaagaaagaaagaragagagaaaagaaaacagagatgggtgggaaagttgtagatagctgggcaagaaagggtgacaatgagagttgtgacagtgatggcagtgaggagtggacaactggagctatctttgaacgtagagctaagaagacttggagatggctgaatgtgtgagggaaagaaagggaaaggatgatttaggtttggggcctgagcatcagggtgaatgagagagagaggaaaaaaaaggcagctgctctttattccttaagattctttactcctggccgggcgcggtggctcatgcctgtaatcc

SEQ ID NO: 186929 - DNA, 601 bp, Human
ggggccaggcatggtggctcacacctgtaatcccagcactttgggaagccgaggcaggcagatcacttgagttcagaagttcgagaccagcttggccaacatggtgaaaccctgtctctactaaaaatacaaaaattagctgggtgtggtggcatgtgcctgtaatcccagctactcagaaggctgaggcaggagaattgcttgaacccaggaggcagaggttgcagtgagtgaagatggtgccattgcactccagcctgggcaacagaggaagactctgtctcaaaaaaaaaaggctggrggatagatttgtctggagctcacatgagaggttgtgactgaggacaggagccattaacatatccagcactgttcaataaaactttcagcaaagatgaagctgttctatagctgctctgtccgatttgaaagccacaagccacatgtggctgttgagtacttgacaagtggttagtgcacccagaaaactaagttttaaattctatttaacatttttttcctctggtccttgattcaggataaattttatttaattttaatttgaatagttatgagtggctaacagccaccctattggata

SEQ ID NO: 186930 - DNA, 601 bp, Human
ctggaacggatgaacccccaaatctcagtggatcacccaacaggaggttgtttctcattcatataaaatccaggccaggcacagtggctcacgcctgtaattccagcactttgggaggccaaagcgggtggatcatctgaggtcaggagttcaagaccagcctggccaacatggagaaaacccgtctctaccagaaatacaaaaattagttgggcgtggtggcgcacgcctatagtcccagctactcgggaggctgaggcaggagaactgcttgaacccgggaggcggatgttgcagtgarccgagattgtgccattgcactccagtctgggcaacaagagtgaaattccatctcaaaaaaaaaaaaaaaaaatccaaacaggtgttcctgattggaggtggctttcctccgtatggtgactcggggtttcaggctctcaccctcttgtagctctgtaatccccttcagaggactaagcttcaagagtaaggttttattaggctgggcacggcaggagaatcacttgaacccaggaggcggaggttgcagtgagccaagatcatgccgctgctcaccggcctgggcgacagagcaagattc

SEQ ID NO: 186931 - DNA, 601 bp, Human
agtggatcacccaacaggaggttgtttctcattcatataaaatccaggccaggcacagtggctcacgcctgtaattccagcactttgggaggccaaagcgggtggatcatctgaggtcaggagttcaagaccagcctggccaacatggagaaaacccgtctctaccagaaatacaaaaattagttgggcgtggtggcgcacgcctatagtcccagctactcgggaggctgaggcaggagaactgcttgaacccgggaggcggatgttgcagtgagccgagattgtgccattgcactccagyctgggcaacaagagtgaaattccatctcaaaaaaaaaaaaaaaaaatccaaacaggtgttcctgattggaggtggctttcctccgtatggtgactcggggtttcaggctctcaccctcttgtagctctgtaatccccttcagaggactaagcttcaagagtaaggttttattaggctgggcacggcaggagaatcacttgaacccaggaggcggaggttgcagtgagccaagatcatgccgctgctcaccggcctgggcgacagagcaagattctgtctcaaaaaaacaaaaaacaaaaa

SEQ ID NO: 186932 - DNA, 601 bp, Human
ctacgtctggttcatggtggggccccagctggctggaggcgggggctctggggcccctggtgagccccctcttctgccaggaggcgcccccctgcctgccgggctgtttgcagtgcgctcggctggctggcgggatgacctggctcggcgagtggcagctggcgtggccgtagtggccagaggtgcccaggccctgctgcgtgattatggtttccttcctgagctcggccacgactgtcgcgcccagaaccgcacccaccgcggcgagagtctgcataggtgagtggggctggaatgggaggggtgtgggagggctcccagagcctaactacctcagtattcactgaatgagtggctcaaatgggccacatctgctctttgagcctcagttttcttttctgtaaagtgggtgcaattgggtctcttttctgaggttaaatcaagtaatttggaaaaagcacctgagataaagtgagtgtattactatatttcatgactctaagatgcataatgtttcacattttaatgtctttgaaaacgagatgtgtcttataattgatgacttatcatggcttaattggcagcacttttgtctttcttt

SEQ ID NO: 186933 - DNA, 601 bp, Human
gaagtttgttcctctctcacgtaacaaccctgataaggagactgctgttccatgtgatcattcagggacccaggattctcccacactgttactctggcatctctgcatggtcgaagtgggtcgtggggatgtctgaattgtagctcatgagaaggggaaaagagaggaagtggacagcaagcactttccttttgagtaagtgaggcagaaaggacacgcctcataccttactgttgagaacgtagtcatatggtcagggctggcttactggttgttgacagtggtgtccattctgattggytggacgtctattggaattagctagacgtctattctgattagctagacgcctattctgattgactagacgtccattccgataggctagacgtccattcctggctagacgtccattctgattggctagtgcctgtgcagcgccgattgctacatattttgaatattactcctgcacatggcctggccaactgcaaggaagagtgggaaatgtcagtcctagctggacaggtgtgtgcccaacttacgcactattattttagaagaggcgaacagagtttgttggaaaatagcatctccacgg

SEQ ID NO: 186934 - DNA, 601 bp, Human
ttgttgacagtggtgtccattctgattggctggacgtctattggaattagctagacgtctattctgattagctagacgcctattctgattgactagacgtccattccgataggctagacgtccattcctggctagacgtccattctgattggctagtgcctgtgcagcgccgattgctacatattttgaatattactcctgcacatggcctggccaactgcaaggaagagtgggaaatgtcagtcctagctggacaggtgtgtgcccaacttacgcactattattttagaagaggcgaacwgagtttgttggaaaatagcatctccacggtaggaagctctgggagtggaaaaattgataagtttggtgacagaacagtgaaaagagagacctttaatcctgaacgaggatggggtgaatttgggaagagatgatggttggggaagaagacctaagagagggtaattgagaactggtgacttgggaatcaggatccccgaaaaagaggatgagaaaagcatcccttcttcataaatacttactgagcacccgctaggaactagggctcatgctgggcgctgggaacatagatgaataagac

SEQ ID NO: 186935 - DNA, 601 bp, Human
tctattctgattagctagacgcctattctgattgactagacgtccattccgataggctagacgtccattcctggctagacgtccattctgattggctagtgcctgtgcagcgccgattgctacatattttgaatattactcctgcacatggcctggccaactgcaaggaagagtgggaaatgtcagtcctagctggacaggtgtgtgcccaacttacgcactattattttagaagaggcgaacagagtttgttggaaaatagcatctccacggtaggaagctctgggagtggaaaaattgrtaagtttggtgacagaacagtgaaaagagagacctttaatcctgaacgaggatggggtgaatttgggaagagatgatggttggggaagaagacctaagagagggtaattgagaactggtgacttgggaatcaggatccccgaaaaagaggatgagaaaagcatcccttcttcataaatacttactgagcacccgctaggaactagggctcatgctgggcgctgggaacatagatgaataagaccatgaacttattcttcaaagaacgcagggtcctgtaagagtggcagacagggacagg

SEQ ID NO: 186936 - DNA, 601 bp, Human
taaagattagctgggcgttggccgggcgtggtggctcacacctgtaatcccagcactttgggaggccgaggcgggcggatcacaaggtcaggagatcgagaccatcctggctaacagggtgaaaccctgtctctactaaaaatacaaaaaattagccaggcgtggtggcgggcgcctgtagtcccagctactcgggaggctgaggcaggagaatggcatgaacccgggaggcggagcttgcagtgagccgagatcgagccactgcactccagcctgggtgacagagtgagactccatctcaaaaaaaaaaaaaaaaaaatctgggcgtggtagtgtgtgcctgtagtcctagctacttgggaggctgacatgggaggatcacttgagccttggagatcgaggctgtaatgaactgtgatctcttcactgcagtccagcctgtgcaacaaagtgagaccctgtctctaaaataatttaaaaaattaaaatttaagaaataggtaggcaaggtgtggtggctcacacctgtaatctcagggctttgggaggctgaggtgggcggatcacttgaggtcaggagttcaagaccagcctggccaac

SEQ ID NO: 186937 - DNA, 601 bp, Human
aaagagagaaagaaagaaatggataaagcgaaggagccaagtattggaagatctcagtgaagggagagggaacagcaggtgcaaaggctctggggctggaactgccttgtcttagtctgttttgtgttgctatgacagaatatcataggctgggtaattataatgaatggaaatttgttggctcttggttctggaggctgggaagtccaacatcaagatgtcaccgtctgatgagggtcttctttcagcatcattacatgagggaaggcatcacatggtagaagggcaaagagaggagtgrgggaagatcaagcaaacccactcctgcaaccacagcattagtccatttgtgagggtactggagccccatgacctaaatgcttcttaaagtttccacctcctaattcccaataccatcacaatggcaatggcaattaaatttcttttttttttttttttttttttgagatgaagtctcactctgttgcccaggcgggagtgcagtgatgtgatcttggctcattgcaacctccacctcctggattcaagcgattctcctgcctcagcctccgagtagctgggaccacaggtgcctgccacc

SEQ ID NO: 186938 - DNA, 601 bp, Human
ctcactctgttgcccaggcgggagtgcagtgatgtgatcttggctcattgcaacctccacctcctggattcaagcgattctcctgcctcagcctccgagtagctgggaccacaggtgcctgccaccacacctggctaatttttgtatttttgtagagatggggtttcactatgttggccaggctgctctcaaactcctgacctcaggtgatccacccacctcagcctcccaaagtgttgggattacgggcgtgagccactgcacctggccgtaaatttcaatatgagttttggagcggacrgacatccaaatcatagcttgcctgttcggaagcctgtttgggagcctgcactgctggtgtggctagaacatagtgggcaaggggaaggaaggtatgagtagcggatggagagggttgcagggcccagcttgtgaagggcctttaggccagggggcaggggtttggacatgattcttttttttcttttttttgagatacagtctcgctctgttgccctggctggagtgcagtggcacaatcttggttcagtgcaacctcaacctccctcccgggtttaagtgattgtcctgcctcagcctc

SEQ ID NO: 186939 - DNA, 601 bp, Human
agcactggtgagccaggggtgggttatgagcaggagacgggtggcgtgagttttgggtatagaaagacgcctctgggacctggtggggaacagactggagtagagagattggaggctggaggccaggcaggaggctgggatgagggcctaggagggctgtggggaggcacagaagaagacagggcagagagagccccaggccaggaagaaggagacttggggaccgataggctgggtagcgggagggaggaaggcggctaagagtctagtccagtgactgggtggatgacatgagagacastcagagtacccagggtgatgttgcatagtgaagatattgaggagtccagggacacccccggccatccccagccctgggcacttctaaccagaggaagagacatttgagctcagtctttaagacacatggagttggtcaaggctgggtacagcggctcgtgccagtaatcccagcactttgggaggtcaaagcaagtagatcatctgagcttgggacatggcgaaacctcgtctccaccaaaaatacaaaaattagttgggcatggcggtgcacatttaaagtcccagcagcttcacagga

SEQ ID NO: 186940 - DNA, 601 bp, Human
agaaagacgcctctgggacctggtggggaacagactggagtagagagattggaggctggaggccaggcaggaggctgggatgagggcctaggagggctgtggggaggcacagaagaagacagggcagagagagccccaggccaggaagaaggagacttggggaccgataggctgggtagcgggagggaggaaggcggctaagagtctagtccagtgactgggtggatgacatgagagacagtcagagtacccagggtgatgttgcatagtgaagatattgaggagtccagggacacccccrgccatccccagccctgggcacttctaaccagaggaagagacatttgagctcagtctttaagacacatggagttggtcaaggctgggtacagcggctcgtgccagtaatcccagcactttgggaggtcaaagcaagtagatcatctgagcttgggacatggcgaaacctcgtctccaccaaaaatacaaaaattagttgggcatggcggtgcacatttaaagtcccagcagcttcacaggaggctgaggtggaaggatcacttgagcctgtgaggcagaggttgcagtgagccaagatcac

SEQ ID NO: 186941 - DNA, 601 bp, Human
actaaaaatacaaaattaggcaggcgcggtggtgcttgcctgtaatcccagctactcaggaggctgaggcaggagaatcgcttggacctgggaggcggaggttccagcgagctgagattgcaccattgcactccagcctaggtgacagagcaagactccatctcaataataaataaataaataaataagaagaatagttggtcaggataaggggtggtataaggtttttcaggcagagagaacagcatctgcaaagtcctagagataagaaatcacttgacatgtttgggagacaccttgmagccagtgttgatagagaaaaaaaaaaagaattttggggtgaaaagagtttgaagtttgagggtgggaactctcagagatgcggcttcagaggaaggcaaagccagaacaaaaacagactctaggggcctggcacagtgattcacacctgtaatcccactatgttgggaggttgaggtgggaggatcacttgaactcaggagttcaagaccagcctgggaaaagtagtgagaccctatctctacttaaaaaaaaaaagaggctgggcgtggtggctcatgcctgtaatcccagcactttg

SEQ ID NO: 186942 - DNA, 601 bp, Human
tgagggtgggaactctcagagatgcggcttcagaggaaggcaaagccagaacaaaaacagactctaggggcctggcacagtgattcacacctgtaatcccactatgttgggaggttgaggtgggaggatcacttgaactcaggagttcaagaccagcctgggaaaagtagtgagaccctatctctacttaaaaaaaaaaagaggctgggcgtggtggctcatgcctgtaatcccagcactttggaaggccgaggcaggcggatcacaaggtcaggagatcaagaccatcctggctaacacrgtgaaaccccgtctctactaaaaaaaatacaaaaaattagctgggtgtggtggcaggtgcctgtagtcccagttacttgtgaggctgaggcaggagaatggcgtgaacctgggaggtggagcttgcagtgagccaagatcgcaccactacactccagcctgggcgacagagcgagactctgtctcaaaaataaataaataaatacatacatacatacataaaaatttaaaaaaaagaaaagaagaaagagaaagaaaagaaagaaagaaagagaaagaaaagaaagaaagaaagaaagaa

SEQ ID NO: 186943 - DNA, 601 bp, Human
tgggcgtggtggctcatgcctgtaatcccagcactttggaaggccgaggcaggcggatcacaaggtcaggagatcaagaccatcctggctaacacggtgaaaccccgtctctactaaaaaaaatacaaaaaattagctgggtgtggtggcaggtgcctgtagtcccagttacttgtgaggctgaggcaggagaatggcgtgaacctgggaggtggagcttgcagtgagccaagatcgcaccactacactccagcctgggcgacagagcgagactctgtctcaaaaataaataaataaatamatacatacatacataaaaatttaaaaaaaagaaaagaagaaagagaaagaaaagaaagaaagaaagagaaagaaaagaaagaaagaaagaaagaaagaaagaaagaaagaaagaaagaaagaaagagagagaaagaaagaggcgggccaggccaggcgcggtggctcacgcttgtaatcccagccctttgggaggctgaggcgggcggatcacctgaggtcatgagttcgagaccaccctggtcaacatggtgaaaccctgtctctactaaaaatacaaaaaattagccgggcatggtcg

SEQ ID NO: 186944 - DNA, 601 bp, Human
aacaagagcaagactccgtttaaaaaaaaaaaaagtgaactatttctgaacggattggtaaatagcaacagctcccagctcctgccatgccagcctctacccccaggacctcccgcgattcagtaagtgaagacttaacacctggcacatcaggggcctcagggaggcttctcgtgaacttttggatcacgtgtctgcaaccgtgtgtgctgggtgggagtggaaaagcattccctaatgtagtgagcgagtgttgagaaatattgaacactcctgggactggggtgtctgccagatagcrggtgtgtctcagaatgggtgatttatgttagggatgtccctgcggagggtgccctaatcactccccattctgccccagttccagaggccccaggagcagtacccgcccctgaagtttgggaccgtgcccaacggctccacggagaagaacatccgcagcaactatcccgacatgcacagctacatggtgcgctacaaccagccccgcgtagaggaagcgctcactcagctcaaggcagggtcagcgcagactcgggccgggggtgggggttgggccgctggggacctgaggatgctcaaa

SEQ ID NO: 186945 - DNA, 601 bp, Human
ttgagatggagtcttgctttgtcacccaggctggagtgcagtggcgtgatcttggctcactgcaacctctgcctcctgggttcaagtgattctcctgcctcagcctcctgagtagctgggattacagaagcctgccaccacgcccagctaacttttgtattttcaatagagacagggtttcgccacgttggccaggctggtctcgaactcctgacctaggtaatctgcccacctcggcctcccaaagtgctgggattacaggcatgagccaccgggcccggcctaattttaattttttaaggtgtgtgtgtgtgtgtgtgtgtgtagagatggggttctcactatgttgcttaggctggtcttgaattcccaggctcaagtgatcctcctgcctcagcctcccaaagcaccaggattacgggcacgagccaccgtgcctggaaagaattttatctttaaggaaaaaaatggcaccctccatttctctcagcccagaggaatctactttcaccttgtttattgtatcactttgtgatttatctccctatctctaaataccatgtttgcatgactacctcttgatttttcaattttaggcatt

SEQ ID NO: 186946 - DNA, 601 bp, Human
gtgcagtggcgtgatcttggctcactgcaacctctgcctcctgggttcaagtgattctcctgcctcagcctcctgagtagctgggattacagaagcctgccaccacgcccagctaacttttgtattttcaatagagacagggtttcgccacgttggccaggctggtctcgaactcctgacctaggtaatctgcccacctcggcctcccaaagtgctgggattacaggcatgagccaccgggcccggcctaattttaattttttaatgtgtgtgtgtgtgtgtgtgtgtgtagagatggggttctcactatgttgcttaggctggtcttgaattcccaggctcaagtgatcctcctgcctcagcctcccaaagcaccaggattacgggcacgagccaccgtgcctggaaagaattttatctttaaggaaaaaaatggcaccctccatttctctcagcccagaggaatctactttcaccttgtttattgtatcactttgtgatttatctccctatctctaaataccatgtttgcatgactacctcttgatttttcaattttaggcatttttccatccgcttctcactatggaagacatactca

SEQ ID NO: 186947 - DNA, 601 bp, Human
ctgggatcaagtgattctcctgcctcagcctcccgagtagctggaactacaggcacacgcaaccacacccagctagttctttttatttttagtagagatggggtttcaccatattggccaggctggtcttgaacttctgacctgagatgatccgcccacctcagcctcccaaagtgttcttgggattacaggcgtgagccaccatgcctggcccacttcttttcttttctttcgaacttcttttttaaaaatttttaattgtatttttttttttacagatggtctcactatgttgcccagrctggtctcaaactcctggcctcaagcaatcctcccaccttggcctcccaaagcgatgggatgacaagcttgagtgaccactccctacctgaacttttgttaaatttattcctaaatattttattttattttattttttatttttttgccagtgtcaaactcctgaccccaaggaatctgctggcctcagcctcccaaagtgctgggattataggcatgagccaccgcacccagcctggaattgttttaatttcattttaattgttcattgctagtatataggaatataatttatttcaca

SEQ ID NO: 186948 - DNA, 601 bp, Human
ttacaggcgtgagccaccatgcctggcccacttcttttcttttctttcgaacttcttttttaaaaatttttaattgtatttttttttttacagatggtctcactatgttgcccagactggtctcaaactcctggcctcaagcaatcctcccaccttggcctcccaaagcgatgggatgacaagcttgagtgaccactccctacctgaacttttgttaaatttattcctaaatattttattttattttattttttatttttttgccagtgtcaaactcctgaccccaaggaatctgctggcytcagcctcccaaagtgctgggattataggcatgagccaccgcacccagcctggaattgttttaatttcattttaattgttcattgctagtatataggaatataatttatttcacatattttgtaatttatttcgtatattgatcttgtatcatgaaccttgttgaacttctattagccataataatttttattgtggatcctttgggatttttctatatacaattctattaattcgctagggcagccataacaaaataccatagactgagtggcttacacaacagaaatgtatcgcccca

SEQ ID NO: 186949 - DNA, 601 bp, Human
agctgagattacaggcgtgtgccaccacacctgactaatttttgtatttttagtagcaacaggatttcgccatgttggccaggctggtcatgaacttctgaactcaggtgatccgctcgaggttcaagcaattctcctgcctcagcctcccgagtggctgagattacaggcacatgccaccacacccggctaatttttgtatttttagtagagatggggtttcactatgttggccaagctggttatgaactcccgacctcaggagatccgcgccccgggcggcctcccaaagtgctggggwtagaagcatgagccaccacacccagccgtccagccatttcttagtaagcacctagtgtgtgctaggcactgttctagaccctgtggatacagtggtgaatcagacgggcaaagtccctgcctcatggaacttaaattccagtgaagggagacgtgcaatgcacggaataaatgagaatattctatagtgcattccaaggggatacgcgctatgggtaaaaatagggcagggtgaatgcatttggaaaactggggcgggagactggaggttgcagtatcaaatagggtgctcaggaaggtg

SEQ ID NO: 186950 - DNA, 601 bp, Human
cagtatcaaatagggtgctcaggaaggtgtctttggagcaaacacctgacggaggttgtaactgcccagtgggttcacgttgcccgctgcctagacagagccgatttatcaagacggggggtctgcaatggaaaaagagtcattcacgcagagccggctgtgtgggagaccggagttttattatcactcacatcagtctgcctgagcatttgggaaccagagtttttaaagataatttggcgggtaggggcttgggaagcggggagtgctgattggtcaggttggagttggactcacaggyggtcgaagtgaggttttcttgctgttttctgttcctgggtgggatggcagaactggctgagccagattaccagtctgggtggcgtcagctgatccatagagtgtagggtctgtagaatatctcaagcactcatcttaggttttacagtaatgatgtcatccccaggagcaatcgggggagccagaggctgcatggcccctaaccttaatttctaatcttgcagctaatttgttagtcctgcaaaggtagactagtccccaggcaagaagggggtctttttaggaaagggctagtatcgat

SEQ ID NO: 186951 - DNA, 601 bp, Human
tccacccctgagtctttgcttcagctagagagacattcaatttgggggatccacttcctgtctgtttccccacttagcatgtatggactaattcagtccttttctctaatttccacgcaaacaaccacacacacacggcatttatatgtgagcctgtgagtgcgtggacagggtttttctgaaggtttggggacataggaggacttaaatcaacagacaggctaactactcaagactagaggttaagtattcttctctggaagatcctttggcttctcttcaactcagcatccagccgcctttttttttttttttttttttttttgagacggagtcttgctctgtcgcccaggctggagtgtagtggtgcgatctcggctcactgcaacctctgcctcccgagttcaaacgattctcttgcctcagcctcctgagtaactgggactacagatgcctgccaccacgtctggctaattttttgtatttttagtagagacagggtttcaccgtgttagccaggatggtctcgatctcctgacctcgtgatccgcctgcctcggcctcccaaagtgctgggattacaggcattagccaccgtgcc

SEQ ID NO: 186952 - DNA, 601 bp, Human
tttttttttttttttttttttttgagacggagtcttgctctgtcgcccaggctggagtgtagtggtgcgatctcggctcactgcaacctctgcctcccgagttcaaacgattctcttgcctcagcctcctgagtaactgggactacagatgcctgccaccacgtctggctaattttttgtatttttagtagagacagggtttcaccgtgttagccaggatggtctcgatctcctgacctcgtgatccgcctgcctcggcctcccaaagtgctgggattacaggcattagccaccgtgcccrgcctaatttttgtatttttaatagagacggggtttcgccatgttggccaggctggtatcgaactcctgacctcatgtgatccgcccgcctcagcctcccaaagcgctgggattacaggcgtgagtcactgcgcccggccaatatgaactcatattctatataggattctgggagtaatttttgtgttcatttgttttgtttttagagacagggtatccctctgtcacccaggctggggtgcaatggtgtcatcatagctcactgcagcttcaaactcctgggctgaagggatcctcctgc

SEQ ID NO: 186953 - DNA, 601 bp, Human
tggccaggtgcggttgctcacgcctgtaatctcagcactttgggaggctgagacaggtggaccacaaggacaggggttcgagatcagcctggccaacatggtggaaccccgtctctactaaaaatgcaaaaattagctgggcgtggtagtgggcacctataatcccagctacttgggaggctgaggcaggagaatcgcttgaacccaggagtcggatcttgcagtgagccgagactgtgccactgcactccagcctgggtgacagagtgagactctgtctcaaaaaaaaaaaaaaaaaaaraaagaaagaaaaagtcacagttaacacttctccagcacctcctttgcatgaggtactatctaagctttccctatagtccctgctactggggaggctgagataggaggatcgcttgagcccaggatttctggtccagcctggacaacatagcaagaccctgtctcttaaacaacatacttttgcaacaactctgaagggagatactgctgccatgcccattttactgatgttgaaactgaggcactgagaagtgcaatgatttgctcaagagctcagggccagttaggatttggagcagtt

SEQ ID NO: 186954 - DNA, 601 bp, Human
agttggaggttacaggtgaggaggttccaggcctggcggccagggcatctaggtgggactgaccctaccctccattccccctccccccaggaagctggacgccttcatctacgatgctgcagtgctcaattacatggcccgcaaggacgagggctgcaagcttgtcaccatcggctccggcaaggtcttcgccacgacaggctatggcatcgccctgcacaagggctcccgctggaagcggcccatcgacctggcgttgctgcagttcctgggggatggtgcggctgcacacagggatttycacagcggagagggggagggcgaggcccctgggttccggggaagaaagggacaaagacccggacaccagggtctgagggaggaaggggctaagggcctacattcccacatcacagacaagggtcctcagagggtactcatagcaggtgacttttgaccgcccctccctagatgagatcgagatgctggagcggctgtggctctctgggatctgccacaatgacaaaatcgaggtgatgagcagcaagctggacatcgacaacatggcgggcgtcttctacatgctcctggtggccatggg

SEQ ID NO: 186955 - DNA, 601 bp, Human
tcaggaataggggggcagggacagggtaggtggagggttgggcaggtgagagaaaaaatgacagctctgtaatttcactgtaattacccaacccccatcccctgcgcgctgtacccccttcccctcccccaccatctgtaaggggcaggaaggggctctattcctggggcacatccctcatccctagactccatgtgaccccatgacgccccgcccaagcccgtgtcaccaccgtgtgagcacccgacacaccccctccctgggaccccaggggtccagactcccggaccaaaaggaagaggaggctggggcctacactcttgtgaactaagcggggaggacgttggggacgttggtgcctgggtccttagggtggacgggcttcagagccggcgcttttgggtcctgggcgctaagggatctaggggcctaaacacctgagtaattgagtagattaaggttgggaagatggactccccgcacgcaggtttctatgggaccccaccccacggcacctgagtccctaagggggtagggtgtccgaagtgggtgagatgggggttagaactcacagctggccggctctttgggcttgctggtc

SEQ ID NO: 186956 - DNA, 601 bp, Human
gttcaggaataggggggcagggacagggtaggtggagggttgggcaggtgagagaaaaaatgacagctctgtaatttcactgtaattacccaacccccatcccctgcgcgctgtacccccttcccctcccccaccatctgtaaggggcaggaaggggctctattcctggggcacatccctcatccctagactccatgtgaccccatgacgccccgcccaagcccgtgtcaccaccgtgtgagcacccgacacaccccctccctgggaccccaggggtccagactcccggaccaaaaggaagaggaggctggggcctacactcttgtgaactaagcggggaggacgttggggacgttggtgcctgggtccttagggtggacgggcttcagagccggcgcttttgggtcctgggcgctaagggatctaggggcctaaacacctgagtaattgagtagattaaggttgggaagatggactccccgcacgcaggtttctatgggaccccaccccacggcacctgagtccctaagggggtagggtgtccgaagtgggtgagatgggggttagaactcacagctggccggctctttgggcttgctgg

SEQ ID NO: 186957 - DNA, 601 bp, Human
agcagtcctcccacctcagcctcccaagtggcttgtagaaatggggttttgccatgttgcccaggctggtcttgaactcccgagctcaagagatcctcctgcctcagccccctaaaatgctgggattacacgagtgaggcccctcgcccagttgacactgtcttcataaacctcaggcccctgcccccttgtgccccgtggccaaggaggactaatctgtggctgcaggccaggagaggctgagcactaatcccaaggagaagcccaggcttgactgtgagaaaaggcccctccctggctrtggggcatgtctccagccaagtctatctcccacatccagctctgctcaccttctgctcctccggcacctggatttttcttgccttcttcatgattggctggggcttaagttcctcttctgagaagcgatgtcttcgagggtcaaaggtctcgtggccaggaatgcttgatagggcaagatcagctgggtcgggttcaaaggtcatcaacacctccacggtgtctgggtccacagggctgggtgtgtcccgagaggtcaggccttggggaaacagcacgtgtcagctgagtgtgtatttta

SEQ ID NO: 186958 - DNA, 601 bp, Human
gacctagcagagctggctgagtcagcaccccacagtgacactgtcttttgttttaagacaaggtctccctctgttgcccaggctggagtgcagtggtgtaatcttggctcactgcagcctcaatctcccaggcacaagcagtcctcccacctcagcctcccaagtggcttgtagaaatggggttttgccatgttgcccaggctggtcttgaactcccgagctcaagagatcctcctgcctcagccccctaaaatgctgggattacacgagtgaggcccctcgcccagttgacactgtcttyataaacctcaggcccctgcccccttgtgccccgtggccaaggaggactaatctgtggctgcaggccaggagaggctgagcactaatcccaaggagaagcccaggcttgactgtgagaaaaggcccctccctggctgtggggcatgtctccagccaagtctatctcccacatccagctctgctcaccttctgctcctccggcacctggatttttcttgccttcttcatgattggctggggcttaagttcctcttctgagaagcgatgtcttcgagggtcaaaggtctcgtggccaggaatg

SEQ ID NO: 186959 - DNA, 601 bp, Human
tggagtctcgctctgtcgttcaggctggaatgcagtggcatgatctcggctcattgcaacctccacctcccaggttcaagcgattctcctgcctcagcctcccaagtagctgggattataggtgcccgctaccatgtccggctaatttttgttctttttttttttttttgagatggagttctcactctgtcgcccaggctggagtgcagtggcgcgatctcggctcactgcaacctccgtctcctgggttcaagcgattttcctacattagcctcccaagtagctgggactacagatgagygccaccatgcccagctaatttttgtatttttttgtagagacggggtttcaccatgttggccaggatggtctcctgatctcgtgatctgtccgcctcggcctcccaaagtgctgtgattacaggtgtgagacaccacacccggaacatttttgtacttttagtagaggcgaggtttcaccatgttggccaggctggtctcaaactcctgacctcaagtgatccgcccacctcagcctcctaaagtgctaggattacaggcgtgagccaacgcgcctggcccggaatgacaaagtcttgtaa

SEQ ID NO: 186960 - DNA, 601 bp, Human; identical to SEQ ID NO: 30775

SEQ ID NO: 186961 - DNA, 601 bp, Human
tcgggggctggggagagtggggagggggtgcggcagaggacaggaaaggcacatagagaaggaggggaggaggaaaagtggggccgggtctgttcagagcggtgcccctgccagaagtagcctcccagggatacccacccggtgcccagcctctcccctccaggtcagttctcaacacttcaccttccctgacctccctggctgaaatagcgtcctcgttctgttcctccctttcccctttaccctctacttctctttttttttttttttttttttttttttttgtagagatggggtctcrctacattgcccaggctggtcttgaactcctgatctcaagtgatccttctgccttggcctcccaaagtgctgggattacaggcgtgaaccaccacacctgaccatttttatttttatttttcgagacaaggtcttgctctgtcactcaggctggggtgcagtggtgcaatatcagctcatcaaacctcccaccttggcctcccaaagtgctgggactacaggtgctggtcaccaccaaattgtatactttttttttttttttttttttggaggtcttgctctgctgcccaggcttcagtgt

SEQ ID NO: 186962 - DNA, 601 bp, Human
agagggtaggcggggcatagtggctcatgcctgtaatctcagcactttgggaggctgaagtaggaggatcacttgaggccaagagttcaagcccagcctgggcaacatagcaagaccccatctctaaaaaaaaaaaattagccaggcgtggtggtgtgcgcctgtagtcccagccacttgggaggctgaggcaggaggatcactttagctagagaggtcgaggctccagtgagctgcgatcacaccactgcacttcagcctgggcaacagagtgagaccctgtctcaacaaatagaaaaasgtacaattcaatgactttgccatgtgcgtggagctggtcatccatcaccacaatcaattttagaatattttcagccgagcacagtggctcacacccataatcccaacattttgggaggccgaggcaggaggatctcttgagcctaggcgttcgagagcagcctggccaacatggtgagacctcatctctacaaaacatacaaaaattagccaggcacgatagtgtatgcctgtagttccagctacttgggaggctgagatgcgaggattgcttcagtctgggaggtggaggttgcagtga

SEQ ID NO: 186963 - DNA, 601 bp, Human
gtctactaaaaatgcaaaaactatccaggcgtggtggtgcgtgcctgtaatcccagtattcggcaggctgaggcaggagaattgcttggaaccggggggtagaggttgcagtgagccaagagtgcaccactgaactccagccttggcgatagggcaagaccctgtctcaaaaaccaaaaacaaataaaaataaaaataaagaacattatcatcatccaacaagaaactctggacctataagccatcacctcccaatcctcatatcccctcccccctgggccctggtaaccaccaatctccrttctgtttctatggatttttctattttgggcatttcatggaaatggaatctacactatgtggcctcttgtgtctggtttcttcctgagcatcacgttgtcaaggttcaaccacattgtagcatgtgtcagagtctcattcatttttatggtccaataatattttatgttatgtataaactatattttatttattcatcagttgataagcatttggattatttccactctggggcttattatgaatgaagctgctacgaacattgcatgcaagttctttttttttttttttttgagacgga

SEQ ID NO: 186964 - DNA, 601 bp, Human
cttggcgatagggcaagaccctgtctcaaaaaccaaaaacaaataaaaataaaaataaagaacattatcatcatccaacaagaaactctggacctataagccatcacctcccaatcctcatatcccctcccccctgggccctggtaaccaccaatctccgttctgtttctatggatttttctattttgggcatttcatggaaatggaatctacactatgtggcctcttgtgtctggtttcttcctgagcatcacgttgtcaaggttcaaccacattgtagcatgtgtcagagtctcattcwtttttatggtccaataatattttatgttatgtataaactatattttatttattcatcagttgataagcatttggattatttccactctggggcttattatgaatgaagctgctacgaacattgcatgcaagttctttttttttttttttttgagacggagtctcgctctgtcgcccaggctggagtgcagtggagtgaccttggctcactgcaaactccgcctcccgagttcacgccattctcttgcctcagcctcccaattagctgggactacaggcgcccaccaccatacccagctaa

SEQ ID NO: 186965 - DNA, 601 bp, Human
ccagctaatttttgtatttttagtagagacggggtttcaccatgttggccaggctggtctcgaactcctgacctcaggtgatccacctgcctcagcttcccgaagtgctgggattacaggcgtgagccactgctctcggccttgcatgcaagttcttgtttctatttttattttttgaggcagggtctcgatctttcgctcaggctggagtgcagtggtgcagtctcagctcactgcagccttgacctcctgggctcaagctatcctcccacctgagcctcctgagtagctgggacgacargtgcacaccaccacgcccagctaattaaaaaaactttttttttttttcacagacgagatctcactgtgttgcccagactggtttcaaactcccgagctcaagcaattctccctccttggcctcccaaagtgttaggattataggagtgagcctctgcactgggccctgcacacaagttcttacgtggacatatgttttctttgttttttatggagacaggttctcactgttgcccaggctggagtgcagtggcgagatctctgttcactgcaacctctgcctccacaggttcaaacaatt

SEQ ID NO: 186966 - DNA, 601 bp, Human
ttcaccatgttggccaggctggtctcgaactcctgacctcaggtgatccacctgcctcagcttcccgaagtgctgggattacaggcgtgagccactgctctcggccttgcatgcaagttcttgtttctatttttattttttgaggcagggtctcgatctttcgctcaggctggagtgcagtggtgcagtctcagctcactgcagccttgacctcctgggctcaagctatcctcccacctgagcctcctgagtagctgggacgacaagtgcacaccaccacgcccagctaattaaaaaaactttttttttttttcacagacgagatctcactgtgttgcccagactggtttcaaactcccgagctcaagcaattctccctccttggcctcccaaagtgttaggattataggagtgagcctctgcactgggccctgcacacaagttcttacgtggacatatgttttctttgttttttatggagacaggttctcactgttgcccaggctggagtgcagtggcgagatctctgttcactgcaacctctgcctccacaggttcaaacaattctcctgcctcagcctccggagtagctgggaccaca

SEQ ID NO: 186967 - DNA, 601 bp, Human
ttttttgaggcagggtctcgatctttcgctcaggctggagtgcagtggtgcagtctcagctcactgcagccttgacctcctgggctcaagctatcctcccacctgagcctcctgagtagctgggacgacaagtgcacaccaccacgcccagctaattaaaaaaactttttttttttttcacagacgagatctcactgtgttgcccagactggtttcaaactcccgagctcaagcaattctccctccttggcctcccaaagtgttaggattataggagtgagcctctgcactgggccctgcrcacaagttcttacgtggacatatgttttctttgttttttatggagacaggttctcactgttgcccaggctggagtgcagtggcgagatctctgttcactgcaacctctgcctccacaggttcaaacaattctcctgcctcagcctccggagtagctgggaccacagacatgcaccaccacgcccagctaatttttgtatttttagtagagacggggtttcaccatgttggccaggctggtttcaaactcctcacctcagtcaatctacccacctcagcctcccaaagtgctgggattata

SEQ ID NO: 186968 - DNA, 601 bp, Human
atctacccacctcagcctcccaaagtgctgggattataggcgtgagccaccgtgccagcccgaagtggctttatcttttttcattcttcccagcaatagatgatcctctattgccccacatcttctccagtgattagcatcaacagagatttacttattggagacaaggtcttgctcggttgcccaggctgaagtgtagtgggaagatcatggctcactgcaacctcgaactcctgggcacaagtgatgctcccaccccagcctccctaatagccaccacacccagctaatttttgtagcrataagggtctctggttggtctcgaatgcctgggctcaagcgatcttcctgcctcagcctcccaaagtgctgggattacaggcatgagccactgtgcctggccagtttttttctaaagctattttgataggtgcctactggtgtttcactgtagtattaatttgcatttccctaacagctaatggtgtttgagcatcttttcatgtgctcattagccatcatatatattccttttttttttttttttttttttttgagatggagtttcactcttatttcccaggctggagtgcaatggcgc

SEQ ID NO: 186969 - DNA, 601 bp, Human
cccgaagtggctttatcttttttcattcttcccagcaatagatgatcctctattgccccacatcttctccagtgattagcatcaacagagatttacttattggagacaaggtcttgctcggttgcccaggctgaagtgtagtgggaagatcatggctcactgcaacctcgaactcctgggcacaagtgatgctcccaccccagcctccctaatagccaccacacccagctaatttttgtagcgataagggtctctggttggtctcgaatgcctgggctcaagcgatcttcctgcctcagcytcccaaagtgctgggattacaggcatgagccactgtgcctggccagtttttttctaaagctattttgataggtgcctactggtgtttcactgtagtattaatttgcatttccctaacagctaatggtgtttgagcatcttttcatgtgctcattagccatcatatatattccttttttttttttttttttttttttgagatggagtttcactcttatttcccaggctggagtgcaatggcgcgatctcagctcactgtaacctccacctcccaggttcaagtgattctcctgcctcagcc

SEQ ID NO: 186970 - DNA, 601 bp, Human
cgcgatctcagctcactgtaacctccacctcccaggttcaagtgattctcctgcctcagcctccctagtagctgggattacaggcatgtgccaccatgcctggtttttgcatttttttttttttttagtagatcgggggtttctccatgttggtcaggctggtctcgaactcccaatctcaggtgatccgcccaactcggcctcccaaagtgctgggattacaggcatgagccaccgcacccggccatatattcctttttgtttgttctattacttgccactgacttgaagctcacaaatrtattatttggtaaagtgttgaaatatttttcctcttttgaattggattgttttcttatcattgagatttgagagttttttttttttttttttgagacagagtctcgctctgtcacctaggctggagtgcagtggcgcgatctcagctgcctcccaggttcacgccattctcctgcctcagcctcccgagtagctgggactacaggcgcccaccaccacgcccggctaattttttgtatttttagtagagacggggtttcaccgtgttagccaggatggtctcgatctcctgaccttgtga

SEQ ID NO: 186971 - DNA, 601 bp, Human
gggactacaggcgcccaccaccacgcccggctaattttttgtatttttagtagagacggggtttcaccgtgttagccaggatggtctcgatctcctgaccttgtgatccacccgcctcggcctcccaaagtgctgggattacaggcgtgagccaccgtgcccggccgagagttctttatatgatgtgagtacagatccttgatcagatacttgttttgcaaatattttctcccaatctatggcttgtcttttcattttcatatcagcgtcttctcagagtatgttttattattattattatattattattattattattattattattagagatgaagtctcgctctgtcgcccaggctggagtgtagtggtgccatcttggcttactgcaacctccgcctcctgggttcaagcgattctcctgcctcaacctcccgagtagctgggattacaggtgcccgccaccatgcctggctaatttttgaattattagtagagacggggttttgccatgtgggccaggctggtctcgaacccctgacctcaggagatccacctgcctcggcctcccaaagtgcagggattacaggcgtgagccact

SEQ ID NO: 186972 - DNA, 601 bp, Human
cctcggcctcccaaagtgcagggattacaggcgtgagccactgtgaccagccttgattttgcttatgtttttctttctccttataccttgacattgtcccatcttggaactttaaacaaataagtttctggtttttttaaatagttccgtggtatttcataacataggatatacaataattcttgcttaaccagtttcctagtgactgatattaatgttcaatcttttgcctatgtatatacaatgtaaactttaaacacaatgccttgtacatgcagtacttggcattgaacacacttayctctaggacaaatatctggacaaagaattgcttggtcagagtctgtacatttgtaattttgatatgtaatggctacatttccctctatagaaattgtggaagcttgttctctgagccgggggtgtggttaacacctgaaatcccagcactttgggaggtcgaggcaggcggatcacttgaggccagcaataggagaccagactggcctacatgaccccatatctactaaaaatacaaaaattagctgggcatggtggtgcgcgcctgtggtcccaactactcggaaggctgaggcatgag

SEQ ID NO: 186973 - DNA, 601 bp, Human
gtttttttaaatagttccgtggtatttcataacataggatatacaataattcttgcttaaccagtttcctagtgactgatattaatgttcaatcttttgcctatgtatatacaatgtaaactttaaacacaatgccttgtacatgcagtacttggcattgaacacacttacctctaggacaaatatctggacaaagaattgcttggtcagagtctgtacatttgtaattttgatatgtaatggctacatttccctctatagaaattgtggaagcttgttctctgagccgggggtgtggttmacacctgaaatcccagcactttgggaggtcgaggcaggcggatcacttgaggccagcaataggagaccagactggcctacatgaccccatatctactaaaaatacaaaaattagctgggcatggtggtgcgcgcctgtggtcccaactactcggaaggctgaggcatgagaattgcttgaactggggaggcagaggttgtagtgagccaagatcgtaccaatgcactccagtctgggcaacagagcgagaccctgtctcaaaataaaatgaaaaaagaattatttgcagtcaggcacggt

SEQ ID NO: 186974 - DNA, 601 bp, Human
acaatgccttgtacatgcagtacttggcattgaacacacttacctctaggacaaatatctggacaaagaattgcttggtcagagtctgtacatttgtaattttgatatgtaatggctacatttccctctatagaaattgtggaagcttgttctctgagccgggggtgtggttaacacctgaaatcccagcactttgggaggtcgaggcaggcggatcacttgaggccagcaataggagaccagactggcctacatgaccccatatctactaaaaatacaaaaattagctgggcatggtggygcgcgcctgtggtcccaactactcggaaggctgaggcatgagaattgcttgaactggggaggcagaggttgtagtgagccaagatcgtaccaatgcactccagtctgggcaacagagcgagaccctgtctcaaaataaaatgaaaaaagaattatttgcagtcaggcacggtggctcatgcctgtaatcccagcacttgggaggccaaggcaagtggatagcttaagcccaggagttcaagaccagcctgggcaacatggcaaaatcctatctctacaaaaaaaaaaaattagccaggcg

SEQ ID NO: 186975 - DNA, 601 bp, Human
ttacagggtccagctccaatatcacaaaaacggcagagaggcatgaagttggagccaccagcctgtaaactgataactggtacaaggtggttgttagaatgaaatccagtgaatggattggatgtggtggcttacgcctgtaatcccagcactttgggaggccaaggcaggaggatcgctagaggccaggagctccagaccagcctgggcaacacagtgagaccccatctctacaaaaattttaaaaattaggtgggcgcaggctgggcatggtggctcatgcctataatcccagcacttygggaggccaaggcaggtggatcacctgaggtcaggagtttgagaccaacctggccaacatggcaaaaccccatctctactaaaaatacaaaaactagccaggcgtggtggcacacttctagtcccagctacttgggaggctgaggcaggagaattgcttgaatccaggaggcagaggtttcagtgagccgagatagagccactgcactccagcctgggcaacagagtgagactccttctcaaaaaaaaaaaaaaaaaaaaaaaagctgggtacatgtggtctagctactccagaggctga

SEQ ID NO: 186976 - DNA, 601 bp, Human
ttaaaaattaggtgggcgcaggctgggcatggtggctcatgcctataatcccagcactttgggaggccaaggcaggtggatcacctgaggtcaggagtttgagaccaacctggccaacatggcaaaaccccatctctactaaaaatacaaaaactagccaggcgtggtggcacacttctagtcccagctacttgggaggctgaggcaggagaattgcttgaatccaggaggcagaggtttcagtgagccgagatagagccactgcactccagcctgggcaacagagtgagactccttctcaaaaaaaaaaaaaaaaaaaaaaaagctgggtacatgtggtctagctactccagaggctgaggtgggaggatcacttgagcctgggagttggaggctgaagctgaagtaagctgtgactgcaacagtgcacaccagcccaggtcacagagcggaatcctgtctcaaaaagaattaaatgcaatgaatactaacagaaagtaattttgaacgtaattgtttctcttctgaacagcctgtggtctcctgaaattcaaaactgtgaattgggtccttgatgaggtccctttccactaggtaacat

SEQ ID NO: 186977 - DNA, 601 bp, Human
tcagccgggcgcagtggcttactcctgtaatcccagcactttgggaggctgaggcaggtggatcactggaggtcaagagttcgagaccagcctggctaacatggtgaaatcccatctctactaaaaataccaaaaattagccaggcgtggtggtgcatgcctgtaaccccagctactagggaggctgaggcaggagaatcacttgaaaccgggaggcggaggttgcagtgagccaagatcgcgccattgcactccagcttgggcaacaagagcaaaactccgtctcaaaaagaaaaaaagkgggggtaggggggagggatagcattaggagatatacctaatgttaaatgatgagttaatgggtgcagcacaccaacatggcacatgtatacatatgtaactaacctgcacgttgtgcacatgtaccctaaaacttaaagtataataaaaaaaggggtgaccctcaaaagtgggcagtgaaaagtgaaaagagcagagatttttatgtccagacacctgggttcaattccagctttctccatgtattaaaggagtgcctgctgggcatgatgcctctgctcccagcaccttgggaggctga

SEQ ID NO: 186978 - DNA, 601 bp, Human
aggcaggtggatcactggaggtcaagagttcgagaccagcctggctaacatggtgaaatcccatctctactaaaaataccaaaaattagccaggcgtggtggtgcatgcctgtaaccccagctactagggaggctgaggcaggagaatcacttgaaaccgggaggcggaggttgcagtgagccaagatcgcgccattgcactccagcttgggcaacaagagcaaaactccgtctcaaaaagaaaaaaagtgggggtaggggggagggatagcattaggagatatacctaatgttaaatgaygagttaatgggtgcagcacaccaacatggcacatgtatacatatgtaactaacctgcacgttgtgcacatgtaccctaaaacttaaagtataataaaaaaaggggtgaccctcaaaagtgggcagtgaaaagtgaaaagagcagagatttttatgtccagacacctgggttcaattccagctttctccatgtattaaaggagtgcctgctgggcatgatgcctctgctcccagcaccttgggaggctgaggcaggaggattgcttgagcccaggagttcaagaccagcctgggcaacata

SEQ ID NO: 186979 - DNA, 601 bp, Human
cacaccaacatggcacatgtatacatatgtaactaacctgcacgttgtgcacatgtaccctaaaacttaaagtataataaaaaaaggggtgaccctcaaaagtgggcagtgaaaagtgaaaagagcagagatttttatgtccagacacctgggttcaattccagctttctccatgtattaaaggagtgcctgctgggcatgatgcctctgctcccagcaccttgggaggctgaggcaggaggattgcttgagcccaggagttcaagaccagcctgggcaacatagtgggaccgtatgtctwctaaaaataaaaataagaaattagccaggtgtggttgtgtgcacctgtggtctcagctactcgggaggctgaggcaggaggatctcttaagcccgggatttcaaggctgcagtgagctgtgatcacaccactgcactccagcctgggtgacagagcaagattctgtccccaaaaaaataaataagtaaagcaattctggctgtactaatagatcagcctcagaatttcagcggctgaagccaagtttgtttctttttcctataaactgtagttggtgcaggaagggtggaaggaagttgg

SEQ ID NO: 186980 - DNA, 601 bp, Human
ctgcaccactttcctagctttgtccccttggacgagcgacatggtttctgtaaggctcagtttctggctccgaaaatgaggttaagcaaccttgccttctctgccagctgtaaggaatcagtgtgataaaataggtggtaaattgctcaataaatgctgtcaggcagggcgtggtggctcacagctgtaatcccagcagtttgggaggccgaggtgggcagagcacctgaggtcaggagttcgagaccagcctggccaacatggggagacctcgtctctactaaaaatacaaaattagccrggcgtggtggtgggcgcttgtaatgctagctactcggctgaggctgaggcaggagaattgcttgagcctgggaggtggaggttgcagtgagccgagatcgcgccattgcactccagcgtgggcaacagagtaagactctgtcttaaaaaaaaaataataaaaggtggcaaattgctcaataagtgctgttgtgattattctgatgatatctccctcttcagccctcccacacccaattaatctgctcgatttctcccaacaggcacgacctggatgatcgagatcatctgcttaatcctg

SEQ ID NO: 186981 - DNA, 601 bp, Human
ggacgagcgacatggtttctgtaaggctcagtttctggctccgaaaatgaggttaagcaaccttgccttctctgccagctgtaaggaatcagtgtgataaaataggtggtaaattgctcaataaatgctgtcaggcagggcgtggtggctcacagctgtaatcccagcagtttgggaggccgaggtgggcagagcacctgaggtcaggagttcgagaccagcctggccaacatggggagacctcgtctctactaaaaatacaaaattagccaggcgtggtggtgggcgcttgtaatgctasctactcggctgaggctgaggcaggagaattgcttgagcctgggaggtggaggttgcagtgagccgagatcgcgccattgcactccagcgtgggcaacagagtaagactctgtcttaaaaaaaaaataataaaaggtggcaaattgctcaataagtgctgttgtgattattctgatgatatctccctcttcagccctcccacacccaattaatctgctcgatttctcccaacaggcacgacctggatgatcgagatcatctgcttaatcctgaaggaaggggatccatcctggatccgctc

SEQ ID NO: 186982 - DNA, 601 bp, Human
taagcaaccttgccttctctgccagctgtaaggaatcagtgtgataaaataggtggtaaattgctcaataaatgctgtcaggcagggcgtggtggctcacagctgtaatcccagcagtttgggaggccgaggtgggcagagcacctgaggtcaggagttcgagaccagcctggccaacatggggagacctcgtctctactaaaaatacaaaattagccaggcgtggtggtgggcgcttgtaatgctagctactcggctgaggctgaggcaggagaattgcttgagcctgggaggtggaggytgcagtgagccgagatcgcgccattgcactccagcgtgggcaacagagtaagactctgtcttaaaaaaaaaataataaaaggtggcaaattgctcaataagtgctgttgtgattattctgatgatatctccctcttcagccctcccacacccaattaatctgctcgatttctcccaacaggcacgacctggatgatcgagatcatctgcttaatcctgaaggaaggggatccatcctggatccgctccgtgcccatctgggagcgggcaccctggtgtgagaccattgtgggtgccttca

SEQ ID NO: 186983 - DNA, 601 bp, Human
cagtgtgataaaataggtggtaaattgctcaataaatgctgtcaggcagggcgtggtggctcacagctgtaatcccagcagtttgggaggccgaggtgggcagagcacctgaggtcaggagttcgagaccagcctggccaacatggggagacctcgtctctactaaaaatacaaaattagccaggcgtggtggtgggcgcttgtaatgctagctactcggctgaggctgaggcaggagaattgcttgagcctgggaggtggaggttgcagtgagccgagatcgcgccattgcactccagcstgggcaacagagtaagactctgtcttaaaaaaaaaataataaaaggtggcaaattgctcaataagtgctgttgtgattattctgatgatatctccctcttcagccctcccacacccaattaatctgctcgatttctcccaacaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagct

SEQ ID NO: 186984 - DNA, 601 bp, Human
gataaaataggtggtaaattgctcaataaatgctgtcaggcagggcgtggtggctcacagctgtaatcccagcagtttgggaggccgaggtgggcagagcacctgaggtcaggagttcgagaccagcctggccaacatggggagacctcgtctctactaaaaatacaaaattagccaggcgtggtggtgggcgcttgtaatgctagctactcggctgaggctgaggcaggagaattgcttgagcctgggaggtggaggttgcagtgagccgagatcgcgccattgcactccagcgtgggcracagagtaagactctgtcttaaaaaaaaaataataaaaggtggcaaattgctcaataagtgctgttgtgattattctgatgatatctccctcttcagccctcccacacccaattaatctgctcgatttctcccaacaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatc

SEQ ID NO: 186985 - DNA, 601 bp, Human
tcaataaatgctgtcaggcagggcgtggtggctcacagctgtaatcccagcagtttgggaggccgaggtgggcagagcacctgaggtcaggagttcgagaccagcctggccaacatggggagacctcgtctctactaaaaatacaaaattagccaggcgtggtggtgggcgcttgtaatgctagctactcggctgaggctgaggcaggagaattgcttgagcctgggaggtggaggttgcagtgagccgagatcgcgccattgcactccagcgtgggcaacagagtaagactctgtcttaaaaaaaaaataataaaaggtggcaaattgctcaataagtgctgttgtgattattctgatgatatctccctcttcagccctcccacacccaattaatctgctcgatttctcccaacaggcacgacctggatgatcgagatcatctgcttaatcctgaaggaaggggatccatcctggatccgctccgtgcccatctgggagcgggcaccctggtgtgagaccattgtgggtgccttcagcctcccggaccagtacagcccccgcctcatgagctcccatcttcccatccagatcttcaccaa

SEQ ID NO: 186986 - DNA, 601 bp, Human; identical to SEQ ID NO: 30776

SEQ ID NO: 186987 - DNA, 601 bp, Human; identical to SEQ ID NO: 30777

SEQ ID NO: 186988 - DNA, 601 bp, Human; identical to SEQ ID NO: 30778

SEQ ID NO: 186989 - DNA, 601 bp, Human; identical to SEQ ID NO: 30779

SEQ ID NO: 186990 - DNA, 601 bp, Human; identical to SEQ ID NO: 30780

SEQ ID NO: 186991 - DNA, 601 bp, Human; identical to SEQ ID NO: 30781

SEQ ID NO: 186992 - DNA, 601 bp, Human; identical to SEQ ID NO: 30782

SEQ ID NO: 186993 - DNA, 601 bp, Human; identical to SEQ ID NO: 30783

SEQ ID NO: 186994 - DNA, 601 bp, Human; identical to SEQ ID NO: 30784

SEQ ID NO: 186995 - DNA, 601 bp, Human; identical to SEQ ID NO: 30785

SEQ ID NO: 186996 - DNA, 601 bp, Human; identical to SEQ ID NO: 30786

SEQ ID NO: 186997 - DNA, 601 bp, Human; identical to SEQ ID NO: 30787

SEQ ID NO: 186998 - DNA, 601 bp, Human; identical to SEQ ID NO: 30788

SEQ ID NO: 186999 - DNA, 601 bp, Human; identical to SEQ ID NO: 30789

SEQ ID NO: 187000 - DNA, 601 bp, Human; identical to SEQ ID NO: 30790

SEQ ID NO: 187001 - DNA, 601 bp, Human; identical to SEQ ID NO: 30791

SEQ ID NO: 187002 - DNA, 601 bp, Human; identical to SEQ ID NO: 30792

SEQ ID NO: 187003 - DNA, 601 bp, Human; identical to SEQ ID NO: 30793

SEQ ID NO: 187004 - DNA, 601 bp, Human; identical to SEQ ID NO: 30794

SEQ ID NO: 187005 - DNA, 601 bp, Human
ggtgggaaggggcctgagactcagagacctgcctggtccccaaatccagttattcggctctcgatcctctcacccgccgcggcccccatcgaacccgacttttcatactagaaagtgacaggtccagataaaggcagcaaagccaaataactaagagtggctgcgggtccagccacctgggtcggaatcctggctctgccacttcctggctttgtaaacccagtcatatcagcctccgagtacctccacttggtcatctactaagtgggggcggtaggctatgactgacccatccctgctytcctggcccccagagtaggtccccagtatcgggaattgctccctccgggcagccgcagaccccctgccgccctccagcgtgcccctagcccaaaaccacggcggatggcagcggattatccagccccgaacgccgcaaagcgagctcaccatgatggcgcctcctgctcggccaggtccggaaagagagaacgggctggggtgggcggggaaagcctcaagcgagtggcgccgccgtgacgtcacatgggtgcgacgcggcgctctaccacgatccggacttctctgtggtgagttggac

SEQ ID NO: 187006 - DNA, 601 bp, Human
cttaagtttttcagactgtgttgacaattacaagaactatttaatagctccacttatgcagcacttactgtgtgcaaaaccccgtgatgagcatctcctgtgaattatttcttcccaaattcacaaacttgtcagatgagattactgtgtacccaacgaacagccagacactggggcaaaggctcaaaaaccatcacaaggtgggaaggggcctgagactcagagacctgcctggtccccaaatccagttattcggctctcgatcctctcacccgccgcggcccccatcgaacccgacttytcatactagaaagtgacaggtccagataaaggcagcaaagccaaataactaagagtggctgcgggtccagccacctgggtcggaatcctggctctgccacttcctggctttgtaaacccagtcatatcagcctccgagtacctccacttggtcatctactaagtgggggcggtaggctatgactgacccatccctgctctcctggcccccagagtaggtccccagtatcgggaattgctccctccgggcagccgcagaccccctgccgccctccagcgtgcccctagcccaaaaccacgg

SEQ ID NO: 187007 - DNA, 601 bp, Human
gccctggttgctcccagagctccaagtcctgcctcccttccagacagacaagacccagcggctcccaggtctaccgtgctctctggaccagccactcaccatccgggaaagggacagaggcggccggttggtgcgactcataaacaacctcttcaacacaacctggttgaatgtggagttggttcttctggccagaaacctgtataactggagggacgggaagacagtgagaagctgggacagcctgctcccccgcagccttccagtgaaggggcaaacacatgatgatctggactaaaakaatctttatccctttcccccaacccaccgacctagagggagaaagctggcccaggtccttcctggccaaggacctagaaaatcctggctccactcccgagctgtacacagcctagaggctgaaaatacaaatgcaggagaccctggaacagaaccagagacccgagactgctctgcaggcccctgggaggagcttggtgccagcactagaatggaggatctgcaagtcagacctggggtgacccttcccaaagacctcagggcccagcctcaccttgaccaacagcctcaggtagatatc

SEQ ID NO: 187008 - DNA, 601 bp, Human
gtataatgtcccatggtgagcccctggggttcagaagctggcccgactcctgagggacagaggagggggctgggactcctggtcctgggggggaggagggagctgggaacccaggttcctgagtctgaagaaggaggcgccgggagggccggactcctgggtccccgccttggcggcacctggcacgaagtttccctggagattatccttgtagctccaccagtcctcggggtcaggtgctggtccgatgtgagctgggaagagagcagcctgaatccctctccttggcatccccacctcyaccctccctcgggggctcctcccgggaaccccaggtcttacctgctgcccccagtgcagcccagagtaccagcgctcgaggggcgctcagacgagctgcagcccccatccccaggaggcctccgagggacccctgcccaacgccctgcccccctctctcagctcctctgtcccctccttctgggaccctgtccctccaggacttccagctttcctctcctccccacagggagtcccagttccccaaatgccaaagcagccagggactgagatccgcccttcaaacccactcttcttctct

SEQ ID NO: 187009 - DNA, 601 bp, Human
gcatgtataatgtcccatggtgagcccctggggttcagaagctggcccgactcctgagggacagaggagggggctgggactcctggtcctgggggggaggagggagctgggaacccaggttcctgagtctgaagaaggaggcgccgggagggccggactcctgggtccccgccttggcggcacctggcacgaagtttccctggagattatccttgtagctccaccagtcctcggggtcaggtgctggtccgatgtgagctgggaagagagcagcctgaatccctctccttggcatccccayctccaccctccctcgggggctcctcccgggaaccccaggtcttacctgctgcccccagtgcagcccagagtaccagcgctcgaggggcgctcagacgagctgcagcccccatccccaggaggcctccgagggacccctgcccaacgccctgcccccctctctcagctcctctgtcccctccttctgggaccctgtccctccaggacttccagctttcctctcctccccacagggagtcccagttccccaaatgccaaagcagccagggactgagatccgcccttcaaacccactcttctt

SEQ ID NO: 187010 - DNA, 601 bp, Human
agtaggaggacaaggagtcagaaatagagactggatcccagggctggtatctgctgagtgggctgtggtctggactcccagatcccaggggaggaggggctagggacctagactcctgggtctgagggaggactgggctcagatccagaattctgggtcctagaagaatcttggaatagtttccaagtttagcagagacgggtttcaccaagttggccaggctggtcttgaactcctgaccacaggtaatccacccacctcggcctcctaaagtgctgggatttcaagcgtgagccaccgygcccagccgatcaaacccatcttaagccactgtagatggaactacaactcccagcaggccccagtgctaccagcctacccctctgctgcctacctgccccagagccccgtgggagttgtagttcttttttttaatcgctcttatcccacagctggattattattaatgtgttggggagaggagctgcaagagaaggctggacaaggtgggggacggggccacccagcctctggttcctagcaggagccaggaccttcctctcccggcaaacacacacataatctccacccccacactttc

SEQ ID NO: 187011 - DNA, 601 bp, Human
gcacctggccaaaggtgacattttaatggggacctgaaggataagcaggggtgacttgcaaaagaacaaagagaagggcattccaagaagagggaacagcaagtgcaaaggccctgaggtggcctgtttgagtaacagcaaagagacttcatcaaagtccagtgaacagaggagagagaggttatgggggctgaatggtgcaggaccttgtggaaaacagtagagagttttgtatttttatttaaataaactgcatatataggctggatgtggtggctcacgcctgtaatcccagcacttygggaagctgaggtgggcagatcaccagaggtcaggagtttgagaccagcctggccaacatggtgaaaccccatctctactaaaaatacaaaaaccagctgggtgtggcggtgggcgcctgtaatcccagctacttgggaggctgaggcaggagaatcgcttgatcctaggaggcggaggttgcagtgatctgagatcattccattacactccagcctgggcgacagagcgagactccgactcaaaaaataaaataaaataaaaataaataaactgcatatatataacacatttgccagaa

SEQ ID NO: 187012 - DNA, 601 bp, Human
tcaaacgatcctcctgcctcagcctctcaagtagctgggaccacagtcacataccaccatgcccaactaattttcaattttcttttttttttttttttttttttggtagagagggttctccctatgttgcccaggctggtcttaaattcctgggctcaagtcatcatcctgccttagcctctgaaaaatactggaattacacgcatgaagcactgcacctggccaaaggtgacattttaatggggacctgaaggataagcaggggtgacttgcaaaagaacaaagagaagggcattccaaraagagggaacagcaagtgcaaaggccctgaggtggcctgtttgagtaacagcaaagagacttcatcaaagtccagtgaacagaggagagagaggttatgggggctgaatggtgcaggaccttgtggaaaacagtagagagttttgtatttttatttaaataaactgcatatataggctggatgtggtggctcacgcctgtaatcccagcacttcgggaagctgaggtgggcagatcaccagaggtcaggagtttgagaccagcctggccaacatggtgaaaccccatctctactaaaaat

SEQ ID NO: 187013 - DNA, 601 bp, Human
ttaattaactacatcctgagctcatgtttgggggaactgggagctctgaggtgtcatggggagctcagcttagatgggggatgtcaggaaaagcttccctgcaaaggtgacattttatttttatttatttattattttgagacaaagtctcattctggcacccaggctagattgcagtggtgccatcacagctcactgcagcctcaaactcttgggctcaaacgatcctcctgcctcagcctctcaagtagctgggaccacagtcacataccaccatgcccaactaattttcaattttctattttttttttttttttttttggtagagagggttctccctatgttgcccaggctggtcttaaattcctgggctcaagtcatcatcctgccttagcctctgaaaaatactggaattacacgcatgaagcactgcacctggccaaaggtgacattttaatggggacctgaaggataagcaggggtgacttgcaaaagaacaaagagaagggcattccaagaagagggaacagcaagtgcaaaggccctgaggtggcctgtttgagtaacagcaaagagacttcatcaaagtccagtgaacaga

SEQ ID NO: 187014 - DNA, 601 bp, Human
tttgattaacaaatattgactgagctggtgctatgtgccgtggatgcaagaatagagcaataaacaagtagacaaaagtcctgggccttatggagtttatgttctaatgaaggcaagacagacaattgtgaatcacataagtaactgcttaattaactacatcctgagctcatgtttgggggaactgggagctctgaggtgtcatggggagctcagcttagatgggggatgtcaggaaaagcttccctgcaaaggtgacattttatttttatttatttattattttgagacaaagtctcaytctggcacccaggctagattgcagtggtgccatcacagctcactgcagcctcaaactcttgggctcaaacgatcctcctgcctcagcctctcaagtagctgggaccacagtcacataccaccatgcccaactaattttcaattttcttttttttttttttttttttttggtagagagggttctccctatgttgcccaggctggtcttaaattcctgggctcaagtcatcatcctgccttagcctctgaaaaatactggaattacacgcatgaagcactgcacctggccaaaggtgacatt

SEQ ID NO: 187015 - DNA, 601 bp, Human
gcctcccaaagtgctggggttacaggcgtgagccaccgtgcctggcctccaacagtaatttaatcattcaacataatttgaacactgaccactttccaggctctgtgccagtttgtaagttggtgcccaatattggtgaatttgtttgattaacaaatattgactgagctggtgctatgtgccgtggatgcaagaatagagcaataaacaagtagacaaaagtcctgggccttatggagtttatgttctaatgaaggcaagacagacaattgtgaatcacataagtaactgcttaattaaytacatcctgagctcatgtttgggggaactgggagctctgaggtgtcatggggagctcagcttagatgggggatgtcaggaaaagcttccctgcaaaggtgacattttatttttatttatttattattttgagacaaagtctcattctggcacccaggctagattgcagtggtgccatcacagctcactgcagcctcaaactcttgggctcaaacgatcctcctgcctcagcctctcaagtagctgggaccacagtcacataccaccatgcccaactaattttcaattttctttttttttt

SEQ ID NO: 187016 - DNA, 601 bp, Human
ttctggggggagacggagtctcgctctgtcgcccgggttggagtgcagtggcgagagctccgctcactgcaagctccgcctcccgggttcacgccattctcctgcctcagcctccagagtggctgggactacaggcgcccgccaccacacccggctaattttttgtatttttaatagagacggggtttcaccgtgttaaccaggatggtctggatctccggacctcgtgatccgcccgcctcagcctcccaaagtgctgggattacaggcatgagccaccgcgcccggctttttgtttttkttttttttttttttaaatagaatctcactctgctgccgaggctggagtgcagtggtgagatctcgcctcactgcaacctctgactcctgggttcaagcgattctcctccctcaggctcccgagtagctgggactacaggtgtgtgccaccacacccagccaatttttgtatttttagtagagacagggtttcactgtgttggccaggctggtctcaaactcctgacctcaggtgttctgcccaccttggcctcccaaagtgctggggttacaggcgtgagccaccgtgcctggcctccaa

SEQ ID NO: 187017 - DNA, 601 bp, Human
tactgccgagtcctggcttcccatgagagaagcagcaggataaaggacagcaagacataatctcagcagtgtcatcagccaagtgataaggaagggccttaggtctccgcccctgagggaacggcccaggagatctgagacccgaggcctgctcagacgccaggtgcgcacagacttcgcagggcctcagcttccccagcgtaaagtgaagagcttatctggttctttctaggagcatcttcacgattcttgcagtatccttgtactaatagcataatcactactttttcttctgcagaawttgattaaattttcaaaaatttaaatgaattcatgccaaaagaaaacaaccataaaaggaaaatcagtatcacttgtcatacatactcagaccatcatcccccccaaacagaccaatgtattcaattctagccagctgctgctgcctgctctgagccaggaatggcttcccctctgcacaggatacttaagcaagtgtcagagagatgttaaggacacgttagcaccaagttgaaactttctcctgatgttcttgaaaaggaaataactttcccatgcagggattccacgacttcctgct

SEQ ID NO: 187018 - DNA, 601 bp, Human
ctttgggaggccgaggtgggaggatggcttgagcccaggagttcaaggatgcagtgagccatgattgccccactgcatcccagcctgggtaacagagtgagactctgcctctaaaaataaaaataaaatacctaaatagtttaattgttttattgtgaaattcattttcagaattttctctcaaacttataacctcaaattaatcactctttataagctaattttgctagatacaaaaataatctctcaattgaaaagcactgtttactgatgctataccataaagttataaaaagaaggkttttctgaacttgggaaacccctgaggagacagtggagggctgcagccagcacagagactggagcgacacagccacaagccaaggaacgcggcagccccaggagctgggagaggccggcgacagattctcctcagagcctctggaggaggctcagccctgaaggtaccttgatctgggccaagtaaaaccgattctggacttgtggtctccagaactgtgagcgaatacatttctgttgttttaaatcagtaagtttgcagtcatttgttacagcagccagtggagacgaacacaccaac

SEQ ID NO: 187019 - DNA, 601 bp, Human
ttatagtccatgagcctcctagagattaggtatcatcccaggtcccaaactggattacttcctgcctcaacagaagagtacggccagttgaatgtctgcctcaatgagggctcgtgaaattcccgagcgtgtgcacgtgtgtgcctgggcctgcctgtgtgtgttgggggaagagggacaggtccactctcctgggtgaggcccacaggtgtggagagtcccctgggccttgggcaagggctgctgaggagctgtggcctctcatacactgggaaaggtcacttggtgaagcagggatgayaattcctgccacctccttgcagaaacaagatcaaagctggaggtgccgcggatgcatgtgatcccacgccaggctcttacagaaagacagaggagcctgcgggcctggcgggggccctgagcagacgcggcacctggctcagggtaagaaggggacttggctcccctggagacagccccagactgccccaggcctctttgggaccccaggagttaaagtgacctcaccattggaatccatgagataatagactctgcttcctgtggtaacctggacaggacatttcttttcttttttttt

SEQ ID NO: 187020 - DNA, 601 bp, Human
cagcgcagggagatgatattccctggacacccagccagaaggtcagccacactagggcactgaattcctgggatttcctctacagcccctggagtgctgagcgtgggggtggaggggagggatgatttgcggcctgggggatggggaagacaccacttcgcagcagccaggttgggcccacgttctgattctggtgacgcttgttttgaaaaatctctccaactttccaagcatcggcttcccaacgaaagcccagccctcactctgagtgaggggaccgttccagggagaggcccagccrgtgctccacacaggacaggttggctctggaagctatgtcaccacccacccaggccaggactcacccctcagagatctgtctttctcccaccatctgttgcttctccgaactgaaggggctgacctttatagtccatgagcctcctagagattaggtatcatcccaggtcccaaactggattacttcctgcctcaacagaagagtacggccagttgaatgtctgcctcaatgagggctcgtgaaattcccgagcgtgtgcacgtgtgtgcctgggcctgcctgtgtgtgttgggggaagag

SEQ ID NO: 187021 - DNA, 601 bp, Human
gggccaagcatccttcctaccagcaggagagcccaggtggcttggagaaaggcccggcctgggggcagaggctgccctggccccaccacccagtttggtcatgtgccctgtggtcacccacccagagcttccagacagcctttcagggccctatcctcaaaattgatagataaaatgaaccgggaaaggtcccagaaggagagggaccgagaaaaactcaaggggattccagaagggattcgacatgagccctccgagaggagactgtagcctcttggccccggctcactgctatattctrgggcttccagcactttctctgcacaaggcccgagagatcacacaggaagtcaggagcaaagacaccatgaaggggcacgcaggcagggcctctgaagctcagggttcaacccccaagtgacagataacgacaatggccagcgcagggagatgatattccctggacacccagccagaaggtcagccacactagggcactgaattcctgggatttcctctacagcccctggagtgctgagcgtgggggtggaggggagggatgatttgcggcctgggggatggggaagacaccacttcgcag

SEQ ID NO: 187022 - DNA, 601 bp, Human
aggagagccgaaggcaggagagcctgaaaatgcaggctttatggaaagtctgagatacaggagcctggagatctttctaaagaaaaggagcactttgcaacctctgcaaagatggccctgggccaagcatccttcctaccagcaggagagcccaggtggcttggagaaaggcccggcctgggggcagaggctgccctggccccaccacccagtttggtcatgtgccctgtggtcacccacccagagcttccagacagcctttcagggccctatcctcaaaattgatagataaaatgaacckggaaaggtcccagaaggagagggaccgagaaaaactcaaggggattccagaagggattcgacatgagccctccgagaggagactgtagcctcttggccccggctcactgctatattctggggcttccagcactttctctgcacaaggcccgagagatcacacaggaagtcaggagcaaagacaccatgaaggggcacgcaggcagggcctctgaagctcagggttcaacccccaagtgacagataacgacaatggccagcgcagggagatgatattccctggacacccagccagaaggtc

SEQ ID NO: 187023 - DNA, 601 bp, Human
acgtcaacccctcctgctgtctggcctgagcccgccttgctccccatgccaccctgcagcttccgccctctgggtcccactcctgcagggtgccctcagcccagtgcgtgcgcccctggggcccccaggcctatgcacatgtgatgccttctccaaccccctaccccagatgaagatcttttccctcctctgaacccctttttccaactttccgtccccttttcaaggcatctgtcactttctaccttgatctactgctctttcctagcctccactcccagggctgcccacggcgtaagaraggcatcactggcaggcgacaggattttaaatgagctgagaacggggcagtaaataacaccaaacttctttgggggaaagttttcccctttctgttactcttcttagcttggaaatctccttgcagaactgagagggaacagacatcaggcctagcaaacctgggagcagtcttatttctcacattgaagagacaggggatggacccagccaggtgggggatgctgagcgcccagaggggctggacagggaggtgccttcaggttcccaagagcctgcagagggttgggattgagaggcc

SEQ ID NO: 187024 - DNA, 601 bp, Human
ttttagcagatctttcccaccaccttctccagccacatagccctggttattccacgctgcacttgcttccttgtctttttcttcggctccccgctggattgtaaccttctggaggatgggaccacatctgtctcatccattgctgagtccccagcacctggcccagggcctggcacatcttaggtgctcaataaatccatgttgagtgaatgaatgaacagatggaggaatgccagagaaggtagcctttgagctgggtctgagacagccacgttcagccaagcataagcagctccgctcrctgggacccacagcaaggacaagagggacacagaggcaggaggtccctgagtgccagacccttacaatgggagcacggtgccaccagaactctcggttaaccccaagataatcaaacacagaggcttacatccccccgcacaacacccccggccccatgcaccatgaggatcccaggactggcatgaggacagccttctaatcaaatgagccagggcctagggaaggctcccagaaccctgctgggtaaaccaccatctacagtggctccccgcatgccaacccttcccgagcttcacct

SEQ ID NO: 187025 - DNA, 601 bp, Human
gttttagcagatctttcccaccaccttctccagccacatagccctggttattccacgctgcacttgcttccttgtctttttcttcggctccccgctggattgtaaccttctggaggatgggaccacatctgtctcatccattgctgagtccccagcacctggcccagggcctggcacatcttaggtgctcaataaatccatgttgagtgaatgaatgaacagatggaggaatgccagagaaggtagcctttgagctgggtctgagacagccacgttcagccaagcataagcagctccgctygctgggacccacagcaaggacaagagggacacagaggcaggaggtccctgagtgccagacccttacaatgggagcacggtgccaccagaactctcggttaaccccaagataatcaaacacagaggcttacatccccccgcacaacacccccggccccatgcaccatgaggatcccaggactggcatgaggacagccttctaatcaaatgagccagggcctagggaaggctcccagaaccctgctgggtaaaccaccatctacagtggctccccgcatgccaacccttcccgagcttcacc

SEQ ID NO: 187026 - DNA, 601 bp, Human
gtgctgcaagctactgggatggacccatcggggggcctcactgagcgctccagggaaggacagggatgcacagggacctcccaagcccacaggggaggtgggaaagggcttcccgctggggtgggagtaggcagctctttgcaaggctggctcttgctagctcttcgcaaaggcgcctctgacccattctgcaggttttagcagatctttcccaccaccttctccagccacatagccctggttattccacgctgcacttgcttccttgtctttttcttcggctccccgctggattgtaacsttctggaggatgggaccacatctgtctcatccattgctgagtccccagcacctggcccagggcctggcacatcttaggtgctcaataaatccatgttgagtgaatgaatgaacagatggaggaatgccagagaaggtagcctttgagctgggtctgagacagccacgttcagccaagcataagcagctccgctcgctgggacccacagcaaggacaagagggacacagaggcaggaggtccctgagtgccagacccttacaatgggagcacggtgccaccagaactctcggttaacccca

SEQ ID NO: 187027 - DNA, 601 bp, Human
gccctggccaggccttcttgcccctcgacaagaggggccgggcccacctgacttggctggtcccctgttccactcccctggaagagcaacggccataagagggctgtaataaggggcaacctaagcacatgccccagccttaaaaacaccagcccagggccacccgcctgggttggcttcctccctgctgctgccattcaccagccaaggcatacccagaagcacagaggccgtggccagtgccggaacccacctcgaaccccagctccaccccttgatttcagtgcactctccagcaagycactgaatgttcggacctcagtttccctgtcagtgaaacagggtgatggctacaatagtgcctgccacagggcaaggagcttgagaaattatcccttgagagatttatcattcaataaaaccaagggggaaatagtaccatttactgtcatttcatcttggccttctgcctggggaaataatggttaaaccaaatgcgttacttggttgtggcttggtcaagatttaattcatctgtaagcagttctcaggcccacaaggccgcgttgctgtactaggtgctgcaagctactgggatgga

SEQ ID NO: 187028 - DNA, 601 bp, Human
cactcctgcacacgtcaggcgagaacgttcggcacgctccgcaaggcaccgctgactttcagacccacgacagcctcctggacagcagcgggggcataaggggtccttgtcctcaggaccaccagctgtgtccgtacccagccaggaggcccggtgcccactcaggcacagcaggggagctgactgcagtgagaaaagctgccaaggagtgtggttttcaccatcttggcgcaagaaagcataaatctcattttcaccacgagccctcttgcgtagtgacatcccttcggtcacttctttmatgaaggaagctctgtttctttgcttttgcagctcatcctcttggctggatcctccctgcactctactgcactcaagtgaataaaatagcgttcacgctgtgctcttatcatttaaaaataaaacacagaataaaatgaagctcctttcccaggaatttctcctgctatttacatcagaattcccttttggaattccttccatccataaataaaagctacagtgagaatccacttttttaaacccatgaggtcggtaaagatcaaacagttggacagtgagagtttaaactcacataccc

SEQ ID NO: 187029 - DNA, 601 bp, Human
ataacagacagctgattgtgattatatacgaaaccacctggaatatctctggtaattaagaagatcagattcatgtcaatatgctacatctgaataaatgataaacttcaatgaaatgaatgttatattcctaaacagtgagtggggtcccatcatataaacttaattaatctataaacagtcaaaaataggcaataaaattaaatagtactataaattatacttaaattcttactgaaagctactgtacacaggatatgtttgcacatatgtattaaggtgggggatttatatataaaaatatgtacactatgctttctgagcagttacaggcgttttcctttaaaatcagccaagggcaattttctcggtaggctatttttgtcttccttgccatctttagatcaggtgagaggagctgaatgtatgggctgtgtgtgcagttcaggcccttctccggcagggccaaagtgtccccagtgagggccgcgcagcactgctgctgagtatttatggttccagaggctcacacgacagcccccaaacatctgggcatgggaggtacttttgtcaccttattttttaaaaagatagttatttt

SEQ ID NO: 187030 - DNA, 601 bp, Human
gaggacaacctgcccctagataacagacagctgattgtgattatatacgaaaccacctggaatatctctggtaattaagaagatcagattcatgtcaatatgctacatctgaataaatgataaacttcaatgaaatgaatgttatattcctaaacagtgagtggggtcccatcatataaacttaattaatctataaacagtcaaaaataggcaataaaattaaatagtactataaattatacttaaattcttactgaaagctactgtacacaggatatgtttgcacatatgtattaaggtrggggatttatatataaaaatatgtacactatgctttctgagcagttacaggcgttttcctttaaaatcagccaagggcaattttctcggtaggctatttttgtcttccttgccatctttagatcaggtgagaggagctgaatgtatgggctgtgtgtgcagttcaggcccttctccggcagggccaaagtgtccccagtgagggccgcgcagcactgctgctgagtatttatggttccagaggctcacacgacagcccccaaacatctgggcatgggaggtacttttgtcaccttatttt

SEQ ID NO: 187031 - DNA, 601 bp, Human
cccaactatgttttgctgggatgagagaaaggtctgatcaggattgaaatttttccagaggtgaacctcagagaggacaacctgcccctagataacagacagctgattgtgattatatacgaaaccacctggaatatctctggtaattaagaagatcagattcatgtcaatatgctacatctgaataaatgataaacttcaatgaaatgaatgttatattcctaaacagtgagtggggtcccatcatataaacttaattaatctataaacagtcaaaaataggcaataaaattaaatagtmctataaattatacttaaattcttactgaaagctactgtacacaggatatgtttgcacatatgtattaaggtgggggatttatatataaaaatatgtacactatgctttctgagcagttacaggcgttttcctttaaaatcagccaagggcaattttctcggtaggctatttttgtcttccttgccatctttagatcaggtgagaggagctgaatgtatgggctgtgtgtgcagttcaggcccttctccggcagggccaaagtgtccccagtgagggccgcgcagcactgctgctgagtat

SEQ ID NO: 187032 - DNA, 601 bp, Human
aaggccccacctcctagtaagaccaccatgcagctgaggatttcaacagatgaatgacgggggaacaaactctcaggccacaacagcgactcgcctcactgagaagtccctgtgggccgggcactgggccaccagttcccacagggtcatcctatgctcaaaacagcctctgaggctagtccatggccctcctcttaacttctggaccagagccacaggggagcctgtgactcgtccagagccagagtggaaccaagaatccccgactcaggacttaaacactcctacccactggccagtrccccgggatggatgccacgagggttacaagaaggtttattttcccaactatgttttgctgggatgagagaaaggtctgatcaggattgaaatttttccagaggtgaacctcagagaggacaacctgcccctagataacagacagctgattgtgattatatacgaaaccacctggaatatctctggtaattaagaagatcagattcatgtcaatatgctacatctgaataaatgataaacttcaatgaaatgaatgttatattcctaaacagtgagtggggtcccatcatataaacttaat

SEQ ID NO: 187033 - DNA, 601 bp, Human
cccaaggccccacctcctagtaagaccaccatgcagctgaggatttcaacagatgaatgacgggggaacaaactctcaggccacaacagcgactcgcctcactgagaagtccctgtgggccgggcactgggccaccagttcccacagggtcatcctatgctcaaaacagcctctgaggctagtccatggccctcctcttaacttctggaccagagccacaggggagcctgtgactcgtccagagccagagtggaaccaagaatccccgactcaggacttaaacactcctacccactggccrgtaccccgggatggatgccacgagggttacaagaaggtttattttcccaactatgttttgctgggatgagagaaaggtctgatcaggattgaaatttttccagaggtgaacctcagagaggacaacctgcccctagataacagacagctgattgtgattatatacgaaaccacctggaatatctctggtaattaagaagatcagattcatgtcaatatgctacatctgaataaatgataaacttcaatgaaatgaatgttatattcctaaacagtgagtggggtcccatcatataaactt

SEQ ID NO: 187034 - DNA, 601 bp, Human
cacccacagtccccaccaagggcataggctggtgcttctatctttgtattcctcactgtgtgttggcacccagtcctgttcacatgtggaacagaatatgtgatgagtgtgtatctgtatccctggagggaggcaatagtatgggtcatagaaatgtcactgggtttcaggcatattcacggtaactgtcctaagttggcttgggctgctgtaacaaaataccacagactgcctgggttataagccacagatgtttattctcacagttctggaggccgagaagtccaagatcaaggtgccrgagattcagtgtctggtgagggcccgttcctcacagacagtgactgctcattccaacctcatacggtggaaggggccagggtctctctggaggtttttttttttgtttttgtttttgttgtttttcttttttgagacagagtttcattcttgttgcccaggctggagtgcaatggcacgatcttggctcatggcaacctccgcctcccgggttcaagcgattctcttgcctcagcctcccgagtagctgggattacaggcatgtgccaccacacctggctaattttgtatttttagtaga

SEQ ID NO: 187035 - DNA, 601 bp, Human
tgagaacttatcctatgctgtacttgcaggaggcagctttcagcgtggcaatgtccataatagaaaaggcagcaatgaaatccaaccgccttaggacatccggaagtccccacctccatgcactccctgatttgcagagcacacatctaggagtgccatagaaagggacagcagcccccagggcagatgggacaggcgctggggcctttgcttccacggtccccttctccgtaaggctggaacttgaccttaaataagcactacttgagccgggggcggtggctcatgcctgtaatcccarccctttgggaggccgaggtgggtggatcacctgaggtcaggagttcgagaccagcctggccaacatggtgaaaccccatctctactaaaaatgcaaaaattagctgggtgtggtggtgtgtgcctctaaccccagctactcgggaggctggggcaggagaattgcttgaaccagggagctggaggttgcagtgagccgagatcgtgccacagcactccagcctggcgacagagctagactctgtctcaaaaaaaaaaaaaaaaaaaaaagcactacttttatgacagcaagaataaaacc

SEQ ID NO: 187036 - DNA, 601 bp, Human; identical to SEQ ID NO: 31892

SEQ ID NO: 187037 - DNA, 601 bp, Human; identical to SEQ ID NO: 31893

SEQ ID NO: 187038 - DNA, 601 bp, Human; identical to SEQ ID NO: 31894

SEQ ID NO: 187039 - DNA, 601 bp, Human; identical to SEQ ID NO: 31895

SEQ ID NO: 187040 - DNA, 601 bp, Human; identical to SEQ ID NO: 31896

SEQ ID NO: 187041 - DNA, 601 bp, Human; identical to SEQ ID NO: 31897

SEQ ID NO: 187042 - DNA, 601 bp, Human; identical to SEQ ID NO: 31898

SEQ ID NO: 187043 - DNA, 601 bp, Human; identical to SEQ ID NO: 31899

SEQ ID NO: 187044 - DNA, 601 bp, Human; identical to SEQ ID NO: 31900

SEQ ID NO: 187045 - DNA, 601 bp, Human; identical to SEQ ID NO: 31901

SEQ ID NO: 187046 - DNA, 601 bp, Human; identical to SEQ ID NO: 31902

SEQ ID NO: 187047 - DNA, 601 bp, Human; identical to SEQ ID NO: 31903

SEQ ID NO: 187048 - DNA, 601 bp, Human; identical to SEQ ID NO: 31904

SEQ ID NO: 187049 - DNA, 601 bp, Human; identical to SEQ ID NO: 31905

SEQ ID NO: 187050 - DNA, 601 bp, Human; identical to SEQ ID NO: 31906

SEQ ID NO: 187051 - DNA, 601 bp, Human; identical to SEQ ID NO: 31907

SEQ ID NO: 187052 - DNA, 601 bp, Human; identical to SEQ ID NO: 31908

SEQ ID NO: 187053 - DNA, 601 bp, Human; identical to SEQ ID NO: 31909

SEQ ID NO: 187054 - DNA, 601 bp, Human; identical to SEQ ID NO: 31910

SEQ ID NO: 187055 - DNA, 601 bp, Human; identical to SEQ ID NO: 31911

SEQ ID NO: 187056 - DNA, 601 bp, Human; identical to SEQ ID NO: 31912

SEQ ID NO: 187057 - DNA, 601 bp, Human; identical to SEQ ID NO: 31913

SEQ ID NO: 187058 - DNA, 601 bp, Human; identical to SEQ ID NO: 31914

SEQ ID NO: 187059 - DNA, 601 bp, Human; identical to SEQ ID NO: 31915

SEQ ID NO: 187060 - DNA, 601 bp, Human; identical to SEQ ID NO: 31916

SEQ ID NO: 187061 - DNA, 601 bp, Human; identical to SEQ ID NO: 31917

SEQ ID NO: 187062 - DNA, 601 bp, Human; identical to SEQ ID NO: 31918

SEQ ID NO: 187063 - DNA, 601 bp, Human; identical to SEQ ID NO: 31919

SEQ ID NO: 187064 - DNA, 601 bp, Human; identical to SEQ ID NO: 31920

SEQ ID NO: 187065 - DNA, 601 bp, Human; identical to SEQ ID NO: 31921

SEQ ID NO: 187066 - DNA, 601 bp, Human; identical to SEQ ID NO: 31922

SEQ ID NO: 187067 - DNA, 601 bp, Human; identical to SEQ ID NO: 31923

SEQ ID NO: 187068 - DNA, 601 bp, Human; identical to SEQ ID NO: 31924

SEQ ID NO: 187069 - DNA, 601 bp, Human; identical to SEQ ID NO: 31925

SEQ ID NO: 187070 - DNA, 601 bp, Human; identical to SEQ ID NO: 31926

SEQ ID NO: 187071 - DNA, 601 bp, Human; identical to SEQ ID NO: 31927

SEQ ID NO: 187072 - DNA, 601 bp, Human; identical to SEQ ID NO: 31928

SEQ ID NO: 187073 - DNA, 601 bp, Human; identical to SEQ ID NO: 31929

SEQ ID NO: 187074 - DNA, 601 bp, Human; identical to SEQ ID NO: 31930

SEQ ID NO: 187075 - DNA, 601 bp, Human; identical to SEQ ID NO: 31931

SEQ ID NO: 187076 - DNA, 601 bp, Human; identical to SEQ ID NO: 31932

SEQ ID NO: 187077 - DNA, 601 bp, Human; identical to SEQ ID NO: 31933

SEQ ID NO: 187078 - DNA, 601 bp, Human; identical to SEQ ID NO: 31934

SEQ ID NO: 187079 - DNA, 601 bp, Human; identical to SEQ ID NO: 31935

SEQ ID NO: 187080 - DNA, 601 bp, Human; identical to SEQ ID NO: 31936

SEQ ID NO: 187081 - DNA, 601 bp, Human; identical to SEQ ID NO: 31937

SEQ ID NO: 187082 - DNA, 601 bp, Human; identical to SEQ ID NO: 31938

SEQ ID NO: 187083 - DNA, 601 bp, Human; identical to SEQ ID NO: 31939

SEQ ID NO: 187084 - DNA, 601 bp, Human; identical to SEQ ID NO: 31940

SEQ ID NO: 187085 - DNA, 601 bp, Human; identical to SEQ ID NO: 31941

SEQ ID NO: 187086 - DNA, 601 bp, Human; identical to SEQ ID NO: 31942

SEQ ID NO: 187087 - DNA, 601 bp, Human; identical to SEQ ID NO: 31943

SEQ ID NO: 187088 - DNA, 601 bp, Human; identical to SEQ ID NO: 31944

SEQ ID NO: 187089 - DNA, 601 bp, Human; identical to SEQ ID NO: 31945

SEQ ID NO: 187090 - DNA, 601 bp, Human; identical to SEQ ID NO: 31946

SEQ ID NO: 187091 - DNA, 601 bp, Human; identical to SEQ ID NO: 31947

SEQ ID NO: 187092 - DNA, 601 bp, Human; identical to SEQ ID NO: 31948

SEQ ID NO: 187093 - DNA, 601 bp, Human; identical to SEQ ID NO: 31949

SEQ ID NO: 187094 - DNA, 601 bp, Human; identical to SEQ ID NO: 31950

SEQ ID NO: 187095 - DNA, 601 bp, Human; identical to SEQ ID NO: 31951

SEQ ID NO: 187096 - DNA, 601 bp, Human; identical to SEQ ID NO: 31952

SEQ ID NO: 187097 - DNA, 601 bp, Human; identical to SEQ ID NO: 31953

SEQ ID NO: 187098 - DNA, 601 bp, Human; identical to SEQ ID NO: 31954

SEQ ID NO: 187099 - DNA, 601 bp, Human; identical to SEQ ID NO: 31955

SEQ ID NO: 187100 - DNA, 601 bp, Human; identical to SEQ ID NO: 31956

SEQ ID NO: 187101 - DNA, 601 bp, Human; identical to SEQ ID NO: 31957

SEQ ID NO: 187102 - DNA, 601 bp, Human; identical to SEQ ID NO: 31958

SEQ ID NO: 187103 - DNA, 601 bp, Human; identical to SEQ ID NO: 31959

SEQ ID NO: 187104 - DNA, 601 bp, Human; identical to SEQ ID NO: 31960

SEQ ID NO: 187105 - DNA, 601 bp, Human; identical to SEQ ID NO: 31961

SEQ ID NO: 187106 - DNA, 601 bp, Human; identical to SEQ ID NO: 31962

SEQ ID NO: 187107 - DNA, 601 bp, Human; identical to SEQ ID NO: 31963

SEQ ID NO: 187108 - DNA, 601 bp, Human; identical to SEQ ID NO: 31964

SEQ ID NO: 187109 - DNA, 601 bp, Human; identical to SEQ ID NO: 31965

SEQ ID NO: 187110 - DNA, 601 bp, Human; identical to SEQ ID NO: 31966

SEQ ID NO: 187111 - DNA, 601 bp, Human; identical to SEQ ID NO: 31967

SEQ ID NO: 187112 - DNA, 601 bp, Human; identical to SEQ ID NO: 31968

SEQ ID NO: 187113 - DNA, 601 bp, Human; identical to SEQ ID NO: 31969

SEQ ID NO: 187114 - DNA, 601 bp, Human; identical to SEQ ID NO: 31970

SEQ ID NO: 187115 - DNA, 601 bp, Human; identical to SEQ ID NO: 31971

SEQ ID NO: 187116 - DNA, 601 bp, Human; identical to SEQ ID NO: 31972

SEQ ID NO: 187117 - DNA, 601 bp, Human; identical to SEQ ID NO: 31973

SEQ ID NO: 187118 - DNA, 601 bp, Human; identical to SEQ ID NO: 29018

SEQ ID NO: 187119 - DNA, 601 bp, Human; identical to SEQ ID NO: 29019

SEQ ID NO: 187120 - DNA, 601 bp, Human; identical to SEQ ID NO: 29020

SEQ ID NO: 187121 - DNA, 601 bp, Human; identical to SEQ ID NO: 29021

SEQ ID NO: 187122 - DNA, 601 bp, Human; identical to SEQ ID NO: 29022

SEQ ID NO: 187123 - DNA, 601 bp, Human; identical to SEQ ID NO: 29023

SEQ ID NO: 187124 - DNA, 601 bp, Human; identical to SEQ ID NO: 29024

SEQ ID NO: 187125 - DNA, 601 bp, Human; identical to SEQ ID NO: 29025

SEQ ID NO: 187126 - DNA, 601 bp, Human; identical to SEQ ID NO: 29026

SEQ ID NO: 187127 - DNA, 601 bp, Human; identical to SEQ ID NO: 29027

SEQ ID NO: 187128 - DNA, 601 bp, Human; identical to SEQ ID NO: 29028

SEQ ID NO: 187129 - DNA, 601 bp, Human; identical to SEQ ID NO: 29029

SEQ ID NO: 187130 - DNA, 601 bp, Human; identical to SEQ ID NO: 29030

SEQ ID NO: 187131 - DNA, 601 bp, Human; identical to SEQ ID NO: 29031

SEQ ID NO: 187132 - DNA, 601 bp, Human; identical to SEQ ID NO: 29032

SEQ ID NO: 187133 - DNA, 601 bp, Human; identical to SEQ ID NO: 29033

SEQ ID NO: 187134 - DNA, 601 bp, Human; identical to SEQ ID NO: 29034

SEQ ID NO: 187135 - DNA, 601 bp, Human; identical to SEQ ID NO: 29035

SEQ ID NO: 187136 - DNA, 601 bp, Human; identical to SEQ ID NO: 29036

SEQ ID NO: 187137 - DNA, 601 bp, Human; identical to SEQ ID NO: 29037

SEQ ID NO: 187138 - DNA, 601 bp, Human; identical to SEQ ID NO: 29038

SEQ ID NO: 187139 - DNA, 601 bp, Human; identical to SEQ ID NO: 29039

SEQ ID NO: 187140 - DNA, 601 bp, Human; identical to SEQ ID NO: 29040

SEQ ID NO: 187141 - DNA, 601 bp, Human; identical to SEQ ID NO: 29041

SEQ ID NO: 187142 - DNA, 601 bp, Human; identical to SEQ ID NO: 29042

SEQ ID NO: 187143 - DNA, 601 bp, Human; identical to SEQ ID NO: 29043

SEQ ID NO: 187144 - DNA, 601 bp, Human; identical to SEQ ID NO: 29044

SEQ ID NO: 187145 - DNA, 601 bp, Human; identical to SEQ ID NO: 29045

SEQ ID NO: 187146 - DNA, 601 bp, Human; identical to SEQ ID NO: 29046

SEQ ID NO: 187147 - DNA, 601 bp, Human
gctccctggctctgtgtggtatggtcacacccccgtgcaccccctccactgagatggggcggggagagcaccgaggctgctcttcctctcctgggccgtcctctgagcagcagacggggctaagcgttccccagctcgccttcacacacagcccgtgccaccacaccgacggtaccatgaaggacgaggtagctctactggctgctgtcaccctcctgggagtcctgctgcaaggtgggctggttcctatctaggaagagggtgggccttagatccctacagcttgccctctgccccctakgcccaggtggagggcagaggtggggactccagcccaggcccaagctggaagagggtggggactttcagggaactggggggcacctggctgtgagagctgtaggacttgggggtggcaagggtgccaggacaaatggtaggatagccatgggcttggggaagctgatctctgctctttccagctgtcccctctctgggcgtcccagcaagcggcccccattccctggctctgcttcaaaggcacctccatactgggaccacgtggagcagggtagaggtgggactccttcctccagccccc

SEQ ID NO: 187148 - DNA, 601 bp, Human
atgaagaaatgaataaaactccaaatttctgttacaactcactgtcatacctactactctgatatcataatgacaggagaaatgaaaaaaaaaatgaaaggaaaaagaaacaaacaaaaaagaaaacttgctacctatttaaattcctgcagcattctaagaatatgggtttgtaccctacagcctgactacacagaactagagcaagcagttgattcaatttagctcataaacctataacagagttttttttttaatcatcaatgtttctaaatcctgacactttagttttactttttaytacagcaaaaactcaatccacgctattaaaacagaccatacttaccaaacaatcccttgggccccagagccaattggtttcagctgctggtaacgttttaggacagtgaaggttgagtctgccacttgcacactataaaactgactgtcacatttactgtcgctcatgatgcagcgtcctgcaatatcccgaagggtgggcaagtttcagatcccttcaaagaaaaacagaatgaacgtgcattcttaccggaagtacatacgcagctcacgtaagagagttctgaacttattggtatgt

SEQ ID NO: 187149 - DNA, 601 bp, Human
acacagttgaagtgagacaccaaggaagagatggccagcccaacccctcacacagcatcccttcctggttaatccatggagtgacaatgacactgactggcctcatcctgccaatgaatggcaaggcactgcaatgatggcgcctggaaatgaacaggagtgatcgggaataaaaggggaggggggaaaaggtggccatgatgaagaaatgaataaaactccaaatttctgttacaactcactgtcatacctactactctgatatcataatgacaggagaaatgaaaaaaaaaatgaaagraaaaagaaacaaacaaaaaagaaaacttgctacctatttaaattcctgcagcattctaagaatatgggtttgtaccctacagcctgactacacagaactagagcaagcagttgattcaatttagctcataaacctataacagagttttttttttaatcatcaatgtttctaaatcctgacactttagttttactttttattacagcaaaaactcaatccacgctattaaaacagaccatacttaccaaacaatcccttgggccccagagccaattggtttcagctgctggtaacgtttta

SEQ ID NO: 187150 - DNA, 601 bp, Human
atcgaaaagagctttcttctccctcaaccccctctgcctaccagctgtaaacacgcgatgtttaactgcaccacggtttctttaggcgcaaaggtaatcctgttttcattgaccaaaaaaaaagaaaaagaaaaagaaaaaaaaaagttctgcccagaaaaataaggggtaaaaagtgtgggaagtgctgatagctgcagtctaggaaacatgtgaagagctttaccttgagctggcccgtgatgctgcggcggctgaccgtcttaccatgcaagagactaacgttcagggtcagactaaygattctgacgttctgggctggacacacagttgaagtgagacaccaaggaagagatggccagcccaacccctcacacagcatcccttcctggttaatccatggagtgacaatgacactgactggcctcatcctgccaatgaatggcaaggcactgcaatgatggcgcctggaaatgaacaggagtgatcgggaataaaaggggaggggggaaaaggtggccatgatgaagaaatgaataaaactccaaatttctgttacaactcactgtcatacctactactctgatatcataatgacagg

SEQ ID NO: 187151 - DNA, 601 bp, Human
aactttaaaacttttttttttttttttttgagacggagtcttgctccatcgcccaggctggagtgcagtggcgcgatcttggctcactgcaacctccatctcccaggttcaagcgattctcttgcctcagcctcccgagtagctgggactacgggtgtgtgccaccacacctggctaatttctgtatttttagcaaagacggggtttcaccatgttggccaggatggtctcgatctcttgacctcgtgatctgcccagcttggcctcccaaagtgctgggattacaggcgtgagccaccgygcccggccacctttaacacttcttctggcacactggatttaagtgccgatacagcatgtgtcatcaggaagttaagatcaccattactttagatgcaagctgggcattccttccaaacagtccctttcccgccttagcttctcaaagaagctctggactgcaatttcctcttagctcccagggccttcagccgccagggctgaaaaaaacaactgtttccctgatcataggtctccgcaacaaaggatcagttaaaaatcatcgttaaagattctccaaacccaacatctctacaaggaa

SEQ ID NO: 187152 - DNA, 601 bp, Human
cctgtctcccttttgtaagaaggacccacccaactaaacctgggataaccctcccatctcaagaccattaatgtaatcacaccggctaaattccttttgccatgtaaagaaatatacaaattccagggattaggacgtggacatctcaggcgggaccattattctgcatgctacactccccaaagaatcactgacagatgattttcaagtacaatagtgatgaaaggaagtttcagatcatcaattaactacataatgccaatattttaatacgaaatatgatagaaaatccaattcctcytgtcagtgttagctaatctactgttgagcttatttttggaaaagcaagcttttttttcttttttgaaacgggaatgtgccgtaactagattatttcccaattctacttggtgcctcatagcctggtgaaggatacagagaaaagagaaaggtgaaaaggaagcgaaaatcacttataaagtgtttactttccctattagaacataagatagaaggataccataaaactgaaagtcagttatagctataaaaattgaaactgttcttgaatgtaacaattgtcttatagagataaatacaa

SEQ ID NO: 187153 - DNA, 601 bp, Human
ggggagtctgctccctgcctctctcagctggttggaggcttcctgtattgcttggctgtggccccacatcactccaaacttcgctctgccatcacatctctgactatgaccttcctgtctcccttttgtaagaaggacccacccaactaaacctgggataaccctcccatctcaagaccattaatgtaatcacaccggctaaattccttttgccatgtaaagaaatatacaaattccagggattaggacgtggacatctcaggcgggaccattattctgcatgctacactccccaaagaaycactgacagatgattttcaagtacaatagtgatgaaaggaagtttcagatcatcaattaactacataatgccaatattttaatacgaaatatgatagaaaatccaattcctcttgtcagtgttagctaatctactgttgagcttatttttggaaaagcaagcttttttttcttttttgaaacgggaatgtgccgtaactagattatttcccaattctacttggtgcctcatagcctggtgaaggatacagagaaaagagaaaggtgaaaaggaagcgaaaatcacttataaagtgtttac

SEQ ID NO: 187154 - DNA, 601 bp, Human
tcttttcagtttcttgatcttggttttttaaaataaacaacatttcttaattttaatacaaaattgatcaatcttctatgataatttttttttttcttaaagtggagatggggggagtctcattatgttggccaggctggtcttgaactcctggcctcaagcgatcctcccaccttggcctcccaaagtgctggaattataggcatgagccaccacatccagcagataaatgtttttttatgttgtgtttaaaggagtccttccctaccccaaagatcatgaagacattctcctatattaygttcaaatagctttactggcttgccttatatatttacagcaattcaactgacattcacttttgtgtataatatgaggttggggtcaaatttcacttttttctacatgaacattcctatgtccatttatttaaaaggctagcctttcctcattgctccacaggccaccactgccataagtcagaagcccacacatgcatgactctgtttcagggctagtccactgtttctccttgcaccacacgacaccagcttgatcaccagttttatggtaagtcttcacatctcgcagagggagtgtt

SEQ ID NO: 187155 - DNA, 601 bp, Human
cccacttgtagctcagctccatgaggaactaccttcagttattcctggttgtggttattgcggtcactcaaagaatacattgttatcactatctcttcatttatcagctttagaaatgattcacctactccccattacgaaaactgagtatttggccacttccttgaaatccccaatcgccaacacctcctattttttttgttgttctgctttttgggttttccctggttacgtctttaagtaacacccctaatcttcacgcttcttcaactctgaagggaacgtcttgacttctgcttaygtaaaatgagactgttccatccctttctcctccatttaccatatattcataactaagtcttctgtatttcttctttaggatgtttctagaagttgaaaatcaatacatggagtgtaggtgtgtatgtgtacaatgtaaatatcactaacggccagagttgggattacatttcattttctaaagatcacatggctcttgctgccactcataagagggtgagactatttccaggatcaaggacaaaggattctcttatatttcatcaactgctcaaacatcatgtcctctttgtttcataat

SEQ ID NO: 187156 - DNA, 601 bp, Human
ggtgtggtggcttatgcctgtattcccagcactttgggaggccaaggcaggcagatcgcttgagcccaggagtttgagaccagcctgggcaatacagtgaaaccttgtctgtacaaaaaatacaaagattagctgagtgtggtggtgcatgtctgtagacccagttactcaggggactgaggtgggaggactgcttgagccgggggtcgagactgcagtgagcactgatccctccactgcaccccagcctgggtgacagactgagaccctgttgcccagggtctcaaaaaaaaaaaaaaaraaaaagaaaaagaaaaaaagaatttgaaaacagacacacttttttggtatcaaaagtttttgtccaaaatttcagttagataggaggaataaggtcaggaggtctactgtgagatatggtgactgcagttaataacaatgtattgtattcttgaaaattgatgagagtagatttgttctcatcagaaacttttaaaaagtatgtgaggtaatgcatatgttaattcgctcaatttagctagtccataatgtatacatatttcagaacaatatgctggacatgataaatatatacaatttt

SEQ ID NO: 187157 - DNA, 601 bp, Human
tctatttctttattccattgagtttataacattgtttacatttattctcttctattaatgcttttgccaaactcgaacctaattcaatctgttttaaagttgaaggctatctgttgtagcatttggttaagaagctaccttactttaattcagttcatattatgtgtctgtctatatacatatgtaaatccacaggttcatatgcaaattgcaccatttatatgaattataaaatgagaaggatatatccacttgtgaaacaagtcattgacatacatgtagccatgtatgtatttatacytatatacttctcagactcaagaatttgaaaataggccaggtgtggtggcttatgcctgtattcccagcactttgggaggccaaggcaggcagatcgcttgagcccaggagtttgagaccagcctgggcaatacagtgaaaccttgtctgtacaaaaaatacaaagattagctgagtgtggtggtgcatgtctgtagacccagttactcaggggactgaggtgggaggactgcttgagccgggggtcgagactgcagtgagcactgatccctccactgcaccccagcctgggtgacagact

SEQ ID NO: 187158 - DNA, 601 bp, Human
atatagagtgcataaaaccagtcaagaaatgaaatcttcagtttaaacatgacaagaagttggaaacaaagtcactgtttcctgtcttaaaatgtgtatattttggaatatcacagtagaggaaatggctgaattcatgaggagaataaatctaaattttgaatcactgtgtttttttcacaaataacagtatctaaaaagaaaagaagccaaaatttcagctcatggtaaatgttcaagatacaaaatctctaacgtaagcaactgctatataaagttcttttagaactatctcctcctrctactatagtaagaataaaatctacaggctgtgtttccagcatctcgtttcctgttgaaattctgttcattttcctccagaaaatagacatgaagaatcaagtagcctgattacacatttttaggtttcaaactggtactaaatagtatcatttgtattatcacctctgggctactcatgagggctaacagctactaaaggccacctgagaacctaagcactgatttaaatactgtttctatttctttattccattgagtttataacattgtttacatttattctcttctattaatgctt

SEQ ID NO: 187159 - DNA, 601 bp, Human
ttgtaattttataacatggcaacgttatcaacataatgctcagcgaccactaggagaacaaacaatgtgcttgattgaacccaacttcattttctagaaacattatttctccgtaaaatttagtgctttgatttctgtggagcttccaagaatagctactctaaatgtaacatcatctaataacgtgtatttgaaactggtgtgtcatatacaaggtaaaaagctacttatagaacaacatctttccacaaaatatttagttgtttctcaatttgttagatcaatactgttcctattttayagaaacagagtatcaattgatattcctactttggttaagtgacctaaattcctatgcaccataatgatgcctctttctagctttgatttcctcaatgtttattaagaattttatcagccgggcgccatggctcacgcctgtaatcccagcactttgggaggctgaggctggcggaccatgaggtcaggagatcgagaccatcccggctaacgcggtgaaaccctgtctctcctaaaaatacaaaaaattagccgggcgtggtggcgggcgcctgtagtcccagctactcaggaggctgag

SEQ ID NO: 187160 - DNA, 601 bp, Human
ctgacgtcatgatccacccgcctcggcctcctaaagtgctgggattacaggcgtgagccactgcacccggccaacattttgtaattttataacatggcaacgttatcaacataatgctcagcgaccactaggagaacaaacaatgtgcttgattgaacccaacttcattttctagaaacattatttctccgtaaaatttagtgctttgatttctgtggagcttccaagaatagctactctaaatgtaacatcatctaataacgtgtatttgaaactggtgtgtcatatacaaggtaaaaasctacttatagaacaacatctttccacaaaatatttagttgtttctcaatttgttagatcaatactgttcctattttatagaaacagagtatcaattgatattcctactttggttaagtgacctaaattcctatgcaccataatgatgcctctttctagctttgatttcctcaatgtttattaagaattttatcagccgggcgccatggctcacgcctgtaatcccagcactttgggaggctgaggctggcggaccatgaggtcaggagatcgagaccatcccggctaacgcggtgaaacc

SEQ ID NO: 187161 - DNA, 601 bp, Human
tatattgtttgaatttttaaaaataatatatattttttgtaacctgaaaaaattttttaaataagtaagtaaaacaagtccgggtgcggtggctcacgcctgtaatcccagcactttgggacgccgaggcaggcagatcacgaggtcaggagatcgagaccatcctggctaacatggtgaaacccctgtctctactaaaaatacaaaaaattagctgggtgtggtggcaggcacctgtagtcccggctactcgggaggctgaggcaggagaatggcgtgaacctgggaggcggagcttgcrgtgagctgagatcgcgccactgccctccaggttgggcgacagagcgagactccgtctcaaaaaaaaaaaaaaaaaaagaaaaagtaaaataaagcatgcattagagaaatttaaaccaactcaagccacagactcaaaagaaggaagctcaggagtttaagatcagcctagacaatgtggtaagaccccacctctacaaacaattttaaaaattgccaagcatggtggcgcacgcctatggtcccagctacttggagggctgaggtgggagaatcacaacctgggtgacagaatgagacc

SEQ ID NO: 187162 - DNA, 601 bp, Human
gcataagaatgctcaccaaactgttaatgctagtaatctgtgggtggcggtattcaggagtttttacttttttatattgtttgaatttttaaaaataatatatattttttgtaacctgaaaaaattttttaaataagtaagtaaaacaagtccgggtgcggtggctcacgcctgtaatcccagcactttgggacgccgaggcaggcagatcacgaggtcaggagatcgagaccatcctggctaacatggtgaaacccctgtctctactaaaaatacaaaaaattagctgggtgtggtggcrggcacctgtagtcccggctactcgggaggctgaggcaggagaatggcgtgaacctgggaggcggagcttgcagtgagctgagatcgcgccactgccctccaggttgggcgacagagcgagactccgtctcaaaaaaaaaaaaaaaaaaagaaaaagtaaaataaagcatgcattagagaaatttaaaccaactcaagccacagactcaaaagaaggaagctcaggagtttaagatcagcctagacaatgtggtaagaccccacctctacaaacaattttaaaaattgccaagcatggtgg

SEQ ID NO: 187163 - DNA, 601 bp, Human
ccaggtgtgccttaaactcctggcttcaagcgaccctcctgcctcagcccaagtagctgggattacaggtgaagtgaccgtgcccagcttctcaaatactcttaatgaaaatatcaaactaatagtcttccttgaggtcaatttgtcagtatattttaaactagaagtgtgtgtactctgacctgacaatgttggccaagaaattcacctggacgagtatgcaaaaattcaggcgttagaatgttcattgcagcactgcttataacagtgagaaacaaaacaatctatccaacaacaggckgctggcagtctcttaaataaattactgtgcatctgtgctatgcaaccatttaaaaactggctcatatctatgttcattaaagtatatgaggtctaccaacattgcacgaggagaaaagcaggatgaagaataacacgattaatcttgtttatgtacttgtgcacatgtatgcataagaatgctcaccaaactgttaatgctagtaatctgtgggtggcggtattcaggagtttttacttttttatattgtttgaatttttaaaaataatatatattttttgtaacctgaaaaaatttttt

SEQ ID NO: 187164 - DNA, 601 bp, Human
tatttatcaaattggcaaaagcaaaacaaaaaaaatcaacagtatgtagtgctgggggattctgaagtaacagacgttctcagacactttttttttttttttgagatggagtttcattcttgtcccccaggctggagtgcaatggcgcaatcttggcttactgcaacctatgcttcctgggttcaagtgattctcctgcctcagcctcccaatgagctgggattacaggcgcccaccactacgcccagctaatttttgtatttttagtagagacggggtttcaccacgctggccaaccaaygtggtcttaaactcatgactcaggtgatccacctgccttggcctcccaaagtgttgggattacaggtgtgagccacagcgcccggctgatacttttttttttttaggagatggggtcttgttttgttgcccaggtgtgccttaaactcctggcttcaagcgaccctcctgcctcagcccaagtagctgggattacaggtgaagtgaccgtgcccagcttctcaaatactcttaatgaaaatatcaaactaatagtcttccttgaggtcaatttgtcagtatattttaaactagaagtgtg

SEQ ID NO: 187165 - DNA, 601 bp, Human
tcaaacagaaggcaggtgagctcactgctctgctaagactcttactctgacttgccttagagcaaaagacatccttacaacggcctagaggcttgtggtgttcaccctcttctcttcccctgctccctcatctctagccacgccacctcttgatggtcttggaaaacaccaggcgggcatccactgctgtcctgagcgctgtctgttccttctatctccattctacttgcccccaaagtatctgcggcaccaaattcttttttttttttttttttgagacagagtcttgctctgtcgcccyggctggagtgcagtggtgcgatcttggctcactgcaagctccacctcccgggttcacaccattctcctgcctcagcctcctgagtagctgggactacaggcccccgccaccacgcccggctgattttttgtatttttagtagagacggggtttcaccgtgttagccaggatggtctcgatctcctgacctcgtgatccgcccgcctcggcctcccaaagtgctgggattataggcgtgagccaccgcacccggccagaccaacttctttatccccttcaaggctttcttcgaatgtcacc

SEQ ID NO: 187166 - DNA, 601 bp, Human
cccttatagtgggttaccaacccagatgccagagttacgcttttcaaacagaaggcaggtgagctcactgctctgctaagactcttactctgacttgccttagagcaaaagacatccttacaacggcctagaggcttgtggtgttcaccctcttctcttcccctgctccctcatctctagccacgccacctcttgatggtcttggaaaacaccaggcgggcatccactgctgtcctgagcgctgtctgttccttctatctccattctacttgcccccaaagtatctgcggcaccaaattcttttttttttttttttttgagacagagtcttgctctgtcgccctggctggagtgcagtggtgcgatcttggctcactgcaagctccacctcccgggttcacaccattctcctgcctcagcctcctgagtagctgggactacaggcccccgccaccacgcccggctgattttttgtatttttagtagagacggggtttcaccgtgttagccaggatggtctcgatctcctgacctcgtgatccgcccgcctcggcctcccaaagtgctgggattataggcgtgagccaccgcacccggccag

SEQ ID NO: 187167 - DNA, 601 bp, Human
cagaactgaactcctgattccatccctagcccagtctgctcttctcacagccttcatcatctcagttgagagctccctcatccttcaggtgctcaggccaaaaatctaggtgtcattctcaattcctctctctcataccacacatctcatctatcagctaataccatggctctatctttagaaccatttcagcatccagtctcttcccctctcacccttcctattacccctctgggccaaatggaccctccgtcatcccttaacagaactgctgcaacagcagtaactgatgttccatgcycccaccccttatagtgggttaccaacccagatgccagagttacgcttttcaaacagaaggcaggtgagctcactgctctgctaagactcttactctgacttgccttagagcaaaagacatccttacaacggcctagaggcttgtggtgttcaccctcttctcttcccctgctccctcatctctagccacgccacctcttgatggtcttggaaaacaccaggcgggcatccactgctgtcctgagcgctgtctgttccttctatctccattctacttgcccccaaagtatctgcggcacca

SEQ ID NO: 187168 - DNA, 601 bp, Human
attcccagttccaccttgatgtctaacaggcatcttaaagccatctccagaactgaactcctgattccatccctagcccagtctgctcttctcacagccttcatcatctcagttgagagctccctcatccttcaggtgctcaggccaaaaatctaggtgtcattctcaattcctctctctcataccacacatctcatctatcagctaataccatggctctatctttagaaccatttcagcatccagtctcttcccctctcacccttcctattacccctctgggccaaatggaccctccgtyatcccttaacagaactgctgcaacagcagtaactgatgttccatgcccccaccccttatagtgggttaccaacccagatgccagagttacgcttttcaaacagaaggcaggtgagctcactgctctgctaagactcttactctgacttgccttagagcaaaagacatccttacaacggcctagaggcttgtggtgttcaccctcttctcttcccctgctccctcatctctagccacgccacctcttgatggtcttggaaaacaccaggcgggcatccactgctgtcctgagcgctgtctg

SEQ ID NO: 187169 - DNA, 601 bp, Human
caatatatacgtttttaaaagtgattatacaacaacaacaaaaaggacacttgaccccactccccgcttagcaacgccccgattctttgctccctttgcaagcaaaactccccaaagggtgtctcatgtgctatctccaattcttctcccttctttttattttttaaatttttttgagacagggtctcactctgtcacccagactggagtgcagtggcgtgatctcgcctcactgcaacctccacctcccgggttcaagccattctcatgcctcggactcccagaactgaaaattaaattaaaaaaaaaaaaacagccatcatgcctggatagtttttgtatttttagtagagacggggttttgccatgttgcccaggctggtctcgaactcctgacctcaagtgatccgcccacctcgggccttccaaagtgttgggattacaggcatgagccactgcactcagccttctcccatttttttcttaatcccacttggatcaggtttgtgcagccaccattctgctgaaactgtcctcctcgaggccactgatgtcttccatgctgctaaatccactggccagtcctataatcccagcgggc

SEQ ID NO: 187170 - DNA, 601 bp, Human
atttttggctgaaattctccgtaccagcctaaagaccatgctgttacaggctcatcaatcacaacacatgtaccctctggtgggagatgctgagaacgggggaggctctgcacgtaaggggctggagacagacaggaactcagtacctcccgctcaattttgctgtggctctaaattgctctacaatatatacgtttttaaaagtgattatacaacaacaacaaaaaggacacttgaccccactccccgcttagcaacgccccgattctttgctccctttgcaagcaaaactccccaaagagtgtctcatgtgctatctccaattcttctcccttctttttattttttaaatttttttgagacagggtctcactctgtcacccagactggagtgcagtggcgtgatctcgcctcactgcaacctccacctcccgggttcaagccattctcatgcctcggactcccagaactgaaaattaaattaaaaaaaaaaaaacagccatcatgcctggatagtttttgtatttttagtagagacggggttttgccatgttgcccaggctggtctcgaactcctgacctcaagtgatccgcccacctc

SEQ ID NO: 187171 - DNA, 601 bp, Human
aaacttaacgtcttacaagttaaaaattaaaaaaaaaaacaacaaccttttatagcatggtaaatagaatctcaaacacaaattttcctacttcttacatttttggctgaaattctccgtaccagcctaaagaccatgctgttacaggctcatcaatcacaacacatgtaccctctggtgggagatgctgagaacgggggaggctctgcacgtaaggggctggagacagacaggaactcagtacctcccgctcaattttgctgtggctctaaattgctctacaatatatacgtttttaaargtgattatacaacaacaacaaaaaggacacttgaccccactccccgcttagcaacgccccgattctttgctccctttgcaagcaaaactccccaaagggtgtctcatgtgctatctccaattcttctcccttctttttattttttaaatttttttgagacagggtctcactctgtcacccagactggagtgcagtggcgtgatctcgcctcactgcaacctccacctcccgggttcaagccattctcatgcctcggactcccagaactgaaaattaaattaaaaaaaaaaaaacagccat

SEQ ID NO: 187172 - DNA, 601 bp, Human
aatacaaaattttgtctgtatgtctaaatgtttttggatctacaggtgaattaaaatgtatttctaataagtaggtaacactgatttttatgtagctttttaattgttctgtaatatgtcattgaaaacagattttgttaactgttggggttttcttactggccttatttgacaagttttaattgttcttcacctattacatcaattccatctttcttttttatgaaaaatgtactgttttttggcaggaagaagtttatttcattttctttgctactgaagtattggtatcaaattgtgaaaaaaaaaatctatcatgatagtctgcttacacagccgtacaagtaataataacaaaaaattgtaaaatcagcttagagagaattatattaattatattatcgctccctagcttattaaatgtttttcctgacagtacagtcacactgttattcaaatcccggcctctgctgagcccacaggcctgctctgaacccttgcggtgcagggtctggccactcccaccagtgatgcagggaagctggcacggcagaattttaggataagagaaatggatatgtgggtcattatttaagaaaga

SEQ ID NO: 187173 - DNA, 601 bp, Human
aaatgttatacaagttataaatatattgtgtttgtcagtggctcatttctaatgaccatctctggactgttgatttccaccttatttaacacgaaaatattgaggtgagaattctgtagataccctttaagcaacatgaatccaataggtagtgtgggtttttttgtcagttaatacaaaattttgtctgtatgtctaaatgtttttggatctacaggtgaattaaaatgtatttctaataagtaggtaacactgatttttatgtagctttttaattgttctgtaatatgtcattgaaaayagattttgttaactgttggggttttcttactggccttatttgacaagttttaattgttcttcacctattacatcaattccatctttcttttttatgaaaaatgtactgttttttggcaggaagaagtttatttcattttctttgctactgaagtattggtatcaaattgtgaaaaaaaaaatctatcatgatagtctgcttacacagccgtacaagtaataataacaaaaaattgtaaaatcagcttagagagaattatattaattatattatcgctccctagcttattaaatgtttttc

SEQ ID NO: 187174 - DNA, 601 bp, Human
ctgagaacaaatcttataaatttaaggaatttggaaagcctgatgcaaattaaatattccacaatgctcaaaacatgcacatgaatgaaatgttatacaagttataaatatattgtgtttgtcagtggctcatttctaatgaccatctctggactgttgatttccaccttatttaacacgaaaatattgaggtgagaattctgtagataccctttaagcaacatgaatccaataggtagtgtgggtttttttgtcagttaatacaaaattttgtctgtatgtctaaatgtttttggatctrcaggtgaattaaaatgtatttctaataagtaggtaacactgatttttatgtagctttttaattgttctgtaatatgtcattgaaaacagattttgttaactgttggggttttcttactggccttatttgacaagttttaattgttcttcacctattacatcaattccatctttcttttttatgaaaaatgtactgttttttggcaggaagaagtttatttcattttctttgctactgaagtattggtatcaaattgtgaaaaaaaaaatctatcatgatagtctgcttacacagccgtac

SEQ ID NO: 187175 - DNA, 601 bp, Human
ccctttgaacacatgaaaaatctcataccagagagaaaccctttgactgtaaggaatgtggtcaagtctttagacatttcagttctctaagtaaacatgaaagaactcacactggagaggcaccctttgactgtaaggaatgtggtcaagtctttagacattccagttctctatgtaaacatgaaagaactcacactggagaggaaccctttgactgtaaggaatgtggtcaagtcttcagacattccagttctctacgtaaacatgaaagaactcacactggagagaaaccctttgaccrtaagggatgtggtcaagtcttcagacattccaattctctatgtaaacatgaaaaatctcacactggagagaaaccctttgactgtaaggaatgtggtcaagtcttcagacattccagttctctatgtaaacacggaagaactcacactggagagaaaccctttgactgtaagggatgtggtcaagtcttcagacattccagttctctatgtaaacatgaaaaatttcacactggagagaaaccctttgactgtaaggaatgtggtcaagtctccagacattccagttctctaggtaaaca

SEQ ID NO: 187176 - DNA, 601 bp, Human
aggctgtcagctagccctgggaggacaagagctatccctgacgctgcccttgggccacagacctgaggcttgagacgagacaaccctgccctctgtgggtcggtgggctctacccccaagggaggccttcaatggctgtgatggaaccaatctttcctggcaaaagagatctgaaaaaattattaccactccaccatctaaaacccatctgcttatttctgtagtaacaggctctgctgttcttgtctctcactagcttcttccccacagatttcagttcagcaaaaagatgacctcttgytgttggaacataaaatctaatggcaatctgttgataaaattagtatagtaataatccagggaatgctaagaatatctatttccgataaaattatattatctctgcctctagtctcactcagtattttaattgttttttagaaaaaattcgggccaggaggccctaggtggctctgccacagactgtcaccctgtgaccttggagatccctaagcaggatgccatagaatcctggaagccaggaaatggaaacaaatgggaagaccagaacagtgaaagtcatttcaataattctggaaaa

SEQ ID NO: 187177 - DNA, 601 bp, Human
gatgggaggctgtcagctagccctgggaggacaagagctatccctgacgctgcccttgggccacagacctgaggcttgagacgagacaaccctgccctctgtgggtcggtgggctctacccccaagggaggccttcaatggctgtgatggaaccaatctttcctggcaaaagagatctgaaaaaattattaccactccaccatctaaaacccatctgcttatttctgtagtaacaggctctgctgttcttgtctctcactagcttcttccccacagatttcagttcagcaaaaagatgacytcttgctgttggaacataaaatctaatggcaatctgttgataaaattagtatagtaataatccagggaatgctaagaatatctatttccgataaaattatattatctctgcctctagtctcactcagtattttaattgttttttagaaaaaattcgggccaggaggccctaggtggctctgccacagactgtcaccctgtgaccttggagatccctaagcaggatgccatagaatcctggaagccaggaaatggaaacaaatgggaagaccagaacagtgaaagtcatttcaataattct

SEQ ID NO: 187178 - DNA, 601 bp, Human
aagagtttcagacatttgaggcctcaaaaaatttctctcccctgtggcaatttaggaagcttttggaggatgcgtcccaccaaaacaagggggtaatctgagagacaaggacagcaagcaaggaatccaacatgggaggcagatgaaggaaacccccacaaaatcaccaagggagatccaggacagccccttcgagcaggtgcagtggcagccagtgcagaggggaacagggctgaggcttgggagaggttcctgagaagatgaaactgatgaaatacccaagacatctacatgtgctgasagaaaattcagatgcctgatggaagagttagggttgaattaccaccaagaacacagaaactaccccccaaaacaaacaaaaacctcacacaaatagagtataagtgtttgttaactccagggaacaaaaggtgaaaggggaaggtctgctgtgcaaagcatttacacgctcacgatgacgcaacgagccaaacaccatcacatccaccagcctgggaggagggcgaggaaggccgagggtgagggctgggttggtaagaagctaaatcagcatcttatgccccaaactgagaaaggatca

SEQ ID NO: 187179 - DNA, 601 bp, Human
tgagcgcaactgatctgtaactaagaattctacacacatctacacacaaccacactactcatcatgtgagagggcagaataaagagtttcagacatttgaggcctcaaaaaatttctctcccctgtggcaatttaggaagcttttggaggatgcgtcccaccaaaacaagggggtaatctgagagacaaggacagcaagcaaggaatccaacatgggaggcagatgaaggaaacccccacaaaatcaccaagggagatccaggacagccccttcgagcaggtgcagtggcagccagtgcaraggggaacagggctgaggcttgggagaggttcctgagaagatgaaactgatgaaatacccaagacatctacatgtgctgagagaaaattcagatgcctgatggaagagttagggttgaattaccaccaagaacacagaaactaccccccaaaacaaacaaaaacctcacacaaatagagtataagtgtttgttaactccagggaacaaaaggtgaaaggggaaggtctgctgtgcaaagcatttacacgctcacgatgacgcaacgagccaaacaccatcacatccaccagcctgggagg

SEQ ID NO: 187180 - DNA, 601 bp, Human
aatacaaaaaattagctgggcgtggtggcggacgcctgcagtcctagccactagggaggctgaggcaggagaatggcgtgaacccgagaggcagagtttgcactgagccaagaccatgccactgcactccagcctgggcgacagagcgagactccatctaaaaaaacatcagatggcactaagaaactccggagccatgctagatgccttgctaccacaggcactgcctccgccattctgagcgcaactgatctgtaactaagaattctacacacatctacacacaaccacactactcatyatgtgagagggcagaataaagagtttcagacatttgaggcctcaaaaaatttctctcccctgtggcaatttaggaagcttttggaggatgcgtcccaccaaaacaagggggtaatctgagagacaaggacagcaagcaaggaatccaacatgggaggcagatgaaggaaacccccacaaaatcaccaagggagatccaggacagccccttcgagcaggtgcagtggcagccagtgcagaggggaacagggctgaggcttgggagaggttcctgagaagatgaaactgatgaaatacccaa

SEQ ID NO: 187181 - DNA, 601 bp, Human
ttcagagaaaaagaataaagaatggagttaagaggacattctgaaagaaatgatataaatttctcagacctctataatatgtgcttccagactgaaggccaagtgcccagcaaaactaaagaaaaaatgcccacatcaaggcatacatcaaaacatctcagaatacaaggaataaataactgagtttaaaagtttccagagataaaaccaaaccaaaacccaaaaccacagcacttaaaaaaggttagtcatcagccaggcacagtggctcatgcctgtaatccagcactttgggaggccraggcgggcggatcacgaggtcaggagatcgagaccatcctgggtaacaaggtgaaaccctgtctctactaaaaatacaaaaaattagctgggcgtggtggcggacgcctgcagtcctagccactagggaggctgaggcaggagaatggcgtgaacccgagaggcagagtttgcactgagccaagaccatgccactgcactccagcctgggcgacagagcgagactccatctaaaaaaacatcagatggcactaagaaactccggagccatgctagatgccttgctaccacaggcactgcc

SEQ ID NO: 187182 - DNA, 601 bp, Human
ccgcatgcacagtcctgtgggtaccaacagggaaggcacggtgaggcctgcctgcaacagggctgcctggtgagtttgcgctctgccacatgagaagcacagccctgtaccccagcagccaggcttacatccctccaccaagggactgaaggggccttttccagagaaattaaatggtgcccagagaaaaaacctacagaaggtgacacctgtggctgcctgtggtccaagagacacccattctttaacaatttacccattcactcagtacttccagtcagcctttaatgcttcaatctctttttttttttttttttttttgagacgaagtctcgatcttgttgctcaggctggagtgcaatggcactatctcagctcactgcaacctccgcttcctgggttcaagaaattctcctgcctcagtctcctgactagctgggattataggcacctgccaccacgcccagctaatttttatatttttagtagagacagagtttcaccatgttgaccaggctggtgtcgaactcttgacctcaggtgatctgcccgcctcagtctcccaaagtgctgggattactggcatgagccaccgtgcttg

SEQ ID NO: 187183 - DNA, 601 bp, Human
tgctggcccttcacgcagagaaactgatgcccagcttccaggtgcagggccacaggcgccgcatgcacagtcctgtgggtaccaacagggaaggcacggtgaggcctgcctgcaacagggctgcctggtgagtttgcgctctgccacatgagaagcacagccctgtaccccagcagccaggcttacatccctccaccaagggactgaaggggccttttccagagaaattaaatggtgcccagagaaaaaacctacagaaggtgacacctgtggctgcctgtggtccaagagacacccattytttaacaatttacccattcactcagtacttccagtcagcctttaatgcttcaatctctttttttttttttttttttttgagacgaagtctcgatcttgttgctcaggctggagtgcaatggcactatctcagctcactgcaacctccgcttcctgggttcaagaaattctcctgcctcagtctcctgactagctgggattataggcacctgccaccacgcccagctaatttttatatttttagtagagacagagtttcaccatgttgaccaggctggtgtcgaactcttgacctcaggtg

SEQ ID NO: 187184 - DNA, 601 bp, Human
tgctgtccagcctgcagcagtgtgggcgctgtctgggcctctcttctaatcagtgtggaggatgcatttgccccatcaacatgccagacctgaggccttattaatctgctccagcaacaactgcaccttgacatgcacagcagctgcggccaggactgccagtgccgtaagcctgtggccgtctggggtcattctccagaatccatgcagcttcttcaagggctggactaacgagttagactgggatgcaagataccactgtctctgctcccctgaggcttccatggtggccctagtctcytccacccaccccgggccctgcagggtgtgatcttgtttttgatttactatcttgggggcagtttcaggtttccatttggccttcccactgtgacgactcttactcacaggccaaggaactcgtgtgggcgttactccacctgccaagcgcctccgctccggctacacactgaggactggggagacggccactgggtggcctgggaccctgtggcccactgagagccaccagacacagacggctcaggaatgaaggcctgggacacaggccaggcaagccacagaggcctgccaatgtgag

SEQ ID NO: 187185 - DNA, 601 bp, Human
ccaaacactctcagggctcctccacttgcagggttcgtggggtcaggggtcaggggtcagggcataagtgaagtctgggccaggtctcttgcggccatgttatgggagggtgggaacgttagcaaaggcttagagcaaggctgtgagagaacattgctgtccagcctgcagcagtgtgggcgctgtctgggcctctcttctaatcagtgtggaggatgcatttgccccatcaacatgccagacctgaggccttattaatctgctccagcaacaactgcaccttgacatgcacagcagctgyggccaggactgccagtgccgtaagcctgtggccgtctggggtcattctccagaatccatgcagcttcttcaagggctggactaacgagttagactgggatgcaagataccactgtctctgctcccctgaggcttccatggtggccctagtctcctccacccaccccgggccctgcagggtgtgatcttgtttttgatttactatcttgggggcagtttcaggtttccatttggccttcccactgtgacgactcttactcacaggccaaggaactcgtgtgggcgttactccacctgccaa

SEQ ID NO: 187186 - DNA, 601 bp, Human
cctcccccactgcccgctcaactctgggatccagacccactgcttgagaggtatcccaggaaggagcacatcatgacaggtgtccactgtctggccttgccggtccttccccacaggtacctgtggccacccaccgggtaagaacagccaggcactcttgaggatgaatggacacagctctaagtagacactgaaacccgaagaccccaaacactctcagggctcctccacttgcagggttcgtggggtcaggggtcaggggtcagggcataagtgaagtctgggccaggtctcttgcggycatgttatgggagggtgggaacgttagcaaaggcttagagcaaggctgtgagagaacattgctgtccagcctgcagcagtgtgggcgctgtctgggcctctcttctaatcagtgtggaggatgcatttgccccatcaacatgccagacctgaggccttattaatctgctccagcaacaactgcaccttgacatgcacagcagctgcggccaggactgccagtgccgtaagcctgtggccgtctggggtcattctccagaatccatgcagcttcttcaagggctggactaacgagttagac

SEQ ID NO: 187187 - DNA, 601 bp, Human
ttggcagcgatggaaagcaagcagactcggtgctggcgggagaagcagaaacaggcgcttcctcaggccacagagggtgtgcagtgggcactttctctccaggaggctgatttctgaggtgtgaaatgcacacacttccccagccagcaggccctgaagcccagcccacccagaactaacagcacggccgcaggagcaaggaagacaaggacagcctggttctaccaaggacagacgcagcagtggaaccatctccacgggctgcctgccagctctgtgaaccccagtgcgccagaaacaygctcatctgaagacactgccatctgtcaaaaaactgtcatcacatactaatttaacaggaaaagcacactttactgccgtctgctggaagactgtggtgataaagtcccaagcttgtgtgggtgctctgtgtggccaatggggaggtggctaaggaggtgctctccccgcaccctgggaccctctctagtcacccccgaaatacaacctgaggcagcttcccaacacctcacttcaatttcaagacagcagaggaaagacagttctgccccttcaagtcttgaaaatcactcagaacaaa

SEQ ID NO: 187188 - DNA, 601 bp, Human
tacattttctactagccatgctcaacagcatgcagaaataggtgaaattaattttaatcatacagtatatttttttaacccaatatatccataatattatcatttcaaaatgtaatcaacataagaaaaatactgagatattttacattctctttttagtactgagcctttgaagtccagtatgtattttacaactgcagcacggccacatcctgagtgctccacagcctcctgtggttagtggctgccatactggacagcacaggtctagaatcgtctgatcctggaatcttcccatggytctttctctccttggaagagcaattccatgatcatccacctccaatcttctcaccttcgccacaaagacacgccagcactggtgctgctgtctccatctgtacgtggcacaaaaactcacctgctcatgttctggttgccacctctcttccctccccagtgctgactctgtgtgagctctcagcactcagaagcacgcctggcgcgagcagacacttgggaagtgtctgcagaatgaagacatgcatcatattccacctgacttgcaaagccttaacacaacttctgcaaccttttccct

SEQ ID NO: 187189 - DNA, 601 bp, Human
atttgccctttctgtggtctcgcaggccctcaggctgtcctatctaccctccatccatgcatctacacgtccagcacacatgcccccctcccgctctccacgcctggacttgagttccccaatactctgactctctcttgctaaggtcctcatgctctctgtcagtccagcacacacggccccctcctgctctccacgcctggacttgagttccccaatactctgactctctcttgctaaggtcctcatgctgtctgtcagtccagggcagtgctgtcccacagacaatgtcatataatgygaacgatgtgtataatttacattttctactagccatgctcaacagcatgcagaaataggtgaaattaattttaatcatacagtatatttttttaacccaatatatccataatattatcatttcaaaatgtaatcaacataagaaaaatactgagatattttacattctctttttagtactgagcctttgaagtccagtatgtattttacaactgcagcacggccacatcctgagtgctccacagcctcctgtggttagtggctgccatactggacagcacaggtctagaatcgtctgatc

SEQ ID NO: 187190 - DNA, 601 bp, Human
tcaaatcctaggaaagaaatggcttaaattagtaaaatgaatgaagcatgctaaataaactacttcacatccgtgagggtcgtgaagccagtgtgagagtgtagggagtgaactgaactctgagatttgggaacaactttggaaaatcttactctcaaattgaaactaaaacaaatcagcctaaagccgtcagatggtgccccttacccccagtggaaaccttcatggcccccatttgccctttctgtggtctcgcaggccctcaggctgtcctatctaccctccatccatgcatctacaygtccagcacacatgcccccctcccgctctccacgcctggacttgagttccccaatactctgactctctcttgctaaggtcctcatgctctctgtcagtccagcacacacggccccctcctgctctccacgcctggacttgagttccccaatactctgactctctcttgctaaggtcctcatgctgtctgtcagtccagggcagtgctgtcccacagacaatgtcatataatgtgaacgatgtgtataatttacattttctactagccatgctcaacagcatgcagaaataggtgaaatta

SEQ ID NO: 187191 - DNA, 601 bp, Human
cactttaagtttgcactgtgaagaatttataaggagaccactttgataaaattattaaaatctgaaattattttcctaagatacatacaaaacactgactatggagcttgatttccttaaaagcaaccatcaatctgcccaaggatggagaccaatttaaactttcataacgaaaacaaagtcaaagactaatgaaaaactaagtggttaaaacacaaatgaaaaagggaagatgtgaagaaccatgttagggtaaaaaatactgaggatggaagaatggcaaatgaggaaagaaggctaytgtaacaattagagtagttattctcctttctgctgtatctctaacatgacttgctgactacagtatgagtttatctctttcattttacatttattttgacttccccagtgtgtcacaaaataacccactagacagatttttaaaaaaaattctacaaaatgtcagcacagtaacaaacaagaaagtttaacatattgttcctcacaaaattttcattttaatctctttcacttaggtcctttgtaatgtgcttcagttcttactttgggggaaaatatttcaatgcataccagtaactaa

SEQ ID NO: 187192 - DNA, 601 bp, Human
accaaggctcagagaggccctaaatttctcaaggatgcatggctgccaaggggaggagtctgagctggggcccgaggtggccgggctaaagctttctctttctcatagaccaccgcagggacaggagttccttttctaccccgggtcgcaaattaaagcaaatctctgagaccctcagtctgatttctgcaacttttttctatctcccaaatttcaatctaatatttgaaagagttggcaaaattttctttagaaaatgatgttaaactctgtgtggcttttgggaataacattaggtaaycttatatataacactattaattactgacattaatgttcatatgtatagcaggaattttaattttacttactaaaatgcaccaaaaagtactcacatttttcatttttgtactttttgaagaaaacattttgtaataaaacaaggaatggcacaaaatgagtaagaattgagacaaactgaacattaagtagatatttctaaattattagtcttttaatttttcaacttttccctttttaattaagtttacttgcaaaataaagacgtccttatttataggttgcaacaagtgaatctgag

SEQ ID NO: 187193 - DNA, 601 bp, Human
gagaggactccaccccagcatcctacaggtgggagggatgggggacagatgagagggacgggggaaggggaacaataattccgacaagcccagtggaccctgttgtctaactctcgtgaagctgcaggcagaccacaggtctattttacagaaggggaaaccaaggctcagagaggccctaaatttctcaaggatgcatggctgccaaggggaggagtctgagctggggcccgaggtggccgggctaaagctttctctttctcatagaccaccgcagggacaggagttccttttctacccygggtcgcaaattaaagcaaatctctgagaccctcagtctgatttctgcaacttttttctatctcccaaatttcaatctaatatttgaaagagttggcaaaattttctttagaaaatgatgttaaactctgtgtggcttttgggaataacattaggtaaccttatatataacactattaattactgacattaatgttcatatgtatagcaggaattttaattttacttactaaaatgcaccaaaaagtactcacatttttcatttttgtactttttgaagaaaacattttgtaataaaaca

SEQ ID NO: 187194 - DNA, 601 bp, Human
cacacccctacccgcctgctgggggcctccacctctcctctggatgatggcagcctctgctctgttctcctgctctgccctgcccttgacgatccaccctcaattcagcagctgggaggagcctctttgcatctcagtcagactaggcacccagaaatgggcaggtgagagaaatatctgctgggttaatgataaaggactagaaattaaaccagttgtgagaggagacccacagattccccgagaggactccaccccagcatcctacaggtgggagggatgggggacagatgagagggaygggggaaggggaacaataattccgacaagcccagtggaccctgttgtctaactctcgtgaagctgcaggcagaccacaggtctattttacagaaggggaaaccaaggctcagagaggccctaaatttctcaaggatgcatggctgccaaggggaggagtctgagctggggcccgaggtggccgggctaaagctttctctttctcatagaccaccgcagggacaggagttccttttctaccccgggtcgcaaattaaagcaaatctctgagaccctcagtctgatttctgcaacttttttc

SEQ ID NO: 187195 - DNA, 601 bp, Human
ctacctcagcctcccaagcagctgggactacaggcgtctgccaccatgcccggataattttttgtatttttttagtagagacagggtttcactgtgttaggcaggatggtctcgatctcttgacctcgtgatccgcctgcctcagcctcccaaagtgctgggattacaggcgtgagccgccgcacccagccataacccaaacatttttaagaaaaagtcaaatgtccactttcatgacaaaccaggtttccaaatgtagttttacgcctctggatctgcaaggggaagagaaacctgggcycccagggtggtggggaagagcaccaggcagcctcagaccaatgtctgggcagggcccaaggctgggaaaccacagcaaggaaggtggcaattgccgagctgcgggtggcactgcccagagtgtgggcatgaggcacgggggagtatttttctctaagtcacatcgaaatgaaattagaacagacttttcaaaccacacaacaatctcacattcccacaggataaaacactcacagatgcttctggctggcctagctgtatacagtgctggcaacttacacttttttttttaatctacaga

SEQ ID NO: 187196 - DNA, 601 bp, Human
tcatggcatgaaggaagcctgccactacgcagtgatttccctcacagctaaagctcactcacaccagtgctgacacagaaacacgcacgtgagcaccaaactcagagtggagctcctccagcgggggaaccaggagctacaatgcctttagggaaggataaacagacgtgtgatttttcagcaagttgctcagcctctctggttaagtggcctaaacaagaggatgtaaccaaagccaatggcacagaatagatgcttaataaactatgagctcacagcagcatttgcaaaatggagactrgtagcaccaaagcggaagttcattcccgaggtactctgagctggggctccagcagcaaaagagcaagcgacccaggtctcagacaacacttggcctttctgtaactgggagcccccaaatggagaacttgctacccatatgtagccactctggacggacagacaagatccaaggaaatataagcctggcctctctatataaatcttttcaaaacagatactcacggcttctgcttcggcggggtcataccaaacagtgatgtatgggtgacgcagagcttcgtctacagagatccgcttg

SEQ ID NO: 187197 - DNA, 601 bp, Human
ctcccaagcatttcaggcccacggaggtgagagttccttcaatgctgacaggtttgctatttctaacctatcatcgacagccttcaaggggtcccgtcgaggcatcaagactgctgtctgtgtctgaggccagcgtctgctcagtggacatggatgaaatgtcattgatcgatgaagactgagaaggagtggcgttgctacttactgctgcatctgtgctaagaaaaccaaatataataaaatctgaggcacgacattgctgcaaatccaggcagcgagactgcaggccatttctcggctytgtccttttgcagtttcccaatcctaactatgagtatagacaagaagtcagtcagctggactttctgaacttttccttgagtctttctttgggccaagagtcccatattcctatgtctttccttgcaagattcttctttttttctcagtagctaaacatatatgtggccatgtataatcatgttagctacttaaaaaatacctgctgctttcaagcagacatcaaaaggacacagctatatttatctgaaaatgcagtatcacaaaagcttaagcctgactaggattccagtgtcaccag

SEQ ID NO: 187198 - DNA, 601 bp, Human
ccgagatagggccctaacagaccatgcgggcacgtgagtgctccacagaggaaacgagctcatgccagaaaccagcacatctcagccatcaagacagataaggggtcaaggtagcagaatgctggctgtgccagcctcgctaagttctcccaacagcccttccaggtacatttatggatgaggcaggtggggcaggctggggctcagccggatcatccctcctccagtccctagctgagctggcagcctcaggaactggggccagcactccctaccttcttctttggatggaactagaccygcagcacccatcccagtccctaaggcctgggcaacaggccaccccctgcttcttgctccaggccccaccttgagctgggtcacaagccggctccatcccccaccctggaggagcaccacgtggggagggagagatgtcagcacacacaggtcaagggtccgtgtgttcagtggagtgggggacagaactggcaccaggtgaaggaatgcatcatgacgatgccagggagatggggctgcctcacaggccgggggggaccagcctaggattcccctcgcgcagggacaggctctgactatc

SEQ ID NO: 187199 - DNA, 601 bp, Human
cgggaggctgaggcaggagaatggcgtgaacctgggaggtggagcttgcagtgagccgagatcgcgccactgcactccagcctgggcgacagagcgagactccgtctcaaaaaaataaataaataaataaaaagtacccttgatgttggggtgaggggacactggtgggtggacaggactcaaaaacaagcacgcagccaggccacacggccgtggaaggaccctgcagtgggtcatttaaagccactctgtgctctgagtttgtgcacactggcctctgacgtcgcatgatttgcttttccccgatgacgcagagggataaaatgcaccttgtccacatggctttctcccaccctactcctggacctgcaggacagctgacctggcggccaggctgtggcgctgcaggcttggcgggctgtcctcagcgtcagcctgggcgatgtgtagggccatggtggacacctgcgagaagctgccctcttctgagctctgagagctgcgcggggccatgcagacctcctcttcctcctggcgggaacaggagaggcagccaggccagaaaccaccagccactgccctcagccctcgcccccaccct

SEQ ID NO: 187200 - DNA, 601 bp, Human
ttagataatcagagattcctgggaggaatcttggcccaaacacagtccactccacctctccgggagaaaaagtacacttgccgggcgcagtggctcacgcctgtaatcccagcactttgggaggccgaggcaggcagatcacgaggtcaggagatcgagaccatcctggctaacacggtgaaaccccgtctctactaaaaatacaaaaaattagccaggcgtggtggcggacgcctgtagtcgcagctactcgggaggctgaggcaggagaatggcgtgaacctgggaggtggagcttgcrgtgagccgagatcgcgccactgcactccagcctgggcgacagagcgagactccgtctcaaaaaaataaataaataaataaaaagtacccttgatgttggggtgaggggacactggtgggtggacaggactcaaaaacaagcacgcagccaggccacacggccgtggaaggaccctgcagtgggtcatttaaagccactctgtgctctgagtttgtgcacactggcctctgacgtcgcatgatttgcttttccccgatgacgcagagggataaaatgcaccttgtccacatggctttctcc

SEQ ID NO: 187201 - DNA, 601 bp, Human
aatcagtgatttagataatcagagattcctgggaggaatcttggcccaaacacagtccactccacctctccgggagaaaaagtacacttgccgggcgcagtggctcacgcctgtaatcccagcactttgggaggccgaggcaggcagatcacgaggtcaggagatcgagaccatcctggctaacacggtgaaaccccgtctctactaaaaatacaaaaaattagccaggcgtggtggcggacgcctgtagtcgcagctactcgggaggctgaggcaggagaatggcgtgaacctgggaggyggagcttgcagtgagccgagatcgcgccactgcactccagcctgggcgacagagcgagactccgtctcaaaaaaataaataaataaataaaaagtacccttgatgttggggtgaggggacactggtgggtggacaggactcaaaaacaagcacgcagccaggccacacggccgtggaaggaccctgcagtgggtcatttaaagccactctgtgctctgagtttgtgcacactggcctctgacgtcgcatgatttgcttttccccgatgacgcagagggataaaatgcaccttgtccacat

SEQ ID NO: 187202 - DNA, 601 bp, Human
ttgtaatacctgtggggagaaatcagaaggtgctgaggaacgcgctgcagcaaccctcctcgaacttctctccactgtccctgtgccccctcttctcctggaaaggaccccccgcctggggcaggagtatggatgggcctgggcctgagtgctggcaggggctcctccgtgtgcctggcctcagatgtctaccccacagccccagcagcaccctgggctgtgtttcctcccgagtccactgctgagctctgtgatgggaagtgagggggcatccagccccgtgtggcatggagctcctccyggggatgggctaccctgggccagccaggcagccctggggctgcaagccgccgactgccctgcccgtacgtgggtgcactaaggcacacgttgaggggtttgtggaaggagcctggcagaatccagctaactgttgttgtcccccaggcctagccctgccgtatgctagggcagagggacaggacgcagagcctgcatctcagcaacactgctgtgaatggggccagcacagccatcctgagtgtgaaatgccagggataagagagcctgggcagagttccgggaattaggttacgttctc

SEQ ID NO: 187203 - DNA, 601 bp, Human
cgaggccagcaccatcccactgtctgtctggttgtcctgtgtggagaggacaagccaggctgtgggtcccgcctgaggccctcctgcagggcagccacccccagccaggaaagtgcggcatggtcctgcagcgcggctgacctaacacctgtccctgggaagctgagccagaaacaaggcgtccattccatcccagggtgagggtcacatgcccctgccacggagggagacactgaggtcaggggggctgtgtgtggcccgtggacgcctcatacttggggacctccacggtggccaagcrtatgctcagtgtgtgaagagcaggagccgtgggagaagcagggagaggcctcacaacctggcagctcgtagttcaaaaaacgatccatgtgaggctgcctcccggtttggggggctttgttatccttcgactgtggcttggtgtggtttttattttgaattacacgggagggaaactgcgatcttttcagagtcccccaacatctccaagtggccctggaggcaggaacccaggtccctgtggtctggccaagggctcccatggggcccctctgcccagcgctcactgaccaggcccggg

SEQ ID NO: 187204 - DNA, 601 bp, Human
cgggtttttttcccccaaaatgggggcttgctgtgttgcccagcctggagtgcagtggcacgatcatggctcactgcatcctcgaccttctgggctcaagcaactctcccacctcagcctgctgagcggctgctaccacaggcatgggccaccacacccagctaatttttaaaattactatttgtagagacagcgtctcattctgttgcccaggttggtcttgaactccgggcctcaagtgatcctcctgcctcagcctcccaatgtgctgtgattacaggtgagagctactgcctggccraatctatcttttatttcgatttctttcctgaatttagtctgctgtcagttgtatcatcacattgtccgtccatttctatcctgaaattttgaatttcagattcaacaaaacaagccactgcttgtttccttatatgtttaattcatgttggagcattttgctcgttttcctgtttcttttgaacaattgtctaccgggaagttttaactctaatactgtcttattcctataactttgtatggagggtgcttttttgggggttcaggattattcatgttaggatttcctacaccagaaata

SEQ ID NO: 187205 - DNA, 601 bp, Human
ttgtccctgtggtgccctggttttagaaaagatttatcgggtttttttcccccaaaatgggggcttgctgtgttgcccagcctggagtgcagtggcacgatcatggctcactgcatcctcgaccttctgggctcaagcaactctcccacctcagcctgctgagcggctgctaccacaggcatgggccaccacacccagctaatttttaaaattactatttgtagagacagcgtctcattctgttgcccaggttggtcttgaactccgggcctcaagtgatcctcctgcctcagcctcccartgtgctgtgattacaggtgagagctactgcctggccaaatctatcttttatttcgatttctttcctgaatttagtctgctgtcagttgtatcatcacattgtccgtccatttctatcctgaaattttgaatttcagattcaacaaaacaagccactgcttgtttccttatatgtttaattcatgttggagcattttgctcgttttcctgtttcttttgaacaattgtctaccgggaagttttaactctaatactgtcttattcctataactttgtatggagggtgcttttttgggggttc

SEQ ID NO: 187206 - DNA, 601 bp, Human
aggcggagcttgcagtgagctgagatcgcaccactgcactccagcctgggcgtcagagtgagactccatcttaaaaaaaaaaaaaaattgcttgagcccaggaggtggaggtttcagtgagccaagatcgtgccgctgcactccagcctgggtgacaaagtgagaccctgtctcaaaaacaaactaacaaaaaacaaggagggactggagccctgtcagggtctgatgggaaccaccaaggacacagtggagcatggcatgcgttcagacttcagaaaacacacacagactcgactcaaayagcaaagcggatcgatctgatccagcactcactggagctctgtccctacctagcctggacccgagactgtgaagaatgtccaacttcatcccccaacccagttctcactctgtcttgcccatctcagtgaacggcaccaccgtcccctcagccgctcaagccaagcaccctggggttctccttgcttcctccttcccctcactcttcaaagccaatccatccagaagtcctgtccattctaactccaggacacatccgtgcatctccattcctggccctcctgcggagccagctgtgtcc

SEQ ID NO: 187207 - DNA, 601 bp, Human
tgaaacaattgcttgaggccgggtgcggtggctcatgcctgtaatcccagcactttgctgggagaccgaggcgggcggatcacgaggtcaggagatcgagaccatcctggctaacacggtgaaaccccgtctctactaaaaatacaaaacattagccgggcgtggtggcgggcgcctgtagtcccagctactcgggaggctgaggcaggagaatggcgtgaacccgggaggcggagcttgcagtgagctgagatcgcaccactgcactccagcctgggcgtcagagtgagactccatcttaaaaaaaaaaaaaaattgcttgagcccaggaggtggaggtttcagtgagccaagatcgtgccgctgcactccagcctgggtgacaaagtgagaccctgtctcaaaaacaaactaacaaaaaacaaggagggactggagccctgtcagggtctgatgggaaccaccaaggacacagtggagcatggcatgcgttcagacttcagaaaacacacacagactcgactcaaacagcaaagcggatcgatctgatccagcactcactggagctctgtccctacctagcctggacccgagactgtga

SEQ ID NO: 187208 - DNA, 601 bp, Human
cgcctgcggtcccagctaagtgaaacaattgcttgaggccgggtgcggtggctcatgcctgtaatcccagcactttgctgggagaccgaggcgggcggatcacgaggtcaggagatcgagaccatcctggctaacacggtgaaaccccgtctctactaaaaatacaaaacattagccgggcgtggtggcgggcgcctgtagtcccagctactcgggaggctgaggcaggagaatggcgtgaacccgggaggcggagcttgcagtgagctgagatcgcaccactgcactccagcctgggcgwcagagtgagactccatcttaaaaaaaaaaaaaaattgcttgagcccaggaggtggaggtttcagtgagccaagatcgtgccgctgcactccagcctgggtgacaaagtgagaccctgtctcaaaaacaaactaacaaaaaacaaggagggactggagccctgtcagggtctgatgggaaccaccaaggacacagtggagcatggcatgcgttcagacttcagaaaacacacacagactcgactcaaacagcaaagcggatcgatctgatccagcactcactggagctctgtccctaccta

SEQ ID NO: 187209 - DNA, 601 bp, Human; identical to SEQ ID NO: 23156

SEQ ID NO: 187210 - DNA, 601 bp, Human; identical to SEQ ID NO: 23157

SEQ ID NO: 187211 - DNA, 601 bp, Human; identical to SEQ ID NO: 23158

SEQ ID NO: 187212 - DNA, 601 bp, Human; identical to SEQ ID NO: 23159

SEQ ID NO: 187213 - DNA, 601 bp, Human; identical to SEQ ID NO: 23160

SEQ ID NO: 187214 - DNA, 601 bp, Human; identical to SEQ ID NO: 23161

SEQ ID NO: 187215 - DNA, 601 bp, Human; identical to SEQ ID NO: 23162

SEQ ID NO: 187216 - DNA, 601 bp, Human; identical to SEQ ID NO: 23163

SEQ ID NO: 187217 - DNA, 601 bp, Human; identical to SEQ ID NO: 23164

SEQ ID NO: 187218 - DNA, 601 bp, Human
ccttttcttctctccgtgtttcccttagtcttggactttctaggatgtctagcagataaatctctcacttctagaccatatgtcccctaccccctccctttttttttaagagacaaggtcttgccatgttgcctaggctgacctcaaactcttgggctaagctatcctcctgctttagcctcttgagtagctaggactatagatacatatccctatgcctggctgggaccagatggcctttctgaatcctttctagtaggtgattctctctcctggagaaactctttccttaaagcttgctttttttttttttttttttgccaaccctcagagcagacaatctatctataaagtcagatttgagtggagaattaaaggaattatctgaataattaaaacaagaacactaatatctttgaaaaggctatttaagacttaatgatgcctacaaccatttacttgttaaagtctacttaaatatttattctacattgctagcgctccagacatacatgcatatcttattagtggattcattcaaaatattcacacacatggaataaactcaagaacataataactcctaaataggctttgatca

SEQ ID NO: 187219 - DNA, 601 bp, Human
aaacactgaaacagaaggctttgttggcccataggctaaaccattagagaaatgttgggatgcaccatagcaagggatttcacacccagtaggctcacagcaggcaaaagagaatccctggccatttctgtaaggctttgagattttctgagcactttcacttttcttccttgagtattactgtggatggaggcagacaagataggctgtattgtcgctaatttacagatgaagaaatggagatgagagaagataaatgactttctcaacttcccagagccaggatgagaagccacatctwgtgaataactgactctctccactacgtcttcttctctgctacatattcaatgtcaggggtctcagcccctacccccaagagagacaaggtaaaagaacaaggtgaggcaccatcagggtccttgcttttgagcatgaaagcctcacactcctacactcaatatccacaacacaaaacatgagcctggtggcctggggacaaatctccttgaggtgacttgctttattcttccccttgcttctcaacaaagtgacacagaggctagaggagcctcttctcttctctttggagaatcaaaga

SEQ ID NO: 187220 - DNA, 601 bp, Human
acaactcagctgaccattgattcatttcttcattccttcaacaaacatgtatcagcctattatttgtcaggaactcagttcctaacacagttgtagaagataagaaaatgatgtaaagccttcatggaatccctagatagagttgatcatttccttcttgtaagtaccttgtatatatgtctattccatgtcatacattatttgtttatgtttctgttccctttaagactgagtttcccaagggcaaggcccaaatcttaaccatttttccctcttttgttaggtcctatgacatagtaastatacaagaaagtttgttgaaataaactgaactatgagcaaaagatatataaatgacgtagacctaaactccaaagtttacatacacaggagaagtgcccaaaataattggtgcagataataaattggaagaagggatgtaaatgtgggttggagttaggaaggttttgtgaaggaactgtgagtcttgtgttagactttaaagaacagataggtttggcaggggtgatgacaaagcagtgggcaataagcaaatcatgtgaaaggttattgagagttccaaacactgaaacagaaggct

SEQ ID NO: 187221 - DNA, 601 bp, Human
cagcacagctgggtgcagtggctcatgcctgtaattttggcacgttgggagactgaagtggggagattgcttgaggccaggagttcaagaccagcctggccaatataaagaaaccctgtctctaaaacaaacaaacaaacaaaacacaactcagctgaccattgattcatttcttcattccttcaacaaacatgtatcagcctattatttgtcaggaactcagttcctaacacagttgtagaagataagaaaatgatgtaaagccttcatggaatccctagatagagttgatcatttcctkcttgtaagtaccttgtatatatgtctattccatgtcatacattatttgtttatgtttctgttccctttaagactgagtttcccaagggcaaggcccaaatcttaaccatttttccctcttttgttaggtcctatgacatagtaagtatacaagaaagtttgttgaaataaactgaactatgagcaaaagatatataaatgacgtagacctaaactccaaagtttacatacacaggagaagtgcccaaaataattggtgcagataataaattggaagaagggatgtaaatgtgggttggag

SEQ ID NO: 187222 - DNA, 601 bp, Human
cattcttaaaaatactcagcacagctgggtgcagtggctcatgcctgtaattttggcacgttgggagactgaagtggggagattgcttgaggccaggagttcaagaccagcctggccaatataaagaaaccctgtctctaaaacaaacaaacaaacaaaacacaactcagctgaccattgattcatttcttcattccttcaacaaacatgtatcagcctattatttgtcaggaactcagttcctaacacagttgtagaagataagaaaatgatgtaaagccttcatggaatccctagatasagttgatcatttccttcttgtaagtaccttgtatatatgtctattccatgtcatacattatttgtttatgtttctgttccctttaagactgagtttcccaagggcaaggcccaaatcttaaccatttttccctcttttgttaggtcctatgacatagtaagtatacaagaaagtttgttgaaataaactgaactatgagcaaaagatatataaatgacgtagacctaaactccaaagtttacatacacaggagaagtgcccaaaataattggtgcagataataaattggaagaagggatg

SEQ ID NO: 187223 - DNA, 601 bp, Human
ctccccaccacttcaagttccacccatttccaacctgcagactggcctccagttacgagaacctccactctgcctgccccgctctgctgagaagtgtcttttggccctgacctttccactcagtgtttatctattctgtgttttagtctttcagaggtctgccctttttgctgggaaacaactaatttgaaccaagatgctgatgagcggtgctaggatttgtctttaattagcggtcatttgaaaccagcagacaagcaagggtgcagaacacttcccagcccctccgcagtcacattasatgcctccactcttggacaaggcagctcctagcagcatcaccccttcatagctgttcaagctgaggaaggccttcgatagagacatcactgaaaatgccacactgtgcctgaaatctgctgaaaacacaactcacctcatggatctcaaaatatctctgagccagtcagtgcaaaaccagaggtaagccagccctatttcatgaattagtccttggacaatgggaaatacagcagcgtcctgataactatacttgggggagtgggtgagagatgggggaacaagcagaataattgctcca

SEQ ID NO: 187224 - DNA, 601 bp, Human
taggaattaaaaagagattgtttaaactcttttttcacctgaacaagttacatttttgccagaaattcttggaaaacacttttttctggttcctggaatcacaattccaatttcaaatattacgcccatattaatgtaaaagccttttcatgttctatcttcatggatctctgagttccttagggtgtcagtggatttggggattgaaattcattcacagagtcccttcctcttactaattatagaatcccaagccttgtttgtatatatttccacttttatttgcttccctacgacgtgytttttattatttttttggcctttatgatatatatattacatacatagacacacacatgaagacattcatatacctacatatcttggtgctgtggcttagtcatacacgttgttgttctctgctttttttttttctttttgagcagaaatttaatcctgggattaatttctgaagttcagtttctcagtttaactattcccatgtattaataactttttgatatttctagggattgtcatgtacatacctccccaccacttcaagttccacccatttccaacctgcagactggcctccagt

SEQ ID NO: 187225 - DNA, 601 bp, Human
gcctttctgttttccccttgcacccatccccgcttccaaaagctatgcctccatgtgtaacatacaatgtgggcctctgaatcaactaccccaatggtgcctctgctgaagagatgttccagatagtcataaattaatgacattctccatgtcatcatttctgagattcttgagcaggaccttttttttttgagacggagtcttgctctgtcgcccaggctggagtgtagtggcgagatctcggctcatctttaattaggaattaaaaagagattgtttaaactcttttttcacctgaacragttacatttttgccagaaattcttggaaaacacttttttctggttcctggaatcacaattccaatttcaaatattacgcccatattaatgtaaaagccttttcatgttctatcttcatggatctctgagttccttagggtgtcagtggatttggggattgaaattcattcacagagtcccttcctcttactaattatagaatcccaagccttgtttgtatatatttccacttttatttgcttccctacgacgtgctttttattatttttttggcctttatgatatatatattacataca

SEQ ID NO: 187226 - DNA, 601 bp, Human
caaaaaataaagaaaagaaaagaaatctttccagactttagagagaaatcttgagggccacattccagcctttctgttttccccttgcacccatccccgcttccaaaagctatgcctccatgtgtaacatacaatgtgggcctctgaatcaactaccccaatggtgcctctgctgaagagatgttccagatagtcataaattaatgacattctccatgtcatcatttctgagattcttgagcaggaccttttttttttgagacggagtcttgctctgtcgcccaggctggagtgtagtggygagatctcggctcatctttaattaggaattaaaaagagattgtttaaactcttttttcacctgaacaagttacatttttgccagaaattcttggaaaacacttttttctggttcctggaatcacaattccaatttcaaatattacgcccatattaatgtaaaagccttttcatgttctatcttcatggatctctgagttccttagggtgtcagtggatttggggattgaaattcattcacagagtcccttcctcttactaattatagaatcccaagccttgtttgtatatatttccactt

SEQ ID NO: 187227 - DNA, 601 bp, Human
taggaatcaggggagcttaagaaatctttccggccaggcgcggtggcttacgcctgtaatcccagcactttgggaggctgaagcaggaggatcacttgaggtcaggggttcaagaccaacctggccaacacagtgaaaacttgtctctactaaaaatacaaaaattagccaggcgtggtggcgggcacctgtaatctgagttactcgggaggctgagacaggagaattgcttgaacccgggaggcagaggttgcagtgagctgagatcatgcccctgcactccagcctgggtgacagagcragactccgtctcaaaaaataaagaaaagaaaagaaatctttccagactttagagagaaatcttgagggccacattccagcctttctgttttccccttgcacccatccccgcttccaaaagctatgcctccatgtgtaacatacaatgtgggcctctgaatcaactaccccaatggtgcctctgctgaagagatgttccagatagtcataaattaatgacattctccatgtcatcatttctgagattcttgagcaggaccttttttttttgagacggagtcttgctctgtcgcccaggctg

SEQ ID NO: 187228 - DNA, 601 bp, Human
actcatgctttcctcaaggagttcacagaaatttattagttgtcttccccaaaaaagatcttgaaggtacttttattcttctggctgttgtattttttttattttaattttttttgccgatgacagtgatgggagaaatataacttcatttctaatcagtttccttctctgaggatggctatggctgtctctttagtgggctttcttatacctccagctggatcaagagcctgaactctggctgtcctgccagtaaaagcctcctcctcatacccaagcactgcctgcaagggccctgctsagggtaggaatcaggggagcttaagaaatctttccggccaggcgcggtggcttacgcctgtaatcccagcactttgggaggctgaagcaggaggatcacttgaggtcaggggttcaagaccaacctggccaacacagtgaaaacttgtctctactaaaaatacaaaaattagccaggcgtggtggcgggcacctgtaatctgagttactcgggaggctgagacaggagaattgcttgaacccgggaggcagaggttgcagtgagctgagatcatgcccctgcactccagcctgggtgaca

SEQ ID NO: 187229 - DNA, 601 bp, Human
tgctttactcatgctttcctcaaggagttcacagaaatttattagttgtcttccccaaaaaagatcttgaaggtacttttattcttctggctgttgtattttttttattttaattttttttgccgatgacagtgatgggagaaatataacttcatttctaatcagtttccttctctgaggatggctatggctgtctctttagtgggctttcttatacctccagctggatcaagagcctgaactctggctgtcctgccagtaaaagcctcctcctcatacccaagcactgcctgcaagggcmctgctcagggtaggaatcaggggagcttaagaaatctttccggccaggcgcggtggcttacgcctgtaatcccagcactttgggaggctgaagcaggaggatcacttgaggtcaggggttcaagaccaacctggccaacacagtgaaaacttgtctctactaaaaatacaaaaattagccaggcgtggtggcgggcacctgtaatctgagttactcgggaggctgagacaggagaattgcttgaacccgggaggcagaggttgcagtgagctgagatcatgcccctgcactccagcctgg

SEQ ID NO: 187230 - DNA, 601 bp, Human
ttgctttactcatgctttcctcaaggagttcacagaaatttattagttgtcttccccaaaaaagatcttgaaggtacttttattcttctggctgttgtattttttttattttaattttttttgccgatgacagtgatgggagaaatataacttcatttctaatcagtttccttctctgaggatggctatggctgtctctttagtgggctttcttatacctccagctggatcaagagcctgaactctggctgtcctgccagtaaaagcctcctcctcatacccaagcactgcctgcaagggscctgctcagggtaggaatcaggggagcttaagaaatctttccggccaggcgcggtggcttacgcctgtaatcccagcactttgggaggctgaagcaggaggatcacttgaggtcaggggttcaagaccaacctggccaacacagtgaaaacttgtctctactaaaaatacaaaaattagccaggcgtggtggcgggcacctgtaatctgagttactcgggaggctgagacaggagaattgcttgaacccgggaggcagaggttgcagtgagctgagatcatgcccctgcactccagcctg

SEQ ID NO: 187231 - DNA, 601 bp, Human
gctgctatggccaggaaaaaaaaaaaagattctgctctttgcttgctttactcatgctttcctcaaggagttcacagaaatttattagttgtcttccccaaaaaagatcttgaaggtacttttattcttctggctgttgtattttttttattttaattttttttgccgatgacagtgatgggagaaatataacttcatttctaatcagtttccttctctgaggatggctatggctgtctctttagtgggctttcttatacctccagctggatcaagagcctgaactctggctgtcctgccrgtaaaagcctcctcctcatacccaagcactgcctgcaagggccctgctcagggtaggaatcaggggagcttaagaaatctttccggccaggcgcggtggcttacgcctgtaatcccagcactttgggaggctgaagcaggaggatcacttgaggtcaggggttcaagaccaacctggccaacacagtgaaaacttgtctctactaaaaatacaaaaattagccaggcgtggtggcgggcacctgtaatctgagttactcgggaggctgagacaggagaattgcttgaacccgggaggcag

SEQ ID NO: 187232 - DNA, 601 bp, Human
ttgaggcagttacccttattattttattattattattttattcttacaaatgataaaataatcacacacactccaaacccacactaaattggaaatactttttcttgggacatacagcttgttaacatggcagaaatggtacctgcattttcagacttctttgctctcttttctatgtcatgcagcttctctattgttcaatataaacataatcgaagaacattccaactaactgctagcattttttccctctaatcttgttctgtattactactcataatgcccaagttttgttcctcarcttcaatcacagtgattaattgaattatctcacactagatagtatcttgttacaccgtgccctcatataccttatgggattttcagcatgtttgcagagctcaagttataaccaggaatcagatgctggcctctactgctggccccacttgacctctctttgatcactcatttttctctcccatcccattttctagtttcctctaaagtcctctgtactcacttttgaccacaatatactgcttctgccccacatctctggcttgatctccagaatttgagttcctttgagctcagttat

SEQ ID NO: 187233 - DNA, 601 bp, Human
ttttaattcttatctcaatcctgtttctattatgcttaaaagatcaatttgacaaaatgtttaaatgcacattaccaagttagccttcacaattctttgaggcagttacccttattattttattattattattttattcttacaaatgataaaataatcacacacactccaaacccacactaaattggaaatactttttcttgggacatacagcttgttaacatggcagaaatggtacctgcattttcagacttctttgctctcttttctatgtcatgcagcttctctattgttcaatatraacataatcgaagaacattccaactaactgctagcattttttccctctaatcttgttctgtattactactcataatgcccaagttttgttcctcagcttcaatcacagtgattaattgaattatctcacactagatagtatcttgttacaccgtgccctcatataccttatgggattttcagcatgtttgcagagctcaagttataaccaggaatcagatgctggcctctactgctggccccacttgacctctctttgatcactcatttttctctcccatcccattttctagtttcctct

SEQ ID NO: 187234 - DNA, 601 bp, Human
tcctgggcaagttccttaacctctctgagccttgcctgtataatggggataaagatattcaagtttcaggtgattgtgaagattaaataaggtttccaaagcatctggtttacatccaacacactataggcatttactaaatggtagttattattttgattattagcattttttacacaaaatgtttaagtttttaattcttatctcaatcctgtttctattatgcttaaaagatcaatttgacaaaatgtttaaatgcacattaccaagttagccttcacaattctttgaggcagttacscttattattttattattattattttattcttacaaatgataaaataatcacacacactccaaacccacactaaattggaaatactttttcttgggacatacagcttgttaacatggcagaaatggtacctgcattttcagacttctttgctctcttttctatgtcatgcagcttctctattgttcaatataaacataatcgaagaacattccaactaactgctagcattttttccctctaatcttgttctgtattactactcataatgcccaagttttgttcctcagcttcaatcacagt

SEQ ID NO: 187235 - DNA, 601 bp, Human
cctagattgtgttttgcgacagcgatgttttattccagtgagctggacgtggctcttttaggtaagtaaacaagagctttattttttaatttgccaaaaagtaacaaaattgactcagtttatgaatcaattagtcaattttttacttacaaggcaagatattctcatcaactttttttcccagaaatatttccaaagttaaggcatttaagtgttgggacaggttagatttaaagtttttttattgccccaactccagtccagactgttccaatttacccaacagaattttaaaatttgktttttttaccttgtaaaattaaaaaattgtgaaattcaaaggtattgcctatttcagttatttccttattgtttctgggagttagagttttacaatttatagttaaggaaactatgaaacaaactaaatattatttgtttacttcatttgtgagtaataaggtctttttaaaggaatgatcctgggcaagttccttaacctctctgagccttgcctgtataatggggataaagatattcaagtttcaggtgattgtgaagattaaataaggtttccaaagcatctggtttacatccaaca

SEQ ID NO: 187236 - DNA, 601 bp, Human
tcctcaaaagcatttgtagaatacactggcctggccacaatatactgattcccaaagggttcaatcattttgatttttctgttggctgtggcaagttgaagacctttgcaactatgtggtgaacacttcttcttgcctttagcaggttaaaaatgcctgaaaccaaacagagcttgcttcttaaataactcagagataatgtgatgcaatttacagatgagtgagctccgaactgaatgttaccaccttttaagatcaaaaaaggcaggattaagggacctagattgtgttttgcgacagygatgttttattccagtgagctggacgtggctcttttaggtaagtaaacaagagctttattttttaatttgccaaaaagtaacaaaattgactcagtttatgaatcaattagtcaattttttacttacaaggcaagatattctcatcaactttttttcccagaaatatttccaaagttaaggcatttaagtgttgggacaggttagatttaaagtttttttattgccccaactccagtccagactgttccaatttacccaacagaattttaaaatttgttttttttaccttgtaaaattaa

SEQ ID NO: 187237 - DNA, 601 bp, Human
taagttagcagttccacaaatgattaaatatagagttaccctatgatccagcaattacaatcctagtgatatacccaagaaaattgaagcatgctcacacaaatatttgtacacaaatgttcaaaatagcattactcataactcataatagcccccaagtggaaacaactcaaatgttcatcaaccgatgagcagataaaaaaattgtgatatgtccatacaacagaatacttatttgtccataaaatggaatgaagtaccaatacatgctacaatatggatcaaccttgaaaacattacrgtgagtgaaagaaaccagacacaaagtgccatgtattgtattatttcatttgcatgaaatatgcagaagaggcaaatccacagagaaagggtaggggggatgtgaagttaatgggtaagggatttttaggggttggtggtggtgaaaatgttccagaattagatagtggtgacagatgcacaacctagtgaatatacgaaaagtccctgagctgtacacattcagaggaagaattttattgtatataaattatacttaaaaaaaattttaccttgtagtacggccacaatccctgtgctg

SEQ ID NO: 187238 - DNA, 601 bp, Human
ccaatttaaaaatggataaaaactttgaatagacatgtttcaaaagatatacaaatggccaataaacacctggaaaaaatattcaatattgttagtcattagagaaatgcaaatgcaaaccacaatgagataccacttcacactcactgggatagctaaaagaaaaaagatggacaataacaagtgttgatgatatggagaaatctgaaccctcatacactgctagtggaaatgtaaaatggtgtagctactttagaaaataagttagcagttccacaaatgattaaatatagagttaccmtatgatccagcaattacaatcctagtgatatacccaagaaaattgaagcatgctcacacaaatatttgtacacaaatgttcaaaatagcattactcataactcataatagcccccaagtggaaacaactcaaatgttcatcaaccgatgagcagataaaaaaattgtgatatgtccatacaacagaatacttatttgtccataaaatggaatgaagtaccaatacatgctacaatatggatcaaccttgaaaacattacggtgagtgaaagaaaccagacacaaagtgccatgtattgta

SEQ ID NO: 187239 - DNA, 601 bp, Human
ataaaaaagttatctgcaaattgtatatctgacaagggtctggtatccagaatatagaaacaacacttgcaactccacaacaaaaagacaaataacccaatttaaaaatggataaaaactttgaatagacatgtttcaaaagatatacaaatggccaataaacacctggaaaaaatattcaatattgttagtcattagagaaatgcaaatgcaaaccacaatgagataccacttcacactcactgggatagctaaaagaaaaaagatggacaataacaagtgttgatgatatggagaaatytgaaccctcatacactgctagtggaaatgtaaaatggtgtagctactttagaaaataagttagcagttccacaaatgattaaatatagagttaccctatgatccagcaattacaatcctagtgatatacccaagaaaattgaagcatgctcacacaaatatttgtacacaaatgttcaaaatagcattactcataactcataatagcccccaagtggaaacaactcaaatgttcatcaaccgatgagcagataaaaaaattgtgatatgtccatacaacagaatacttatttgtccataa

SEQ ID NO: 187240 - DNA, 601 bp, Human
aactactaaggtggcatagtcatgaacagtaggttagcaataattaataatcactaccttccagttatagtctatttgcaatcaacaaaaacttaaaatacctactcaatcatcacccagaaaaaaaaatggagcataaaaagctcaagtgcttgctacctaatttaggtgttaaactagttaacaatagtagtgtaatttgaacatttattgtaagtcaggcacttaagcatgttacatgtattaactcactcaactcttaaaagaatcctacttgatagctattatttttagcctcatwtttacagccaagaacattgaggcacagagtttttggtaatgtgctcaagctcaaaaagtgagtcagaatcaaatctcaggtactctgcctctagaacactggagcttacctactaggttacactgccactctattgaacgtaatggttacccgttgccacaccctacacactgtggagagaggtacactgacattgaaaatacattcactaaataagactgttgttgaggtatttaaggtgtaactcagtgatcttaagtttatcttttattttccaagcccttctgacaagatcctgtt

SEQ ID NO: 187241 - DNA, 601 bp, Human
aagatttacagtctaaagacttgggttcatttcctggctctgccacttgcccttcccaagtcacaatttcctcatttgtagagtgaggataataaaacttgttctctgtttttttgagatggggtctcctctttcccaggctggagtgcacagctcactgcaacctccactgtccaggctcaagagatctccccacctcagcctcccaagtagctgggactacaggtgtgtgccaccacgcccagctaattttagtatttttagtagagacagggttttgccatgttggccaggatggtcwcgaactcctgaccacaagtgattcacccgcctcgacctcccaacgtgctgagattacagacgtgagccatggcgcccgtccttgttctcttttcttcacagtttagtgggagggtcaaataataaatgcaaatactatttacacactgtaaaacacaaagtgcctgttagctattattataggatccctctggaatctgaatatactccttgtgtttcctttactgtttcaatgagcacttttcttcagccaaattatttgtatttagtgtatgagactttgcaaaataactactaaggt

SEQ ID NO: 187242 - DNA, 601 bp, Human
caatgtatttactgtcatcttgtttcctagagagcctttgctttccagggtctgatggtatgttttatatctgagtgctgcagcagtttacaaagtattaaactaaaccctcaagcttataggcagaggagcatgagagtagggctgggaggtctgtgctggctgttcactcccatcccacaatccaacagtgttggtcttggagttaaaccaaagttctagaagcttcagggtgtgttcctaagaacgagttgtgtggctggtagggccattctctgaattagatagagggcctgattascttaacctttaagaaaacctctactcagtccatgcgtgttgaaagtgtggtgccagggtgccctcctatttcaacattaattctatttggggctatgcacatgcaaagtgtagaggagataaggcaggttgggcacctgtgttcctaacattcagaacatgttgccagggaaaaagaaatatttttggctcatacagagtattggctaagaagagtacttgagagtttgtcattacctcatttcccctagtttagtttgtgctttcagaatttaagaaccggggtccttgatttaccact

SEQ ID NO: 187243 - DNA, 601 bp, Human
gagattttaaaaaatcaaggctggtcgccatggctcatgactgtaatcccagcactttggcaggctaagtcgggcggatcacccaaagtcaggaattcacgaaccagcctggccaacacggtgaaaccctgtctctagtaaaaatacaaaaattagccagtggcaggcacctatagtcccagctacttgggaggctgaggtagaagaattgcttgaacccaggaggcagaggttgcagtgagccgagattacaccgttgcactccggcctgggcgacaagagcgaaactctgtctcaaaaracaataaataaataaataaataaaaattaaaaagatgcttggactgaatgattattaaaaatcaagaattccaaatggcttttgtggaattttaaggtaagaggggcctttgagaagttctctaatccagctccatattttaaaggtacgagggcaatctaacaacctataaagaggaaatccatccactagatggaaacaatctcacaatctcagtaacacatttccatgtttaacaagtacaaggcaaagacattaaacctgcttggaatagaattacttctggtttatagctgggcg

SEQ ID NO: 187244 - DNA, 601 bp, Human
aataggctgagcaaccacatggtagtgatgttacatggcagagattttaaaaaatcaaggctggtcgccatggctcatgactgtaatcccagcactttggcaggctaagtcgggcggatcacccaaagtcaggaattcacgaaccagcctggccaacacggtgaaaccctgtctctagtaaaaatacaaaaattagccagtggcaggcacctatagtcccagctacttgggaggctgaggtagaagaattgcttgaacccaggaggcagaggttgcagtgagccgagattacaccgttgcrctccggcctgggcgacaagagcgaaactctgtctcaaaagacaataaataaataaataaataaaaattaaaaagatgcttggactgaatgattattaaaaatcaagaattccaaatggcttttgtggaattttaaggtaagaggggcctttgagaagttctctaatccagctccatattttaaaggtacgagggcaatctaacaacctataaagaggaaatccatccactagatggaaacaatctcacaatctcagtaacacatttccatgtttaacaagtacaaggcaaagacattaaa

SEQ ID NO: 187245 - DNA, 601 bp, Human
actccttagttccccaggaagcatctttttctgtcacaccatgtaattcaaaataggctgagcaaccacatggtagtgatgttacatggcagagattttaaaaaatcaaggctggtcgccatggctcatgactgtaatcccagcactttggcaggctaagtcgggcggatcacccaaagtcaggaattcacgaaccagcctggccaacacggtgaaaccctgtctctagtaaaaatacaaaaattagccagtggcaggcacctatagtcccagctacttgggaggctgaggtagaagaatygcttgaacccaggaggcagaggttgcagtgagccgagattacaccgttgcactccggcctgggcgacaagagcgaaactctgtctcaaaagacaataaataaataaataaataaaaattaaaaagatgcttggactgaatgattattaaaaatcaagaattccaaatggcttttgtggaattttaaggtaagaggggcctttgagaagttctctaatccagctccatattttaaaggtacgagggcaatctaacaacctataaagaggaaatccatccactagatggaaacaatctcaca

SEQ ID NO: 187246 - DNA, 601 bp, Human
agcggggtgtagtggcacatgcctggagtctcatctacttggggggctgaggtagggggattgctcaaacccaggagtttgaggttgcagtgagctgtgatcatgccagcctgggtgacaaagcgagaccttgtctcaaaaaaaaaaatccttgacaaaaaatatagttagatggaagtttactagagtaatcgaaaagggcagtacagaaaaccaaatatacaatataatctcattttgcaaacaacaacaaaaaactcggtagaaaaatgtcggatgcatatcaaactaataataatarttaaggtttaaggcagaggctgtatgcaaggtacagagtagaccaaaggcatgtttcaagagggaggactgagctttttttcttaactgtcaagactgcttccttgtcatcatctctccagtttgccagggacactcagtatgtattgttattcagtattaactattcatttacaactgttatactgaatctctttgaggatgtggtcaaatattaaatgctccttcattgtttctgaagttgatgcccaaagaaaatctgtaggatgacatctactaaaagctagcagcccaaaacttg

SEQ ID NO: 187247 - DNA, 601 bp, Human
tttcagaaaatgggatgggagagcattatagggatgggcaaggatattagttagaaagtccttctagaaggcctagttgagaagtgagaagggtctagattaaagttctggaaatggagaggaagagactgatttaagaggaaatatttataggacctggtcattgactagagggaaggagagcagaaattggtgatggtttcagggtttctatctggaaaactaggtaagcagtgatgcagtgattgtgataggaaagaagtatttttgggagggggaatcatatacgtagttctaaaarcgtgtatctgaggtgcctggggacatccacagtcgagtccattggtctgcagcttagaagaaaggcctgggctggaggtatagtttggggattcattaacaagtagatgcacatgaaatcataaacatgtaggaaattgactagaaagagtctgtggaattagaactatggtatagagtgtacggttgaagcttgggggagactgaaagtgggagaagaaccaatgtcagaccctgaggagatgtttgagaggtaggaggtgaataagaactgtcctgccagagtcagggagggagagag

SEQ ID NO: 187248 - DNA, 601 bp, Human
attaaaggtttctgggatcaaggggatgtttttaattataaggaagccttgacaatggttgaactaattttcactcccaccaacagtgtataagcacagtgtggcgattcctcacagggctgaagacaaaaataccatttgacccagcaattccattactggatatatacccaaaggaatataaatcattcttttataaagacgcatgcatgcatacattgattgctgcactattcacaatagcaaagacatggactcaaatgcccatcagtgatagactggataaagaaaatgtggtacrtatacaccgtggaatactatataaaaacatataaaaaaattaaaaaaaaacaatatcctttgcaggtacatggagttggaggccattatccttagcaaagtaatgcaggaacagaaaaccaaatactgcatattctcacttataagtgggagctaaatgatgagaacgtatggacacatggaggggaacaacccacactggggcctatcggagggtgaagggtgggaggaaggaaaggatcaggaaaagtaactaatgggtgctaggcttaatatctgggtgacaaaataatctatacaa

SEQ ID NO: 187249 - DNA, 601 bp, Human
gagaaaacatcttccttaccacttacctctctaatcatctttgagaaatcccatttttgtaggcactaagcagcattcatttacatagatgactcaaccaactattaccttatgtctgccatgtgcaaaactctggctgagtaataagaaagatcaaaagataaattagacctgaatcttgccctcaaggaagatagaacatttatatattcctgtagtactgacagaaaacgtgtggtataataatgagggaaaggagcaatctagtttttttcctttattgttttcttagttttaaaawaattcccagcacatagtatgtcttcatattttttgttgaatatatgagagagatatagatcatgtactatgaaaattctgagaaattttcctcttggtgggtatctgggaaaacttgagcagataccgtctaaacgtgcctaggatttgcagaaaagtggaggaagagaaggtacacagttatgaagatggattcttctgtttacagaaagctttcagtgacagagggagagggagcgtggagggcattgtggccaccaggatctgggatggagtgggtggcatgcaatgggaaggaagg

SEQ ID NO: 187250 - DNA, 601 bp, Human
taatgtaaaaaggaggaaggcaaaggagcaaatgaaaaacagtagttcctagaagaaaattcatttaggcaggagcctagtgaattgatctccctgcttaatgattagagtatcaagtgtggcttcttattaaagtttgggattctgccaaaatggaacatatgtttatggaccagtgatatgctgtggttctttattgtagcccattttcccaaagctgctgggttttatgagaaaacatcttccttaccacttacctctctaatcatctttgagaaatcccatttttgtaggcactaarcagcattcatttacatagatgactcaaccaactattaccttatgtctgccatgtgcaaaactctggctgagtaataagaaagatcaaaagataaattagacctgaatcttgccctcaaggaagatagaacatttatatattcctgtagtactgacagaaaacgtgtggtataataatgagggaaaggagcaatctagtttttttcctttattgttttcttagttttaaaaaaattcccagcacatagtatgtcttcatattttttgttgaatatatgagagagatatagatcatgtacta

SEQ ID NO: 187251 - DNA, 601 bp, Human
agtctatctttagtacaatgtcttttggaactaacaaatacctttctaataaaaaaaatttaatgccctaatgtaaaaaggaggaaggcaaaggagcaaatgaaaaacagtagttcctagaagaaaattcatttaggcaggagcctagtgaattgatctccctgcttaatgattagagtatcaagtgtggcttcttattaaagtttgggattctgccaaaatggaacatatgtttatggaccagtgatatgctgtggttctttattgtagcccattttcccaaagctgctgggttttatgrgaaaacatcttccttaccacttacctctctaatcatctttgagaaatcccatttttgtaggcactaagcagcattcatttacatagatgactcaaccaactattaccttatgtctgccatgtgcaaaactctggctgagtaataagaaagatcaaaagataaattagacctgaatcttgccctcaaggaagatagaacatttatatattcctgtagtactgacagaaaacgtgtggtataataatgagggaaaggagcaatctagtttttttcctttattgttttcttagttttaaaaaa

SEQ ID NO: 187252 - DNA, 601 bp, Human
aagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataayattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggttta

SEQ ID NO: 187253 - DNA, 601 bp, Human; identical to SEQ ID NO: 187252

SEQ ID NO: 187254 - DNA, 601 bp, Human
gctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaarttggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaat

SEQ ID NO: 187255 - DNA, 601 bp, Human
cacccatgaggtccttgagtctgagacactgccccatggaaaggattctttgtagcagtgaaaaactggaaacaaggaaactatgcatcaggaggcgaatggttaaatgaattgtgatgtatctagacaatggaatacacagcagccatccaattctatgatacggttctatgttgaattggcatggaaggtgatccatgaaagatgggcaattagaaagcaagatagaagattatatgtgtagtctgatttcctttctattaagtgcgtgtgtgtctgtgtgtgtgtgtgtgtgtgtgtgaggttgtgttacagagaaaaagtcagaaaggaagtatctcagaaacttaacaatggctaaactaggaaagggtgcttcaggagtttttattttctatattatgtatgttggcattttggggattttttgtgcattgtaaaaatactcctttatgatcagagtaaagcaaaaagttattttaaatgactcatcagtggatgctggtttgccttttcaaacacacctaccctctttagttctgaattagctgttactccatagacggctggcaagtccatccagagagtggtcactgtgtgc

SEQ ID NO: 187256 - DNA, 601 bp, Human
cccatgaggtccttgagtctgagacactgccccatggaaaggattctttgtagcagtgaaaaactggaaacaaggaaactatgcatcaggaggcgaatggttaaatgaattgtgatgtatctagacaatggaatacacagcagccatccaattctatgatacggttctatgttgaattggcatggaaggtgatccatgaaagatgggcaattagaaagcaagatagaagattatatgtgtagtctgatttcctttctattaagtgcgtgtgtgtctgtgtgtgtgtgtgtgtgtgtgtgargttgtgttacagagaaaaagtcagaaaggaagtatctcagaaacttaacaatggctaaactaggaaagggtgcttcaggagtttttattttctatattatgtatgttggcattttggggattttttgtgcattgtaaaaatactcctttatgatcagagtaaagcaaaaagttattttaaatgactcatcagtggatgctggtttgccttttcaaacacacctaccctctttagttctgaattagctgttactccatagacggctggcaagtccatccagagagtggtcactgtgtgctg

SEQ ID NO: 187257 - DNA, 601 bp, Human
gccctgtgcagcccctgctgggcggttggcaggcatctgatccaggcatggtgagtggatggatctgatagatggctcagagaccctgcctcgtgtagggaacaaaaagcagagctatgaaaaaatgtaagagatgattcaagctccgtgtagcaaattgtacaaagttcaaagtaaggacctgcattcctgactcatgttagtatctgatttgatgttagtgctgtaagcatcagaggctataagtgtggggagatgctgtgtgcacaataaccccatgctgattttcatgttggctacktaagaatgttagagaatacaaaaatagtgattggataataataggttccaagctaacttttctaataggcacttttctcttttggagaattagcagctctctcccttcctttatctcccaggtccctgcacataccccatgctttctgactttcatgccttagtgcatatgttttcccaccctggagcaatgttccctcccctcgttgcatgtctccatgctcttcggccttcaaggacccgcaaaaatgtcacctcttcaatgaagccctcctggattctccccagagctaaagacatg

SEQ ID NO: 187258 - DNA, 601 bp, Human
atgacttactcagtgtatttgaatgcaagcttcttgaggacatggatcatgtcttacacattgtttaagccaaataaatgtatcaggtactcaaggcacattgaataagtgggttcgatggatggcccatggcacctgcaacaaggcctcactgagcagcaagggagagatttgccacagtgctgagtcaactgcccatccactcccgacagaccgctgagatggtcctcactctcagtatgtttggtcatatgtgggattttcccccctatatttttcccgctttctcactggcaagacraaaatgaaagcaagcactgagacttagtagctgggagaataaaatatttgagaagtattctgacaaaaatgaaagagaaatagatggcaaggctgtctgtggaggttctagatgtgggctctagggaggggtatgtcctgtttttactctttggctctctccaaattttctatgagccagaagcagatgcatattttataaactgtaatatattacattctattatacaccataatatattacatgatatatactatttgtttatttattttagagacagggtcttgctctgtcactcag

SEQ ID NO: 187259 - DNA, 601 bp, Human
ttgctctgtcactcaggctgcagtgcagcagtgcaatgttagctcacttcagccttgaactcctgggttcaagcgattgtcctgcgtcagccagctgagtagctgggactacagggtaggcaaccatgcctggcatatttttaaattttttgtagagatggggtcttgctctgttgcccaggctgatctcaaattcctggcctcaagtgatgctcccacctcagcctcccaaagtgttggaattacaggcatgagccatcttgcctggcttgtgtttatatattacctttaaaaaaaaaaataaagagaaacctttatagaaagctagtgtacaacttagttgcataaagtagcctcggtgaatgtaattactagacttgctctttctgcggtagctggagcaggctacaagttcctcctctagatgagttttgtaaacaggtgtgctgaacgttagagcattgggcttcttcttcttttttttttaaatctgacaagttatttttatgacagctcttaaaataaaattttacacacttggtaagatatttaaatagtttgcaaaatctaaatgaaaacatgaaagttcattttccactgg

SEQ ID NO: 187260 - DNA, 601 bp, Human
tttctgtatttgtcaaatttcctgcaaacacgtgtgttacttttgtaacaaaaaaagtcatttttcagataaatgtcagtgttttcctggcccccagagggctgcagtgaaattcggtgaatgcccaggtggctgggtaaggtcacggccggaggctggggctactcatttttatttcagacacagtcctgttccaggctttcttgtgtcttagggtcaattgccaaaatatttttttctcttctaaaaatttattgtgagtcttacttgtatctaatttcaagctcactgaaaagtgaaraattgtgtaaagaatgcttataaacccttcacccaaaccattgttttcattttgtcctactggctttattattctccttctctctatatacatatgttttcattaattttttgcattttttgcttattttttgaatcctttgagaatatgccaaagacactgttctcttttgcccctaaatacttcaggggataattcctaagaacaggggcattctcctgtaaaaccacaatgcagtcagcaaaatcaggaaatttaatccggatgcagcactatcatcgaattcacagcacctattgt

SEQ ID NO: 187261 - DNA, 601 bp, Human
tttataaatgggagctaaatgttgagtacatatggacacaaaaaagggaataacagacactgggacccccttgaggatggagggaggtaggagggtgaggataaaaaaactatctaccagtcaggtactatgcttattaacctgggtggcgaaataatctatacaccaagcccccatgacgcgcaatttacctatatgacaaacctgcacatatacccctgaagctaaaataaaaggaaaaaacccacaaaaacaaaccaaaacaaaaaaaacccacgtgggtccgtagtgatctctcaarttggctacaacagcacaaggcactccagtgcacttttgaaaagctaccagcagagaggttaccaggaggaagttctggttgctttcctcctcagggcctgctgacagccggagatgacactgagaagtgaagtgccagaaggttttcatcgtactttgctttttcctgccttacttgaacagctttattgaggtccaattataataaactgcaaatattaaaatgcagaatgtaagttctgacgtacatacacccttgcgaagctctcacacaacccagacagtgaacatatttatcccc

SEQ ID NO: 187262 - DNA, 601 bp, Human
ctttggggtatgttgtggagacagaggaaaatgtggtgttataaacagctaaggatttttaaccatctttaactagggtgtgcttagttccatatgcctgttctaaaactcagacaaatgaggcaaagggagaattcatgtaatttgcttttaaaaaacccatggtgggcacattagttgtatttcttgcataacattatgtagaccttatgaaaacacgtaacagtatacattcccctgaaagagaccaagagctgagcaaaaattagtgagtcagtctgggcgtggtagctcacgcctstaatcccagcactttgggaggcagaggcgggcggatcacctggccaaggccaggatttcaagaccagcctgcccaacatggcaaaaccccatctctactaaaaatacaaaaatagctaggtgtggtggcatgcgcatgtaatcccagctacgtgggaggctgaggcacgagagtcgcttgagcctgggaggtggaggttgcagtgagccaagatcacgccattgcactccagcctgggcaacagagcgagactctgtcttaaaaaaaaaaaaaaaaatcagtgagtcaaatcataatcca

SEQ ID NO: 187263 - DNA, 601 bp, Human
caaaatggtttgctttaccatctgggtattggcagctgctctctgcatcccagaaatcttatacagccaaatcaaggaggaatccggcattgctatctgcaccatggtttaccctagcgatgagagcaccaaactgaagtcagctgtcttgaccctgaaggtcattctggggttcttccttcccttcgtggtcatggcttgctgctataccatcatcattcacaccctgatacaagccaagaagtcttccaagcacaaagccctaaaagtgaccatcactgtcctgaccgtctttgtcttgtctcagtttccctacaactgcattttgttggtgcagaccattgacgcctatgccatgttcatctccaactgtgccgtttccaccaacattgacatctgcttccaggtcacccagaccatcgccttcttccacagttgcctgaaccctgttctctatgtttttgtgggtgagagattccgccgggatctcgtgaaaaccctgaagaacttgggttgcatcagccaggcccagtgggtttcatttacaaggagagagggaagcttgaagctgtcgtctatgttgctggagacaacctcagga

SEQ ID NO: 187264 - DNA, 601 bp, Human
tccacatcacatcatagcaatgttcatatggtacagtggggtagatgtctctgaaaggcaaagctaggccattttatggtccactgattgaggagctctgttcagactactggagtagatgtgtaacatcctgaactgatcttagtcctggcacagcttcattgtgtgaccttggaaaagttgcttactttcttaggttttttttgttgttgttgtttgttttttaaacaacatttaatgggtggtcatgatgtctaggaactatgctaggcactggggatacaaactgtataggtatttstgtgagtatgagtggtccctgccttggaggagcatacaatctggtgaggaaaacgggcatagaaacagaatatcaatataaactgatgttgtggagggatgcacaaggtactatgagagcagacaggaagggcacctaaccaaagggagcaggagagaggagaaagctccctggaagaggtgactcctgtgctgagttctttaagggtaaataggaatatccaggggaagaggagaggagggcattagccggcagagtatgtaaagccttagtaaagccacagaggcattaaagaaacag

SEQ ID NO: 187265 - DNA, 601 bp, Human
gtaaactaggctaagctatgatgttcaataaggtgtattaaatgcgttttcaacttaccatattttccatttatgatggatttattgagatgcagccctattgtaagttgagatgcatgtgtacctatctcagggttaataagcacaaatgggaaaaatcacataaaacagcacaatatctggcatgtggtgagtattctgtaaatgtcagctgctattaggtaggacacgccaaagagcttactctggttggtgactgagatccactgaagagttctgtttcttttttctttattattaatattattattattattattattattattatacagagtttcacccttgtcacccaggctggagtgcaatggtgtgatcttggctcactgcaacctccacctcctgggttcaagcaattctgcctcagcctctcaagtagctgggattacaggcacctgccaccacgcccggctagtttttgtatttttagtagagatggggttttgccgtgctggccaggctggtctcgaactcctgatctcaggtgatctacccacctcgggctcccaaagtgctgggattacaggtgtgagccgctgtg

SEQ ID NO: 187266 - DNA, 601 bp, Human
ttggctcactgcaacctccacctcctgggttcaagcaattctgcctcagcctctcaagtagctgggattacaggcacctgccaccacgcccggctagtttttgtatttttagtagagatggggttttgccgtgctggccaggctggtctcgaactcctgatctcaggtgatctacccacctcgggctcccaaagtgctgggattacaggtgtgagccgctgtgccctggctgtttcttttcaaatagtagcatgatcacatttgcattttagctagtacactgtaccagcagttaggaaayagtgagggaaaagattagacccagttaagtcacaaaggtgactagggtttactattgcaatggtagagggatgggggagtacatttaggagggttgaatctacaggaaacctggtgatcaattggttgtgggaggtgagatagaaggaagcagcaaggaaagatgtccatgtttctgatttaggtggatggctgtgaaatttattgagaaggggaaagaggaagaagagaagatcggggaaggggagagtatgaatttagtatagaaacatgttgaggttaaggtgcctaggagataagt

SEQ ID NO: 187267 - DNA, 601 bp, Human
atcttgatgtttttccttgacttctctctttccttcaggctcttacatccaataaatcaacaaatcctatctattttatattttaaatatacccacatcccactatctccatcactaccttcctatttcaggtcaccatctctcacttggattgtggcagtatcctcttagttgctttccctgcttatatccttgcctcatagcccccacagcccatactccacacaacagccagagtggcccatatttttaaaagtgtttttatgtcactctattcatgtcatgtattcaaaagcctccrgtggctttcccattcaaaataccatgatatttgatatttggttattgtgacctaccaggttctacacattatggccctggctatgtctgacctcattttctatcactcttttttatctcagccatactggccaccttgttatttctcagccatgtcaggccaggcacgctcccacctcacagccctcgtatttgcttttattccttagcatactcttctagatattggcttagttattttcctgaagtctttgttcactgtcatctcttcagagagttctcttctgactaccttgtatat

SEQ ID NO: 187268 - DNA, 601 bp, Human
gtgcttttcaagcattttgaggctggacttttctgggtcctgccctgtccctttctttgtgtgtgagttttttgttttttcttgttcatttgtttgtttgttgtaatcgttgtgttgttgttgttttaatgtgctttcatgtggtattggaattggttctgaaagtgatcgagctagaactaagtgagcaccttttctttaaccatcctttgtttcagcatgcccctagaaagccaaggttccttgaaacttttctatatacgtctatatggaaactactaaccaatccttctccctttcmtttgggaacattgacttctaaagcaccgtagaagttcttgacaattaagtgcataagtacattggaagaggttttagaagggtcgtagtgattcaactttttaactgaaggccaggctgaagaaaggggcttcaagttcagctcaagggatttagatggaacatggaagagggctttggaatctccttctttggacagggtattttaaagccgagtaattttttacttctagtgacatgattcctgggagaactttctctttctttcttttttgcaaggtactcaggccccctcaggaga

SEQ ID NO: 187269 - DNA, 601 bp, Human
tctgccaactatgacggtgagtgactggtatgagcaacatcggaaatatggagcattaccggatcagggaatagccaaggcagcaccaggtatgacggggtaggagggaaatagttgtaccactggtcttttactccctggcaattaagttcttaccaagtatagttgccctttaggaacagaaatagtggggacaaagattctgagtaatagaaagattctagacagtactatgtttattattaaatagcaaatggttatgggaggatggggtcagtgatagcatagtttgtaaatctckccaaatgtcatgacataaaaacagagcagctgtgtagaaaactcaatctatggatagcagttccgcatctggtaatggcagagtaggttgtatcaggccagcccctcatacaggataacaattacaaactgaacaaaatattttaaaaaccaactacctgaaggtactggcaagtcaccaaaagcaggtgtaagctgaagggcagtcaacacttagaaggaggaaatgatacttggaattcattgagggcagggactttgacttactgtacctttagtgcccaacttggtaattggatca

SEQ ID NO: 187270 - DNA, 601 bp, Human
gactcataactcaaaagaaaaggcaatcaatggataccaaccccaagataactcagatgttggaattagcagacagggactttaaagcagctattatttttatcctcaagggcagagagcaaaatatgtttgtaattaatgaaaagataagaaatctcagcagagaaatagaaactatacacacaaattctggaatggaaaaatacaatatctgaaaatgtaaagtcactggatgagcttaataccagattgttgctgacagaagagcctgtcggttaacttgaagatcaatagaaattayccaatttgaaaaaaaagattggataaaagtaagcagtatctcagtggcctgcggaattatgtacaaaggtctcatgtatgcgcaattggaatgccagtaccagaggagaaagaagggaacagaaaaacttgaagaaatgatgactaaagatttcccaagattcagaaatgtcagcaaaccccaacagtttaaatacaaacaaaatcacacataggcacattatagtcaaactgcagaacaccagagagaaagaggaaattttgaaatcatccaaagataaagtacacattacacatagga

SEQ ID NO: 187271 - DNA, 601 bp, Human
ttgtttgtgagattctcctgttttatgtgaaccgatacatgtctattgctgtataacaaattactctaaaacttagcaatttaaaataatcagcatttattgtatcatagtttctgagggtgaggaattcagaagcaactgggtggtcctagctcagaaacattcatgaggttgcagtcaagctgtcagctggggctgcagtcttctggaagcttggatgggactagataattcactgccaagctcatcgatgtagctgaggacaggaggctcacatagggttgctcacaacagcttccgytccccaaagtgaatgatctgagaatgaccaaaatcaaaaggctcaatatcttttataacctaatgttggaatatgacttctgccctattctattagtcatatagaccaaccctgatagagtatgagaggagactccataaaagcatgaataccaagaggctgggattgttgtgcaccatccttgaggccccccatcacataattttttttttttttttttttgagacggagtcttgctctgtcgcccaggctggagggcagtggcgcgatctcggctcactgcaagctccgcctcccggg

SEQ ID NO: 187272 - DNA, 601 bp, Human
gtataacaaattactctaaaacttagcaatttaaaataatcagcatttattgtatcatagtttctgagggtgaggaattcagaagcaactgggtggtcctagctcagaaacattcatgaggttgcagtcaagctgtcagctggggctgcagtcttctggaagcttggatgggactagataattcactgccaagctcatcgatgtagctgaggacaggaggctcacatagggttgctcacaacagcttccgctccccaaagtgaatgatctgagaatgaccaaaatcaaaaggctcaatatmttttataacctaatgttggaatatgacttctgccctattctattagtcatatagaccaaccctgatagagtatgagaggagactccataaaagcatgaataccaagaggctgggattgttgtgcaccatccttgaggccccccatcacataattttttttttttttttttttgagacggagtcttgctctgtcgcccaggctggagggcagtggcgcgatctcggctcactgcaagctccgcctcccgggttcacgccattcacgccattctcctgccccagcctcctgagtagctggga

SEQ ID NO: 187273 - DNA, 601 bp, Human
ttctggaagcttggatgggactagataattcactgccaagctcatcgatgtagctgaggacaggaggctcacatagggttgctcacaacagcttccgctccccaaagtgaatgatctgagaatgaccaaaatcaaaaggctcaatatcttttataacctaatgttggaatatgacttctgccctattctattagtcatatagaccaaccctgatagagtatgagaggagactccataaaagcatgaataccaagaggctgggattgttgtgcaccatccttgaggccccccatcacataattttttttttttttttttttgagacggagtcttgctctgtcgcccaggctggagggcagtggcgcgatctcggctcactgcaagctccgcctcccgggttcacgccattcacgccattctcctgccccagcctcctgagtagctgggactacaggcgcccgccatcacacccggctaattttttttttttgtatttttagtagagatgaggtttcattgtgttagccaggatagtctcgatctcctgaccttgtgatccgcccgcctcggcctcccaaagtgctgggattacaggtgtgag

SEQ ID NO: 187274 - DNA, 601 bp, Human
tatacacctgatagaatggccaaatccagagcacctcaaatgtaaatagaataaaccttcgaattagaagtcagggatcgattatcaggtctagctgcatgctgtctataaaagatacattttaaatacaaagacacagattggttacaaataaaaagaagaaaagatatataggtggctcacgcctgtaatcccaacactttgggaggccaaggcaggcggatcatgaggtcaggagttcaagaccagcatgaccaacatggtgaaaccccatctatactaaaaatagaaaaattagcckggtgtggtggcacacgcctgtaatcccagctactcaggaggctgaggcaggagaatcgcttgaacccaggaggctgaggttgcagtgagccgagaccacaccactgcactccagcctgggtgacagagtgagactctgtctcaaaaaaaaaaaaaaaaaaaaagatatataggttgagcatcctaaatctgaaaatgaaaaacctgaaatgctccaaaatccgaaacttcttaaggctaatgtgatgcttaaaggaaatgctcactgaagcattttggattttcagatttgggatgctca

SEQ ID NO: 187275 - DNA, 601 bp, Human
ccacaaaccttcaatttgttaaaaaaaaaaaaaaaaaaaaaagtctctgcaaagcacaatagagtgaagcacaataaaacgaggtatgccttcaccttcttttcagatacccatggaacattcaccaaggtagatcatatactggtccatgaaataagtctcaataaattttcaaaaattgaaatcacactgaatatgtcctcagaccacaatggaattaaattagaaatcaataatgtacctagaaaattctcaaatatttgaaaattaaacagtacacttctaaataacctataggtcyaagaagaaattagaaagaaaattagaaaatacttctaactgggaataagttcaagagatctgttatacagcatggtgactatcgttaatggctgggtgcggtggctcacgcctgtaatcctagcactttgggaggccgaggcgggtggatcacctgaggttgggagttcaagactaacctggccaacatggtgaaacctcgtctctaataaaaatagaaaaattagccgggcgtggtggcgggtgcctgtaatcccagctattcgggaggccgaggcaggagaatcggttgagtctggga

SEQ ID NO: 187276 - DNA, 601 bp, Human
acctaagaggagtgagaccatatgtccacaaaagacctgtacaagattgaacatagcagcattatttgtaatagtccacactgaatacacaccactcaaatgcccataaataatagaatgaagaataaattttggtatattcacacaatggaaaactatgtagcaataaggttaaactatagtttgtttgctataagtgacaaatatagctgaatcgtgtgaaaaaagccagacgcaaaagagtatatactgtatgattccattcatacaaacttcaacaaacaggtgatacttgtgtgtrctggttgaaagctagtaagtgttcacccttagttggggatcatgaatggaactggacctacagggtcttctgaggagttagaaatattttgtatcttcatctgggtactgattacatggatgtgttcaatatgtgagagttcactgagctatacaaatgttagtatacttttctacacgtatgttgcacttcagtgaatgtgaaaaaacccatggacaatatttataatgaaaataggtggcagtgtatccccatgaacctcacaataaaaacaggtaagggcaaattacccatagccac

SEQ ID NO: 187277 - DNA, 601 bp, Human
tagagaaataactgactacaattctggggcaggaaatatacaaataagcttggaacatcttgtcataaaagatagggaaggagctttcaaagactactggggtcatatcgagccaatttaaagatgtttccactggccaattcggtttcacagaggataattgacagtagcaacaagtccatccaacacccaaatcttggtttctaataccatcctctaataaatgaaccagggctccttggagaaatagctgattctagggctgaggcagggaatatacaagatgaacctggagcatctygtagtcagatgatagtcaacgtatgatggggttatatcctggtaaagccattctaagttgaaaatattgttaagttgataatgcatttgctatacccaacctacccaacatcacagcttagcctaacctaccttcgacctgctcagaacacttacgttagtccacagttgggcaaaatcatctaacacaaagcctattttatactaaaatattgaatatctcaaaatatgaggtatggcttttactgtatgcatgtcactttcacaccatcataaacttgaaaaatcttaactcagggct

SEQ ID NO: 187278 - DNA, 601 bp, Human
cagaggataattgacagtagcaacaagtccatccaacacccaaatcttggtttctaataccatcctctaataaatgaaccagggctccttggagaaatagctgattctagggctgaggcagggaatatacaagatgaacctggagcatctcgtagtcagatgatagtcaacgtatgatggggttatatcctggtaaagccattctaagttgaaaatattgttaagttgataatgcatttgctatacccaacctacccaacatcacagcttagcctaacctaccttcgacctgctcagaacrcttacgttagtccacagttgggcaaaatcatctaacacaaagcctattttatactaaaatattgaatatctcaaaatatgaggtatggcttttactgtatgcatgtcactttcacaccatcataaacttgaaaaatcttaactcagggctctctgtactagaaaacaagagctcaaaaaactgttggggtgttaaaggaacacaagagccagctgcaccctcacagcccaaaactgggagaacttgggcaggaaagtaaatttaacagtattggattatcacactaggaataaaatgaat

SEQ ID NO: 187279 - DNA, 601 bp, Human
tgtaaaaattagccaagtgtggtggttcatgcctgtggttccagctactcgggaggctgaggcaggaggatgacttgagcccaggagttcgaggctacagttagccatgatcacaccactgtactccagcctaggcaacagagagaaaccctatctcagaaaaaaagactcctgagctgttagaagagatcagatccccacacatttcattcatagtaatgagactatttctcatgagcaaagtcagagtagccaggaaaatgctgctttacctcacaaaggaaaaaaaatgcaaaagagrtgcagcagttggtttaatttcttttgggtgtacactgcatgataaatgccatttggacctcagagcctatttcaagcactgcaaaataatacgtaggcattcttttctggtaggtccaactgccctgtgattttcaattttatgcacaaaaacttatgtatgactatagtaaaggaaatggatggaggaggaaacgtcaactgcaatcccacccccctggcaactcacaaatcacaaattcataaatattttttctttcctgtttttggattgcaggggttgtttgatggtggtggtaat

SEQ ID NO: 187280 - DNA, 601 bp, Human
tgccctgtgattttcaattttatgcacaaaaacttatgtatgactatagtaaaggaaatggatggaggaggaaacgtcaactgcaatcccacccccctggcaactcacaaatcacaaattcataaatattttttctttcctgtttttggattgcaggggttgtttgatggtggtggtaatgtttttgtttaggggcttggggggggtgggtgttggccatttttgcaagaattctcttccaaaatagaattcattctgaggggcaccttttatgatttttgccttcttgtggaaaccactyagagcatcctttcgtactattttttaacatgcgatatattaggtaatgcaagttctctccccgcttccgccgggctcagggtaggcagctggctgtattcctgttctcattgcatgtggttgtgctcagagtggaactgaggcccctgacgttacttattaacattccctcaatttctcacctccctttctaatttttccactttagaggaattcagaaaagcagctcagcaacaggaagaacaagaagaaaaggaggaagaggatgatgaacaaacactccacagagcccgggagtggg

SEQ ID NO: 187281 - DNA, 601 bp, Human
caaaggagcactccttaggttcaacagtattcactgagctcttactggaaattaaaatatggctgaagtctaaggcaggaaggccaataaaggaggctatttttaattgtttctaaaacaagggtttgcgtttctgagttttctttgggctgaaagttattatgagcatgagagcagattttgatgggggaggagaggcctatgagagccataagagaaggaggggtggtagaagaggagagggtgcctgcctagatcctagtcctgtcttgaactcccgagagccagggaatatccagcwccttgatgaagccctaggcgggcgcctcctccttgtgcctatgatgtattgagacccagaatgtccatttcaaacataccagtgtgtctccgcttggctggcaacccaagagtgcccatctgaggaattgtgccaaacacttgcttgaatcttcaatttggattaagttggtctcgggaggcagggcctcagcaatctatattttgaaaaaactccctaggtgcttttctttctttctttctttctttctttctttctttctttctttctttctttctttctttctttctttttctttct

SEQ ID NO: 187282 - DNA, 601 bp, Human
aattgtttctaaaacaagggtttgcgtttctgagttttctttgggctgaaagttattatgagcatgagagcagattttgatgggggaggagaggcctatgagagccataagagaaggaggggtggtagaagaggagagggtgcctgcctagatcctagtcctgtcttgaactcccgagagccagggaatatccagcaccttgatgaagccctaggcgggcgcctcctccttgtgcctatgatgtattgagacccagaatgtccatttcaaacataccagtgtgtctccgcttggctggcamcccaagagtgcccatctgaggaattgtgccaaacacttgcttgaatcttcaatttggattaagttggtctcgggaggcagggcctcagcaatctatattttgaaaaaactccctaggtgcttttctttctttctttctttctttctttctttctttctttctttctttctttctttctttctttctttttctttctttctttctttttctttcttttctttctttctttctttctttctttctttctttctttctttcttcctttctctttctctctttctttctctttctctctttctt

SEQ ID NO: 187283 - DNA, 601 bp, Human
aagttaccaagagcctcctctcccaaccagctgggacgtgaaactgtgggctccactgatcacaagcagtggggtgaggtggggtggagcagatgtggcatgtgtcccgggcttcctgcctcatgaggactcagcagagctttcacccccagaaactgcaagttgggacttgtccctaggaaaatccagttgctgccaaggtcgtgcagtcactcagccctggagtcaagccagagcaggcaggtaggtgccagggctccctcatgggcaaactcactctccgttttccctctcctgaagsgggaggagaggagccaggtagaccagccacctttaattttctttttgcctgcaaaacggtttccttggacacaggcaacacgaggcaggggctgccaggtgtctagacttcagatcacctgatgtgcctggcaggatgtggctcagcctgggagaaatcatcccttgcgctgccccgcccggcccctccttacccctaggccacccgcctgacgacatccttgggaaaggccctcagcctacagcacctgtcagctgctgtctgaaggaggtagttggcagggggaagtgatagggggga

SEQ ID NO: 187284 - DNA, 601 bp, Human
tcaccgagacaccactggagggtgacttcgcctgggagcgtgtgcggggccttggcctgcccaagctctaccttcccacggggccccggcgaggccgggatgagttgggaggaggcaggcggcctggcacctcacctgctctgctgcaggggacagcagaggaagaccatgtggacctgtcactgtcttgtacccttgtgcctcgctcaggggagcaggctgaagggtccccaggtggacctggagactctcagggtcgaaaacggcggcagaccagcatgacaggtgcggacatgtgcasggaaggactttgtaagggaccaggattctcagaatccatggtccaagggctgacctgtctggtcctggtccagcatgctccaggtagaaggaaacaggcccagagaggggaagcaacctccctgaggtcacacagcaagtaggcagcaaagaccaactagctaacatttattgggaatgttcattatgccaggccctttgccaagcttctaaggtagatttatttagtccttatagcaatgttataacataagacattcttgtcaccctgcccgcctttctttttgagacaggtgtctta

SEQ ID NO: 187285 - DNA, 601 bp, Human
ttttgcccacctgtaggctaatgtgtgtgttctgggcacacttaaggcaagctaggctgagctacaatgcttggtaaattaggtgtatcaaatgcattttcaacttgcaatattttcaacctacaatgggtttctcaggtcacaaccccatcataagacgagggacatctgtaatccatatgttcattgttttaagtaaatagacattttttatatatccagtttgttgatagtaatttcgttgtgatgatagcaactaacaatagggctttctgtcagatgccttcctcggcactgggtygtggtgtattcccagggtggtaggagagccccggaaggctcagaatcaatgcgcgtggcctttggaaagccctgctcatcctccttcagctaccaagggctggctgagtggtcctgctcccaggctctgtcctcctgctcctcggaaggacgtcagtgcctgaggcctcttcctctccccggcagcagcctgtgtcgctcgatagggtcacatctggagaagggcagagggttcccctcaagcctccgctgagcactgaccagcacaggagcggtaagaaggaggaggccaggaaagaac

SEQ ID NO: 187286 - DNA, 601 bp, Human
tgtcagatgccttcctcggcactgggtcgtggtgtattcccagggtggtaggagagccccggaaggctcagaatcaatgcgcgtggcctttggaaagccctgctcatcctccttcagctaccaagggctggctgagtggtcctgctcccaggctctgtcctcctgctcctcggaaggacgtcagtgcctgaggcctcttcctctccccggcagcagcctgtgtcgctcgatagggtcacatctggagaagggcagagggttcccctcaagcctccgctgagcactgaccagcacaggagcrgtaagaaggaggaggccaggaaagaaccaccggggaggagcccgggagaaagtctgcagagctcacacaggcctgggaattgtgagtgctcccgccggggcagaaatacctcgtgatacacaaggccttgggtagagtgagaagttagccctggagtaaaggctgctggtgccatgcggcagaacttaaatgcaagcctcgaggggtcaagttgtttccaagtaactgctggcatcccataataaagccgaagaaaaattactgggattggagggtcaaaacatggcgcacccagttagg

SEQ ID NO: 187287 - DNA, 601 bp, Human
ccggcagcagcctgtgtcgctcgatagggtcacatctggagaagggcagagggttcccctcaagcctccgctgagcactgaccagcacaggagcggtaagaaggaggaggccaggaaagaaccaccggggaggagcccgggagaaagtctgcagagctcacacaggcctgggaattgtgagtgctcccgccggggcagaaatacctcgtgatacacaaggccttgggtagagtgagaagttagccctggagtaaaggctgctggtgccatgcggcagaacttaaatgcaagcctcgagggktcaagttgtttccaagtaactgctggcatcccataataaagccgaagaaaaattactgggattggagggtcaaaacatggcgcacccagttaggagtaattagcaaagtctgacatcaaaaattaccagacatgattcaaggaagtaggaaaatatgacctctgatgagaaaactcaggcaacggaaatagagcgagaaataacacaaatgatagaattagtaaagaaggtgaaaacagttgttataaatctgtgtgttcaaggaagtagaggaaaatgtaaacacgttgagtggagata

SEQ ID NO: 187288 - DNA, 601 bp, Human
aaattaccagacatgattcaaggaagtaggaaaatatgacctctgatgagaaaactcaggcaacggaaatagagcgagaaataacacaaatgatagaattagtaaagaaggtgaaaacagttgttataaatctgtgtgttcaaggaagtagaggaaaatgtaaacacgttgagtggagatatgaaaaattataaaaagacccaaataaaacatctggagatgaaaaaaatgccatagaggagacgcgaacgtactggttgggatgcaggagaaagacgggtgagcttgaggccgcagcaasagaaatgaccaacgtgaaaccagggagactccatagcgagtggacagagtgggctccggggacggctgggctgacgcaagccccacagtgcgaatgagcttgaggcccctggacggcacacttgaaatggtgaaaatgtcaattttgttatatgtatttttttaccacaattaaaaaggaagtgaacagagcatcatggcgccatgggaccatgatgtattggcttccaagaagccaaatacagcgggagttgcagtcccaaaaggtgacgggagtgggcgctcagagaacatttgaaga

SEQ ID NO: 187289 - DNA, 601 bp, Human
gacctctgatgagaaaactcaggcaacggaaatagagcgagaaataacacaaatgatagaattagtaaagaaggtgaaaacagttgttataaatctgtgtgttcaaggaagtagaggaaaatgtaaacacgttgagtggagatatgaaaaattataaaaagacccaaataaaacatctggagatgaaaaaaatgccatagaggagacgcgaacgtactggttgggatgcaggagaaagacgggtgagcttgaggccgcagcaacagaaatgaccaacgtgaaaccagggagactccatagygagtggacagagtgggctccggggacggctgggctgacgcaagccccacagtgcgaatgagcttgaggcccctggacggcacacttgaaatggtgaaaatgtcaattttgttatatgtatttttttaccacaattaaaaaggaagtgaacagagcatcatggcgccatgggaccatgatgtattggcttccaagaagccaaatacagcgggagttgcagtcccaaaaggtgacgggagtgggcgctcagagaacatttgaagaagtcggccggaggtggggcgcggtggctcacgcctgt

SEQ ID NO: 187290 - DNA, 601 bp, Human
ctggcaccgggaccgcccctcctccccggacagccgcgtgggcaaggccggcttccctccacatccccacggagcacgaggtcagatgcatgggttgttccggtccgtgggtgagaaacgggttctctgtgtcgcgtctcttcagagcgaagttgagtcttttcgtgtgcttctgacattcgcatctttttttctgtgcattcttcacttctctacaaggactgacctttcccttctctatctctaggagcacttgatagaacagaaatatttaagccgccgctactttctcagtctgtcrtttgcttctggtgtctttgagccacacgaacatgtttacatgatcgtaggtaaaaaggctgccaggttccagaagaacccccctgtggactctgctgggacacgcatggccgggtggttttcattaaactcgtggtctgttgggaatgtgtcctagtccattttataaagaattgaccccattttatctttttatatctattcatttactgcaacgccacttattttttaaaatattaattaaaaataatattttaaaatttatttatttaaaaaaaggatatagagatggagttttgcc

SEQ ID NO: 187291 - DNA, 601 bp, Human
gcagaggaagcctttaggtagcagcttcagagagaacagagtgtagatgtttcttatcagatgtaagatctgtgtcgatattaaggctgcagggtatcgtgaggcctgtccggcccccacttcccgtcatggcctgaaccagactctgaggttaaattttagagtgccctggccaaggaggaagtccattcagatggctggggggccttagaattgtgtttttggtttacagcttccttctccgggaagtttccttttaatgttcattcttaaatggttgaaagactcctgtaagaacccrtttatctgttgtagtcaaagatattctccacacaaagaaatgcatgtaaatgaattcagggaagctggaagagacatagcctatagtggggttttgttatgaatgccttgagactttttaatcctggaaggaaaactcacaggatggtaacgcagaggcctgatcagcttggcgggagcttgtggtttccaggctcttgtggctggaatgtaacagtcaaccctagtgactcaaaccgtcagccccaggactgggctctgctgcttttcctgtccttttctaggggagacttagatgtca

SEQ ID NO: 187292 - DNA, 601 bp, Human
gaaagactcctgtaagaacccgtttatctgttgtagtcaaagatattctccacacaaagaaatgcatgtaaatgaattcagggaagctggaagagacatagcctatagtggggttttgttatgaatgccttgagactttttaatcctggaaggaaaactcacaggatggtaacgcagaggcctgatcagcttggcgggagcttgtggtttccaggctcttgtggctggaatgtaacagtcaaccctagtgactcaaaccgtcagccccaggactgggctctgctgcttttcctgtcctttyctaggggagacttagatgtcaatcagaacactgtcttgcaatcattttgtcaaaacaacaagctttatttgttggacttgtggtgggtacaccacgttaaaccggtattgatacaccggagtcacagttgaccagttaagtcagaatttctgagtgcaggacttgctgaatctccccagatgactcggacggggggtcagggccggagatcctgctctgaggcatgaacccacttagcatcaggtcaggtggacccatacctttacaaccatgaacatcttaaacatcatgactaagagg

SEQ ID NO: 187293 - DNA, 601 bp, Human
gctacgtcacagagaggacctcagcacatgtggattgactgtggacatgaacacctcaaagtcgcttccaattacaaaatacaaaatttttcttttgtatgaaacatacgcaaaaatggctcatgcttgtaatcccagcactttaggaggttaaagcaggaggatcccttgagtccaggagtttgagaccagcctggccaatatggcgaaactccatctctactaaaaatacaaaaattagctgggcgtgctgatgcatgcctgtgatcctagctacttgggaggcttaggcaggagaatygcttgaacccaggaggcagaggttgcaatgagccaaaattgtgccattgcactccagcctatgtgacagagcaagaatccgtctcaaaaaaaaaaaaaaaaatagatagttacagtgaaggtgtggggatttaggaaggccttgctaaggtcagaatccctatgtgaatgctgagctggtggatggggagatgaaaacacccaggagaaaccgggatggatgaacccacgctgtgtgtgtgtcagtgcaaataccgtttaatccaatgtcgtacaacaagatagcaacaaggatagatta

SEQ ID NO: 187294 - DNA, 601 bp, Human
gaaacgagaatcggagcagacacggaccgtgtcctccctcatcacatccacacacgacctggagaggggtgcactgggccagggctgggggtgagcttgggtgttcgtgactcaagttgcaaatggccctctgcccaaaatgatacaaaaccacaatgacatcagtgctgatatcagagatagtttacaggaaccctttaccctgaaaaggactactcttagattgctgaagtcaccagataagccatttcctgtcgttttaaagtaaataaaatgctactgcctggattccttggctctrcacgcctctctcctttcttctaaacctggttgttgacaccgcctccttcccgactgctctccgctgtcatccttatcaacaggagtgtgtgatgtttctccacctgctacacactgtcagaggcacaagggatccaaaagtgcatgtgatcagttttctgcttttaaaaagtctagagtggaaacgggtaattatgacccagtagaaaatgggcaggaacagatggcagagacaaagcctggccccgcccctccccgccccagagagtcaggggagctgcgtgcattggaatcacactgt

SEQ ID NO: 187295 - DNA, 601 bp, Human
ttaagagctctgattagcagtcatatctcatccactaacacggagaaatgggttaaacctttattttacaaatcagatttgatacacaaaatatttttaaaacatggttcctggaggctctaataaataaaggaataggtgatgttgaaaaggttagcaacctctgattttgttctgaaacagtccattatttcagggtcagcaattagagatgctataggttggttaggtctcaaaaggaaaaagtttgctttaccatgatttattgtgcctgagactggcttcagtaccccactggcaygcgtggctcatgtgagaggcttccctgagccgaggagtcttggaagtcgccttaggtaaggggggccgccctcactgtgttccccactgcttgccttgtctgtagggctgtcggcagcgcctcgaaactgatggagctcgttcatggaggtctgcagctcagggcgaagcaccccaccctggtgcacgcggattcctccaggtctcacctgataattacggtgactctaaccacagcctcctgctctgacagcactggtaagtcaccatttgtgcttggtcagtggcaagtaatagaaaa

SEQ ID NO: 187296 - DNA, 601 bp, Human
agccgcagccttgcggccctggcaggcgtcctgggggctttgttggagcaccgtggccatgccccgtaccggaacagcaggctcacccacctccttcaggactgcctcggtaaccgttttccccaaaatgccccaggatgggggaccacgtaccccaggacatgtgcacacacttctggcctgcacgtcctcgagggccacccatgcaccccctgcacctcctgtgtcctcgctgtggctagctggcactcccacggcacggtggtcattctcctgcgccgtctcaccttggcctgattgygtgcttgttcggtctgtgtgtgacttgcctcctggttggggctcagtttctcaagggtggcagccctggcctttctcttcaccaggggtccgccagagcagctgagggctctctaggctgctgctgcatgtgtggcctgggtccctccggctgtgtagacctgcttaggccccaagttccttgggtcttttgggggcaggtgccagaagcctggacgcaacagattaagcaccagtgccaggtggggcacaggcggcccctgtgtggagtcatccagctgtggctggatctgggctttgc

SEQ ID NO: 187297 - DNA, 601 bp, Human; identical to SEQ ID NO: 187285

SEQ ID NO: 187298 - DNA, 601 bp, Human; identical to SEQ ID NO: 187286

SEQ ID NO: 187299 - DNA, 601 bp, Human; identical to SEQ ID NO: 187287

SEQ ID NO: 187300 - DNA, 601 bp, Human; identical to SEQ ID NO: 187288

SEQ ID NO: 187301 - DNA, 601 bp, Human; identical to SEQ ID NO: 187289

SEQ ID NO: 187302 - DNA, 601 bp, Human; identical to SEQ ID NO: 187290

SEQ ID NO: 187303 - DNA, 601 bp, Human; identical to SEQ ID NO: 187291

SEQ ID NO: 187304 - DNA, 601 bp, Human; identical to SEQ ID NO: 187292

SEQ ID NO: 187305 - DNA, 601 bp, Human; identical to SEQ ID NO: 187293

SEQ ID NO: 187306 - DNA, 601 bp, Human; identical to SEQ ID NO: 187294

SEQ ID NO: 187307 - DNA, 601 bp, Human; identical to SEQ ID NO: 187295

SEQ ID NO: 187308 - DNA, 601 bp, Human; identical to SEQ ID NO: 187296

SEQ ID NO: 187309 - DNA, 601 bp, Human
tcatgaataactctgtttgtctcaatactcgtcgctagcctgatcttgaaataagatttcccaggcatttaattatctaaaagttgtaaggcacaatggcaaacctcttcatctcttgatagacttcttaggacaccagggttattaagaacaaagtttctgcagtgcagaccagcggttcttacccagaaggagtatggctgctttgctaggtcagtctatctctttatctaaaaatagtcttgtgcttcttaacatcactaataacaaaagcaacaggaataatcctaataatgtagtytggtagaaaaagcattggacaaagggtcaggagaccaaactctacttctcagtaggtgatccagtctgggcaaatgtctacctcctatttcaggttctttcttcataaaatgaaaaaactggaaataacaaccttcaagatccctttcttcttcaaaacttctttgctttatgcagtggctcttgtttagccctatgctgcaatttttcaaagcatgtttgatttcttactgtatggttatattatttttacatcattagtggggtaggacaaggattatcacttatattttactgaagg

SEQ ID NO: 187310 - DNA, 601 bp, Human
aaggcacaatggcaaacctcttcatctcttgatagacttcttaggacaccagggttattaagaacaaagtttctgcagtgcagaccagcggttcttacccagaaggagtatggctgctttgctaggtcagtctatctctttatctaaaaatagtcttgtgcttcttaacatcactaataacaaaagcaacaggaataatcctaataatgtagtttggtagaaaaagcattggacaaagggtcaggagaccaaactctacttctcagtaggtgatccagtctgggcaaatgtctacctcctrtttcaggttctttcttcataaaatgaaaaaactggaaataacaaccttcaagatccctttcttcttcaaaacttctttgctttatgcagtggctcttgtttagccctatgctgcaatttttcaaagcatgtttgatttcttactgtatggttatattatttttacatcattagtggggtaggacaaggattatcacttatattttactgaagggaaaataatattaggtgcctgatggtcacttagaaacaaaagtgctccagttctttgttggagtctgacttagtaggtggtggcatg

SEQ ID NO: 187311 - DNA, 601 bp, Human
ttcaagacaattacttcattctggggagccctaggctacagtttctaattcttccatgtgagatatagagaatacatgtccaaacatcaaatttcttgttttctaatgccttttttactcttataaataacattttaaaagtatttctttaattatttaattattatagaagtttattaattagaaatttatccaagttccctgaaaaaggtaatatatgtgaattattattgttcatgtcttaggtatactacatggtttcaggccaccaatttgcacacaaggctgcattaatattacycataagtaaataacattacacttatgggaagaacattttcatttttaaattaaaggcttcattttcaatctgtaaaatgggtgtgataatagtacccatttcataggaagatggcaaagactcagaggtataatgtctttaggctgaactttttgaaattatttggcagatcgaatatcagatattagaagtttcaaacaattcaacttaatatattaggtacttagcataggccctgtcatctggtaagcatctagtaaaaattaaccattatttgtatccctttcatgtctctacaga

SEQ ID NO: 187312 - DNA, 601 bp, Human
ttctgtggctaaatataagttttgtggggtagatatacatgcattatgagctgtttggccagttattgcccctcttagggtgtcgggtgtcagagcttctttttctcttttctcatgtgtaaaattatgattcttgcagttctcatattctatgaatttataacaccatatgaaaaataacccttctacatactcaagaacatattctgtaattctagaaatcaagtatgtttattctaacctaaaaaatcatgcctattgtcattataatactaattgattgaggttttactttaacatkgttttagttctggtgttcgatgcctgtttttcctgttgagatgtgcaagtgttttcagaggggccaagaagcgccttcatcttgctggagcagtgggccagaaagaagcatagatttggcaggtggtagcttgcagacagacatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattca

SEQ ID NO: 187313 - DNA, 601 bp, Human
ttttgtggggtagatatacatgcattatgagctgtttggccagttattgcccctcttagggtgtcgggtgtcagagcttctttttctcttttctcatgtgtaaaattatgattcttgcagttctcatattctatgaatttataacaccatatgaaaaataacccttctacatactcaagaacatattctgtaattctagaaatcaagtatgtttattctaacctaaaaaatcatgcctattgtcattataatactaattgattgaggttttactttaacatggttttagttctggtgttcratgcctgtttttcctgttgagatgtgcaagtgttttcagaggggccaagaagcgccttcatcttgctggagcagtgggccagaaagaagcatagatttggcaggtggtagcttgcagacagacatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattcatagtgtttgccaattcctt

SEQ ID NO: 187314 - DNA, 601 bp, Human
aaataacccttctacatactcaagaacatattctgtaattctagaaatcaagtatgtttattctaacctaaaaaatcatgcctattgtcattataatactaattgattgaggttttactttaacatggttttagttctggtgttcgatgcctgtttttcctgttgagatgtgcaagtgttttcagaggggccaagaagcgccttcatcttgctggagcagtgggccagaaagaagcatagatttggcaggtggtagcttgcagacagacatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattcatagtgtttgccaattcctttggtgtaaatattcccatcatggcccattttaaactaccaatgtgatgtctgctggctcacagattcctgaaaacttaacaattagctacctcgggccagtacaagccgagtccagcacactgtcggcaagcctaagtacaaatgatccttggag

SEQ ID NO: 187315 - DNA, 601 bp, Human
acatgatttcagaggctctcctgtgcctgtcaatttttttccaagttgtccctgatgcctgaaattctatgacagaggacaatgagagataagggcacatggatgtcctggtaaatgcttaggaatccgagtacagggcttgttggagagccctgattcatagtgtttgccaattcctttggtgtaaatattcccatcatggcccattttaaactaccaatgtgatgtctgctggctcacagattcctgaaaacttaacaattagctacctcgggccagtacaagccgagtccagcacacygtcggcaagcctaagtacaaatgatccttggagaggtagccaccaactaaacagcatacttagttgcacgtgactgatatcggatccttttcagcggtaaagggaaaatggagagcctcaggcactttgagtaagcacaggatggaagaggcagcctaaatgggaataaagcatcatagattggtgtggctcacgtggccactttctagatgtgggatctcagaccagacacttgacctctttctgcctgtgtcctatttgtaaagtaaggaccccaacactacctacttcaagtgatgt

SEQ ID NO: 187316 - DNA, 601 bp, Human
aacagtcaagatcaccattccagtaagcatctgggtgagggtctccactcctcatggccttttccctttagcctacagtcttatctagcaacagaaccatctcctgcttgcagcaagcatcctttctaaattaaagatggtaggtggggagatggtcccctttccttgcttttgaaagcattactgctagtgatcacaaacactgcttctggaatcagacagatctgggtcaaaaactagctcacatttgatctgtgtgattttgtataaattatataatgctgtgcaattctctaaaaarctatctttttttttttttttagacagagtcttgctgtgtcacccaggctggagcacagtggtgccaccttggttcactgcaacctctgcctcccaggttcaagtgattcctctgcctcagcctcttgagtagctggaactacgggtgcgcgccatcatgcttggctaatttttgtatttttttttagtagagacggggtttcaccatattggccagctggtctcgaactcctgacctcatggtctgcccacctcggcctcccaaagtgctgggattacagatgtgagccatcgcgcctgg

SEQ ID NO: 187317 - DNA, 601 bp, Human
agatctgggtcaaaaactagctcacatttgatctgtgtgattttgtataaattatataatgctgtgcaattctctaaaaagctatctttttttttttttttagacagagtcttgctgtgtcacccaggctggagcacagtggtgccaccttggttcactgcaacctctgcctcccaggttcaagtgattcctctgcctcagcctcttgagtagctggaactacgggtgcgcgccatcatgcttggctaatttttgtatttttttttagtagagacggggtttcaccatattggccagctgstctcgaactcctgacctcatggtctgcccacctcggcctcccaaagtgctgggattacagatgtgagccatcgcgcctggcctatgtttttaaaataattaagcaaggccagacacagagactcacgcctgcaatcccaacattttgggaggcctaggtgggcggatcacttgagcccaggaatttgaaaccagcctgggcaacatggtgagactccgtctccacaaaaaaaaaaaaaaagccagatgtggtgctgcatgcctgtagtcccagttacacaggagggtgaggtgggaggat

SEQ ID NO: 187318 - DNA, 601 bp, Human
ggacaccagcagaatctaacacatggtctcgtctgtctcagctcatgtctcactttccctcatctctggaatccaaccacaccaggttttcttcaacgttaaagcctccgttttaagtgtcacttacttgggaaagccttccttgatgtccctagactaagtcatgtcctcctgtcctgttctaccacagcaccaggtgtcctttcttcacagcacatgctgaagttgtaactactcatttgttaatgtgatgatgtattaatgtaatttccccacctcaccctccattgaactatcagcwttatgagagcaggcacccaagttgataaagatggccttgccagtgtctacaagagtgtctggcacacactattcactcatgcatcatttgtggagggaataaaaggagaaagggagaaaagaaaggagggagtaaggacataaggtatagattcagctggagaggttagagacacaaacgaagctcaaatagagaaggttcaatacccaaataatagagaccaaggcaagtgacataggacttcaaaagggagattactgggtgtagaaacaagtaacaaagactccctggaggtagtag

SEQ ID NO: 187319 - DNA, 601 bp, Human
ttcaaaagggagattactgggtgtagaaacaagtaacaaagactccctggaggtagtagtgtgtggcctatcgttgaacaaggaagaggaagattcagatattcaggtggttggaattttaagtgctgggtcagaaaggcacatgtaggaactagcaggagggccgggtcccagccctcaactctttttaggagaattaagcaactcttttctcctttttcctctgcctgtcttacccctccttccttgccttttacagctaaagcctccgtagataatattctttttttttttcttgacscagaaccttgctctgttgcccaggctggggtacagtggtgggatcacagctcactgtagcctcagcttcccaggctcaagtgatccttctgcctcaacctcctgagtttctgggactagaggcatgcaccatcatccttggctatttaaaaaaaaaatttatagagacagggtctcactatattgcccaggctgttctcaaattcctgggctcaagcaatcctcctgcctcagcctccaaaagtgctgggattacaggcatgagccaccatgcctcgccatgcagataatattcttaaaa

SEQ ID NO: 187320 - DNA, 601 bp, Human
agaaagggcccaagcaaagtactttgcaattgagacatgcacagtttgcatctgttttaatggagtgtcatcatgaattgatctttgcctgtgtaatgtgaggttaatgttttatggagataaccgttgtattgatattttcttttctcacaataaaattagatttgattcctactgttcagggactggtacacccattcatcagtttctgcagtagaaatagcccacagagaaatactataaacacgagagtttagattctgactcagtctgaaagaaagcagaagagctcagtttcagsctgggcacagtggcttatgcctgtaatcctcgcactttgggaggccaaggcgggcggattacctgaactcaggagtttgagacaagcctagccaacatggcgaaaccctatctctactaaaaatacaaaaaattagccaggcgtggtggcatatgcctgtaatctcagctacttgaaaggctgaagcaggagaattgcttgaacccaggaggcagaggttgcagtaggctgagatcgcaccactgcactccagcctgggcgacacagcaaggtgctgtcacaaaacagaaaaaaaggaaa

SEQ ID NO: 187321 - DNA, 601 bp, Human
tgatctttgcctgtgtaatgtgaggttaatgttttatggagataaccgttgtattgatattttcttttctcacaataaaattagatttgattcctactgttcagggactggtacacccattcatcagtttctgcagtagaaatagcccacagagaaatactataaacacgagagtttagattctgactcagtctgaaagaaagcagaagagctcagtttcaggctgggcacagtggcttatgcctgtaatcctcgcactttgggaggccaaggcgggcggattacctgaactcaggagttygagacaagcctagccaacatggcgaaaccctatctctactaaaaatacaaaaaattagccaggcgtggtggcatatgcctgtaatctcagctacttgaaaggctgaagcaggagaattgcttgaacccaggaggcagaggttgcagtaggctgagatcgcaccactgcactccagcctgggcgacacagcaaggtgctgtcacaaaacagaaaaaaaggaaaagaagaagagctcagtttcttgaactacaagctccatgtaaaacaagacatgtaaatatcaaacgtggaaatcgtgtc

SEQ ID NO: 187322 - DNA, 601 bp, Human
gagctcagtttcaggctgggcacagtggcttatgcctgtaatcctcgcactttgggaggccaaggcgggcggattacctgaactcaggagtttgagacaagcctagccaacatggcgaaaccctatctctactaaaaatacaaaaaattagccaggcgtggtggcatatgcctgtaatctcagctacttgaaaggctgaagcaggagaattgcttgaacccaggaggcagaggttgcagtaggctgagatcgcaccactgcactccagcctgggcgacacagcaaggtgctgtcacaaaamagaaaaaaaggaaaagaagaagagctcagtttcttgaactacaagctccatgtaaaacaagacatgtaaatatcaaacgtggaaatcgtgtctacaaaaaactattttaaagctcttcgcaaatgttcatggaccaaatagtaaatcctcattccaccctcattttcttaacgaactaataatacattcctcccattcatcagtgaattatgaggcctactggaaaaagtagaccttccaggacataattttcatccagaggtcagtttgggtttggcttcatgacactcagaggcctca

SEQ ID NO: 187323 - DNA, 601 bp, Human
actcagaggcctcactaaaagtgatcctaaggagaaaacaggtctgtaatgccttcccatgcatataaaagtccccttttggatcaacagtcttctcagttccttgaaattcagtaaaagttttctgtattttaataaaataagagctagatacaggttcttatgtcttatgttgccatataattcctattaacctaaagttatttgtaagtaggcttctcattatatttttccttttctgatatttaaaaagtcacagaaattataactgtttgttataaaaattcaactatagggattyttccccccaaacttcatatattttgccatatctttattatgattattattggtttgtttgtttttattgactctgtatcaaggaaacgtttctgtgttggtacatttcaatttattcatttgttccgcaaacattttgtaaatagctgctctgtgccaggcaccacgctagatgtgaggaacgcagtggtaagtaatggaggcaggtgtcttaggttggtgcacaagtaactgaggtttttaattgaggtcaattacttgtgcaccaccctaatagcttgcattctaggggatgggacag

SEQ ID NO: 187324 - DNA, 601 bp, Human
cccccaaacttcatatattttgccatatctttattatgattattattggtttgtttgtttttattgactctgtatcaaggaaacgtttctgtgttggtacatttcaatttattcatttgttccgcaaacattttgtaaatagctgctctgtgccaggcaccacgctagatgtgaggaacgcagtggtaagtaatggaggcaggtgtcttaggttggtgcacaagtaactgaggtttttaattgaggtcaattacttgtgcaccaccctaatagcttgcattctaggggatgggacagacakcaagcaagtgtataactgcatagggcagatagagaatgtggtaggttctatggcaagaccaggcagccactctggctgaactgggaggtggggtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacatgcagagttcaagagaggggcacaagacgaggggcagaagccaaactctgc

SEQ ID NO: 187325 - DNA, 601 bp, Human
gttggtacatttcaatttattcatttgttccgcaaacattttgtaaatagctgctctgtgccaggcaccacgctagatgtgaggaacgcagtggtaagtaatggaggcaggtgtcttaggttggtgcacaagtaactgaggtttttaattgaggtcaattacttgtgcaccaccctaatagcttgcattctaggggatgggacagacagcaagcaagtgtataactgcatagggcagatagagaatgtggtaggttctatggcaagaccaggcagccactctggctgaactgggaggtggrgtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacatgcagagttcaagagaggggcacaagacgaggggcagaagccaaactctgcaggcccttgtggatcatggcaaggagtttggatttgattccaactcccatgaaaagtttccaaggttgaagcagtgggtgtgagtccctcca

SEQ ID NO: 187326 - DNA, 601 bp, Human
ttacttgtgcaccaccctaatagcttgcattctaggggatgggacagacagcaagcaagtgtataactgcatagggcagatagagaatgtggtaggttctatggcaagaccaggcagccactctggctgaactgggaggtggggtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacaygcagagttcaagagaggggcacaagacgaggggcagaagccaaactctgcaggcccttgtggatcatggcaaggagtttggatttgattccaactcccatgaaaagtttccaaggttgaagcagtgggtgtgagtccctccatctagaagtgaactgacagctatggggtcagcagattatacaatggccaagaatagaagccaggaagctgggtacagtctcctgcagtggtctcctgggccattgtgtagtgtcccatcctacgagttgttcttcagttgtcttatgtttttttattt

SEQ ID NO: 187327 - DNA, 601 bp, Human
ccctaatagcttgcattctaggggatgggacagacagcaagcaagtgtataactgcatagggcagatagagaatgtggtaggttctatggcaagaccaggcagccactctggctgaactgggaggtggggtggtcagagaaggaatttatagctaaactgaagtttgaggaaataactagttaaatgaagaaatgggaaagagcattctgggcagagggaacggcaagtacaaagaccctgaggaaggaaaaagcttggcttgcgtgaggaacagagatttgaacatgcagagttcaagasaggggcacaagacgaggggcagaagccaaactctgcaggcccttgtggatcatggcaaggagtttggatttgattccaactcccatgaaaagtttccaaggttgaagcagtgggtgtgagtccctccatctagaagtgaactgacagctatggggtcagcagattatacaatggccaagaatagaagccaggaagctgggtacagtctcctgcagtggtctcctgggccattgtgtagtgtcccatcctacgagttgttcttcagttgtcttatgtttttttatttatttatttatttat

SEQ ID NO: 187328 - DNA, 601 bp, Human
aaagagcattctgggcagagggaacggcaagtacaaagaccctgaggaaggaaaaagcttggcttgcgtgaggaacagagatttgaacatgcagagttcaagagaggggcacaagacgaggggcagaagccaaactctgcaggcccttgtggatcatggcaaggagtttggatttgattccaactcccatgaaaagtttccaaggttgaagcagtgggtgtgagtccctccatctagaagtgaactgacagctatggggtcagcagattatacaatggccaagaatagaagccaggaagcygggtacagtctcctgcagtggtctcctgggccattgtgtagtgtcccatcctacgagttgttcttcagttgtcttatgtttttttatttatttatttatttattttatttttttatttttgagacggagtctcactctgtcacccaggctggagtgcagtggcacagtctcggctcactgcaacctccgcagtggtcttatgttttaacttttttgtggcatccttcttcctgggggtactttgtccagaatcatctcactccatgttttgatgggaaagtgcctggtgtataacctgcg

SEQ ID NO: 187329 - DNA, 601 bp, Human
aatggttgagtcagttcattgcaagaacatgcttatctattttatatacgtggaggaataggtgaacttatctgttagctatggttcaacattcaggttgtttccaggtataatgaaaacaccaaaaaaaagcagtatacataatatagggctgtctcatttttaaaatcagcttcttaggatagagtgccccaaataggataattgtgtcacaggataagaacattttctggtcttgatcatttattgctacatcatcttccaaagagattgaagaagcagtgtgtgggccaccaaaagyggcaccatgtttgttttcagaaccattagagaagattatgtttctaaaaaggaactaatagaaacaaaagaatctcactgttgtgattttcaagtactccattttgaatgttttagtgagagagaggggaaaatacgtgatcttttatacataggtgagatggtttggtttaaagtcagtgtcacatgtatgtagatgaacccaccacctgcatagttggatttaaggggtgccaaaaggtctcctactctgcaaaacctgaatgcccgaactgactgtcacagagtaggggtggtctga

SEQ ID NO: 187330 - DNA, 601 bp, Human
atcagcttcttaggatagagtgccccaaataggataattgtgtcacaggataagaacattttctggtcttgatcatttattgctacatcatcttccaaagagattgaagaagcagtgtgtgggccaccaaaagcggcaccatgtttgttttcagaaccattagagaagattatgtttctaaaaaggaactaatagaaacaaaagaatctcactgttgtgattttcaagtactccattttgaatgttttagtgagagagaggggaaaatacgtgatcttttatacataggtgagatggtttkgtttaaagtcagtgtcacatgtatgtagatgaacccaccacctgcatagttggatttaaggggtgccaaaaggtctcctactctgcaaaacctgaatgcccgaactgactgtcacagagtaggggtggtctgaaaggttcccatgaatgagctctttgggttaggtcatgaaacaccttatcaaggagcaaatgaaatacaagaaggtgtcacaggagccacttttgactgttccgtagaagttagttttaattttagacagggcctatgacactgaaattctcaggctgtaattccaga

SEQ ID NO: 187331 - DNA, 601 bp, Human
tgaagcagggcagggaaactgcccagaaccctatgccccttggcctgtcccttactttcagggatcaacaagttatcttccaactctgtgacccttccccctggggtgtaaattgaatagtagaaatgaaaagacaaagccagtttagaaagtcaccttgaaacctcattgtcctcatctctaacattataaagttggactgaatgatttctaaagactcttccagttcaaaaacatggaaacttggctcacatttgtaataccaacactttgagaggttggcattacaggatctcttgasggcacgagtttgagaccagcctgggtaacatagtgagatcccatctccacaaaaacaaaaaataaaaaaattagctgggcatggttgtgcacacctatagtccagctatttgggaagctgagggaagaggattgcttaagcccaggagtttaaggttgcagtgagctatgattgcaccactgcactccagcctgggctacagagcgagaccctatctctctttgtttttaagtggaaattgtgtatctctgccaattatatcaggaattcacaaaaagtgatggagattagccaaacatg

SEQ ID NO: 187332 - DNA, 601 bp, Human
aagcccaggagtttaaggttgcagtgagctatgattgcaccactgcactccagcctgggctacagagcgagaccctatctctctttgtttttaagtggaaattgtgtatctctgccaattatatcaggaattcacaaaaagtgatggagattagccaaacatggaaatctttccaggaagtaatacctttagggtgattaataactgtgtggctcatgagaaagcatgttgtcaaaatacaagcatgaccccaagaacgcaccctaaaaatgaagtcagacatttcatgtgtaaccaatayaaaatctgaaataataacagccaatatttaatgagttctcgctgtgtttcatagcatcaaggttaagtgttttatatgtcttatatcataaatattcacaataaccacattcattatgttatcctattgttatccccatgtcatttatgagaaggctgaggtttatagaaactaagtatctctatctaggttacacatataggacgaatattaaaagttggattaaatgttcttcaatggacattttcagatctaagcttgtttgggtctgataagtcttttaatagaagctgaaaaggc

SEQ ID NO: 187333 - DNA, 601 bp, Human
taacagccaatatttaatgagttctcgctgtgtttcatagcatcaaggttaagtgttttatatgtcttatatcataaatattcacaataaccacattcattatgttatcctattgttatccccatgtcatttatgagaaggctgaggtttatagaaactaagtatctctatctaggttacacatataggacgaatattaaaagttggattaaatgttcttcaatggacattttcagatctaagcttgtttgggtctgataagtcttttaatagaagctgaaaaggcagagttggggcaagratttgttggtgagtttctaacataatccaatagaggtgttgagtcgggaccagcaggcttgctccagattgcccagcagacttacccgaaagacagcagaaacatcatcaacagcaacaattttttttaaaaaaccacaatagttagcatcactacaagaagaggactgaacactttgttaagtattttctcatttcctccttacaattctttgaacaagataaaagtaaaattttgttttggtgaggaagcaatggagctacgaggacggtaagtaatttacccaaggaagcaaagtga

SEQ ID NO: 187334 - DNA, 601 bp, Human
agacttacccgaaagacagcagaaacatcatcaacagcaacaattttttttaaaaaaccacaatagttagcatcactacaagaagaggactgaacactttgttaagtattttctcatttcctccttacaattctttgaacaagataaaagtaaaattttgttttggtgaggaagcaatggagctacgaggacggtaagtaatttacccaaggaagcaaagtgaaaagtgtaaaggcaacagcatgccttaggacataaggattccctatactttgctcctacatacattagtgtgacctgycctgatatctctgtggttacccaagtagaattacattttgcaagaaggtaattctacttaccttcacgactgcgagcatctcagccagtttctcgctgcgagtttgtgaattcgccagtctttggtgactttgcagagtgtgtttccattcacctgaactctatgggctgacaaacatgagttcctggacttgtaaacctgaggatctgttcctggggtggcctctgacaaggaaagatgctgtatccgcctcagcactatttaattttccagattaacaactaatagcagcattagcca

SEQ ID NO: 187335 - DNA, 601 bp, Human
cactacaagaagaggactgaacactttgttaagtattttctcatttcctccttacaattctttgaacaagataaaagtaaaattttgttttggtgaggaagcaatggagctacgaggacggtaagtaatttacccaaggaagcaaagtgaaaagtgtaaaggcaacagcatgccttaggacataaggattccctatactttgctcctacatacattagtgtgacctgtcctgatatctctgtggttacccaagtagaattacattttgcaagaaggtaattctacttaccttcacgactgygagcatctcagccagtttctcgctgcgagtttgtgaattcgccagtctttggtgactttgcagagtgtgtttccattcacctgaactctatgggctgacaaacatgagttcctggacttgtaaacctgaggatctgttcctggggtggcctctgacaaggaaagatgctgtatccgcctcagcactatttaattttccagattaacaactaatagcagcattagccacttattgagccttttctgggaataacattctgggaaagctatatccaaagtggtaatacaaggagtaccagga

SEQ ID NO: 187336 - DNA, 601 bp, Human
gacggtaagtaatttacccaaggaagcaaagtgaaaagtgtaaaggcaacagcatgccttaggacataaggattccctatactttgctcctacatacattagtgtgacctgtcctgatatctctgtggttacccaagtagaattacattttgcaagaaggtaattctacttaccttcacgactgcgagcatctcagccagtttctcgctgcgagtttgtgaattcgccagtctttggtgactttgcagagtgtgtttccattcacctgaactctatgggctgacaaacatgagttcctggrcttgtaaacctgaggatctgttcctggggtggcctctgacaaggaaagatgctgtatccgcctcagcactatttaattttccagattaacaactaatagcagcattagccacttattgagccttttctgggaataacattctgggaaagctatatccaaagtggtaatacaaggagtaccaggaggaaagtattagcctagcgaagtgacccagaaagggagtttgagggagctaataccaaacctcacccttttccacaatccatgctgaggccatttccatgacaatgatccaatttg

SEQ ID NO: 187337 - DNA, 601 bp, Human
ggccatttccatgacaatgatccaatttggtgtttcccaaagtggggtactatcaggagcacacaagatggcacatggacaaatctggttttaacatgtctttaatagttatgtatctactataatttatgttagaaataagtgttttaaaatttatggtggtaatttaaagtttcctcctagaataaatttgtttatgtggaaaaaataagtcaattgaaagaatactattgagcagacaatactatttgagggaactagggtatggtagaaattgccaagctaagttggaaactgaagsctgggagcactgaatccttgggataacaacatgaatcataattcattataatttgcttttaagtagttccaagagtgaaatgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagtgagcaaatgagcctcctgccacaaactgaacccacattt

SEQ ID NO: 187338 - DNA, 601 bp, Human
ggtatggtagaaattgccaagctaagttggaaactgaagcctgggagcactgaatccttgggataacaacatgaatcataattcattataatttgcttttaagtagttccaagagtgaaatgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagygagcaaatgagcctcctgccacaaactgaacccacatttctctcaatccaagaaaaggctgttctaattccaaacaagctcattgtaaacctcaataacatgaagttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagag

SEQ ID NO: 187339 - DNA, 601 bp, Human
aattcattataatttgcttttaagtagttccaagagtgaaatgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagtgagcaaatgagcctcctgccacaaactgaacccacatttctctcaatccaagaaaaggctgttctaattccaaacaagytcattgtaaacctcaataacatgaagttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccatgtggcacatttcaataattttaaa

SEQ ID NO: 187340 - DNA, 601 bp, Human
tgtaataacctccactggacatttggagacgcagaggtgatccacagagtccagggcacttgaagatattgggttgctgcaaaagtaattgtggtttttgccattaatagatataagcacagaggagcagggaagatggtcaaaagagatcccaggcccccacgttctgccagagcacagtgagcaaatgagcctcctgccacaaactgaacccacatttctctcaatccaagaaaaggctgttctaattccaaacaagctcattgtaaacctcaataacatgaagttagtattgttcacrttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccatgtggcacatttcaataattttaaaaaaacagttgcaaaatgttatgcagtaacaaatctcccatc

SEQ ID NO: 187341 - DNA, 601 bp, Human
aaaggctgttctaattccaaacaagctcattgtaaacctcaataacatgaagttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccrtgtggcacatttcaataattttaaaaaaacagttgcaaaatgttatgcagtaacaaatctcccatctttgtcccaagtcacattgctgtcctacatcacagcaaccacgatagttaatttcttataagttcttccaataatactttatacatatacttgtaatactaataaacattcttcttttcttcctttttaaatagtagtaacatactctgcacacacttcttaacttttcttttagttggttaacaatgtatcctggagattgatccacactgatacacaaagatattcttcatt

SEQ ID NO: 187342 - DNA, 601 bp, Human
ttagtattgttcacgttgctttccaactgtgtttcagatttatataactggttcctaacacataattaactgctgttggaatgaatctttgtccccttgcctccgtgcctgctggacttcatatctgtgtattaatagtcacttttgtttggcgatcttgtgaaaaatgcagactaatttttaatccttaaagagataatacattcacataattttatttttattttttcagataatggcctttcgccatgtggcacatttcaataattttaaaaaaacagttgcaaaatgttatgcagtracaaatctcccatctttgtcccaagtcacattgctgtcctacatcacagcaaccacgatagttaatttcttataagttcttccaataatactttatacatatacttgtaatactaataaacattcttcttttcttcctttttaaatagtagtaacatactctgcacacacttcttaacttttcttttagttggttaacaatgtatcctggagattgatccacactgatacacaaagatattcttcattctgtttatggttgcataatacttcattgtatgcatgaaaaatttcttttaat

SEQ ID NO: 187343 - DNA, 601 bp, Human
atactctgcacacacttcttaacttttcttttagttggttaacaatgtatcctggagattgatccacactgatacacaaagatattcttcattctgtttatggttgcataatacttcattgtatgcatgaaaaatttcttttaatgaaggttggtctgtttccagtttttgttattatgcacaatgagaaatgaacagccttgtagatgtgtcattttccataaatacttttataacagtggttctcaaccaaaggtgattttgcccaccaggggacatttgacaaaacctggggaaattkttggttgttataagtggggaggagggtgccaccaacatctagtgggtagaagctgagggtgctgctaaatatcctacaattcacaggacagactcacaacaaaaaattattcagcccaaaatgtcaataatgctgaggctgagaagctccagtctgtagaaaacatttctagaagtggaattgctgagtcaaaggatatttgcatctgttattttgttgactatgagcaaattactctctacagaagttgtaccagtgaacattccccagggccacatgtgagaagcatgttttctcaaa

SEQ ID NO: 187344 - DNA, 601 bp, Human
ttatgtattttggctactggtccttcagtgcttaaaaagaagacacaaaaaatacgttctttcaaactcatttaacatttcatatttcttattctgggaggaaggtctttgaaggaacattcacagctcagagatactgacagaaacaatacagaggatgccttgagaatctactttatgcttggaaaatatcacttagttcttgctcctaatttccacataagtccttttctctctgctcccttttgtaagaaaatctaaacacacatgttttcaacatgctaggatcatgttaccttgwtctagtaagaatggggcttggacattattcctgagttatcatttcacttataagataaatatacccatataaaagcacactgaattactttattagaatctatgaagaaaaaggctatccctcaagaagaacatgagagagactgtcatgtacttgaacccccatggatacagatgagcaggtggcaggtgctctctagctgctgctcactgctaatggggttatgcggtttcaagggcgtgcatcatttcgcacacccagcatttgatgcataccccttattcctctcccataatcatc

SEQ ID NO: 187345 - DNA, 601 bp, Human
atctcttcttccaaaaatgggatgatgctccatctgttgctttaaatctgctctttaacacttggtatatacttttgtccctctgtatagatgaactttattatctgttaatggttacagagtagtcattatgtatgatgacgaatttaaccatacacagatggatgtttaaccataactaatttaaccatttgtctattgatggatatttaagtttttccagtttattttagtgtaataaataatgcttctgtgaaaatcctttttattacatctttatatattttgaacaaatgtttcyatagaataaatcagatcagggaaatgtatttattcattttagttaactgtttttaatattataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccaacccccaggaccacccacacaggtatctgctctt

SEQ ID NO: 187346 - DNA, 601 bp, Human
tttccagtttattttagtgtaataaataatgcttctgtgaaaatcctttttattacatctttatatattttgaacaaatgtttccatagaataaatcagatcagggaaatgtatttattcattttagttaactgtttttaatattataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccaacccccaggaccacccacacaggtatctgctcttcatagtttcttatgagaaaacacattttaatagatgatcctaaattgccctctgaaaactgtatgtaagaataattctttttcttttcttttctttccttctttgttcctttccttctttccttttgaaaagtctcacttttttcatttgggtggccagggtgttactattttcaaatggcaggttttaaaggaagtgaaattgttttcctcatag

SEQ ID NO: 187347 - DNA, 601 bp, Human
attacatctttatatattttgaacaaatgtttccatagaataaatcagatcagggaaatgtatttattcattttagttaactgtttttaatattataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccarcccccaggaccacccacacaggtatctgctcttcatagtttcttatgagaaaacacattttaatagatgatcctaaattgccctctgaaaactgtatgtaagaataattctttttcttttcttttctttccttctttgttcctttccttctttccttttgaaaagtctcacttttttcatttgggtggccagggtgttactattttcaaatggcaggttttaaaggaagtgaaattgttttcctcatagcacatccagccacatggtaacccacagtgcgaaatgctgaggtggagaaag

SEQ ID NO: 187348 - DNA, 601 bp, Human
tataaaagaaatacacattcatggcaaaatattcaaagagtacagaaggatacaaggtaaaaagaaaagctccttgggaggccaaggcgggtggattgcttgagaccaggagttcaaggccaatctggacaacagagcaagactctatctcttaagaaaaaaaaaaaaaggaaagaaagaaagctctcttcacactccctactcccaacccccaggaccacccacacaggtatctgctcttcatagtttcttatgagaaaacacattttaatagatgatcctaaattgccctctgaaaacygtatgtaagaataattctttttcttttcttttctttccttctttgttcctttccttctttccttttgaaaagtctcacttttttcatttgggtggccagggtgttactattttcaaatggcaggttttaaaggaagtgaaattgttttcctcatagcacatccagccacatggtaacccacagtgcgaaatgctgaggtggagaaagccagccaacggtgggccagtgatgagtaagaggtcttatggaaaagaagagagaaacgaaggcaggtgtgggatggatcagtttcctggcttt

SEQ ID NO: 187349 - DNA, 601 bp, Human
tgcgaaatgctgaggtggagaaagccagccaacggtgggccagtgatgagtaagaggtcttatggaaaagaagagagaaacgaaggcaggtgtgggatggatcagtttcctggctttaaggtggtccagggagccttgaaattaatggtcttagctccagactttcccagagctttagaatagagggaggttaggtctagctgaagatgggctggggagggaggaactaggaacagctcattgcaaattgctctggtgttttacaagatgctaatttttccatagagacagtaatgagcayatcttttttgttttgttttatcttgttttgtttgagacagtgtctcactctatcacccagagtgcagggacatgataatgactcactgcaacctcaaccccccaggctcaactgatcctcctgcctcagcctcctgagtggctggtactacgggcatgtgccaccacacctggctaacttttaaaatttttttgtagagacagggcctcactatgttacccagactgttgttgaactcctggcctcaggcgaccctccttctttggcctcccaaagtgttgggattataggcatgagcca

SEQ ID NO: 187350 - DNA, 601 bp, Human
taatgagcatatcttttttgttttgttttatcttgttttgtttgagacagtgtctcactctatcacccagagtgcagggacatgataatgactcactgcaacctcaaccccccaggctcaactgatcctcctgcctcagcctcctgagtggctggtactacgggcatgtgccaccacacctggctaacttttaaaatttttttgtagagacagggcctcactatgttacccagactgttgttgaactcctggcctcaggcgaccctccttctttggcctcccaaagtgttgggattatagrcatgagccattgctactagcatttgctagtaggtttatgtaattttaaaaaattctcttaattaacttaatgattcagagactattcttatgtcgcttttgaaaaatgaggcaactgagaggttgagacacttgcctcaggttgcacagctgataaggaatgaggttaggatgcaaacctgagtctgccctacttgaaagctccagttctcccctactctgccttaccagaggagaaagctgaaaactgctatttttttagaaacgtggagatgtccttttcccatgggtagcagacaca

SEQ ID NO: 187351 - DNA, 601 bp, Human
ctcaggcgaccctccttctttggcctcccaaagtgttgggattataggcatgagccattgctactagcatttgctagtaggtttatgtaattttaaaaaattctcttaattaacttaatgattcagagactattcttatgtcgcttttgaaaaatgaggcaactgagaggttgagacacttgcctcaggttgcacagctgataaggaatgaggttaggatgcaaacctgagtctgccctacttgaaagctccagttctcccctactctgccttaccagaggagaaagctgaaaactgctatttttttagaaacgtggagatgtccttttcccatgggtagcagacacataacttctcatcgacacatttgctgggctagtccagcagcaaaagagccaatgttgttggagcaaagaggagtggctattctgaggaaccagggagtgtgttccacctttgcaatccagcataagcattgctcagtcaaatgggacagaaacaaagctctgcgagtccatggcttggtgaaatgggtcacacaattgattttccagcactgagttcagggaatgatagtcttctgtggaaagtcccagcaagt

SEQ ID NO: 187352 - DNA, 601 bp, Human
tagtccagcagcaaaagagccaatgttgttggagcaaagaggagtggctattctgaggaaccagggagtgtgttccacctttgcaatccagcataagcattgctcagtcaaatgggacagaaacaaagctctgcgagtccatggcttggtgaaatgggtcacacaattgattttccagcactgagttcagggaatgatagtcttctgtggaaagtcccagcaagtgctaagccaggaagcatagtagttaggttatcaggctctggagtcatagagtggagcttgtacgctgctcttctaygtattaagagggttggcctctgtgaacttcaattttctcatctataaaatggggagataatatgttgtaggatcgtgatgaaacaggatggaatgttgaatgcctggaatatagaaaatgttcaaaaatagtatcattttcatgttttttcctgcttctctctttgaaacttataatccaagctctatttcataaaaatattaacataaaaagccgccctgccccctcatctatctatcaagcaatgcacatttatgggaaacctgatgctgacccatttgtaaacaacctgtttctggg

SEQ ID NO: 187353 - DNA, 601 bp, Human
gcaaagaggagtggctattctgaggaaccagggagtgtgttccacctttgcaatccagcataagcattgctcagtcaaatgggacagaaacaaagctctgcgagtccatggcttggtgaaatgggtcacacaattgattttccagcactgagttcagggaatgatagtcttctgtggaaagtcccagcaagtgctaagccaggaagcatagtagttaggttatcaggctctggagtcatagagtggagcttgtacgctgctcttctacgtattaagagggttggcctctgtgaacttcaaytttctcatctataaaatggggagataatatgttgtaggatcgtgatgaaacaggatggaatgttgaatgcctggaatatagaaaatgttcaaaaatagtatcattttcatgttttttcctgcttctctctttgaaacttataatccaagctctatttcataaaaatattaacataaaaagccgccctgccccctcatctatctatcaagcaatgcacatttatgggaaacctgatgctgacccatttgtaaacaacctgtttctgggttggggttttgtacatagcagagcagctccttc

SEQ ID NO: 187354 - DNA, 601 bp, Human
gtgatgaaacaggatggaatgttgaatgcctggaatatagaaaatgttcaaaaatagtatcattttcatgttttttcctgcttctctctttgaaacttataatccaagctctatttcataaaaatattaacataaaaagccgccctgccccctcatctatctatcaagcaatgcacatttatgggaaacctgatgctgacccatttgtaaacaacctgtttctgggttggggttttgtacatagcagagcagctccttctctgtgagatctattgaaagtcagcccttaatacaagggttygttaaaaaagagaaaaagaaaaagaaggaaagaaagagagaaaggaaagaagaaaggaaaggaaaggggaaaagagagagagaaatagtaacataaaaagaaaaaagatataaaagctgattgcacaagcttacccttgtgaagatttgtaagcatcagcatcttgaattgtgtctgacacgtgtcagatgcttgggatgaaacatcagactatgaggatggcatatctttgaacgtggccaagaaaagagacaagggtaagcaaggtcctgtgactttcgccccaagtaatgcagacag

SEQ ID NO: 187355 - DNA, 601 bp, Human
aagagagaaaggaaagaagaaaggaaaggaaaggggaaaagagagagagaaatagtaacataaaaagaaaaaagatataaaagctgattgcacaagcttacccttgtgaagatttgtaagcatcagcatcttgaattgtgtctgacacgtgtcagatgcttgggatgaaacatcagactatgaggatggcatatctttgaacgtggccaagaaaagagacaagggtaagcaaggtcctgtgactttcgccccaagtaatgcagacagaataacaagtaagaatgagagcaggttgtacttrgcctctccctttctctggtggcttttgtgtggtttccttggaaagttttaccctggcatttttcagaaatagcacagttgtttgggatgattataggcaatcaccctttcccagagactgaactgtgtcgggctcattgaccagccaccccccggggaccaactagggaggacatagctggtcctgctgtttaccaagtattggatcttgtgagatgccagaagaaccaacctcagggtctttggaaagactgaccaaccagtcaggatggattgtggtggtggatcccaagcactcatt

SEQ ID NO: 187356 - DNA, 601 bp, Human
ttgtgtggataacaatttttttaatatactacaaccaagtaagattttattttcacaaatgcaatgttggctcactatcctaaagtcaattaagataatatacaatattacttgaataaatgtcaaaaaagaacatttcaataaacaaagaaaaatatttgacaaatccaacactctttgtgataaaacccccagtacactaatagaaaaaaaattttgagtcttgcaaaaagtcatctatgaaaacctacaactaacattatacttaatggtgaaagactgagtgctttatctgtaagtytgggaacaagacataaatttccacttttttttttttttttttttatggagtcttgctctgtcacccaggctggagtacagtggcatgatcttggctcactgcaacctccacctcctgggttcaagggattctcctgcctcagcctcccgagcagctgggattacagatgcgtaccaccatgcctggctaatttttgtattttcttagagacaaaattttaccatgttggctaggctggtctcaaactcctgacctcaagtaatccacctgcctcaacctcccaaagtgctgggattacag

SEQ ID NO: 187357 - DNA, 601 bp, Human
tgggttcaagggattctcctgcctcagcctcccgagcagctgggattacagatgcgtaccaccatgcctggctaatttttgtattttcttagagacaaaattttaccatgttggctaggctggtctcaaactcctgacctcaagtaatccacctgcctcaacctcccaaagtgctgggattacaggcatgagccactgtgcctggccaatttccacttttaacactctattcgacactgttctgcaagtactagccagataaattacactataaagtgaaatgaaattctccagattgagaaaaaaaagtagaactctttttcattgcacaccacataattttccacaaaaaaaaaaaaaaaaaaattgtaaggaacttcctaaaaacccactaggactattaaacaaattcatccatgtcaaaagatacaagatcaacatacaaattaatttttttaacttttattttaggttcagaggtacatgtgcaggttttcatataggtaaattgcatgttgcaggggtttggtgtacagattatttcatcacccaggtaataagcatagtacccagtaggtagattttcaattcccaccctcca

SEQ ID NO: 187358 - DNA, 601 bp, Human
gcaggggtttggtgtacagattatttcatcacccaggtaataagcatagtacccagtaggtagattttcaattcccaccctccaccctcgagtaggtgccggtatctgtggtgcccttctttatacccatatgtgctcactttttagcccccacttacgagaacatgcagcatttggtttttagttcctgtgttagttcacttgggctaatggcctccaactctacccatgtcgctgcaaaggacacaatctcatacttttctatggctgcataattctccatggtgtatgtttaccacattttcttttcttttcttttctttttgagacagagtcttactctgtcacccaggctggaatgcagtggcacgatctcagctcactgaaacctctgcctcccgagttcaagcaattcttgtgcctcagccacccaagtgcctgagattacaggtgtgcaccatcatgcccagctaatttttatatttttagtagagatggggtttcaccatgttgcccaggctagtctcgaactcctggcctcaagtgatctgctgccttggactcccaaaatgctgggattacagatgtgagccaccacgcc

SEQ ID NO: 187359 - DNA, 601 bp, Human
gcctcaagtgatctgctgccttggactcccaaaatgctgggattacagatgtgagccaccacgcctggcctcacattttctttattcattcttttgttaatgggcatttaggttaattctatatctttgctattgtgattagtgctgtgatgaacatatgtgtatatgcgtctttatggtagaatagtgtatattcctctgggtatatacccaagaatgggattgctgggtcaaatggtaattctgttttaagttctgtcagaaatcacctaacaatttgaaatgataatattttagatawtgggttaaacaaaatttattgttaaaattattacttgttatgttttgcatttttgaatgtgcctactggaaaaacttttaagttacatatatggctcatgttacatttctattggacactatcactttagaacttcacatagaatttttatccctgttcacaattccagttaatatttgcctccactgtctgccctcatcacaatgctgctaggctgttaacaagccagacttacccagtatttttctaccccaggattttgccctggctgcttgctctacctgggatgctcactcccct

SEQ ID NO: 187360 - DNA, 601 bp, Human
atttattgttaaaattattacttgttatgttttgcatttttgaatgtgcctactggaaaaacttttaagttacatatatggctcatgttacatttctattggacactatcactttagaacttcacatagaatttttatccctgttcacaattccagttaatatttgcctccactgtctgccctcatcacaatgctgctaggctgttaacaagccagacttacccagtatttttctaccccaggattttgccctggctgcttgctctacctgggatgctcactcccctagaccttctcccasatggctcctgttcgactttttggtctcttcttagatgccctttctctctccagagaggtctgccttggccacagtttggtcacatcaactgttctattctctttccagcacttctttgttttgtctgccttcccaagtatactacgggctctgtgagagtctatcatgttcatcagttcatttcctgaactcagaatagcacctcactcatagctggccctccataaatatttcctgaatggctaaatgtactagccttaaatctgtttaagattgtttaaactgtgttccaacctgaca

SEQ ID NO: 187361 - DNA, 601 bp, Human
ttgcctccactgtctgccctcatcacaatgctgctaggctgttaacaagccagacttacccagtatttttctaccccaggattttgccctggctgcttgctctacctgggatgctcactcccctagaccttctcccagatggctcctgttcgactttttggtctcttcttagatgccctttctctctccagagaggtctgccttggccacagtttggtcacatcaactgttctattctctttccagcacttctttgttttgtctgccttcccaagtatactacgggctctgtgagagtctrtcatgttcatcagttcatttcctgaactcagaatagcacctcactcatagctggccctccataaatatttcctgaatggctaaatgtactagccttaaatctgtttaagattgtttaaactgtgttccaacctgacaccctttgttttgagctaattaagctccactgagggccagccactgctgggcactgggtatatgggaagatgccctggtctctgaccttagggagctcaggacctagtaggttccaaagacaaaaatgtcagcaaatggagttgtcatatcacatgccatgagc

SEQ ID NO: 187362 - DNA, 601 bp, Human
aaatgacctcctacctcagcctctcaaagatctgggattggctgggcatgttggctcatgcctgtaatcccagcactttgggaggctgaggcgggcagattgcctgagctcaggagttccaagccaccctgggcaacatggtgaaaccccatctctactaaaatacaaaaaaaattggggaccagcgcagtgactcacgcctataatcccagcactttgggaggttgaggtgggtggaccacagggtcaggagatggagaccatcctggctatcacggtgaaaccccctctttactaaaartacaaaaaattagctgggcgtggtggcacatgcctgtagtcccagctactcaggaggctgaggcaggagaatcgcttgaacccaggaggtggaggttgcggtgagccgagatcacaccactgcactccagcctgggcgacagagcaagactccatctcaaaaaaacaaaaaagagaaaaaaaaaagatctgggattacaggcattagccaccatactgagcctctacagtgttttcatttgtcacaaaaaacataaatagattttgtactttcaataatggataaagttgtttttactta

SEQ ID NO: 187363 - DNA, 601 bp, Human
tgagcagacaaactatattcctaaagaaatagctggtattcaaggggaacgccttcagctttcgcccattcagtatgatgttggctgtagtttgtcatagatggctcttattattttgacgtatgttcctttaatatctagtttattgatagtttttaacatgaagcaatgttgaattttattgaaagccttttctgcatctattgagataatcgtgatttctgcctttagttctatttacgtgatgaattacatttattgatttgcatatgttgaaccaaccttgcatccctaaagcctrcttgatcatgtaaaaaaggattagccttttttttttttttttttttgagtcagtattgctctgtcacctatgctggagtgcagtgtcatgatcttggctcactgcaacttctgtccacctcagcctcccgagaagctgggactacaggtgtgcaccaccatatccagttaatttttgtaattttttgtagaaacagagtttcaccacgtttcccaggctggtctcgaacccctgggctcaagtgatccaccctcctcagcctcccaaagtgctaggattacaggcatgagccaccacgcc

SEQ ID NO: 187364 - DNA, 601 bp, Human
aatagctggtattcaaggggaacgccttcagctttcgcccattcagtatgatgttggctgtagtttgtcatagatggctcttattattttgacgtatgttcctttaatatctagtttattgatagtttttaacatgaagcaatgttgaattttattgaaagccttttctgcatctattgagataatcgtgatttctgcctttagttctatttacgtgatgaattacatttattgatttgcatatgttgaaccaaccttgcatccctaaagcctacttgatcatgtaaaaaaggattagccttttttttttttttttttttgagtcagtattgctctgtcacctatgctggagtgcagtgtcatgatcttggctcactgcaacttctgtccacctcagcctcccgagaagctgggactacaggtgtgcaccaccatatccagttaatttttgtaattttttgtagaaacagagtttcaccacgtttcccaggctggtctcgaacccctgggctcaagtgatccaccctcctcagcctcccaaagtgctaggattacaggcatgagccaccacgcctggctggattagcttttcgatgtgctg

SEQ ID NO: 187365 - DNA, 601 bp, Human
atccaccctcctcagcctcccaaagtgctaggattacaggcatgagccaccacgcctggctggattagcttttcgatgtgctgctggatttggtttgcaagtattttcttgagaatttttgcttcgatgttcatcaatattggcctgaagttttcttttttgttgtatctctgccaggttttggtatcaggatgatgctggcctcatagaataagttgtgggggagacgctcctcctcaatttcttggaatggtttcagtaggaattacattggctcttctttgtacatctggtagaattmggctgtgaatccatctggtcccaggctttttttgggtggtaggctatttattactgattcaatttgggagtttgttatggatttgttcagggaattaatttcctcctggttcagtcttgggagggtgtatgttgtccaggaatggattcatttttctaggttttctaatatgtgtgcatagaggtgttcatagtagtctctgattatttgtatttctgtggggttagtggtaacatcctctttgtcatttctagttgtgtttaattggatcttccttcttttcttctttatgagtatagc

SEQ ID NO: 187366 - DNA, 601 bp, Human
tttttagtagaggtggggtttcaccatgttgggcaggctgtctcgaactcctgatctcaggtgatcttcccgtgtcggcctcccaaagggctaggattacaggcgtgagccaccatgtccagccttagatactccttaatccagtcaatttgacacctaaaattaagtctacaagtccatcccttgtctatttggcacccatacatatcttaaaccacacgtaatttccaaatgaagacaataacaaagtaatagttctgcctaacaagatgcaactaacataatgaggctatcctgtgtrcaacagaaaattcactaatcgtgatttttgagattttagatgttaaggacttagacttcagggatttttatcattcaggatttcagcattcaggactatgacattcagaatcgtgtcttttgggattgattggtagtgggtataatgacgtattttgcaactggttccatagctgaattccatagctgaattctcaatggcagctcaattctaggtacctgtgagaggcttcttccatccagaagcactttcctaactatctttccttggagcctgatagaccaccaatggaatttgttc

SEQ ID NO: 187367 - DNA, 601 bp, Human; identical to SEQ ID NO: 32446

SEQ ID NO: 187368 - DNA, 601 bp, Human; identical to SEQ ID NO: 32447

SEQ ID NO: 187369 - DNA, 601 bp, Human; identical to SEQ ID NO: 32448

SEQ ID NO: 187370 - DNA, 601 bp, Human; identical to SEQ ID NO: 32449

SEQ ID NO: 187371 - DNA, 601 bp, Human; identical to SEQ ID NO: 32450

SEQ ID NO: 187372 - DNA, 601 bp, Human; identical to SEQ ID NO: 32451

SEQ ID NO: 187373 - DNA, 601 bp, Human; identical to SEQ ID NO: 32452

SEQ ID NO: 187374 - DNA, 601 bp, Human; identical to SEQ ID NO: 32453

SEQ ID NO: 187375 - DNA, 601 bp, Human; identical to SEQ ID NO: 32454

SEQ ID NO: 187376 - DNA, 601 bp, Human; identical to SEQ ID NO: 32455

SEQ ID NO: 187377 - DNA, 601 bp, Human; identical to SEQ ID NO: 32456

SEQ ID NO: 187378 - DNA, 601 bp, Human; identical to SEQ ID NO: 32457

SEQ ID NO: 187379 - DNA, 601 bp, Human; identical to SEQ ID NO: 32458

SEQ ID NO: 187380 - DNA, 601 bp, Human; identical to SEQ ID NO: 32459

SEQ ID NO: 187381 - DNA, 601 bp, Human; identical to SEQ ID NO: 32460

SEQ ID NO: 187382 - DNA, 601 bp, Human; identical to SEQ ID NO: 32461

SEQ ID NO: 187383 - DNA, 601 bp, Human; identical to SEQ ID NO: 32462

SEQ ID NO: 187384 - DNA, 601 bp, Human; identical to SEQ ID NO: 32463

SEQ ID NO: 187385 - DNA, 601 bp, Human; identical to SEQ ID NO: 32464

SEQ ID NO: 187386 - DNA, 601 bp, Human; identical to SEQ ID NO: 32465

SEQ ID NO: 187387 - DNA, 601 bp, Human; identical to SEQ ID NO: 32466

SEQ ID NO: 187388 - DNA, 601 bp, Human; identical to SEQ ID NO: 32467

SEQ ID NO: 187389 - DNA, 601 bp, Human; identical to SEQ ID NO: 32468

SEQ ID NO: 187390 - DNA, 601 bp, Human; identical to SEQ ID NO: 32469

SEQ ID NO: 187391 - DNA, 601 bp, Human; identical to SEQ ID NO: 32470

SEQ ID NO: 187392 - DNA, 601 bp, Human; identical to SEQ ID NO: 32471

SEQ ID NO: 187393 - DNA, 601 bp, Human; identical to SEQ ID NO: 32472

SEQ ID NO: 187394 - DNA, 601 bp, Human; identical to SEQ ID NO: 32473

SEQ ID NO: 187395 - DNA, 601 bp, Human; identical to SEQ ID NO: 32474

SEQ ID NO: 187396 - DNA, 601 bp, Human; identical to SEQ ID NO: 32475

SEQ ID NO: 187397 - DNA, 601 bp, Human; identical to SEQ ID NO: 32476

SEQ ID NO: 187398 - DNA, 601 bp, Human; identical to SEQ ID NO: 32477

SEQ ID NO: 187399 - DNA, 601 bp, Human; identical to SEQ ID NO: 32478

SEQ ID NO: 187400 - DNA, 601 bp, Human; identical to SEQ ID NO: 32479

SEQ ID NO: 187401 - DNA, 601 bp, Human; identical to SEQ ID NO: 32480

SEQ ID NO: 187402 - DNA, 601 bp, Human; identical to SEQ ID NO: 32481

SEQ ID NO: 187403 - DNA, 601 bp, Human; identical to SEQ ID NO: 32482

SEQ ID NO: 187404 - DNA, 601 bp, Human; identical to SEQ ID NO: 32483

SEQ ID NO: 187405 - DNA, 601 bp, Human; identical to SEQ ID NO: 32484

SEQ ID NO: 187406 - DNA, 601 bp, Human; identical to SEQ ID NO: 32485

SEQ ID NO: 187407 - DNA, 601 bp, Human; identical to SEQ ID NO: 32486

SEQ ID NO: 187408 - DNA, 601 bp, Human; identical to SEQ ID NO: 32487

SEQ ID NO: 187409 - DNA, 601 bp, Human; identical to SEQ ID NO: 32488

SEQ ID NO: 187410 - DNA, 601 bp, Human; identical to SEQ ID NO: 32489

SEQ ID NO: 187411 - DNA, 601 bp, Human; identical to SEQ ID NO: 32490

SEQ ID NO: 187412 - DNA, 601 bp, Human; identical to SEQ ID NO: 32491

SEQ ID NO: 187413 - DNA, 601 bp, Human; identical to SEQ ID NO: 32492

SEQ ID NO: 187414 - DNA, 601 bp, Human; identical to SEQ ID NO: 32493

SEQ ID NO: 187415 - DNA, 601 bp, Human; identical to SEQ ID NO: 32494

SEQ ID NO: 187416 - DNA, 601 bp, Human; identical to SEQ ID NO: 32495

SEQ ID NO: 187417 - DNA, 601 bp, Human; identical to SEQ ID NO: 32496

SEQ ID NO: 187418 - DNA, 601 bp, Human; identical to SEQ ID NO: 32497

SEQ ID NO: 187419 - DNA, 601 bp, Human; identical to SEQ ID NO: 32498

SEQ ID NO: 187420 - DNA, 601 bp, Human; identical to SEQ ID NO: 32499

SEQ ID NO: 187421 - DNA, 601 bp, Human; identical to SEQ ID NO: 32500

SEQ ID NO: 187422 - DNA, 601 bp, Human; identical to SEQ ID NO: 32501

SEQ ID NO: 187423 - DNA, 601 bp, Human; identical to SEQ ID NO: 32502

SEQ ID NO: 187424 - DNA, 601 bp, Human; identical to SEQ ID NO: 32503

SEQ ID NO: 187425 - DNA, 601 bp, Human; identical to SEQ ID NO: 32504

SEQ ID NO: 187426 - DNA, 601 bp, Human; identical to SEQ ID NO: 32505

SEQ ID NO: 187427 - DNA, 601 bp, Human; identical to SEQ ID NO: 32506

SEQ ID NO: 187428 - DNA, 601 bp, Human; identical to SEQ ID NO: 32507

SEQ ID NO: 187429 - DNA, 601 bp, Human; identical to SEQ ID NO: 32508

SEQ ID NO: 187430 - DNA, 601 bp, Human; identical to SEQ ID NO: 32509

SEQ ID NO: 187431 - DNA, 601 bp, Human; identical to SEQ ID NO: 32510

SEQ ID NO: 187432 - DNA, 601 bp, Human; identical to SEQ ID NO: 32511

SEQ ID NO: 187433 - DNA, 601 bp, Human; identical to SEQ ID NO: 32512

SEQ ID NO: 187434 - DNA, 601 bp, Human; identical to SEQ ID NO: 32513

SEQ ID NO: 187435 - DNA, 601 bp, Human; identical to SEQ ID NO: 32514

SEQ ID NO: 187436 - DNA, 601 bp, Human; identical to SEQ ID NO: 32515

SEQ ID NO: 187437 - DNA, 601 bp, Human; identical to SEQ ID NO: 32516

SEQ ID NO: 187438 - DNA, 601 bp, Human; identical to SEQ ID NO: 32517

SEQ ID NO: 187439 - DNA, 601 bp, Human; identical to SEQ ID NO: 32518

SEQ ID NO: 187440 - DNA, 601 bp, Human; identical to SEQ ID NO: 32519

SEQ ID NO: 187441 - DNA, 601 bp, Human; identical to SEQ ID NO: 32520

SEQ ID NO: 187442 - DNA, 601 bp, Human; identical to SEQ ID NO: 32521

SEQ ID NO: 187443 - DNA, 601 bp, Human; identical to SEQ ID NO: 32522

SEQ ID NO: 187444 - DNA, 601 bp, Human; identical to SEQ ID NO: 32523

SEQ ID NO: 187445 - DNA, 601 bp, Human; identical to SEQ ID NO: 32524

SEQ ID NO: 187446 - DNA, 601 bp, Human; identical to SEQ ID NO: 32525

SEQ ID NO: 187447 - DNA, 601 bp, Human; identical to SEQ ID NO: 32526

SEQ ID NO: 187448 - DNA, 601 bp, Human; identical to SEQ ID NO: 32527

SEQ ID NO: 187449 - DNA, 601 bp, Human; identical to SEQ ID NO: 32528

SEQ ID NO: 187450 - DNA, 601 bp, Human; identical to SEQ ID NO: 32529

SEQ ID NO: 187451 - DNA, 601 bp, Human; identical to SEQ ID NO: 32530

SEQ ID NO: 187452 - DNA, 601 bp, Human; identical to SEQ ID NO: 32531

SEQ ID NO: 187453 - DNA, 601 bp, Human; identical to SEQ ID NO: 32532

SEQ ID NO: 187454 - DNA, 601 bp, Human; identical to SEQ ID NO: 32533

SEQ ID NO: 187455 - DNA, 601 bp, Human; identical to SEQ ID NO: 32534

SEQ ID NO: 187456 - DNA, 601 bp, Human; identical to SEQ ID NO: 32535

SEQ ID NO: 187457 - DNA, 601 bp, Human; identical to SEQ ID NO: 32536

SEQ ID NO: 187458 - DNA, 601 bp, Human; identical to SEQ ID NO: 32537

SEQ ID NO: 187459 - DNA, 601 bp, Human; identical to SEQ ID NO: 32538

SEQ ID NO: 187460 - DNA, 601 bp, Human; identical to SEQ ID NO: 32539

SEQ ID NO: 187461 - DNA, 601 bp, Human; identical to SEQ ID NO: 32540

SEQ ID NO: 187462 - DNA, 601 bp, Human; identical to SEQ ID NO: 32541

SEQ ID NO: 187463 - DNA, 601 bp, Human; identical to SEQ ID NO: 32542

SEQ ID NO: 187464 - DNA, 601 bp, Human; identical to SEQ ID NO: 32543

SEQ ID NO: 187465 - DNA, 601 bp, Human; identical to SEQ ID NO: 82295

SEQ ID NO: 187466 - DNA, 601 bp, Human; identical to SEQ ID NO: 82296

SEQ ID NO: 187467 - DNA, 601 bp, Human; identical to SEQ ID NO: 82297

SEQ ID NO: 187468 - DNA, 601 bp, Human; identical to SEQ ID NO: 82298

SEQ ID NO: 187469 - DNA, 601 bp, Human; identical to SEQ ID NO: 82299

SEQ ID NO: 187470 - DNA, 601 bp, Human; identical to SEQ ID NO: 82300

SEQ ID NO: 187471 - DNA, 601 bp, Human; identical to SEQ ID NO: 82301

SEQ ID NO: 187472 - DNA, 601 bp, Human; identical to SEQ ID NO: 82302

SEQ ID NO: 187473 - DNA, 601 bp, Human; identical to SEQ ID NO: 82303

SEQ ID NO: 187474 - DNA, 601 bp, Human; identical to SEQ ID NO: 82304

SEQ ID NO: 187475 - DNA, 601 bp, Human; identical to SEQ ID NO: 82305

SEQ ID NO: 187476 - DNA, 601 bp, Human; identical to SEQ ID NO: 82306

SEQ ID NO: 187477 - DNA, 601 bp, Human; identical to SEQ ID NO: 82307

SEQ ID NO: 187478 - DNA, 601 bp, Human; identical to SEQ ID NO: 82308

SEQ ID NO: 187479 - DNA, 601 bp, Human; identical to SEQ ID NO: 82309

SEQ ID NO: 187480 - DNA, 601 bp, Human; identical to SEQ ID NO: 82310

SEQ ID NO: 187481 - DNA, 601 bp, Human; identical to SEQ ID NO: 82311

SEQ ID NO: 187482 - DNA, 601 bp, Human; identical to SEQ ID NO: 82312

SEQ ID NO: 187483 - DNA, 601 bp, Human; identical to SEQ ID NO: 82313

SEQ ID NO: 187484 - DNA, 601 bp, Human; identical to SEQ ID NO: 82314

SEQ ID NO: 187485 - DNA, 601 bp, Human; identical to SEQ ID NO: 82315

SEQ ID NO: 187486 - DNA, 601 bp, Human; identical to SEQ ID NO: 82316

SEQ ID NO: 187487 - DNA, 601 bp, Human; identical to SEQ ID NO: 82317

SEQ ID NO: 187488 - DNA, 601 bp, Human; identical to SEQ ID NO: 82318

SEQ ID NO: 187489 - DNA, 601 bp, Human; identical to SEQ ID NO: 82319

SEQ ID NO: 187490 - DNA, 601 bp, Human; identical to SEQ ID NO: 82320

SEQ ID NO: 187491 - DNA, 601 bp, Human; identical to SEQ ID NO: 82321

SEQ ID NO: 187492 - DNA, 601 bp, Human; identical to SEQ ID NO: 82322

SEQ ID NO: 187493 - DNA, 601 bp, Human; identical to SEQ ID NO: 82323

SEQ ID NO: 187494 - DNA, 601 bp, Human; identical to SEQ ID NO: 82324

SEQ ID NO: 187495 - DNA, 601 bp, Human; identical to SEQ ID NO: 82325

SEQ ID NO: 187496 - DNA, 601 bp, Human; identical to SEQ ID NO: 82326

SEQ ID NO: 187497 - DNA, 601 bp, Human; identical to SEQ ID NO: 82327

SEQ ID NO: 187498 - DNA, 601 bp, Human; identical to SEQ ID NO: 82328

SEQ ID NO: 187499 - DNA, 601 bp, Human; identical to SEQ ID NO: 82329

SEQ ID NO: 187500 - DNA, 601 bp, Human; identical to SEQ ID NO: 82330

SEQ ID NO: 187501 - DNA, 601 bp, Human; identical to SEQ ID NO: 82331

SEQ ID NO: 187502 - DNA, 601 bp, Human; identical to SEQ ID NO: 82332

SEQ ID NO: 187503 - DNA, 601 bp, Human; identical to SEQ ID NO: 82333

SEQ ID NO: 187504 - DNA, 601 bp, Human; identical to SEQ ID NO: 82334

SEQ ID NO: 187505 - DNA, 601 bp, Human; identical to SEQ ID NO: 82335

SEQ ID NO: 187506 - DNA, 601 bp, Human; identical to SEQ ID NO: 82336

SEQ ID NO: 187507 - DNA, 601 bp, Human; identical to SEQ ID NO: 82337

SEQ ID NO: 187508 - DNA, 601 bp, Human; identical to SEQ ID NO: 82338

SEQ ID NO: 187509 - DNA, 601 bp, Human; identical to SEQ ID NO: 82339

SEQ ID NO: 187510 - DNA, 601 bp, Human; identical to SEQ ID NO: 82340

SEQ ID NO: 187511 - DNA, 601 bp, Human; identical to SEQ ID NO: 82341

SEQ ID NO: 187512 - DNA, 601 bp, Human; identical to SEQ ID NO: 82342

SEQ ID NO: 187513 - DNA, 601 bp, Human; identical to SEQ ID NO: 82343

SEQ ID NO: 187514 - DNA, 601 bp, Human; identical to SEQ ID NO: 82344

SEQ ID NO: 187515 - DNA, 601 bp, Human; identical to SEQ ID NO: 82345

SEQ ID NO: 187516 - DNA, 601 bp, Human; identical to SEQ ID NO: 82346

SEQ ID NO: 187517 - DNA, 601 bp, Human; identical to SEQ ID NO: 82347

SEQ ID NO: 187518 - DNA, 601 bp, Human; identical to SEQ ID NO: 82348

SEQ ID NO: 187519 - DNA, 601 bp, Human; identical to SEQ ID NO: 82349

SEQ ID NO: 187520 - DNA, 601 bp, Human; identical to SEQ ID NO: 82350

SEQ ID NO: 187521 - DNA, 601 bp, Human; identical to SEQ ID NO: 82351

SEQ ID NO: 187522 - DNA, 601 bp, Human; identical to SEQ ID NO: 82352

SEQ ID NO: 187523 - DNA, 601 bp, Human; identical to SEQ ID NO: 82353

SEQ ID NO: 187524 - DNA, 601 bp, Human; identical to SEQ ID NO: 82354

SEQ ID NO: 187525 - DNA, 601 bp, Human; identical to SEQ ID NO: 82355

SEQ ID NO: 187526 - DNA, 601 bp, Human; identical to SEQ ID NO: 82356

SEQ ID NO: 187527 - DNA, 601 bp, Human; identical to SEQ ID NO: 82357

SEQ ID NO: 187528 - DNA, 601 bp, Human; identical to SEQ ID NO: 82358

SEQ ID NO: 187529 - DNA, 601 bp, Human; identical to SEQ ID NO: 82359

SEQ ID NO: 187530 - DNA, 601 bp, Human; identical to SEQ ID NO: 82360

SEQ ID NO: 187531 - DNA, 601 bp, Human; identical to SEQ ID NO: 82361

SEQ ID NO: 187532 - DNA, 601 bp, Human; identical to SEQ ID NO: 82362

SEQ ID NO: 187533 - DNA, 601 bp, Human; identical to SEQ ID NO: 82363

SEQ ID NO: 187534 - DNA, 601 bp, Human; identical to SEQ ID NO: 82364

SEQ ID NO: 187535 - DNA, 601 bp, Human; identical to SEQ ID NO: 82365

SEQ ID NO: 187536 - DNA, 601 bp, Human; identical to SEQ ID NO: 82366

SEQ ID NO: 187537 - DNA, 601 bp, Human; identical to SEQ ID NO: 82367

SEQ ID NO: 187538 - DNA, 601 bp, Human; identical to SEQ ID NO: 82368

SEQ ID NO: 187539 - DNA, 601 bp, Human; identical to SEQ ID NO: 82369

SEQ ID NO: 187540 - DNA, 601 bp, Human; identical to SEQ ID NO: 82370

SEQ ID NO: 187541 - DNA, 601 bp, Human; identical to SEQ ID NO: 82371

SEQ ID NO: 187542 - DNA, 601 bp, Human; identical to SEQ ID NO: 82372

SEQ ID NO: 187543 - DNA, 601 bp, Human; identical to SEQ ID NO: 82373

SEQ ID NO: 187544 - DNA, 601 bp, Human; identical to SEQ ID NO: 82374

SEQ ID NO: 187545 - DNA, 601 bp, Human; identical to SEQ ID NO: 82375

SEQ ID NO: 187546 - DNA, 601 bp, Human; identical to SEQ ID NO: 82376

SEQ ID NO: 187547 - DNA, 601 bp, Human; identical to SEQ ID NO: 82377

SEQ ID NO: 187548 - DNA, 601 bp, Human; identical to SEQ ID NO: 82378

SEQ ID NO: 187549 - DNA, 601 bp, Human; identical to SEQ ID NO: 82379

SEQ ID NO: 187550 - DNA, 601 bp, Human; identical to SEQ ID NO: 82380

SEQ ID NO: 187551 - DNA, 601 bp, Human; identical to SEQ ID NO: 82381

SEQ ID NO: 187552 - DNA, 601 bp, Human; identical to SEQ ID NO: 82382

SEQ ID NO: 187553 - DNA, 601 bp, Human; identical to SEQ ID NO: 82383

SEQ ID NO: 187554 - DNA, 601 bp, Human; identical to SEQ ID NO: 82384

SEQ ID NO: 187555 - DNA, 601 bp, Human; identical to SEQ ID NO: 82385

SEQ ID NO: 187556 - DNA, 601 bp, Human; identical to SEQ ID NO: 82386

SEQ ID NO: 187557 - DNA, 601 bp, Human; identical to SEQ ID NO: 82387

SEQ ID NO: 187558 - DNA, 601 bp, Human; identical to SEQ ID NO: 82388

SEQ ID NO: 187559 - DNA, 601 bp, Human; identical to SEQ ID NO: 82389

SEQ ID NO: 187560 - DNA, 601 bp, Human; identical to SEQ ID NO: 82390

SEQ ID NO: 187561 - DNA, 601 bp, Human; identical to SEQ ID NO: 82391

SEQ ID NO: 187562 - DNA, 601 bp, Human; identical to SEQ ID NO: 82392

SEQ ID NO: 187563 - DNA, 601 bp, Human; identical to SEQ ID NO: 82393

SEQ ID NO: 187564 - DNA, 601 bp, Human; identical to SEQ ID NO: 82394

SEQ ID NO: 187565 - DNA, 601 bp, Human; identical to SEQ ID NO: 82395

SEQ ID NO: 187566 - DNA, 601 bp, Human; identical to SEQ ID NO: 82396

SEQ ID NO: 187567 - DNA, 601 bp, Human; identical to SEQ ID NO: 82397

SEQ ID NO: 187568 - DNA, 601 bp, Human; identical to SEQ ID NO: 82398

SEQ ID NO: 187569 - DNA, 601 bp, Human; identical to SEQ ID NO: 82399

SEQ ID NO: 187570 - DNA, 601 bp, Human; identical to SEQ ID NO: 82400

SEQ ID NO: 187571 - DNA, 601 bp, Human; identical to SEQ ID NO: 82401

SEQ ID NO: 187572 - DNA, 601 bp, Human; identical to SEQ ID NO: 82402

SEQ ID NO: 187573 - DNA, 601 bp, Human; identical to SEQ ID NO: 82403

SEQ ID NO: 187574 - DNA, 601 bp, Human; identical to SEQ ID NO: 82404

SEQ ID NO: 187575 - DNA, 601 bp, Human; identical to SEQ ID NO: 82405

SEQ ID NO: 187576 - DNA, 601 bp, Human; identical to SEQ ID NO: 82406

SEQ ID NO: 187577 - DNA, 601 bp, Human; identical to SEQ ID NO: 82407

SEQ ID NO: 187578 - DNA, 601 bp, Human; identical to SEQ ID NO: 82408

SEQ ID NO: 187579 - DNA, 601 bp, Human; identical to SEQ ID NO: 82409

SEQ ID NO: 187580 - DNA, 601 bp, Human; identical to SEQ ID NO: 82410

SEQ ID NO: 187581 - DNA, 601 bp, Human; identical to SEQ ID NO: 82411

SEQ ID NO: 187582 - DNA, 601 bp, Human; identical to SEQ ID NO: 82412

SEQ ID NO: 187583 - DNA, 601 bp, Human; identical to SEQ ID NO: 82413

SEQ ID NO: 187584 - DNA, 601 bp, Human; identical to SEQ ID NO: 82414

SEQ ID NO: 187585 - DNA, 601 bp, Human; identical to SEQ ID NO: 82415

SEQ ID NO: 187586 - DNA, 601 bp, Human; identical to SEQ ID NO: 82416

SEQ ID NO: 187587 - DNA, 601 bp, Human; identical to SEQ ID NO: 82417

SEQ ID NO: 187588 - DNA, 601 bp, Human; identical to SEQ ID NO: 82418

SEQ ID NO: 187589 - DNA, 601 bp, Human; identical to SEQ ID NO: 82419

SEQ ID NO: 187590 - DNA, 601 bp, Human; identical to SEQ ID NO: 82420

SEQ ID NO: 187591 - DNA, 601 bp, Human; identical to SEQ ID NO: 82421

SEQ ID NO: 187592 - DNA, 601 bp, Human; identical to SEQ ID NO: 82422

SEQ ID NO: 187593 - DNA, 601 bp, Human; identical to SEQ ID NO: 82423

SEQ ID NO: 187594 - DNA, 601 bp, Human; identical to SEQ ID NO: 82424

SEQ ID NO: 187595 - DNA, 601 bp, Human; identical to SEQ ID NO: 82425

SEQ ID NO: 187596 - DNA, 601 bp, Human; identical to SEQ ID NO: 82426

SEQ ID NO: 187597 - DNA, 601 bp, Human; identical to SEQ ID NO: 82427

SEQ ID NO: 187598 - DNA, 601 bp, Human; identical to SEQ ID NO: 82428

SEQ ID NO: 187599 - DNA, 601 bp, Human; identical to SEQ ID NO: 82429

SEQ ID NO: 187600 - DNA, 601 bp, Human; identical to SEQ ID NO: 82430

SEQ ID NO: 187601 - DNA, 601 bp, Human; identical to SEQ ID NO: 82431

SEQ ID NO: 187602 - DNA, 601 bp, Human; identical to SEQ ID NO: 82432

SEQ ID NO: 187603 - DNA, 601 bp, Human; identical to SEQ ID NO: 82433

SEQ ID NO: 187604 - DNA, 601 bp, Human; identical to SEQ ID NO: 82434

SEQ ID NO: 187605 - DNA, 601 bp, Human; identical to SEQ ID NO: 82435

SEQ ID NO: 187606 - DNA, 601 bp, Human; identical to SEQ ID NO: 82436

SEQ ID NO: 187607 - DNA, 601 bp, Human; identical to SEQ ID NO: 82437

SEQ ID NO: 187608 - DNA, 601 bp, Human; identical to SEQ ID NO: 82438

SEQ ID NO: 187609 - DNA, 601 bp, Human
aaaaagctgggttgaggaagaggctccctgctctgactgttccagtgcagctgctgctggctgccttctccagtgatctcgggcagctcccagaaatgggtctgttctctgctcagagggcaacggtccagcccgaagtcaatgaccagcctgctccctcgtgtgtactttgtaaatagctgggctccctaaggggaaacctcacctagatttagcttagagtaaggaggaagacccccaccctgctgaggtcacaaaacacaatgaaaaataaacatatgaccccaatggccatgccccragtctactctggtcacactcctgagagccagtgagggaaatccagtggccgactgtgagagaggactctgacttgtaggtcacaagcacctggtcacccgaaggtcaggactgctgagggtttgctcaccaaagcaccacacattagagggagaatgagaggggaaggaagagagaaaagcgtggggcaccaggaaagtgcggcagagaaaacaaagagcaactaaaaattatccagagtcaggagtcgcaacctttggcatcacggctcagaggaagcccaagcccggtgctcctcctg

SEQ ID NO: 187610 - DNA, 601 bp, Human
ttaagcttccctcctccccaccagaccctggactttgggccatcctcagcctgagccagcaaacagcccctcccctggagacaaaaaaaaaaaaaaaaaaaaaaaggctgggcacaacgtcattccctgaacgtggttctttctagccatgtttacttcttccaataaaagaaaagtccttttctgcctgggctttgagacgcttgcagatcttgccatcggtcggtctgagccttttcactattcccataaggccccttcctctcccttttgcaatattccctttccccttctgcaatcrtgctttggaataaggtctctccttccctaagcccagatttatttgtatttgacacctcaaaacagcatactgggcactggaaagaaaaggggatgcataatggccagtcttcctcctgggcagcctccctgaacagagccaggagtgaagcattagtagaactggttgccgaaagtctatcaaattccaaaacattccaccatcttccagttcacagtacaactttatgggatggaggtgatatgaaaataataaaacaaaacaaaacaaaaagcaagaaaacgacaacccaggtctctt

SEQ ID NO: 187611 - DNA, 601 bp, Human; identical to SEQ ID NO: 18468

SEQ ID NO: 187612 - DNA, 601 bp, Human; identical to SEQ ID NO: 18469

SEQ ID NO: 187613 - DNA, 601 bp, Human; identical to SEQ ID NO: 18470

SEQ ID NO: 187614 - DNA, 601 bp, Human; identical to SEQ ID NO: 18471

SEQ ID NO: 187615 - DNA, 601 bp, Human; identical to SEQ ID NO: 18472

SEQ ID NO: 187616 - DNA, 601 bp, Human; identical to SEQ ID NO: 18473

SEQ ID NO: 187617 - DNA, 601 bp, Human; identical to SEQ ID NO: 18474

SEQ ID NO: 187618 - DNA, 601 bp, Human; identical to SEQ ID NO: 18475

SEQ ID NO: 187619 - DNA, 601 bp, Human; identical to SEQ ID NO: 18476

SEQ ID NO: 187620 - DNA, 601 bp, Human; identical to SEQ ID NO: 18477

SEQ ID NO: 187621 - DNA, 601 bp, Human; identical to SEQ ID NO: 18478

SEQ ID NO: 187622 - DNA, 601 bp, Human; identical to SEQ ID NO: 18479

SEQ ID NO: 187623 - DNA, 601 bp, Human; identical to SEQ ID NO: 18480

SEQ ID NO: 187624 - DNA, 601 bp, Human; identical to SEQ ID NO: 18481

SEQ ID NO: 187625 - DNA, 601 bp, Human; identical to SEQ ID NO: 18482

SEQ ID NO: 187626 - DNA, 601 bp, Human; identical to SEQ ID NO: 18483

SEQ ID NO: 187627 - DNA, 601 bp, Human; identical to SEQ ID NO: 18484

SEQ ID NO: 187628 - DNA, 601 bp, Human
ggatcacactgcatgttagttgaaccttttcaccttggctttggaattaaacgttggccaccctatgtgccttccagaataccagtccccggtgccactgtcaaaccctctgcgtttcaaagctctggctgtttcaacctcatttttccactgtatttgtccacccgaggcattcattctaagttgaacacgaggggccatgaacgatgggaggatagggaatgatctcatgagcctgaaacaggagaggacaccagcaacagcaaagaggccaagtgagtcccaggcatcacacacggcrggtgcttggagctgcccccaagggatgtcagaaatctcgagttcagggccaaatctaaactgagaactgagagcagagcccagtgttaaaggccagggccagcaggaggaatacatagaagaaatgcccccaggtgtcctctccgtggggcaaggtggatccccaggaggtcagagaggcgttgctgccatcaaaggcccaagaggaggctcatcaccacccagctttgggccagctccttttctttctcttttttttttttttttttttctgagacagagtctcgctctgttgcccagg

SEQ ID NO: 187629 - DNA, 601 bp, Human
aatccttgtgcctcagcctcctgagtacctgatattacgggcatgcaccaccacacctggctgatttttgtgtttttagtagagatagggttttaccatgttaaccaggctggtctcaaacccctgggctcaagtgatccaatcaactcggccgctcaaagttctgggatgacaggtgtgatttttagtacagacagggtttcatcatgttggccaggctggtcttgattcctggcctcaaggaatctgcctgcctcagcgatccacccacctcggcctctcagttctgggatgacaggcygcgcccagccccatcaccttttcagttactcccatcctctgggcccctctgcctccctcccacatgcaggctgggggtgttggttaccttgccatcagcaggcccgtgtcaggctttctcgccatcctgcacctagcaggtgcatcataaatgctgcatattcagagtttctcatccctctgatctctggtccactccaaaatccttgctgcactgctaagatctacccatgaaagatttgcttttcagcagggtccccacgtcacagtcttccagcatgaggggtacacagtggtagta

SEQ ID NO: 187630 - DNA, 601 bp, Human
aacccctgggctcaagtgatccaatcaactcggccgctcaaagttctgggatgacaggtgtgatttttagtacagacagggtttcatcatgttggccaggctggtcttgattcctggcctcaaggaatctgcctgcctcagcgatccacccacctcggcctctcagttctgggatgacaggccgcgcccagccccatcaccttttcagttactcccatcctctgggcccctctgcctccctcccacatgcaggctgggggtgttggttaccttgccatcagcaggcccgtgtcaggctttstcgccatcctgcacctagcaggtgcatcataaatgctgcatattcagagtttctcatccctctgatctctggtccactccaaaatccttgctgcactgctaagatctacccatgaaagatttgcttttcagcagggtccccacgtcacagtcttccagcatgaggggtacacagtggtagtagaggcttgttacttattttcagaatgataaaactgaaacccataaagggtaagggatttgccgaaggtcacacggctaatgacagagctggtggcaccagaagaagtctacctgttct

SEQ ID NO: 187631 - DNA, 601 bp, Human
gactttagcacctttagatatctgatacaaggggaatcatgcagtattcatccttctgtaaggggcttattcactcagtatgtcttctcagtttactcatgctggcacaaatggcaagtttccttattttttaaggcggaataatgtttcatggtatgaatacactatattttctttcttttttttttttttttcttgaggcagaatctcgctctgtcgcccaggctagagtgcagtggcaccatcttggctcactgcaacctccacctccctggttccctggttcaagtgattctcgtgsctcagcctcccgattagtggctgggattacaggagcctgccaccacgcccggctaatttttgtatttttagtagagacagggttttgccacgttggccaggctggtctcgaactcctggcctcaagagattcacctgccttggcctcctaaattgatgggattacaggcgtgagccaggcgtgcccggtcagaatatactccattttcttgatccattcttctgtcagtagacacatgagttgtttccgtatcttggccattatgaataatgcttcagtgaacacgggggtacagatacc

SEQ ID NO: 187632 - DNA, 601 bp, Human
ttcatggtatgaatacactatattttctttcttttttttttttttttcttgaggcagaatctcgctctgtcgcccaggctagagtgcagtggcaccatcttggctcactgcaacctccacctccctggttccctggttcaagtgattctcgtgcctcagcctcccgattagtggctgggattacaggagcctgccaccacgcccggctaatttttgtatttttagtagagacagggttttgccacgttggccaggctggtctcgaactcctggcctcaagagattcacctgccttggcctyctaaattgatgggattacaggcgtgagccaggcgtgcccggtcagaatatactccattttcttgatccattcttctgtcagtagacacatgagttgtttccgtatcttggccattatgaataatgcttcagtgaacacgggggtacagatacctctttgagatcctgacttcgtccttttggccatctacccatggattaaagacttaaacacaggacctgaaactgtaaaactcctagaaaaaaaacatagggaaaaagcaatgatattttagatgtgacaccaaaagcacaggcaaca

SEQ ID NO: 187633 - DNA, 601 bp, Human
tgttaaatgtcatagctatgatggaaaactacatagtggttcctcaaattaaaaatagaactgccatatgatccagcagttccacttagagatatatatccaaaataattgaaatcaggatcacaaagagatacctgctgtttaaaataaaataaaataaagacagggtcttgctgtgttgcccaggctgtactccaactcctgagttcaagcaattgtcccgcttcagcctcccaagtagctggaattagaggcgtgcactaccacagctggtgatacctgctgtttaaatgagtgtgckttccactacgataagctctctctcagtggggtagaaagatcttgttctaaatcccagatgaactgggtactttgaaggaggtgtagcattcaggtttgttcttaatggcagttacatatggttttataaccacatccttttgttgaaatgcttttgatgcagaaatgctttcagtgcaggctttgaaaaagatcaccgtctgacttcatgtctttaaaaaaattaagctaatgaaatgacacctaggatctaagggatgcccggaagcttcctcagtccttctctagcttggtgccattt

SEQ ID NO: 187634 - DNA, 601 bp, Human
ttgaaatcaggatcacaaagagatacctgctgtttaaaataaaataaaataaagacagggtcttgctgtgttgcccaggctgtactccaactcctgagttcaagcaattgtcccgcttcagcctcccaagtagctggaattagaggcgtgcactaccacagctggtgatacctgctgtttaaatgagtgtgctttccactacgataagctctctctcagtggggtagaaagatcttgttctaaatcccagatgaactgggtactttgaaggaggtgtagcattcaggtttgttcttaatgrcagttacatatggttttataaccacatccttttgttgaaatgcttttgatgcagaaatgctttcagtgcaggctttgaaaaagatcaccgtctgacttcatgtctttaaaaaaattaagctaatgaaatgacacctaggatctaagggatgcccggaagcttcctcagtccttctctagcttggtgccatttcttgtagacagagaggagagctattaagacacacgacagcagattgttctgtaatgatgacattcttgcttcatgtaaatagccatttagaagcctcagttgggactt

SEQ ID NO: 187635 - DNA, 601 bp, Human
aacttcaggtgcagagcaatccaaatactagccttacactttgcattttcagtgatagacatttagaaagctggggttttttcctttcctaatgaagtttgatgtttttgccggcgtccagggaagtgatcctgagctgaggctgtcagtaaaaaagccatttctcagccaggccctgaggcttagcagcctcttccagcagcacagcctccaggaggcagagtctggtgttacataaagggtgccatctgcttggagcaactcgagagcagagtgaggaagtgtggcgttggccgttgcytttcaaaatatttgccatcttcagaaaccctgtcattcttcccatcagccacaaaagccagtgtttcttaaaatctggctctgagttcagcatggaggccctgggcctggcatggagtaccttggtttgttgcagagagagagagacggcaagggcagagagcacacaccacacatggctctgcatggctttccagaaaccaccctggctggatcaccctcagccactctgaattcgcaggcaagagaacctgtacttacccatgctttctgtaaaagtcatcttggctttaaggcagtt

SEQ ID NO: 187636 - DNA, 601 bp, Human
agacccaggtcttcttgtgtggctggtggcagacttagcttcttaacatgtgagtccctcactcctggagggaccctgagtgaattgccgctcccacagtcagcttccagaactgactggcagaaattgatgagaggttctcagcctggtggagatgtcccacccgctcctgtgtgggaggccaggaagcagggtgtcatgcatgggagccacgagcttcagatgttcctgctagcccaccttcctcctgagtgccagactccacagagtccatggccctgggtgttggtcccaagaatasgactgtggctaacaaccagcccacagagtgagcatccctgcctgtgtctgtgctgaagctctttcattcagggagacactggcttcaaacccctggagtggggctggccttccagggagccccttgatgtccgcagaatcggcatctcctgtgggcattccaggcccagatccgtcacagagctgtctcctctgcccttgaaggccggagaggtgaaatgagagggctgtgctcagagccgtcaacagacccaagggtcactcgccctagggccactagccccttggccagctcaggttc

SEQ ID NO: 187637 - DNA, 601 bp, Human
ccaggcaagaagggggtttatttcagggaaagggctgttaccggcattgtttcaaagttaaactataaactgaattcctcccaaggttagtttggtctgcatccaggaatgaacaaggacatcttggaagttagaagcaagatggagtcatttaggtcaccatcataattttctcagttaaaatttttgcaaagacagtttcagttcctcctgttgggttttataataccttattcctaatacttcatactgtgggatatgaagatgggaaaagagtgataaccgctctagcttctttctsctgacagggagcgtagtcagggtaggtgttgacccaaaggtaggaggagtgaaaccactttgcagctgtctgcttctactcaggggttcctggttagggtttgaaggcctgcatgacaaaggcattagtattctcatctatagttttaacaaatgagtcctaggataaagagtgaaagtcctggcttcagaagcttttgtagaattgatcctaagctctgagggacccaggtaaatagctccaagaaccaatcagacatggggttactagcagagagagatttgggtcagaggttgttag

SEQ ID NO: 187638 - DNA, 601 bp, Human
agacaaaccgtagtaggacaagtttacttgcaaaataagtcatagtcttattaagcttggcctgattatttgtataaagtaaagcaagaataattgtttgccagataggctgtttttaaaattggctttgctgaaactttgttccataagaaatctcaggttagacttttttaaagcctcgagcccagccatggatttatctactatacctgcaaagataaacctgtatgagttgggtgaaattttttcttctcatggtcctaagataatttggggctcctgggcctgtcaaaaagtgacrgtctttatttaccacagttcaggaaccccgtacagggactgtgtagacaaggtatgaggccagcttttccaagggacttctattggctctgttagtcaactttgttccttaaagcagtctgtttatatttgaaagtatgtcgtaccagtcaaagccttggtaaagtaaccggcatctctaattgtatcctattacaaaagaaaacagattgttactgcccttgcacaaataattatactgccataagttgagaatactcacaaatagtttccaaattctggagaaatcagagagaaggca

SEQ ID NO: 187639 - DNA, 601 bp, Human
ggggctcctgggcctgtcaaaaagtgacagtctttatttaccacagttcaggaaccccgtacagggactgtgtagacaaggtatgaggccagcttttccaagggacttctattggctctgttagtcaactttgttccttaaagcagtctgtttatatttgaaagtatgtcgtaccagtcaaagccttggtaaagtaaccggcatctctaattgtatcctattacaaaagaaaacagattgttactgcccttgcacaaataattatactgccataagttgagaatactcacaaatagtttcyaaattctggagaaatcagagagaaggcaatatgctctaaattttgctcacagaagtatactttaactcaattgttaaagttataaatagctcaaaagaaaaatagttttctggactctgaaaaacaaaaggattaacaatgtttaacacatcagctctccatgaggatcctagaagttttttttcctccattccaatggcacaatttgtaaagttatcagagacctgcattcaagagtacccattagagtactatatctgattataaactgccttttgaaaaggataaaaccaagacagc

SEQ ID NO: 187640 - DNA, 601 bp, Human
atgaggccagcttttccaagggacttctattggctctgttagtcaactttgttccttaaagcagtctgtttatatttgaaagtatgtcgtaccagtcaaagccttggtaaagtaaccggcatctctaattgtatcctattacaaaagaaaacagattgttactgcccttgcacaaataattatactgccataagttgagaatactcacaaatagtttccaaattctggagaaatcagagagaaggcaatatgctctaaattttgctcacagaagtatactttaactcaattgttaaagttrtaaatagctcaaaagaaaaatagttttctggactctgaaaaacaaaaggattaacaatgtttaacacatcagctctccatgaggatcctagaagttttttttcctccattccaatggcacaatttgtaaagttatcagagacctgcattcaagagtacccattagagtactatatctgattataaactgccttttgaaaaggataaaaccaagacagcaactgcctgtgggtaacaaaagtctcaggacagccgtagttaaagatgcagtcaacaaggaaatctggtcatctctgtgaca

SEQ ID NO: 187641 - DNA, 601 bp, Human
agctttctaaacaacaaaacccagtgaagatagcatgaggccaactgaatctttcttttattttttttaatagtttactccaaagccaaataaaaatctttcattgtctctctctgtcaatattacataaaaatattcttcaaaagagaaaaccaaattttatctcgcattagtgcatctttaatgctaaagctagttttgtttttgttgttgtttgaggtggagtctcgctctgttgcccaggctggagtacagtggcacgatctcagctcactgcaagctctatctcctgggttcatgycattctcctgcttcagcctcccgagtagctgggactacaggcgcgtgccaccacgcctggctaattttttgtattttttagtagagacggggtttcaccatgttagccaggatggtcttgatctcctgacctcgtgatccacccacctcggcctcccaaagtgctaggattacaggcatgagccactgtgcccggcctgttgtagttttgagacggagtttcactcttgtcacccaggctggagtgcagtggcatgatctcggctcactgcaccctccgcctcctgggttcaagcgattc

SEQ ID NO: 187642 - DNA, 601 bp, Human
ctgaatctttcttttattttttttaatagtttactccaaagccaaataaaaatctttcattgtctctctctgtcaatattacataaaaatattcttcaaaagagaaaaccaaattttatctcgcattagtgcatctttaatgctaaagctagttttgtttttgttgttgtttgaggtggagtctcgctctgttgcccaggctggagtacagtggcacgatctcagctcactgcaagctctatctcctgggttcatgtcattctcctgcttcagcctcccgagtagctgggactacaggcgygtgccaccacgcctggctaattttttgtattttttagtagagacggggtttcaccatgttagccaggatggtcttgatctcctgacctcgtgatccacccacctcggcctcccaaagtgctaggattacaggcatgagccactgtgcccggcctgttgtagttttgagacggagtttcactcttgtcacccaggctggagtgcagtggcatgatctcggctcactgcaccctccgcctcctgggttcaagcgattctcctgcctcccaagtagctgggattacaggcacccaccaccact

SEQ ID NO: 187643 - DNA, 601 bp, Human
cctgacctcgtgatccacccacctcggcctcccaaagtgctaggattacaggcatgagccactgtgcccggcctgttgtagttttgagacggagtttcactcttgtcacccaggctggagtgcagtggcatgatctcggctcactgcaccctccgcctcctgggttcaagcgattctcctgcctcccaagtagctgggattacaggcacccaccaccactcctggctaatttttgtattttttagtagagactgggtttcgccatgttggccaggctggtcttgaactcctgaccccacgwgatcgcccacctcagcctcccaaagcgctgggattacagttgtgagccaccactcctagccaaagctagtttttaataaaattttacaaacaaatgtatccgattttagtttgactgtagggtaacattttcataaaccttttatataaccctttataattgtttgttaacaaatcagtgttcaaaaataaaacactattttttttttttttttttgagatggagtcttgctccattgcccaggctggagtgcagtggcacattctcagctcactgcaacctctgcctctcaggttcaag

SEQ ID NO: 187644 - DNA, 601 bp, Human
acagttgtgagccaccactcctagccaaagctagtttttaataaaattttacaaacaaatgtatccgattttagtttgactgtagggtaacattttcataaaccttttatataaccctttataattgtttgttaacaaatcagtgttcaaaaataaaacactattttttttttttttttttgagatggagtcttgctccattgcccaggctggagtgcagtggcacattctcagctcactgcaacctctgcctctcaggttcaagcaattcttctgcctcaacctcccgagtagctgggaytacaggcgtgtgccaccacgcccggctaatttttgtatttttagtagagacaggatttcaccatatgggccaggctggtttcgaacttctgacctcgtgatctgcctgcgtcggccttccaaagtgctaggattacaggcatgtgccaccgcgtctggcataaaaccctattattttgatatatgggcccagattctggccctgcatcagtatgcttttaatatttaatttatggaaaaaattaaataataccctttcgattttagccagcttgctcacacacagagttgttcacaaagt

SEQ ID NO: 187645 - DNA, 601 bp, Human
agaaacagtatctgatctgcctaattcagaccaaatgaagacagttttatttcatcaataatctttaaaactatctttatttaccaaagattactaacgtcatgtgaactaaaatgcattagagttgctatttctttgacaaaatatttaagtgcttattttttaagccaattaattacagctcttaaacatcacacacacaacattataaatatatagaccgaagaagatgcattagttaagatttttcatttgctgattttttaggggttttttttccccattttacaaatcttgtcaygactcacagagaccatctatgccatgcttggactgtctgacttgtcctatgtgtccctctttcgtgaataatcagtcgttctattttaggacaagaatttaccatacaagatcttttctcatataaatttctttttttataatcatccttaccaaaaatacatctttatagcctcaacttttttcacatatctctttcccctactaaagtaattcctgatgccctcaaaagtgaaaaaggccaagtaatgtgattcaaaacagaacagagccttagattttgagaggggtctgtctgctt

SEQ ID NO: 187646 - DNA, 601 bp, Human
tgcttggcaggtagtaggtgttctagaaaggtgtgtcgtattaatgtgtgaatactgactccccctcctaagtcactgagtgaggagagaggatgtgtgattcatctgaggcatgcgagagctggttgtgcctttgtctttgtttttcttttttcttttgagatggagtctcactctattgcccaggctggagtgcagtggtgcgatcttagctcactgcagcctccacccaccgggttccagtgattttcctgcctcagcctccagagtagctggggatttgtattcacagcacagagtrcaccagattccctacagcctaagtctaggctcataagattttttctattaatcagacccttgcagaggagacaaacagtgatgttttccattcatacacggcgagaggggccagaagcctggctggtaagaaatgtttaccctttttgcctgcatgtcaggtttctgggttcccattctctgtagcttccagaagaacggagcagctcttgatgaccctgctcgctgcacgctagctgtgggcgccaagtcgcattgcaaaggaaaaccatccgtttctgttttatggaaccacaggcaa

SEQ ID NO: 187647 - DNA, 601 bp, Human
ataccccatgctggggctacaaacagataccacctaatagagctagagatgccccatgatggggctacaggcagacacccaatgatggggctacagacagataccctgtgatggggctacagttacaggacgtctccccaggactgtttattgcagttaaatccatacaccatgggttggcagcaccccattagtagagatggtgccagtgtcagcccccagtcgaagagaactaggtggccgcctgggctggcctctggatccatcaccagtgaggggggttggggaggctactgaatcrctggaagatagccacaagggagatcacagatgagcccccaaatttgtaaccccctccacaggttctccttgcccacagcctagacagccaatttatcaagacaggagaattgcaatagactaattcacacagagccagctgtgcaggagactggagttttattattactcaaatcagtctccaagaatttggggatttgagtttttaaggataacttggtgggtaggggctctggaggtgtggattgctgattggtcagcatggagatgaaatcatagggggtagaagtgagtttttctt

SEQ ID NO: 187648 - DNA, 601 bp, Human
gattggtcagcatggagatgaaatcatagggggtagaagtgagtttttcttgctgtcttctgtccttgggtgggatcaaagtgccggttgaatcatattacctgtctgggtggcgtcaactgctgcattggaaggcagggtctgcaaaatacctcaagcactgatcttaggatttacaagcgatgttattctcaggagcaatgtggggaggttcagactcttgcagccagaggctccgtggctccaaaaccataatttctaatcttgtaactaatttgttagtcctacaaaggcagactgstccccaggcaagaagggggtttatttcaggaaagagctgttatcctttgtttcaaagttgaactataggccgggcagggtggctcacgcctgtaatcccagcactttgggaggctgaggcaggccgatcacttgaggccgggagtttgagaccagcctggtcaacagggtgaaaccccgcctctactaaaagtacaaaaattagccaggtgtggtggtgcacacctgtaatcccagctactcgggaggctgaggcaggagaatcacttgaacctgggaggcagagattccagtgagccga

SEQ ID NO: 187649 - DNA, 601 bp, Human
ggtgatggggacacagattggagcactcaactcaggcacaggaccccagcagaacatgcccaggtcctcctagacatgggcccttgcagactttctgaggcctcggtttcgtcatcttaccaaggtgtgaccccaaccatcatctcctgaacttctggccacagagctctgagcaagcttccatcatgaccccattttggagatggggagttggcgcagccacactgctgctcagtggtagaaccagcatctgacccaggccacctgttccagagaccctgcttttagccagcagctcagwccccagtcatgtggggccatttatttatttatttaagatagagtctccctttgtcgcccaggctggagtgcagtggtgcgatctcggcttactgcaacttccacctcccgagttcaagcaattctcctgcctcagcctcccgagcagctgggatttcagacgtgcgccaccatgcccagctaatttttgtattttaagtagaaatggagttttgctgtgttagccaggttggtctcaaattcctgacctcaagtgatccacccttctcagcctcccaaagtgctgggattacaggcatga

SEQ ID NO: 187650 - DNA, 601 bp, Human
attttggagatggggagttggcgcagccacactgctgctcagtggtagaaccagcatctgacccaggccacctgttccagagaccctgcttttagccagcagctcagtccccagtcatgtggggccatttatttatttatttaagatagagtctccctttgtcgcccaggctggagtgcagtggtgcgatctcggcttactgcaacttccacctcccgagttcaagcaattctcctgcctcagcctcccgagcagctgggatttcagacgtgcgccaccatgcccagctaatttttgtatyttaagtagaaatggagttttgctgtgttagccaggttggtctcaaattcctgacctcaagtgatccacccttctcagcctcccaaagtgctgggattacaggcatgagccaccatgcccggcccacgtggggctgtttaaattaaaatcaaattaactgagttcctccattgcattggccacgtttcaagtgtgcagagtgacacatggccagtggctgccatcaccgctgatgtcgccacgtccctcatcacaggaatatccctggcagccctgctcccggccctctgccctcctgacg

SEQ ID NO: 187651 - DNA, 601 bp, Human; identical to SEQ ID NO: 18485

SEQ ID NO: 187652 - DNA, 601 bp, Human
tgggattacaggtgggagccactacgcctggcccacatagctcatttttagactcacttccattaagtcttgtttggacccacgaacattgtctttttttttttaagatggagtttcacttttgttgcccagactgtagtgcaatggtgcaatctcagctcactgcaatctctgcctcctgggttctagcaattctcctgcctcagcctcccgagtagctggaattacaggcgcccgccaccacgcccagctaatttttgtgtttttagtagagacggggtttcaccatgttgggcaggcmaggggtgatccgcccacctcagcctcccaaagtgctgggattacaggtgtgagccaccgcatctggccaacatgtcttttttttttttttcctttttaaccacaaagagacttaagcagtccttgtcacagatgatgaattgatgttgcaagtattgtcttagcttggattaattttcttgcttactgtaattttagataatatagctttgtaattagagattttatgtgtaaaccacaaaaatgtttacatgaaggccattattacagatgtgacgtgcataattattagtaatttgta

SEQ ID NO: 187653 - DNA, 601 bp, Human
atgtgatttgaaaggtaatttagtattgaatagcatgtgagctagagtatttcattctttctggtttatttcttcaaatagactttgaatataatggtgaatgggtattataaattaactaataaaaatgacattgaaaatgaaaaaatatatatattaaagtgtagaaagtgaccaggcgtggtggctcacacctgtaatccaagcaccttgggaggctgaggcaggaggatctcttgatcccaggagttcaagaccagcctgggcaacatagcgagacttcgtctctaaaaaaaaaaaaagagagaaaaaaattttttttatttaaaaaaagtgtagaaagtgtcaagaccccacttcttaccattatttggtatatttctctatacccacccacccttcctccttactccctccctcccttcccaatctttttatctttttgtattctgattttttgtttgtatattttgctttaatttaatgtatcctttaaaaatttcccatacattttatatgtatatataaaaacgcatgctgccaaagataatttataagaaagaccattgaatttttttaaaagtgatatatattcattgaa

SEQ ID NO: 187654 - DNA, 601 bp, Human
gtagggtattgctgtgtcacccaggctggagtgcagtggtgtgatctcggctcactgcaacctccacctcccgggctcaggtgatcctcctgcttcagcctccccagtaactgggactacaggcgcgtgccacatgcctggctaattttgtatttttagtagagatggggtttcaccatgttggccaggctggtctctaactcctgacctcaggtgatacgcccacctgggcctcccaaaatactgggattacaggcatgagccgctgcatcagccagcagtttttcttgtggttttttttgtttgttttgttttgttttgtttttgagatagggtcttactctgttgtccacgctggagtgctgtggtatgatcgtagctcactgcagcctcaaactcctgggctcaagtgattccttctgcctccgcctcccgagtagctgggactacaggtatgcaccaccatacctggcaaatttttacaaagttttttgtagggacggggtcttgctacattccccatgtcggtcttgaactcctggcctcaagcaactctcctgtctcagcctcccaaagcactgggattacaagtgtgagccac

SEQ ID NO: 187655 - DNA, 601 bp, Human
acatttacttttaatataacatttatgacttttctaacttagtatgcaccatcctaaaggtaagccagggagagaaattcctctgcatcagttttaatggtgggcttgtgttctaaaggagtgagattggttttttgtaaagactacttagtaatttgtttttaccaataatggaatggtatacttcctacctctctttttttagtttgaagtattttctttctaaacataactctctctctctatttatctatatataatatatacatatatatcttatattttatgtatatatatataacttgcttagattttgtcttatgtaatatttggtacataaaaaataatatttataatttatagactattttccatgtgttattatgtgctaaagtattttgtatcttagcaccgagaggctaagcagtttcctagggttaccagctagtaaactaagggaaacctttacttcctttagctcagtggttctcaaaatgtggttccctagaccaaaagtattaatatcagacaagaacctaccgaatcaaaatatctgtgatgaggcccagcaagctatgctttaacaagtttccgagtgatt

SEQ ID NO: 187656 - DNA, 601 bp, Human
gaagtcccatggatgtgtttatgaacatggttgaggaagatttaggaagactgcaacagtacactacctaaagcaggttttttactccatctttttttgccacgtacactggcctcccactttgatatgcttgaaattatctccttgatttgtctttcaaaactacatattgaggctggttgcggtggctcacacctgtaatcctagcactttgggaggccaagccggacagatcacttgaggtcaggagttcgagaccagcctggcaaacatgatgaaaccccacctttactaaaaatayaaaaattagccaggcgtagtggtgtgtgcctgtaacccagctacctgggaggctgaggcaggagaatcactggaacccgggaggcagaggctacagtgagccaacatcacgccactgcactccagcctgggtgacagagcaagactctgtctcaaaacaaaacaaaaaacaaaaaactacgtattaagacaagaaacagactgggcgcggtggctcacgcctgtaatcccagcactttgggaggctgaggcgggcggatcacaaggtcaggagatcgagaccatcctggctaacacggtg

SEQ ID NO: 187657 - DNA, 601 bp, Human
agtcccatggatgtgtttatgaacatggttgaggaagatttaggaagactgcaacagtacactacctaaagcaggttttttactccatctttttttgccacgtacactggcctcccactttgatatgcttgaaattatctccttgatttgtctttcaaaactacatattgaggctggttgcggtggctcacacctgtaatcctagcactttgggaggccaagccggacagatcacttgaggtcaggagttcgagaccagcctggcaaacatgatgaaaccccacctttactaaaaatacamaaattagccaggcgtagtggtgtgtgcctgtaacccagctacctgggaggctgaggcaggagaatcactggaacccgggaggcagaggctacagtgagccaacatcacgccactgcactccagcctgggtgacagagcaagactctgtctcaaaacaaaacaaaaaacaaaaaactacgtattaagacaagaaacagactgggcgcggtggctcacgcctgtaatcccagcactttgggaggctgaggcgggcggatcacaaggtcaggagatcgagaccatcctggctaacacggtgaa

SEQ ID NO: 187658 - DNA, 601 bp, Human
aagtctgtgaatttgccctttgacatgcctaatggcttaatgccttctctagtcccaccatgcccctaccctggatcaggccttcaatacctcagccctaaagtattgcaactgcctcctaattgacccctctagtgccagaatcgtcccctgaacacctgctgcactgtgaatatagaaaacacactgccttttctacgtcactcctatctggaaaaccatcaatggctatttcctatttctcatctttcttcagtcagagccagctttgaatgtagccttcaacaccagacagagaccsatctctacctaaatcctagtgctgccattacttgctgagtggccttagagaagtcactaggcttatctggccttccattttcttatctgtaaattggaaataacagttgtgcctacctctcaagtttgaccagcatttgcccacagagctcccaccttttctaggggtcactccaagcctcatcctttctttaagtctcagctgaagccttgcctcctccaggaggacttcttattcacagcagcaccccctctctgaatttccatagcacttgtggtctatagggaagaatttagcaga

SEQ ID NO: 187659 - DNA, 601 bp, Human
tcaagaaatgtgaccagtggttacttctgggaaggagtattgggtgtctggggcagaaaggttccccccatacccttttttactgttgttgttgttgttttttacaatgttcatgcattattttttcctgaattttattttgaaaaaattcaaacgtacaaatagatcaaagaagtagaacaatgaacatacatataaccaccaagattccacaattaacatttcaacatagttgctgtgtagttctgtttctatcagtcaatctatttacacacacacacacacacacacacacacacayatatatttgaaggtcacaggcatcataacacattcccactaaattcttcagaatgactctttaaagaataagaagattctccctcctaaccacaatatattatcacagctaagaaaataaacaataattcctaatataatctaatttccaatccatattcaaattgccccaatattccccaaatgtctttcatagctttgtaaaatccagaatccaaaaccaaggtttgtgtattgcatctacttatgtccctttagtgtcgtttaatctagaacagtgcatgctcctaatttttgtgtg

SEQ ID NO: 187660 - DNA, 601 bp, Human
aaccaaacatctgctagaataaggtttcagttttcactgcaggaaaactgtgttgtgtaaagaaaaatagagatacacccttgggcagttttttgggggtaacctagcaacccatcgaaatcaagagatttttgaaggatactgcaaagtagaatcaggtctgactgttcagtgttatgattttaagggcactgagtacagatagcaccccacccctcacccccagcaccctgcctggaatttcagcttttaaaaattcattccttttatttgaaagaccttatgtgtcttctggagtcaygtgttgaagagtaaaatacgcctgggaggaatatcacctaaaaccctatcagctgataacagctatctcttcagtgaagatggagagcctgggatgggacaaaatgatctctgggaatagcaggaataggatgcctgagtgacaagaggggacaagggaatgaaagggaaaatggaagacatggctaacttaagataccataaacggaaggaacctcatagaccatctataccaatgccttttaaaaaaacatttaaaaaacgtggaggctgggtgctcacacctgtaatctcagcactt

SEQ ID NO: 187661 - DNA, 601 bp, Human
gctgctccaagctgaccagccctggtggaagccacggatggccctactcttgaaaaaggtcactctccacacttctgcagggagcacaaggaggctgatgttattattaagcccttaccaaatcctccttgagcaatcacccaacactccaaacaccaagattcttgagctgcaatcaggaatgtccctggagtgaattagttttggctggggcgtgggggttggattgagcaacgagctccaatctggggtctaggggtaactggagcatttgaaatttgttacccaataaaaatctctrctaaggctcaagactgaaataactcagctgggctctggactcagcagggaccattcattaactaacacttctcatctgtgatagttacagacaggttttttcatgccccccaaaacgggctttaacgttgcagctggcagacagctgtggcctcacagtgtttacattacccagactaatgcagtctgcgcaggagacacagaatgaatctgatttagcttttggaaaatgggattttgaaaagttccgtggttttctctcacccctcccttcctgagctgcagaaagactgaaggtgga

SEQ ID NO: 187662 - DNA, 601 bp, Human
gggacaaactaagtagatactggctgacttacttgagtctacagtcaaccttcttatagtggcccatgttatttcaaatagcaactgttagttccttgccaactagaggtcccattgttcttttacaaaaatattagataatccaaacccaagtcattccaacaccatttccccctggcctcttgtattttgagttgacaagttcttaccataatcttcaatagcattgttagtcctagcctgatatttcttcttctaagcccacttccagtgtttaagccctcatataaaaggtgcttakttgtaagtcatagatcctatgtggtggtcctatagaactttcttctttaaaaacctttttcatctgaaagtaagaggttgtgtggtacgttagaaggagcactgcatgcggagcccctagttccatcatctattgcctctccacctctccgatactcaattccctctatcagacaggtgacagtccttaccctgcctatctcacaggagcctcgaaagattcaaataagatagtgagtatacagataatgtattaagcgtagtgttagaaaatgagaactcataaccattatttcattta

SEQ ID NO: 187663 - DNA, 601 bp, Human
caggtgtaggtttagtgcaacgagctggttgtctgctctgcccaactctaggtcacacttgaacccctgggcttagaagcagctccatgggtgctatggtttctcaggcctgtcagcctctggctcttggccttcttgcactcaagggactcaaagtcaaactccactccatcacctcaccgtacttgttctctcttcagccgagatgtaattgctccaatagcaaactagtttgcagaaatgctactctgcctccctggtagatgactttgtatatcttcctccttgcaaagccattttygcttcttgtaccacacctgatttcattagaaagtatttgctttaaatttgcagggagaagaaacttaagtagttctcacaaggatgttttgcacagtcattaagactacagttcaaaccccagctttccacctattagccaccttgccttaatcaagtccctcaacctctcttcccatcactttccttctctgtaaaatggaggacaacaatagtacctcacttttaaggacactgtgaagattaaatgagattatgtatgtaaagcgtttagcacagtgccggacacataggaagctct

SEQ ID NO: 187664 - DNA, 601 bp, Human
aacccaaaaatgaaaactttccagtgtgccagaaataacgagttaaaaactaccatgataaaaaggcacgagacacaaggcaggtgtaggtttagtgcaacgagctggttgtctgctctgcccaactctaggtcacacttgaacccctgggcttagaagcagctccatgggtgctatggtttctcaggcctgtcagcctctggctcttggccttcttgcactcaagggactcaaagtcaaactccactccatcacctcaccgtacttgttctctcttcagccgagatgtaattgctccaayagcaaactagtttgcagaaatgctactctgcctccctggtagatgactttgtatatcttcctccttgcaaagccatttttgcttcttgtaccacacctgatttcattagaaagtatttgctttaaatttgcagggagaagaaacttaagtagttctcacaaggatgttttgcacagtcattaagactacagttcaaaccccagctttccacctattagccaccttgccttaatcaagtccctcaacctctcttcccatcactttccttctctgtaaaatggaggacaacaatagtacctc

SEQ ID NO: 187665 - DNA, 601 bp, Human
catccttaaaattatgttattgaatacatctaggcatataagaaagttattaagtgaaaggacattacaaagaatgtatacagtgtcatctcatttttataaaaatgtaatttatgtatgagagatattgtatagtactttacagctcaggatctgaaggtaggcctatttttaaatctgtgcactatcacttattagctgtctgacctagagtaatttctaaacctctctgagtgccttagtttctttatctgtaaagtggatatagatatatagattatatatatagatatatatatayacacacacacatacatatacatatacatatgtatatatgcatatacacatatgtatatatatgcatatatacatatgtatatatatatgcatatatatttgcaatgatatgcttgcatatctagaaacccaagaggtgtaactgaattaaaatttcgcaaaagaatgaataagagttcaatgcggtagttagatgcacagtggacaacccaaaaatgaaaactttccagtgtgccagaaataacgagttaaaaactaccatgataaaaaggcacgagacacaaggcaggtgtaggtttag

SEQ ID NO: 187666 - DNA, 601 bp, Human
gagtgcctggcacatagcaggtactcggtaattgtttgcggatttttcttaaagaatgaataaaatatattttctaacgtaattctgagagccatctgagaagcataaaccattcttctctaacactttcaaaatgtaggcaatcagttgaagtaaatggccagtgtcttagtctgctcaggccaccatagcaaaaatatatacaacagacattgatttctcccagttttggaagctggaaagtccaagatcaaggtgttgtccaattcagttcctggtgaaggccctcttcctgcctcaygtggcctttccttggtgcatctgggtgaagagaaagtgagggagttccaagctctggtcttttcctcttctataaagggcacaaatcccaacacggggaacccaccttcatgacctcatctaaatctaagtacctccctgaagccccacctccaaatgccatcacatttcgggttagagtttcagtatgtgaattttgaggagacaaagttcagttcatagtataagcatagcagcattaaatagacattgtgcatcagtggaagaaattttttttttttgagacagtctcgctctgtca

SEQ ID NO: 187667 - DNA, 601 bp, Human
cctggaaagcgcatgcacacatacagggaagccatctcatcctccctcttcaggtcatgggcccctcttatatctgttcatagctccttcacttcttcattagcaccacataacaactggaaataacatcactatttataagattatttgttcaatatctgccttttccattagattgtaagctacacgaaggcagggatcatgtctgccttggtcactgcttagaagagtgcctggcacatagcaggtactcggtaattgtttgcggatttttcttaaagaatgaataaaatatattttytaacgtaattctgagagccatctgagaagcataaaccattcttctctaacactttcaaaatgtaggcaatcagttgaagtaaatggccagtgtcttagtctgctcaggccaccatagcaaaaatatatacaacagacattgatttctcccagttttggaagctggaaagtccaagatcaaggtgttgtccaattcagttcctggtgaaggccctcttcctgcctcatgtggcctttccttggtgcatctgggtgaagagaaagtgagggagttccaagctctggtcttttcctcttctat

SEQ ID NO: 187668 - DNA, 601 bp, Human
taaaaagaaaaatagatgttggtgaggatgtggagaaaagggaatgcttatgtactgttggttagaatgtaaattagcacaacttaaggaaaacagtagggatagttctgaaagaacaaaaaatagaaatgtcatttgatccattctcaaagaactaaaattagaaatatcattcgatccaggagtcccactactgggtatctacctacagggaaataaatcattatatgacaaagatacttgcactcatgtttatcactgcactattcacaatagcaaagataatggaaccaacctaagygtccatcagtggtggattggataaagaaaatatggtagctatacatcatggaacactacccagccataaaaaagaatgaaatcatgtgttttgcagaaaattgcctattgtgtacaatgttcactattcgagtgatgagtacatcaaaagcccaaactccaccatggtacaatatatgcatgtaggaagtctgcacttgtaccctctacatctgtacaaaatattttaaaatatagcttcaagatgtaattaaagtcacatatcagctgattttgagttaataaaaaagacagatgatca

SEQ ID NO: 187669 - DNA, 601 bp, Human
ttcatgtttcttcctgggttggccaatagaaagtggtatttgtggccgggcatggtggctcacgcttgtaatcccagcactttgggaagccgaggcgggtggatcacgaggtcaagagatcaagaccatcctggccaatatggtgaaaccctgtctctactagagatacaaaaaaattagctgggtgtggtggcatgcacctgtagtcccagctactcaggaggctgaggcaggagaatcgcttgatcctgggaggcggaggctgcagtgagccaaaatcgcaccactgcactccagcccrggtgacagagtgagactccatctcaaaaaaaaaaaaaagttgtatttgtgtagtttttctaactgtagtgatgtgcgtgtgctgaattactcacttggattctcctccttgagagtagggttcattttgtcactaatctggctagattgcttatcataatgcttaaaaatatagctttaaacatacaagtggccaataaacatgtgaaaaaaacactcaacatcactaatcagagaaacacaaattaaaaccacaatgagataccatcttacaccagtcagaatggctataattaaaaag

SEQ ID NO: 187670 - DNA, 601 bp, Human
acttggaatgacagttaattggcaacagagctaggactagagctcagggctcctcatggctctttctgttgcaccacacagcttctcctaggcctaatggaatcagtcctgggcaccagggctgacaaaaattcccttggacaacaccaggggtgtaattcacatgctgaaatggtttcattggcctgggagatgagtcagaattttggaagtggtccctgacataagcatgtatgatgcaataccataggcattccaaagttgatcaaggctatgttaaaattccaattttaggattccrttccctaataattgtccaataagctgcccttggcagctactgccagcctactgacttccccttttgtgtgacaggaatcccactactcagaaatatcaccattcacattctgatgtaaaacaatgggctcatccgttttttctcatcagcctttcatctctagggcctctcagcttgtggcatgattcactgaaatacatcaaacatgacagaagatgcaagcatttggaaacttacatcagccatcatcaaattaaaaaggtatcttgatatgatttagcaatcatccttggaagagag

SEQ ID NO: 187671 - DNA, 601 bp, Human
ctttgttgaaatggggtcttcctatgttgcccaggctggtctggaacttctgacctcaagcaatcctcccacctcagcctccagagtagctgggactacatgtgcatgtcaccagacctggctaattttttaaattttttgtataatgaggttttgccacgttgcccaggctggtcttgaacacctaggcttaagtgagccacccaccttggcctcccaaagtggtgggattacaggcatgagccactgtaccccacccctcagagcatttaaatctgaaatggcttctgggctttatttmatttttctaaaaactgaccactgccgtaaccatccacatgtcatctgaagagttgacactgagttcaagagtttgaggctacagtgagctatgatcagcccaccgcactctagcatgggcaacagagtgagacccgatctcattttttttttttttaaggatgaagatttgacactagttggagaaatggttctacatctcattactaggattttatgaatgtcagccctctagcataagtagtagttacttctttcaaattaaaaaaatttggattttaaagtaagataagctcattac

SEQ ID NO: 187672 - DNA, 601 bp, Human
tccaagtgtcgtgggagggacctggtgggaggtaattgaatcatgggggtgcctacactcatgctgttctcgtgatagtgagtgagttcttacaggatctgatggttttataagaggcttttctctcttttactcagcacttctctctcctgccaccacatgaagaaagacatgtttgcttccccttccgccatgagtgtaagtttcctgaggcctccccagccatgtggaactgtgagtcaattaaacctttttcctttataaattacccaggcttgggtatttctgcagagcagcatgmgaacagactaatatatctgccttctatgattgggtttttcccccagcagagcccaacagtttatatcacgtgaagctaagaatctaggggagggagagttgtacatgttatgtctcaatcttttcagacttcctaagtttttctatcttttgagcatttgcatttttcatgtttgaatcagaaaagcctccattttggctgactctagcccttcactctggggagtagaatgggcaggtagccattagtacacaggaagggagggatttgtggtatcttaaagccattggattttattta

SEQ ID NO: 187673 - DNA, 601 bp, Human
caagtgctaaactaaactgtgtgatgcagattaaaagtgctgtatgaagccagaagagaggcagcagtatggctgaagtggtcgagaagggttgtttttttaaggaggtagaggttgagtttccttgacaatatgttaggacctggcggtagtttttgaaggaaaaaattgacaggacttgttaacagactgtttgtgggggatgaaattcagtaaaaagcaaaacagactttggttcagatcctgggtgacagggagatgagggaaacaccatgagtttgactttgtacctgattagctygagctgttagcaaaacatccaagcacaagtacacagtaagtatttggaatatttggagctgaaggaaagattatactagaaaaacccatcttttcacttgagagtttccagaagatatgggaactatcacaacttagcagccaacaaatgatgtgagctaagatagttaataacccctctctgggctttagtttcctcatgtataaaatgaggtgcgatggtaggtggttttttatgagataacatttggattagcatagtatctggtatttggaaggagccctatacttgctggaatat

SEQ ID NO: 187674 - DNA, 601 bp, Human
agtatgtgcccagaactgcactgggtgtttaagaaactatgaagaaagatgtggcctcgactctcagggtatttaatgtctatatgggaaaacaagaaaagtgaattctccatttcagggtgtagaatatagtagacactcaatacatgcttgttgcatgagtgaatgctgctgagcacatgctaattgcccctgaatgacaagtgctaaactaaactgtgtgatgcagattaaaagtgctgtatgaagccagaagagaggcagcagtatggctgaagtggtcgagaagggttgtttttttaaggaggtagaggttgagtttccttgacaatatgttaggacctggcggtagtttttgaaggaaaaaattgacaggacttgttaacagactgtttgtgggggatgaaattcagtaaaaagcaaaacagactttggttcagatcctgggtgacagggagatgagggaaacaccatgagtttgactttgtacctgattagctcgagctgttagcaaaacatccaagcacaagtacacagtaagtatttggaatatttggagctgaaggaaagattatactagaaaaacccatcttttcacttg

SEQ ID NO: 187675 - DNA, 601 bp, Human
tgttatttttttccagtctatttgctctctgcataatttctgttgttatatactcaagttcaccgatttttttcctttgtcccctccattctgttgttcaccctattcactgagattttcattttggttattgtgtttttcagttctaaagtctacatttggttctttatgtattcttatttgcttactgagactttccgtttttatttgttccaagcatgtttgtaattgctcattgaagcatttttatgatagctgtttcaaaatctttgtcagataattctatctcatcatcttagtrttggcatgaattgactgtctttttcactcagtttgaaatcttcctggttcttggtatgatgaatgattttcaactgaatactgttcattttggatattatgtcatgagactctggatcttatttaaaccttaggttttagtggtttttttctgacattgctctagtagaaaaaactggaagggttgccttgttactgccaaattggggtagaagttcaggctcaccactcagcctttgcatggacagttggaggtgagggttgcagtttttcctgtggtgtttggctatagtagagcagt

SEQ ID NO: 187676 - DNA, 601 bp, Human
ggtgggttgagccatttatatatataatatatatataatgtgtgtatatatatatatatatctgataatttctttctctgaagtctatctgatattaatatagacactcatgctttgttttgactaatgcttgtatgataaatatgtttccttccttttactttcagttgtcttatatcattatatttaaggtgagtttcttgtagagtacatactgtcgggtcattttttcttatccactctgccagtctctgtcttctaattggtgtatttagaccttatatacattaaatgtaattgktgatatgttaggatctaagtctgccattttatttttaattttgttttctttttcctgccttcctatgagtatttgaatattttggggaatattgtaacattttgatttatctgtagtggttttgagtgtatatctttgtatagattctgagtggctctaggtattacattgtatatacataacttatcacagtctgctggtaatgttattttgccagtatgagtgaagtataaaaaccttacttctgttaatgtctctttatctccctagtttatgatataaccaacttaaatatttcct

SEQ ID NO: 187677 - DNA, 601 bp, Human
tagaaatacaattgtatgcttatcttttgtttatgcatgtatctcctgaccttgctgaactcatttatttgttttaggagtttaaaaaaaatagttttcttgctattctctatacagaccatcatgtcatctgaaaataagaaaatgttctttcttcctttctaatctgtatgccttttatttccttttctggactttctgtactagctagaatgtccagcactatgatgaataagagtagtgaaagtgcacatccttgcctttttcctgatctaagggtgaaaacaatcagtttttcacyattaagtaaaatgttagttgtaggggtttttttgcagatgctgtttatcaagttgaggaaattcctctctattccctgtttgctgagagattttatcatgaatggatgctgaattttgtcatttttttggcatcaaatgatataatcatgtgatttttcttctttagctgttaatatggtggttcacactgattgatttttaaatattgaaccagacttgcatacacggaataaacctctcttggtcatggtgtataattccttcatattgctgaagtctgtttgctaatattttgttat

SEQ ID NO: 187678 - DNA, 601 bp, Human
cctctgcctcccaggttgaagcgattttcccaccagcctcctgggtagctgggactacaggctcaagccaggacgcccagctaattttttgtatttttagtagagaccgggtttcaccatgttggccaggctggtctcgaactcctgacctcaagtgatccaccctccccccccaccccaccccttagcttttcacagtgctgggattacaggcatgagccaccacacctggccagaagagacattttaacatcagttgtcagatacagagttggggctgcagatggggaagacagcacaygtcgagagaatggccaagaccagcactacagagctggagcccaggtcagcacaatcctcttcatgcaactctgtgttatcttcctttcttccctgctattttccttatgccactaccaaccatcaccctttcccctcattcgagcacagctcaggtaggtctctatctttcatctttgaaaatgaatcaatacaggcaaaaatctcattgcatgaaaatctgtcatcttggaaatgtgtgtgtgtgtgtgtacacatacacatgtgtgaatatgtgtgtcttgcaggtatgggataataa

SEQ ID NO: 187679 - DNA, 601 bp, Human
gactatggctctaaaacacttgggtgattctgcttcagtgtctgatggctgagtttttaggagaggggacagaatcaactttaaaactgagcaaaccaaagcatagaggggctgtgggagcaatttcccatgcatgactcggggaagctgagagaagctctaagatggtatgtggcagtgagagacagggacaaatctttcctgaaaacaacaagaggaagaatggagtgttctcaggctttcacacaagacttgtgtcacaagttggagaggggagacccagatagactccagctgagcrgtggtttgtgctttcccggaaagctgaggcctctagaacttaggacagtgagggcagatgctcatccctaggaggacacccacatccaagaagagcagataattcctgtattccaagagctctgtgcacttctttatgaacctgccctgcttccaccaaacatagctatttctcaggccaagccaccagttctaaaattgatcgctctgcatttacgctgggtataaatagatatagatgggccgtttaatttcccacgtggctaccttccgccaattggagcacccttgggagtagaag

SEQ ID NO: 187680 - DNA, 601 bp, Human
caatggaaatggtctttctttcttccttttttttttttttttttttttaaaaaaggggttttgctctttgcccaggctggagtttattcgttcaatcacagttaattgcagcctcatctcctgggctcaagtgatcctcctgcctcagcctcctgagtagctgggatcgcctggctactttttttttgaggaaatggtctttctaagcagcatggtctctgaaagcctgaactgggggttcatgtgatgcctgtctttggggaatttacaggagagctgatcaagagagataacaggaggragttatctactggggtggggctggggaaatctctagacaaaagatatccaaattaaagcaaatttcttgcaccgaatttaaaaggttggggctctgatccttggaactgcagtctatggaggccctgtcacagttatagggcaaatgttcaaagtagaaatactttctatttcacctagaaagtagtagtagtgatgactttaaaaatatatatttatgcttctttgcaatgtcttaagtgattacagaaaccaggggttctaaaaagcttgtttaaacgtgtatggattacatatggca

SEQ ID NO: 187681 - DNA, 601 bp, Human
gctaacttcacgtctgtttgagtgtccccgagcctgaatgttcccaaaagtgctttgcagttgaccccatatccacatatgatagagtattgtactggtaaatatcactatacacttctctgatctggactttctatataacgaagatttgactttgggtgtgatagctccttatactagcaatatcaaaaaacataacaattttttaaaaactagctggatgtggtggtgcgcacctgttgtcccagctacttggcaggaggattgcttgagcccagagtgagaccctgtctccaaaaamaaacaaacaaaaaaaaaagagcaagaacagggtgttgagccgggcgcagtggctcacgcctgtaatcccagcactttaggaggccaaggcgggtagatcatgaggtcaggagattgagaccatcctggctaacacagtgaaaccccgtctctattaaaaatacaaaaaattagccaggcgtggtggcacgtgcctgtagtcccagctacttgggaagctgaggcaggagaattgcttgaacccaggaggcagaggttgcagtgagctgagatggcgccactgcactccagcgtgggcgac

SEQ ID NO: 187682 - DNA, 601 bp, Human
gggagtgtgggacggggtgttctgggatcacggagacgtccaagtctggactctgtcctgggtctgtgcttctggcgacctcccttttcttcagtgggatgcggggtgcaggggccggttccagggtcccctgagctcaagttctcgccccaccccgccccgcaagtctagaaaagatgcccctgcccttggctgggtaatctctggatttacctacttctgtaaccccccgggctgaagagaccaccccccgggattcaattaacttactctctggagcgcgcgttcctccctgctcccrggagtcggtttcccagaactttctgaggcccgcgcatgctcccctcgactccccgtgtttccactctccacagaaatccacgcattcacgcccctcccctcccccgagcctgcagaggactccgccctgctttccctacattcagggctgctccttttgtcgccaatacagacctgttgacaggtcacgcctgggaagcgggtggggtgtcccggagcggtgctgaggcgctgcaggcccggcttctggctgcgggggagctgtaccctgaagcctcgccggaactcgcgtctggggcca

SEQ ID NO: 187683 - DNA, 601 bp, Human
aggggtggggatgggtgaatacgtgatggctgcggcctttcccaccagacagtagggtgggggcagggtggaaaaagggggtgcggtgggcgaatggggaggcggggggctgactgggagtgtgggacggggtgttctgggatcacggagacgtccaagtctggactctgtcctgggtctgtgcttctggcgacctcccttttcttcagtgggatgcggggtgcaggggccggttccagggtcccctgagctcaagttctcgccccaccccgccccgcaagtctagaaaagatgcccctgsccttggctgggtaatctctggatttacctacttctgtaaccccccgggctgaagagaccaccccccgggattcaattaacttactctctggagcgcgcgttcctccctgctcccaggagtcggtttcccagaactttctgaggcccgcgcatgctcccctcgactccccgtgtttccactctccacagaaatccacgcattcacgcccctcccctcccccgagcctgcagaggactccgccctgctttccctacattcagggctgctccttttgtcgccaatacagacctgttgacaggt

SEQ ID NO: 187684 - DNA, 601 bp, Human
tgcctcttcgtctactgtgagggacctcaggatgcagctcccatctggctcgagtgacaaggacagaggggaacagggcttctctgagcacctcagacagctcaggggaccttcttacccacaaacgccttcgttccattttgaagcgacttaggctggcctcaggacctccaacgcttggatttctaggtctcagtcacttgttgccacgcacgtctgagagtaataatcaaaatgctccaaaaagaagaatacatgtataatatttacgaagcaacggcctcctgtgaaaacctccgcraatactgctgaggaaactgacaactggcgactcaatcccgccctttcagtgcaaatctctggctccaaacctgagcaccagtgtttcctgggctgaaccagggggcaggaggaacaacagaccatgtggttggtcacaagtgacccctgtggtcaaggaccctgactacggtcttgcagcgacatttctgcctctgctcccgccttcctaggacgcctacgccactgcctgggccgtccccaacccccagcaccttcagaggggccgagtcccagagcatccaccgcattacaaatgcgc

SEQ ID NO: 187685 - DNA, 601 bp, Human
aagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccagctaactttctgtayttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggcttctctgagcacctc

SEQ ID NO: 187686 - DNA, 601 bp, Human
tttctatttttagtaaagacaggatttcaccattttggccaggctagtctcgaactcctgacctcaggtgatctgcccacctcggcctcccatggtactgggattgggattacatgcatgagccaccatgcctggcctagggttaatttttatttttggagacggagtctcgctctgtcgccaggctggagtgcagtggcatgatcttggcttactgcaaccttcgcctcctgggttcaagcgattctcctgcctcagccacttgagtagctgggactacaggtgcatgccaccacgcccrgctaactttctgtacttttagtagacgcggggtttcacagtgttagccaggaatggtctcaatctcctgacctggtgatccgcccgcctcagcctcccaaagtgctgggattacaggcatgagccaccgtgcccgaccctagggttgactctcatacaaagacagcacgggaagtgaaatgctcttttgtggaaatgaccagaaacaataaaagcggctcctgcctcttcgtctactgtgagggacctcaggatgcagctcccatctggctcgagtgacaaggacagaggggaacagggc

SEQ ID NO: 187687 - DNA, 601 bp, Human
aattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccaagcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttarggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggcactggaggaagcagcaccaggggcacatttgcacaaaggtgctgtccttcctcccagtataagggagaagtgaaaagactggggcccagcatgactcctagggtccagacatgaattggggagatatttctgcatgtcctgtctac

SEQ ID NO: 187688 - DNA, 601 bp, Human
ttttcaccctcaacacctaatggcctttgtgaaaaccgggttaaactacaatttgttctacatttcctttaattcccaggcaatcatcttcactcatcagctgcgggagactgagattagtaataaaggtcattgtcaatgtccctaattatcaagcagctactgggcacagcaaaggccgcagcagctctcattcattacctcaaatagccttcacagagaatctaaagttcactgtcattttcatttttagtcttgtaagtccctgactctgtctggggaagaacctgctcagctccargcaagcaggaattggtagcccttatgtgaggagtttagaaagagtttcatttccctccctatcaaacaatctaagtgttagaaagggctgataagcttcacataaaccatggaaaaacaggaaaactgagtaagtccaacagttaaggaagcttccatgggatccccgcttccaggagatccaagggaggaggaggaaccgcgatcaagtgtgagttgtgtaatctctgagctgtgcaatctccctgtgaggcagtgacactcctctgtccagcttcacactgccagtttgtccagtggc

SEQ ID NO: 187689 - DNA, 601 bp, Human
cttgtagttaaaatggaatattttttaaccttgtagttaaaaaaaagcctaactagtaaatcactgatttaaaaaatcataaatgatgcaaattataattgcttgccacatactatttaaattgtaataaagtaaaattcaaagtagatgtcttttattttccaaaaaaaaaaaaaaagccgtttaagaaattatttttaacatatacaaaatggcagaaatcaaaatgtttgggattcaatataaataataaatgttccaggtaatggttatactaattaccataatttgatcattacayactatatatgcataaactgaaatttcacatgtaccctataaatatgtacaattattgtgtatcaattaagaaatcaatccaataaccaaataaaaatgtttgggattaaggcaaaactacatttagagacaagaacaaagcctgttcctttgtaaggaaagaaaaaggaaaaccatctaagcagcattggccctcatggcccgtggagaccctgaggtgacagtagaaggaggcagtggccatagcctgaggctcccgactcaccagacccagctgtggtgcagaagccatctgcccaga

SEQ ID NO: 187690 - DNA, 601 bp, Human
cctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaaaaacattctgagacatgtattttaagtgygtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtatacaatacattattaactacagttaccatctt

SEQ ID NO: 187691 - DNA, 601 bp, Human
acccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaataaaaaaamaacattctgagacatgtattttaagtgcgtctcttttacgtatattaagagttactactttgacatggaaatcagcggagcaaacacttcacagtaaaacaaagcctggttcttttctcccaaaacattagttttaaaatggagaaataaaaattgtgtatatttatggtgtacaatatgatgctctgaaatatgtatacattgtagaataggtaccttaagctaattaacatacatatgatctcacatatgtgtggtgagaacacttgaaatatactcttagcaattttcatgtataca

SEQ ID NO: 187692 - DNA, 601 bp, Human
agtctccgtgggcttgtccacacactcatgctgatgtatcggctctgaatggaaccctgaggaaacatacagggaacaaggcatccctttcagcccaagcataagcaactctatcttttcctcacccttctgagggaccaacttagggccaaagtcactgtgctagcaacagcaggggagttctcagtttaccccgattccactctgcactcggtggccacaaagccacagctctgctggcaccaggatgaacatctcatcaagtgtagaggaggggacaggacggccactggcaccatcytgtatctacccactactctatttaattctagtccccctgggaagtgagaactaaggagcctgagggctgaccctgctcattttgggaaaaagtttctgatgatcactcaaaggcaattcaaatgggagtgtcacatagcccaggacagcatccttctctgctccaacaaataagccagatgggaaagatgaggaacacacacacaatgcacaatggatgccattatgtttcactaaaaaattttaaatgagaaactacagaagcagcacaacagtattacatagcaattggaagtacaat

SEQ ID NO: 187693 - DNA, 601 bp, Human
tcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagaggaggagtctacgcagattaatcatctggcccaggtaaggrgaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctctgtgctcaaaccatctacttttcgcttctttgtcatgggc

SEQ ID NO: 187694 - DNA, 601 bp, Human
acagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgcatggatgtgggagagraggagtctacgcagattaatcatctggcccaggtaaggagaaaatttcgccaaggtgggtagcttccaggtacaagtcacttccaaatcttcaatagagtccagctgcaccattttcaggatcatcttgatatcctgcatgggcattgcaaaaatcttcagcttcttacagcacaggcgtagtacatttttctttcgcttcactttctcaatgaggtaggagaacaattcatcacaggcaccttccttgaggaacaggtctacgagcacctctactggaatgaagggctgctctgcctct

SEQ ID NO: 187695 - DNA, 601 bp, Human
attctaaatcaccctttacagacaggaaatttgaggcaggtttagagggagcagctcatgttgagaagctggtgagcgcacagcttacaatttcaaatctcacctttgatgggctttcccttcttcaatgccctccttgcttacttttgatcatcttaggcatcacttcctaaggaagaatgcctaaagccacccttgccaggccccaacctcccattacagagttttctaacaaggagtcactgttaatagcatctatcctaatgtatacctctaacccttatgagtagtagttatgtgrtaccatgcttggggacagtggtgaacaagacgtgttaactggtagtgacttgctcactcttgcattattggtggctggcacatacaagatatcctttattgtttactgcaataaggaagggcttgctctggtctgcagagaaatctcaccatccctcacctgagcaactgatccaggcggcctctaaggaaaaataaagagtccacatagagagcctgcaggcactgcagactgaggaactgagaggtgaactgggcgatatactgctcttccttctccggggaaatgtaggaagatgca

SEQ ID NO: 187696 - DNA, 601 bp, Human
aagcttaaggttgtaagctgggagcagtggctcagggaaggcaggagggcaaggagctgatcatccgtgatcccacactcatcaaagaccaggtcctggagggtggcagaggctctctccagcagagcttggaggggctcgggacttacatcggtcagcatgaccccacttagactcaggacacttagctgactgacgctgggactctgggacagatgcatcacatccccttccgaaagccggcagttagttattgagagggtttccaaggggttcatcacgtgcctgcaaatagacaaakcagttagtgctggggaatggtggtagtggggtggggagactggagagaggcccatttcaccaaaacccaaagtcttcctgatgatggttaaccgccaggatgccatgctgtaaaggagcattcaaggagtacaagttcaggtttagtcctttctccatcatttgctgtgtaagtgggtcaagtaaacaaagatctcaaacactcccttggctgatctgtgaggcagggtccaacacagacctcttaggtggtgtgagcatgaattgaattgagagcctgatttgatgtctcaagcaagga

SEQ ID NO: 187697 - DNA, 601 bp, Human
ccgccctgtgccgcgattgcggccccggccccgaagacccaagtctcttcagattgtgcggggcccacgcgagggtcatggggtgggggaaatcctgacttgtgcgtggaaggagctgtggtgtatgaggttcccagttccttttctctccacagaggacacccgtttttccctgagttttctaagtgtatgggatgcagggtcccaaatcctcactctgtcccccagcctgctgtttccagggcttgcagtaaatccccaaatttcctgttctcttttcgcttttccaaacgccaacctytccccttccattcacgacattagcaaccgtttctcctatattctacatttcagatattgtgctttcattgtttatttttcaacaaagcaatggattactctttcatcaaggtttgttttctgttcatagccttgacactccgctgtaagaaacctttgtgcttgtccttttgtctcctctatgcacagatacctcatcagaatgtctttgagttgaggttcccctttggaatctttacagggtgatatgccttcagcgccccctcctatttattttttcctggttctgggtttcaaaact

SEQ ID NO: 187698 - DNA, 601 bp, Human
ggtcactgagcatttcagtgagcactatgggggtagagggatgttccaactgatagataagatgacctctgctgacactggagtcagacgaatgtctgtattccaggtcagcactgcttctccctgggattcttgccttaacaacaagttcagcttgagtatttcatttagttgaaagtgcattttatcagtagagcttcatagagaagataatgtatttcccaagaggtagatttcagggggaaagagattagtcttatattccacattttaaaaattcttattttcaacggcttgtatytgtatttctccatattttggagtaattatctgcatgatatgtgtaggtgctgtggctttttacctaagaagcagaatctcattccagtacatttgagagtcatgatgccaaatctttgatggtctgtgtcagagacacaaagtctacaatgtgtgtgttcacagtggtgtggattttatgcctcaagtcacttagaaaagtgtcttagaaaacctggacagtgcccttgtgtcttcacaataattcttttgtgtatttatggagatgattctgtaatcttttgggacatggaccaatgtg

SEQ ID NO: 187699 - DNA, 601 bp, Human
ggaagtggaagttgcagtgagttgagatcatgctattgtgctccagcctgggtgacagagcaagactccgtctcaaaaaaaaaaagaaaaaaaatttaaactgcttaacaacaaattcttattttcttttattctttcccagatcatgtgtagtatatgtgtagtatgtttgtcagatctgtgttctgttgggtgacttgaaatggaattccagggcttaaccttgagaatattatcagggaaaagaaatgggggtggggagaaccaactctcctattatggcttcagaaaaatgaatatrgtttcccaagaaagttagtagataaattggggaattacaaagattcaccaaaacatcaatttctcttgcaaggtggagaatttgtgacggtgaataactgttctgtttcctgttattggaacttagcagattctaaatcttagggaacaggacctggcaacaactaggaatcctctaataggatttttgtttactaaatgatttgttatcatagaaatagtagttaagtgacatctttgtctgaaaatagtagattcttgtgctttttctgttcagctatgatgtaaatgtgccttaatt

SEQ ID NO: 187700 - DNA, 601 bp, Human
acatcgacttggtgagtggttgctggtgagaattaagaccctggaggagggagcatttccacactgagaaggggacagtagggtgagtagtgctctgcggattatattttctaattactcaaatattcctcactcattgcctaggagaagccactctgagctacatctccacagtgagagtgtagtaaacttttgaatgtgggtaaaggtaaacaaataagccttgggcatttctggcatgtctccctaatttcatcctccttctctgtacccagaggtgaccacagtactgattctgaattttttttttttttttgagacggactctcgctctgttgcccaggctagagtgcaatggagcgatcttggctcactgcaagcccagcctcccgggttcatgcgattctcctgcctcagcctaccgagtagctgggacttacaggcgcccgccaccacacccggctaatttttttgtatttttatttttatttttattttttttgagacagagtctctctctgtcccccaggctggagtgcagtggcgtaatctcggctcactgcaagctctgcctcccgggttgacgccattctcctgcctc

SEQ ID NO: 187701 - DNA, 601 bp, Human
atgtatgcatgtgtatttactccttataagtagttctctttatttttctctgtgtgattacatgttgctttttacactaggattgagcattttttctgtgtggcctttcatcttctgtaaaatagttttcagtcatcttgtcacattaaagtcatttgtatatttattgcttcatttcttcccttttttctttttttaacttactctgtaggctaattctttttcatttatagggattgctaatattttgttccagggagtgatttatcttttcactccattctacattttgatggactcttaaatttttttgtttgttggcttttttggccgccttctgcatgcaccatcatcaagggtggggaagggtactcttcttgattttaattgagttgactttggctcttcctttcaggcctacttaattttcttgtaagagaacattctagagagtgtatatttagggcaacttgaatctgtgctcccaggttaaataaagaacactctccctactgtcaagttggaaaaaaaattgtaacttatgaaagtttgctactttttaaaattttaaaattttttattttctctctctctctttttt

SEQ ID NO: 187702 - DNA, 601 bp, Human
actcttaaatttttttgtttgttggcttttttggccgccttctgcatgcaccatcatcaagggtggggaagggtactcttcttgattttaattgagttgactttggctcttcctttcaggcctacttaattttcttgtaagagaacattctagagagtgtatatttagggcaacttgaatctgtgctcccaggttaaataaagaacactctccctactgtcaagttggaaaaaaaattgtaacttatgaaagtttgctactttttaaaattttaaaattttttattttctctctctctctytttttttttttttttggagacagagtctcgctctgccacccaggctggagtgcagtggcatgatgttggctcattgcagccttcgcctcctggcgtcaggtgtttccagtgcttcagccttccgagtagctgggatcgcaggtgtgagccaccatgcccggctaatttttgtagttttagtagagacagggttcctgacctcaagtgatctacttgccttggcctcccaacatgctgggattacagacgtgagccactgtgcctggctgcttttgtttttaagaggtttgtgtttttctg

SEQ ID NO: 187703 - DNA, 601 bp, Human
attagctgagcattgtggcatgtacctgtggtcccagctactcccagctgaggtgggaggatggcttgagcctgggaggcagaggttgcagtgagccaagattgtgccactgcactccaatgtgggtgtcagagtgagactcaatctcaaaaataaataaataataaaagttttaaattggattgttttcttgctattgagctgtttgaattctttatatattttggattttaacaccttatcagatatatggtttgcaagtattttctcccactccgtgtgttgcctgcctttccactcygttaattgtttcctttgctgtgctaaaaagctttttagtttgacatccacatccacaatggtgctgtcaaaaacagctacatgggaacttgtttatgtactctttctgcagtgtctggtttcacccagaactcttttgtgagattaagcaccttcctcatatcaggaagattgtgggtctttcctattattcacagctgaatccctgagttaggtttgattgtatgtgatcaaacatagtatgtattatttcctcaagcaacatttttggacatgtttcttagaaatagtttactaactg

SEQ ID NO: 187704 - DNA, 601 bp, Human
tataagaaggaaataagcactttgaaggaaagtaaatgatggtgtgagataatacggaagctgagggtgtgtgtatatgttctctgtggagggtggcaacatcagtgagtgaagaaatgtcaccatcggtcatttatatttccacctcttatacatcttcagcaccatttcaggaactgcttaagtgtggatgtagatagtgcatagcaatatagacagtcctgcctttttgaggttaacaataatgattccccgtaaagatataggtatggcttattgtcatttttgcattggttaaaarttttaatgcatgtaatatgtgatgctgactttggacatgggtatctggaacctggaggaaggcacaccactgcatacggtgtgtgctagaaccacgttggatccctgttgaaacatcttaagtgttctgccccttaagccacaggggcggagcctgaagttatatccagttaggggtgccaggatggcatcctacttattgtccaatcaggcgcgcctcagagccctgtctgcccccaacctcaccccaccctgtacgatcttgtggtgaattttcttttcttgagctggctgcattacc

SEQ ID NO: 187705 - DNA, 601 bp, Human
tcaggcgcgcctcagagccctgtctgcccccaacctcaccccaccctgtacgatcttgtggtgaattttcttttcttgagctggctgcattacctttcttctggctcctggctccactgccctggctctgtgctctgtgctggccgtggtagccggagggaggacccaggagaccccgaagatgggaaatggcgagtgtgggaaatggcaagtgtgcaggggcctggggtccgacatggctggaggggcccaggcctcctcgccatcagcatccgattctgtttcatctgagttgctcaartgtgtgggaagcagggtatcaaatccacccccggcctaactctccttgatctggcagcaaactgctaaattgtaggtataatttctgcagtccccaacaccagcttctgttctcggatgcacagtgttatcaactatttggtttttttgttttgttttgtttttgcatttgtttttgtttttttttttttggtggagtctcattctgtcgccgaggctggaatgcagtggcgcaatctccactcactgcaatgtccgcctcctggattcaagcgattttcctgcctcagcctcctgagta

SEQ ID NO: 187706 - DNA, 601 bp, Human
tcccacctcagcctcctgagcagctagaaccataggtgcaggctacacgactggctaattttttgtagagatagggtttcaccatgttgcccaggctggtctcaatctcctgagctcaagtgatcctcctaccttggcctcccgaagtgctgggattttaggcgtgagccaccactcccagctccttttttgtgatttcaaatagaatcctagagtgtagccttgagaaggctacagggagaaaaagctcagagaaatagggagaatcactcttcattatggcttcacataactgaatctttctatctatctatctatctatctatctatctatctatctatctatctatgtttatcttgagacagggtcttcctcttttgcccaggttggagtgcattggcacccatcatagcttgctgcattctcatactcctggtctcaagcagtcctctcacctcagcctcctgagtagctgggactacaggcgtgcaccaccactgctggctaatttttaaatttttctgtagagatggaggttctcactgtgttgcctaaactgatgttgaattcctgggctcaaacaatccttctgcctcaacc

SEQ ID NO: 187707 - DNA, 601 bp, Human
tcaggcgtggtggcaggtgcctgtagtcccagctactcaggaggctgaggcaggagaatggcatgaacccgggaagcggagcttgcagtgagccgagatcacgccgctccagcctgggcaacagagagccagactccgtctaaaaaaaaaaaaaaaaaggtaaaaaatccttcattagtctcatttagtacttaattatatttgatctgcaggataggtacaagcttgcaagtattctctcttagtataataacagaagatgggcttaattttcccagtaaccaattgtgagaacacatgygaaatgcttcctggagtgtttctgggggctcatcaggtgggcactatgtgttgcgcgtgtaacaaattcccaaactctcagaaggtgggacgccagaaattttcatattttttccataaagagtttaggcaccgagctactcttacataggtcattgggctccttccccaaatccgtttcccagataccaggaatggatgtgatgcaggacaggtgcgccctaaaattggggcttatcccaggatggtttccagctttgcccagggaagaattcaagggcaggccagtggtgttagataa

SEQ ID NO: 187708 - DNA, 601 bp, Human; identical to SEQ ID NO: 27379

SEQ ID NO: 187709 - DNA, 601 bp, Human; identical to SEQ ID NO: 27380

SEQ ID NO: 187710 - DNA, 601 bp, Human; identical to SEQ ID NO: 27381

SEQ ID NO: 187711 - DNA, 601 bp, Human
gttccagggtctaaggctggggtgggcacacccctcccccatgcctgataatgaggagctatccccacctctcacacagttctacaacagtctacaccagttctcacagcagtctacaccagtttgccatttaaaagcaaactaccatcgcgaggcactttacagtctactgagcaatgcactgtttccatagccctttgctattcacaaagggagtttgctgccctgagccaccacggagggctctgtccagaaccccttgcctacttttgggaaacagtcctcccctcgtggcattttgttatagacctcaccctccaccacctgtgattgggtcaggagcagctaggccaatcagagaccttccctgggacttttgaacccttggtgggggcttgggcctcactcctttttttttttttagctttaaaattttattcatttatgtatttattcattcatttatttatttttagacacgaggtcttcttgttacgtcacacagactggagtacagtggtgtgattatagctcactgcaacctcaaattcctgggctcacgggatcctcctggctcagcttcctgagtagctgggaccat

SEQ ID NO: 187712 - DNA, 601 bp, Human
atgtagatacctttcgataacgacagacggatagatataacctacataaacaaaagtcctttgaggtcctgtttaagagcataagggagccctgttatcaaaaagttttgaggcagcactttgggagaccgaggcgggcagatcacgaggtcaggagtttgagcccagcctggtcaatatggtgaaacccccgtctctactaaaaagatcagccgggtgtggtggtgcgtgcctgtagtcccagctactcaggaaagctgaggcaggagaattgcttgaacacgggaggcggaggttgcakcagtgagccaagatcgcgccactgcactccagcctgggcgacagagtgagactctgtctcaaaaaaaaaaaaaaaaaaaaaaaagtttgaggatcactgtcttataatgttccaaggaagagttaagtatgtatcctaaagaaaagtcaccttctcagtgacgtcttcccaaatctccccaggaaaagtaggcattttgtttcatagctctcaaataaaattagagtagcttacaccaatgctgtcattcgcaaatttgccagttccttcacccttattaaataatgaattctccatgct

SEQ ID NO: 187713 - DNA, 601 bp, Human
ttcagtggtcttcagccttttttacccttgaagtacccctgaaagaaattttgaaaatctatgcatcattttgtacattttcaagttcacatctaaaaaacttatcatatattcaaatcttgccaaaggatgctttttctattttgcattaaattctaatttagtgtatttcttccttagttggactctgccttttcttttctagtccttatccagaaaagatctatttcatgtaattaatcaaagtagacttaaagggtttttaaaaaaataactttttactattacatgtttctttcctttttttttttttttgtttgagatggagtctggctctgtcgcccaggctggaatgcagtgatgcaatcttggctcactgcaaccttcgccttcccggttcaagccattcttctgcctcagcctctgtagtagctgagattgcaggcgcctgccacacatacccagctaagttttgtatttttagtagagacggggtttcaccatgttgaccaggttggttttgaactcctgacctcaagtgatacacccatctcagcttccaaagggctgagactacaggcatgagctattgtgcccagtc

SEQ ID NO: 187714 - DNA, 601 bp, Human
ttaagttctttctttgcactatttgctttctgttgacccacaagttgctgctgtctttaacataaataatttcccttaccagttagcctcaaaccactgccccctctctacatttccttttaccactcagctctgagaaagattactttgtgttctctgcctctgttttctcaacaaccacctcactcccataaaaggtaacttctgcccctccaccccactgaaatcacaaaggatcatcaggcctgccaaaacctcttctccattctcaacatcacggtggccttgacattactaactwctttctcctttcctacagcctttccaactgacttctcttcctactcatgtctagatttctttaaaactctcaatccttctgtctctcttgctccatcttcttttgtacagttccaaatgaaatataatgcccagattttcctccttggtcccttttttgtgtttcatttttcctcttgaggatcaggtcccactctgtggaagctctttctcccattcttataaaactggtttcttctcatttgtcaaatctcagtttaaatacaaccactttttataggcctttgttagcattcacatc

SEQ ID NO: 187715 - DNA, 601 bp, Human
actctggatgtttttcaacaattgcaacatttttttctgtggaggccaaatcaaaccaaaaatatagacagtgctcaatccatctctgagggcaggcaaaatgaaccatattccatcttctatcttcttttcttcccacgtgtttttccctatttcatgccaatttcatgccataattccgtaattcctcaacactctattactcttcttcatctgtggcttttctctgttcttatattctcttacccacatgggctctttgctcatctctctaaatacctgacttatttactatatcctytcatgactttcaatgaccttccaaaaaagaaagaaagaaagaaagaaagaaagaaagaaagaaagaaagaaagaaagaaagaaagaaagaaaaagaaagaaagaaagaaagaaatctgcttattttctccatcttcattctcaggtttccttcttaattatatacacttaaccacagataaggccagagactttaaacaaaaatcacatgaacctttgtttgcatgtataaattagagataaatcaagatttcatttattctatagcctctttttgagagctaatatgcaatgagctgga

SEQ ID NO: 187716 - DNA, 601 bp, Human
ggccaacatttttgggtggtaggaggatattaaatgcttataaaataacagaaaatcattgcagatattgtatagagaatgtaaagttcaaaagaaaaaggaaaatataattctccataagtacataatacaactatcattgataatttcctttctcatatttttaaattttaatatagtaaaaatgttcctatacttgcattctatatcctgttttttcacttaatgtataattatttcctgtactgttaaaaactttgtgttgctagtgttaatggctgcacattcgttcagatgcacygtatttgcttacccattcctttacttttacttgctttcagttttttgctatttctaatagagtttttgaaacagagtcagtggtacttttcctgtgtggttcccacaaaaccctatggctgagcagacgaggtctgcttagagagctagaggcataagagaatgtggttcccatttcacttctgaccaaatatcccactcccctttcaaaacaagccttctatatgtgaggagttaactgattatatgttggagctatcatccgtttaattataattcttaggagaaattatttaaacaa

SEQ ID NO: 187717 - DNA, 601 bp, Human
gaagttcttattggaagtaattatagcaaaggattaataaaatctgaaccatttctacaacagtgcgacctaaagtgagtttaaacaccatggtggatccccctttctaatagagttatatgagaattttccttgcaagtggactttctcagtttgtttcctaattatgacactccaaagtttgaatagggctgaaattatccctaatgagggccaacatttttgggtggtaggaggatattaaatgcttataaaataacagaaaatcattgcagatattgtatagagaatgtaaagttcwaaagaaaaaggaaaatataattctccataagtacataatacaactatcattgataatttcctttctcatatttttaaattttaatatagtaaaaatgttcctatacttgcattctatatcctgttttttcacttaatgtataattatttcctgtactgttaaaaactttgtgttgctagtgttaatggctgcacattcgttcagatgcaccgtatttgcttacccattcctttacttttacttgctttcagttttttgctatttctaatagagtttttgaaacagagtcagtggtacttt

SEQ ID NO: 187718 - DNA, 601 bp, Human
agcacataagttaaattctacctattaatgtaaaagtagccttagtcagtttgattccatcatgctggtgtttttcatggcagtcactaggcaggagtacccccttacactggcatctgaggctcaataatcacttgtcaaccatactttaaaaccatagctgtttagggactgaccctatgtggctaaaacttttcagtctgaattttatacttttccctttgattcacagttattatttaaaaactggcaaactatcaaatgttttgcaagacatttccttacaaagagctaaaagttyttgaattgtagttaagaagctaaaatcattctaagaaggaatcacagaactgaaatatctgtttttcctacttactttataagctttgattggatattactgagttcagttatttacttaactaccctataaaactcatacttttattacaactttaatactcaaatgattagctatttcacaagttttgcatgtataaatttgaatgcataatatagaaataacatgtttctatattattctattccaattcattattcagtcaaaagatggaatctttaaacacttctgacctgtgga

SEQ ID NO: 187719 - DNA, 601 bp, Human
agtagagacagggtttcaccatgttggccacgctagtctcgaactcctgacctcaagtgatctgcctgcctcaacttcccaaagtgctgagattacaggcgtgagtcagtgtgcctggccacgttatttaaagaaatagaagtcttctataaagaacttttgtagttttctaccaacagagtgatgtatctgtctgaactcatagatgtcctttgctcctttcttcctgtgcaaatgaaggaatccctctcctgttgatgggaaggcctatctttccatgtgtcagcatccacaaactcascctttctcaaagaccttacgcagttgattatttccttcctatctacaacctttccctctttattaaatcctttctttatatacaggtattaaaatatgcacccacattcccatcctaaaaataacgacaaaaaattaataactcccaaatatctcccttgaatctcaaatctccttcccctcccctcttcccttaccaccctttctctcaactaccattcacagccaaactcaggaaagagttgcctaccatcagtattgttttacgtcctcatttctatctactcatcgggtgtgtcac

SEQ ID NO: 187720 - DNA, 601 bp, Human
tcagtgatccataaatgaaagggaatataaagtataacatccttgctcttaaggaaatcagaatttaatcaagtcaagtcatactgttttgttaaatgttttcttgattgagtgtacctcatttttagagattcagaacaactgttttaggtttgttatgtcaataagaaaagttaggatgtaaagactttttttcaggatggaaaaagttaatttgatgacaataccggtagcaaacagttcccaaaacgacaaagagagggtctagatcaagagcaagaggaagtagatggtaaaaagktctcccatattgaaacaaaatggagcaaggcattatgtaaggaataaaataaggataacagctaattttaatgtgggcttactttgccaggcaatattccaagcgctttatgtatattaccccatctaattgatagagacaggagacagccgagggtctctggtgaaaccctgccttcaagcctaaacagcctaaaggctgaaaaacccgactgctggtcccagatgaagcctgccctttcccaactgatcctttctgaataatgcccacctgtgcactgggaggacggggtggagcctc

SEQ ID NO: 187721 - DNA, 601 bp, Human
attatagttatttaataaaagaattcggactctatctcaagactcctaagttttactgttccctttcagcctcactatactgccactcttcagataatttgaaattaaactattacttgaatgaatgaatcagtcatcctatcaatatcactcttcattttcccactcttaatattttattttcaatagcaagttaagaattaaatactaactttgcttgcctattaggataaaaaaattaaataccaacttgaaacatttttagcacattatacatatgcttaatggaactttttagcattttttttttaaagtggagtctcacttttatttttcatttcacagatttcttcctttaagaccctcaaggctgagcttaaaattggcagaattccatatcagtctgagcacacaccgcactctaattactgtagcatgcataccaatatttcgccatgcaagcagtggcggagtccaaacgtttcgcttcatgcagctggagacagttgtccacaaatgctcgggttacacatatatgtgtttttaattctgctaatttatgttgcactgtcttgaatttaaaggaaataaaagaaaaaag

SEQ ID NO: 187722 - DNA, 601 bp, Human
taatttttttagaacaaaacaaataatcagatatttaagatatgtgacaacttagatccttttcatatgccagttaatttttctgtattgcttttttttttttttggttttaaaaaaaaagtagtatttggccggatgcagtggctcacgcctgtaatcccagtactttgggatgccaaggcaggcagatcacttgaggccaggggtttgagaccagcctggccaacatggcaaaaccacacctctactaaaaatacaaaaaaattagccaggtgtcatggcacgcacctgttaattccasctactctggagactgaggcacaagaattatttgaacctggaaggtggaggttgcagtgaacccagatcatgccactgtactccaacctgggtgacagagcgagactgtctcaaaataaaataaaaaataaaaaaattaaaaaatttttgaaaatactatttgtccttctacataaggattcaaataaagccaaggatcaagcttttgtttattggtctctttactttatttaagaaaaataaaatcctagtagggagttgataaaaaaaaagctgtttccatttgcttgaatacattttg

SEQ ID NO: 187723 - DNA, 601 bp, Human; identical to SEQ ID NO: 39136

SEQ ID NO: 187724 - DNA, 601 bp, Human; identical to SEQ ID NO: 112178

SEQ ID NO: 187725 - DNA, 601 bp, Human; identical to SEQ ID NO: 112179

SEQ ID NO: 187726 - DNA, 601 bp, Human; identical to SEQ ID NO: 112180

SEQ ID NO: 187727 - DNA, 601 bp, Human; identical to SEQ ID NO: 112181

SEQ ID NO: 187728 - DNA, 601 bp, Human; identical to SEQ ID NO: 112182

SEQ ID NO: 187729 - DNA, 601 bp, Human; identical to SEQ ID NO: 112183

SEQ ID NO: 187730 - DNA, 601 bp, Human; identical to SEQ ID NO: 112184

SEQ ID NO: 187731 - DNA, 601 bp, Human; identical to SEQ ID NO: 112185

SEQ ID NO: 187732 - DNA, 601 bp, Human; identical to SEQ ID NO: 112186

SEQ ID NO: 187733 - DNA, 601 bp, Human; identical to SEQ ID NO: 112187

SEQ ID NO: 187734 - DNA, 601 bp, Human; identical to SEQ ID NO: 112188

SEQ ID NO: 187735 - DNA, 601 bp, Human; identical to SEQ ID NO: 39137

SEQ ID NO: 187736 - DNA, 601 bp, Human; identical to SEQ ID NO: 39138

SEQ ID NO: 187737 - DNA, 601 bp, Human; identical to SEQ ID NO: 39139

SEQ ID NO: 187738 - DNA, 601 bp, Human; identical to SEQ ID NO: 39140

SEQ ID NO: 187739 - DNA, 601 bp, Human; identical to SEQ ID NO: 39141

SEQ ID NO: 187740 - DNA, 601 bp, Human; identical to SEQ ID NO: 39142

SEQ ID NO: 187741 - DNA, 601 bp, Human; identical to SEQ ID NO: 39143

SEQ ID NO: 187742 - DNA, 601 bp, Human; identical to SEQ ID NO: 39144

SEQ ID NO: 187743 - DNA, 601 bp, Human; identical to SEQ ID NO: 39145

SEQ ID NO: 187744 - DNA, 601 bp, Human; identical to SEQ ID NO: 39146

SEQ ID NO: 187745 - DNA, 601 bp, Human; identical to SEQ ID NO: 39147

SEQ ID NO: 187746 - DNA, 601 bp, Human; identical to SEQ ID NO: 39148

SEQ ID NO: 187747 - DNA, 601 bp, Human; identical to SEQ ID NO: 39149

SEQ ID NO: 187748 - DNA, 601 bp, Human; identical to SEQ ID NO: 39150

SEQ ID NO: 187749 - DNA, 601 bp, Human; identical to SEQ ID NO: 39151

SEQ ID NO: 187750 - DNA, 601 bp, Human; identical to SEQ ID NO: 39152

SEQ ID NO: 187751 - DNA, 601 bp, Human; identical to SEQ ID NO: 39153

SEQ ID NO: 187752 - DNA, 601 bp, Human; identical to SEQ ID NO: 39154

SEQ ID NO: 187753 - DNA, 601 bp, Human; identical to SEQ ID NO: 39155

SEQ ID NO: 187754 - DNA, 601 bp, Human; identical to SEQ ID NO: 39156

SEQ ID NO: 187755 - DNA, 601 bp, Human; identical to SEQ ID NO: 39157

SEQ ID NO: 187756 - DNA, 601 bp, Human; identical to SEQ ID NO: 39158

SEQ ID NO: 187757 - DNA, 601 bp, Human; identical to SEQ ID NO: 39159

SEQ ID NO: 187758 - DNA, 601 bp, Human; identical to SEQ ID NO: 39160

SEQ ID NO: 187759 - DNA, 601 bp, Human; identical to SEQ ID NO: 39161

SEQ ID NO: 187760 - DNA, 601 bp, Human; identical to SEQ ID NO: 39162

SEQ ID NO: 187761 - DNA, 601 bp, Human; identical to SEQ ID NO: 39163

SEQ ID NO: 187762 - DNA, 601 bp, Human; identical to SEQ ID NO: 39164

SEQ ID NO: 187763 - DNA, 601 bp, Human; identical to SEQ ID NO: 39165

SEQ ID NO: 187764 - DNA, 601 bp, Human; identical to SEQ ID NO: 39136

SEQ ID NO: 187765 - DNA, 601 bp, Human; identical to SEQ ID NO: 112178

SEQ ID NO: 187766 - DNA, 601 bp, Human; identical to SEQ ID NO: 112179

SEQ ID NO: 187767 - DNA, 601 bp, Human; identical to SEQ ID NO: 112180

SEQ ID NO: 187768 - DNA, 601 bp, Human; identical to SEQ ID NO: 112181

SEQ ID NO: 187769 - DNA, 601 bp, Human; identical to SEQ ID NO: 112182

SEQ ID NO: 187770 - DNA, 601 bp, Human; identical to SEQ ID NO: 112183

SEQ ID NO: 187771 - DNA, 601 bp, Human; identical to SEQ ID NO: 112184

SEQ ID NO: 187772 - DNA, 601 bp, Human; identical to SEQ ID NO: 112185

SEQ ID NO: 187773 - DNA, 601 bp, Human; identical to SEQ ID NO: 112186

SEQ ID NO: 187774 - DNA, 601 bp, Human; identical to SEQ ID NO: 112187

SEQ ID NO: 187775 - DNA, 601 bp, Human; identical to SEQ ID NO: 112188

SEQ ID NO: 187776 - DNA, 601 bp, Human; identical to SEQ ID NO: 39137

SEQ ID NO: 187777 - DNA, 601 bp, Human; identical to SEQ ID NO: 39138

SEQ ID NO: 187778 - DNA, 601 bp, Human; identical to SEQ ID NO: 39139

SEQ ID NO: 187779 - DNA, 601 bp, Human; identical to SEQ ID NO: 39140

SEQ ID NO: 187780 - DNA, 601 bp, Human; identical to SEQ ID NO: 39141

SEQ ID NO: 187781 - DNA, 601 bp, Human; identical to SEQ ID NO: 39142

SEQ ID NO: 187782 - DNA, 601 bp, Human; identical to SEQ ID NO: 39143

SEQ ID NO: 187783 - DNA, 601 bp, Human; identical to SEQ ID NO: 39144

SEQ ID NO: 187784 - DNA, 601 bp, Human; identical to SEQ ID NO: 39145

SEQ ID NO: 187785 - DNA, 601 bp, Human; identical to SEQ ID NO: 39146

SEQ ID NO: 187786 - DNA, 601 bp, Human; identical to SEQ ID NO: 39147

SEQ ID NO: 187787 - DNA, 601 bp, Human; identical to SEQ ID NO: 39148

SEQ ID NO: 187788 - DNA, 601 bp, Human; identical to SEQ ID NO: 39149

SEQ ID NO: 187789 - DNA, 601 bp, Human; identical to SEQ ID NO: 39150

SEQ ID NO: 187790 - DNA, 601 bp, Human; identical to SEQ ID NO: 39151

SEQ ID NO: 187791 - DNA, 601 bp, Human; identical to SEQ ID NO: 39152

SEQ ID NO: 187792 - DNA, 601 bp, Human; identical to SEQ ID NO: 39153

SEQ ID NO: 187793 - DNA, 601 bp, Human; identical to SEQ ID NO: 39154

SEQ ID NO: 187794 - DNA, 601 bp, Human; identical to SEQ ID NO: 39155

SEQ ID NO: 187795 - DNA, 601 bp, Human; identical to SEQ ID NO: 39156

SEQ ID NO: 187796 - DNA, 601 bp, Human; identical to SEQ ID NO: 39157

SEQ ID NO: 187797 - DNA, 601 bp, Human; identical to SEQ ID NO: 39158

SEQ ID NO: 187798 - DNA, 601 bp, Human; identical to SEQ ID NO: 39159

SEQ ID NO: 187799 - DNA, 601 bp, Human; identical to SEQ ID NO: 39160

SEQ ID NO: 187800 - DNA, 601 bp, Human; identical to SEQ ID NO: 39161

SEQ ID NO: 187801 - DNA, 601 bp, Human; identical to SEQ ID NO: 39162

SEQ ID NO: 187802 - DNA, 601 bp, Human; identical to SEQ ID NO: 39163

SEQ ID NO: 187803 - DNA, 601 bp, Human; identical to SEQ ID NO: 39164

SEQ ID NO: 187804 - DNA, 601 bp, Human; identical to SEQ ID NO: 39165

SEQ ID NO: 187805 - DNA, 601 bp, Human
tttcagtatgatagattttggaggttttagagtatcatgcacgtgacataatagtaatcttccagcttcttttgagtacacgacagacagtgcaattcttctgtctaccagtagatttcatataacccgacgttaattcatgaagacttttcacttccttttctatagattactcttctttcacatttaagaataagtagatgcgatattactatctgtttaaagctagaaaaggaattcgggcgtgtttggtaatatagtggtgcaagtaagaacttgtgaagaaatgcagttttatgaycttatggactggatggtttgggaaattggaccagagaatagattgttgtatcaaaccgtctgtttagaaaattccattttatttgagaaacccaaaacacgtaaactgtttctagaagcatactttggaagcaggcattgcagtttgaattacagaagtgaggtggattgcccaaggtcaagttcgtggctcttgaaactagaatctaagtttcctgattccttttcttctggtttatgtggttgctgagactggctggcagttctgatttggggaggattccacctgaaagttgatgtt

SEQ ID NO: 187806 - DNA, 601 bp, Human
acaggtagattaatcggagaaatggcatacaagtttattaacgtgtggggtgggaggagggagacagagtgattacctgaaccccaagaggctcagaagcttatataccatcttgaggcaaaggtggtcctgtcatgtagatgaaacctcatagggaggagccctcagagagaatagatggtgaatatttctttcagacctttaaaagtgtcagactctcagttagtctttcctagatccagacaagagagaaccttcagagaaggccaggttgcatcaatgcagattttctctacagacrcaaatctacctcacaaaagacagctttgcagggctgtttgtttgcaggccctcttaacagccatctcaaaatatgtcaaagaagtataatttggggtgaaatattctgatttccttcacttgctagaccctgaagtgggagaaaagagggtgcacattgaggctgtggccagtcaaggggagcacacgtggaatagtgtgctttcaggtaagatccctgtgtgtttgtgcatggggctgctacttagggattttggtttgtgaagttgaggagaaaacaatccagagatcagttaacgtc

SEQ ID NO: 187807 - DNA, 601 bp, Human
ggagggagacagagtgattacctgaaccccaagaggctcagaagcttatataccatcttgaggcaaaggtggtcctgtcatgtagatgaaacctcatagggaggagccctcagagagaatagatggtgaatatttctttcagacctttaaaagtgtcagactctcagttagtctttcctagatccagacaagagagaaccttcagagaaggccaggttgcatcaatgcagattttctctacagacgcaaatctacctcacaaaagacagctttgcagggctgtttgtttgcaggccctctkaacagccatctcaaaatatgtcaaagaagtataatttggggtgaaatattctgatttccttcacttgctagaccctgaagtgggagaaaagagggtgcacattgaggctgtggccagtcaaggggagcacacgtggaatagtgtgctttcaggtaagatccctgtgtgtttgtgcatggggctgctacttagggattttggtttgtgaagttgaggagaaaacaatccagagatcagttaacgtctctcctccatttgagatgtgtgcagcttctttcataaatacattattattttcaa

SEQ ID NO: 187808 - DNA, 601 bp, Human
ctaccatttgggctgatactccctaattgttgataaattatcagtcagtattaccacctaaataattttccatgattcagcttttatcatgcacagcatattcatttcatttaataacatttttttaaaatgctggcttccaaaatatcggcaacccagccaggtggtaagacagagctgggtttttagcttactgcagtgaggaacacttccacagagccttggtagtatttcagagggggagaggcaagttgtaacgtatttgagaattggaagtttggtttaaggcaggtcttttttkttttgttttgttttgagacggagtctcactctgttgcccaggctggagtgcagtggcgcgacctcggctcactgcaagctctgcctcccgggttcacgccattcttctgcctcagcctccgacgtagctgggactacaggcacccgccaccacgcctggctaatttttttgtatttttagtagagacggggtttcacagtgttagccaggacgatctcaatctcctgaccttgtgatctgcccgccttggcctcccaaagtgctgggattacaggcatgagccacctcacccagcctaag

SEQ ID NO: 187809 - DNA, 601 bp, Human
agataagccagataaggattttgaggcaaacattttcaaagagtcttaggactaaactgttcattgatgcttcctttcaaagagttgatgtgtcttttagaaattcttgtaaacatcatgaactcctagcaagagtttccaggaatactcaagttatactaataaaagagtgaatctaaaggcatggtaatgtaatagtaagctatgtgcgggttaggaatggtagttaacttgagatttctaaagaatatctgagggttaccatgtgaattttcacttagtgtttatgatctttaaacarttcattttcttattattttgagagatactaccatagaatgtcatcaactacatcaagctttggatgtgtaccacagtgggtttttttgatgctgtcatcctaaggaagaagctgaggcataacatagaatttaaggacaatacttgagccaaatttaaagactttacttgagccaaagtgagtacactgcctgggacatacttccaagttgcctgggggtgtgccttggttggcctttgttataagcaagtttttaaaggcaaaaaggaacagggaatgggctggtacaaagttgtttga

SEQ ID NO: 187810 - DNA, 601 bp, Human
agataaggattttgaggcaaacattttcaaagagtcttaggactaaactgttcattgatgcttcctttcaaagagttgatgtgtcttttagaaattcttgtaaacatcatgaactcctagcaagagtttccaggaatactcaagttatactaataaaagagtgaatctaaaggcatggtaatgtaatagtaagctatgtgcgggttaggaatggtagttaacttgagatttctaaagaatatctgagggttaccatgtgaattttcacttagtgtttatgatctttaaacagttcattttmttattattttgagagatactaccatagaatgtcatcaactacatcaagctttggatgtgtaccacagtgggtttttttgatgctgtcatcctaaggaagaagctgaggcataacatagaatttaaggacaatacttgagccaaatttaaagactttacttgagccaaagtgagtacactgcctgggacatacttccaagttgcctgggggtgtgccttggttggcctttgttataagcaagtttttaaaggcaaaaaggaacagggaatgggctggtacaaagttgtttgacaggaattc

SEQ ID NO: 187811 - DNA, 601 bp, Human
tgtgtatccacccttaaaaccttgtgaagtataagaaaaccaaggctgagaggttaattgttgaaggctacagagctagtaagatatagacctgggattcttgccttgggctgtcagattctgaagcctgtgatctatttaccacgtcacattgctttttctggtattagaacacctaataaaactccatagtctctgttccctatttttcaaatgccagacagaaataggtatttttttcttttttcttttctttctttcattttttaaataagatggggttttaccacattgcccaggytggtcttaaactcctgggctcaagcagtctgcccactttgacctcccaaagtgctgggattacaggcgtgaaacatggcaccaggccagtattttcttttcttttaactgagtttaagattattgtctaaaactccacaatccattaccattttatatttgtgcaacatttaaaaatgtgtgatgaccacaaaatttcagctaattatattacccttcattgtatactttagtaatatgaattataaaatttataaaagcaaagtaaacctaagcttttgtccagattaatgtatgaaat

SEQ ID NO: 187812 - DNA, 601 bp, Human
ctgtgatctatttaccacgtcacattgctttttctggtattagaacacctaataaaactccatagtctctgttccctatttttcaaatgccagacagaaataggtatttttttcttttttcttttctttctttcattttttaaataagatggggttttaccacattgcccaggttggtcttaaactcctgggctcaagcagtctgcccactttgacctcccaaagtgctgggattacaggcgtgaaacatggcaccaggccagtattttcttttcttttaactgagtttaagattattgtstaaaactccacaatccattaccattttatatttgtgcaacatttaaaaatgtgtgatgaccacaaaatttcagctaattatattacccttcattgtatactttagtaatatgaattataaaatttataaaagcaaagtaaacctaagcttttgtccagattaatgtatgaaatgttacatattggtgtagaaagaacaatgtttccccaactttttgacactatgacacagtaagaaatacattgtataccacattccaagacacacaaatgtatattttaactgctgcaaaaatgttat

SEQ ID NO: 187813 - DNA, 601 bp, Human
aaaatgtgtgatgaccacaaaatttcagctaattatattacccttcattgtatactttagtaatatgaattataaaatttataaaagcaaagtaaacctaagcttttgtccagattaatgtatgaaatgttacatattggtgtagaaagaacaatgtttccccaactttttgacactatgacacagtaagaaatacattgtataccacattccaagacacacaaatgtatattttaactgctgcaaaaatgttatgaaacaattcttcccattactgtgtaataccctctgatttcttttstatttgatgctgttctatgttattgaacaaaaaatgctacatgtaacttattcaatggattttactacccttgggtcatagcctgcgatctgaaaaccactagtttagtcgtatctagtaaatgtaatatgaatttttctttttttttttactttgtaagggataaccatattagaatatattggttaaaagcaacattttcatattttttaaccaatagaacatatctttgatctgctatgaaaagcatgattattttaatagttcttgttcccagttgttttcatgacctaattccca

SEQ ID NO: 187814 - DNA, 601 bp, Human
tcctctccccccactccccccgcccctcagtatcggggaccacaggtgagtaccaccacgcgcagctaagttttgcatgttttgtagagctgggtttttaccgtgttgcccaggctggtctcaaactcctgggctgaagcaattctataccttatgaaggcagctaatatttctgttctaagaagggaatgagggctggacatggtggctcacacctgaaatcccagcactttgggaggccaaggcaggaggatcacttgagcccaggagttagagaccagcctgggcaagatagtaagaycctgtctctatttttttttaaaaaaaaggagtgaggacttgtgcttagaatacactgcatatatgttactagactttaagttgaatcaaaatctcttgtaacataatttaaatgctaccagttgaattaataaaaatcagaaaagtcctaaagaaaaacagcgacaattctaaatatagaagtcatcatttgtatataggagcattcagaaattctggatttttcatacagagctgccaacagtttatatgacatggtaacacaaggagtgattatttgtatggcacaatggggatgaag

SEQ ID NO: 187815 - DNA, 601 bp, Human
aattcataaatctggcaaatcaatactgaaaccacacaaaaaaccttaagaacacgttaaatactaactttacattttctttgtaggtggaaaaactggtggatacgtggaattctcactctaactatgatctcgttgtttttcctgatcatctatatgggatccttcatgctgatgcttcttgtaagtttttgacttttccctgagtgtctcttgctttgtttttcaacatttatataggattgaagtaatttgagcatatcataaaaaagaagctaattcaacactcagtcacagaatmtttagttcctttaagtgtcttttatttcatgatatgatctaacttaatcttttctgtttgcaaaatgactattcagtgtgttcattcagcagagaccaagtttgtataacaggtacatatctatgtgtctgacattgtgccaagcatattttatcaaagatatgacatgagcctgggcaaaaaaacacaagcctgagacctcgtctctacagaaagttttaaaaaataagcttggagtagtggttcacgcctatagtcccagctactggggaggctgaggtgggggatcacttgagcctg

SEQ ID NO: 187816 - DNA, 601 bp, Human
tatgggatccttcatgctgatgcttcttgtaagtttttgacttttccctgagtgtctcttgctttgtttttcaacatttatataggattgaagtaatttgagcatatcataaaaaagaagctaattcaacactcagtcacagaatatttagttcctttaagtgtcttttatttcatgatatgatctaacttaatcttttctgtttgcaaaatgactattcagtgtgttcattcagcagagaccaagtttgtataacaggtacatatctatgtgtctgacattgtgccaagcatattttatmaaagatatgacatgagcctgggcaaaaaaacacaagcctgagacctcgtctctacagaaagttttaaaaaataagcttggagtagtggttcacgcctatagtcccagctactggggaggctgaggtgggggatcacttgagcctgggaggttgatgctgctgtgagctgtggttgtgctactgcactgcagcctgggcaacacagaccatctcaaaaaaaaaaaatgacagaaatacacacacatataacatcaacatatgactattagctagatccctgatttcaaggaactcagtgta

SEQ ID NO: 187817 - DNA, 601 bp, Human
tatataggattgaagtaatttgagcatatcataaaaaagaagctaattcaacactcagtcacagaatatttagttcctttaagtgtcttttatttcatgatatgatctaacttaatcttttctgtttgcaaaatgactattcagtgtgttcattcagcagagaccaagtttgtataacaggtacatatctatgtgtctgacattgtgccaagcatattttatcaaagatatgacatgagcctgggcaaaaaaacacaagcctgagacctcgtctctacagaaagttttaaaaaataagctwggagtagtggttcacgcctatagtcccagctactggggaggctgaggtgggggatcacttgagcctgggaggttgatgctgctgtgagctgtggttgtgctactgcactgcagcctgggcaacacagaccatctcaaaaaaaaaaaatgacagaaatacacacacatataacatcaacatatgactattagctagatccctgatttcaaggaactcagtgtaataggaaaaacatacaagtaaccatatgaataaatagcatgataaataagcgagataagttctatgatagaacatgtt

SEQ ID NO: 187818 - DNA, 601 bp, Human
tttgagcatatcataaaaaagaagctaattcaacactcagtcacagaatatttagttcctttaagtgtcttttatttcatgatatgatctaacttaatcttttctgtttgcaaaatgactattcagtgtgttcattcagcagagaccaagtttgtataacaggtacatatctatgtgtctgacattgtgccaagcatattttatcaaagatatgacatgagcctgggcaaaaaaacacaagcctgagacctcgtctctacagaaagttttaaaaaataagcttggagtagtggttcacgcytatagtcccagctactggggaggctgaggtgggggatcacttgagcctgggaggttgatgctgctgtgagctgtggttgtgctactgcactgcagcctgggcaacacagaccatctcaaaaaaaaaaaatgacagaaatacacacacatataacatcaacatatgactattagctagatccctgatttcaaggaactcagtgtaataggaaaaacatacaagtaaccatatgaataaatagcatgataaataagcgagataagttctatgatagaacatgttaggagtgcatggtagaaa

SEQ ID NO: 187819 - DNA, 601 bp, Human
tttaagtgtcttttatttcatgatatgatctaacttaatcttttctgtttgcaaaatgactattcagtgtgttcattcagcagagaccaagtttgtataacaggtacatatctatgtgtctgacattgtgccaagcatattttatcaaagatatgacatgagcctgggcaaaaaaacacaagcctgagacctcgtctctacagaaagttttaaaaaataagcttggagtagtggttcacgcctatagtcccagctactggggaggctgaggtgggggatcacttgagcctgggaggttgakgctgctgtgagctgtggttgtgctactgcactgcagcctgggcaacacagaccatctcaaaaaaaaaaaatgacagaaatacacacacatataacatcaacatatgactattagctagatccctgatttcaaggaactcagtgtaataggaaaaacatacaagtaaccatatgaataaatagcatgataaataagcgagataagttctatgatagaacatgttaggagtgcatggtagaaaagcacctaatccagtctgagggagggatgaggaggggcttccagaagagacagtgccga

SEQ ID NO: 187820 - DNA, 601 bp, Human
ctattcagtgtgttcattcagcagagaccaagtttgtataacaggtacatatctatgtgtctgacattgtgccaagcatattttatcaaagatatgacatgagcctgggcaaaaaaacacaagcctgagacctcgtctctacagaaagttttaaaaaataagcttggagtagtggttcacgcctatagtcccagctactggggaggctgaggtgggggatcacttgagcctgggaggttgatgctgctgtgagctgtggttgtgctactgcactgcagcctgggcaacacagaccatctcaaaaaaaaaaaatgacagaaatacacacacatataacatcaacatatgactattagctagatccctgatttcaaggaactcagtgtaataggaaaaacatacaagtaaccatatgaataaatagcatgataaataagcgagataagttctatgatagaacatgttaggagtgcatggtagaaaagcacctaatccagtctgagggagggatgaggaggggcttccagaagagacagtgccgaagccgagtcctgaatactggacagaggaaggaattccaaagtggagacatcatgagcgg

SEQ ID NO: 187821 - DNA, 601 bp, Human
tctggccaggtgcggtggctgacgcctgtaatctcagcaccttgggaggccgaggcaggtagatcatttgaggtcagtttgagaccagcctggccaaaatggtgaaacctcgtctcttttaaaaatacaaaaattagccgggtggtagaggcgtgtgcctgtaatctgagctacttgggaggctgaggcaggagaatcgcttgatcctgggaggtggaggttgcagtgagctgagatcacaccacggcactccagtctgggtgacagagtgagatcctgtctcaaaaaaaaaaaaaaaaaragaatattaaagatctaagtaaagtaggtttgaactgttattggttatttaagtttattacatacacatacatgcatagatatatatatatatattatgtttttatgatatttgtgttaagagaatatggatgattcacacatatagttggtactcaattgatattactttatgtgttttaaaaccttgtttctattcctattcttaactagatcatttatattttgagaaggacatgttgtatctagcttgcagttgccttataatgtcagcactcaaaaatgactaattcaatatagt

SEQ ID NO: 187822 - DNA, 601 bp, Human
taatgggaaaaaataacttaaaaataccctgaatggtaggttttggaaaactaacttgtggaaatcttaaaaagaaatcccggaatatatcctctgacagagtttggtaagctttttctgttaaaggaccagatagtaatattttaggctttaaggagctgcatatgtttcagtcacataatattttatttttaaataactctttaaaaaatataaaaatccattcttagctcaaggacagtataaaaacaagcccttggggtgtgttctctagacgctgaaaagctagtctgctgtattsacaaagatttttacctcttaattcatgataataagtgttcaacttgccatttgctctttgagtcttggaatcgacaggtcaagcaccgggtgtgatgctacatcttgagaaattaccttcacccaggttgctgaatgcagcagtttgaaggactacaaaatagaacatcaaaaagggatttataaatctaaacccgtttaataggtgtgcaatcaggacactgtgtaaacagaaatgcataaactcagttgactggccaaagtggctgcaaatgtggaaggttgcttatactttgctaag

SEQ ID NO: 187823 - DNA, 601 bp, Human
agtccactaggagcattagaagaggggagataccagtgtgtgcagggcagtggggagacaggttgaattacctcttctttctttccctcctaatcttcctgaggacaggtggggatttgtcttaggacttctactattaaaaagcattagagctgtgagtagttacgagttaattttcattatgaacttaatccctcaatatatacacccacacattatacatacatacaaagtattaaaatcatacacacacacaaacatacacacattatacatacacacaaagtattaaatttatacccacacacacacacacacacacacacacacacacacacacactgctcccgcctcccaagggtgagggattgtgtgtgtgtagtattttctacattgtttcctaattatctctggcattagattttcagctaaataaaggtatgaactatgtttggtaaatttttgctaatcaataaatttgaaattaagtttaaaacaggaaaatagcattttggtaaaatatatcttgaattggtcttctgaactttgttttgatctttgtgtcatcagaatgtagaaaataattttgttgagtttgagg

SEQ ID NO: 187824 - DNA, 601 bp, Human
aatatagaaaagctaattgtttttaaattataggtactttctattgtgtgtaaactactttttctatggagagactgtagctgattattttgctacatttgttcaaagagaagaacaacttcagttcctcattcgctaccatagatttatatcatttgccctctatctggcaggtaagttaaggaatattctgtattgatatatagttaacatattttccatgtttatttttatttctgttattttaattagtaattttttggttaaattttattccagcctctctttttcattgtttctygtgtataaagctatttctttcatcatgttcttaaatagcaattactcccttatagtgggtttaaaaagtgcttgttaagaatcactccaggccgggtgcggtggctcactcctgtaatcccagcactttggaaggctgaggcaggtggaacatctgaagtcgggagtttgagaccagcctgaccaacatgaagaaagtccgtctctactaaaaatacagaattagacgggcatagtggcacatgcctataatttcagctactcaggaggctgaggcaggagaatcgcttgaacctgggag

SEQ ID NO: 187825 - DNA, 601 bp, Human
tatgctatttcattaaatagttatgatgttcttcttggtgcccctcagctccttcagttcctaggccttctaattctaaaaagccagaaagtgaaatacaatctgaaatggtaatgggaattttcagagaacttgtttttatgtaatgaggaggaatacattttcgaataattttccaccttttacattcaggttttttgttactttttaaaattttaaatttcattttattttcccagagattaggtctccccatgtggcccaggctggtctcgaactcctgggctcaagggatccttcygccttggcctcccaaagtgctgggattacaggcacaagccactgcacccagcctttcattcaggtttattgttcagttcagctttccaaatttgttccttcatttaaaaaaacttttcactgctatatctatagaaagtacattcctagaaataggtattgaaaaatttctactcttttactggtactcatatgatggtagttggtccattttaaattctgaccagttggaaggattatgatcatggagagattatgattgttatcagctaagaagaccatactaaaattttggagagta

SEQ ID NO: 187826 - DNA, 601 bp, Human
acttctggcattttgagttttgatgataataccaacagtcaaagagtctatggtatcttctgttattgaacccaacacttttgtttcatgtgattattcttgtaattatttaaaacaactgcgggccaggtgcggtggctcacacctgtaatcccagcactttgggaggctgaggcaggtggatcccttgaggtcaggagtttgagaccagcctggccaacatggcgaaacccgatctctactaaaaatacaaaaaaaaattagccgggtgcggtggcaggtgcctgtaatcccagctatytgggaggctgaggcaagagaatcgctgtaacctgggaggcagaagctgcagtgagctgaaatcatgccgctgcactccagcctgggcgacagagcgagactccatctcaaaataataataataataataaaagaacaattgtggttaattaaaacataaatcatttctatcattaatatctgcacattagttttcaaactgaatttcaaaagaattatgatgtaaacagcaaccctgcaccccaccgctttgagagtttttccttttctgtaagtaataggcctgtttcttagtttactt

SEQ ID NO: 187827 - DNA, 601 bp, Human
ttttttttgctgggcgcagtggctcacacctataatcccagcactttgagaggccgaggcaggcggatcacaaggtcaggaaatcgagaccatcctggctaacacggtggaaccccgtctctactaaaaatacaaaaaaaaattagctgggcgtggtggtgggcgcctatagtcccagctacttgggaggctgaggcgggagaatggcatgaacctgggtggcggaacttgcagtgagccaagatcctgccactgcactccagcctgggagacagagcaagactctgtctcaaaaaaaaamaaacaaacaaaaaaaaaaaaactagtttttttttttaaatgaaaatatatgcccatgataaaaatttagactagaaaggagtattccatgaaatcctcctccacctcagtgccttacttacgatatctggaggcttactactgttattccagaaattgtctgagtattcaagcttttatgtttatatcccccctccctttttcttatgcaagtaagagtatctcttctgtaccatttttccacttcatatattaatagcttatagatggatttatattggcacatctacatctatcattg

SEQ ID NO: 187828 - DNA, 601 bp, Human
ctgggcgcagtggctcacacctataatcccagcactttgagaggccgaggcaggcggatcacaaggtcaggaaatcgagaccatcctggctaacacggtggaaccccgtctctactaaaaatacaaaaaaaaattagctgggcgtggtggtgggcgcctatagtcccagctacttgggaggctgaggcgggagaatggcatgaacctgggtggcggaacttgcagtgagccaagatcctgccactgcactccagcctgggagacagagcaagactctgtctcaaaaaaaaaaaaacaaacaaaaaaaaaaaaactagtttttttttttaaatgaaaatatatgcccatgataaaaatttagactagaaaggagtattccatgaaatcctcctccacctcagtgccttacttacgatatctggaggcttactactgttattccagaaattgtctgagtattcaagcttttatgtttatatcccccctccctttttcttatgcaagtaagagtatctcttctgtaccatttttccacttcatatattaatagcttatagatggatttatattggcacatctacatctatcattgtatccatat

SEQ ID NO: 187829 - DNA, 601 bp, Human
gcgcagtggctcacacctataatcccagcactttgagaggccgaggcaggcggatcacaaggtcaggaaatcgagaccatcctggctaacacggtggaaccccgtctctactaaaaatacaaaaaaaaattagctgggcgtggtggtgggcgcctatagtcccagctacttgggaggctgaggcgggagaatggcatgaacctgggtggcggaacttgcagtgagccaagatcctgccactgcactccagcctgggagacagagcaagactctgtctcaaaaaaaaaaaaacaaacaaaamaaaaaaaactagtttttttttttaaatgaaaatatatgcccatgataaaaatttagactagaaaggagtattccatgaaatcctcctccacctcagtgccttacttacgatatctggaggcttactactgttattccagaaattgtctgagtattcaagcttttatgtttatatcccccctccctttttcttatgcaagtaagagtatctcttctgtaccatttttccacttcatatattaatagcttatagatggatttatattggcacatctacatctatcattgtatccatatctgc

SEQ ID NO: 187830 - DNA, 601 bp, Human
atgaacctgggtggcggaacttgcagtgagccaagatcctgccactgcactccagcctgggagacagagcaagactctgtctcaaaaaaaaaaaaacaaacaaaaaaaaaaaaactagtttttttttttaaatgaaaatatatgcccatgataaaaatttagactagaaaggagtattccatgaaatcctcctccacctcagtgccttacttacgatatctggaggcttactactgttattccagaaattgtctgagtattcaagcttttatgtttatatcccccctccctttttcttatrcaagtaagagtatctcttctgtaccatttttccacttcatatattaatagcttatagatggatttatattggcacatctacatctatcattgtatccatatctgcagttacatctatattgatatacagcaatagctgagaggtagaatgtcagcatataaggtgattactgttttcccctttggttttgctataatttatgcttgagaataacatctcaattgagtgtggaccgatagtgtagttcattttctttgttgtttctttttatatattttgtctttcatagcctcctaacca

SEQ ID NO: 187831 - DNA, 601 bp, Human
ctacatctatcattgtatccatatctgcagttacatctatattgatatacagcaatagctgagaggtagaatgtcagcatataaggtgattactgttttcccctttggttttgctataatttatgcttgagaataacatctcaattgagtgtggaccgatagtgtagttcattttctttgttgtttctttttatatattttgtctttcatagcctcctaaccagcccctttttagtaattctttgttccatatatgactttttggactctacttctataaaatacaatcaatgttgtgtcttttttttttgaaacacagtctcactccattgcccaggctggagtgcagtggcgcgatctcggctcatggcaacctctgcctcctgggttcaggtgattctcatgcctcagcctcccaagtagctgggactacaggcatgcgctactgtgcctggctaatttttgtatttttagtagagatggagtttcactatgttgctcaggctggtgtctaactcctgagatcaagtgatcctcctgccttgatctccaaaagtgctgggattatgggcatgagccaccatgtctggcctggtatttc

SEQ ID NO: 187832 - DNA, 601 bp, Human
tccttccctccttccctccctccctccctccctcccttttcatcttcattttatctttatgtggtttcttttctttcctttttttttttgaagatggggtcttgctttgccacccaggctggagtacagtggtgctaccatggctcactgcagcttccacctcccaggctctagcaatcttcccacctcagcctcccgagtagctggggcttcaggtgcatgccaccacacccggctaatttttgtatttttggtagagacagagtcttgccatgttgttcaggcttgtcccaaactcctrggctcaagcagtctgcccatttcagcctcccaaagtactgggattaaaggcgtgagccaccgcccctgggctctgtggttttttctctcggccattggtgcagttcttctttatcctcctttccagcaagcctatacacaagccttttccttgactctcctctcccttcaacctgtcgccttacctgtcccctcctttaccaaactttctcaaagaagagattatataatacaccttcacatcctcatatccatttgtgtgacttttcatatccaaactcataccaaaagaagattttgg

SEQ ID NO: 187833 - DNA, 601 bp, Human
agagttctacccagactgagaagttttcggcttgggaagctgtattagttcattctcacactgctataaagaaatgccagagctttaattggcttatggttctgcaagctgtacaggaagcatggctggggaggcctcaggaaacttatgatcttggcggaaggggaagcaggcacatcttatatggtcagagcaggaggaagagggagagtgaggaggtgccacagacttttcaacaaccagatatcatgagaactcatgggacagcaatagggggatggtgcttaaccattagaaaccscctccctgacccagtcacttcccaccaggccccacctccgacactgaggattacaagtggacgtgacatttgggtggagacacagatccaaaccatatcagaagccttcaaaaaggctgttatagctgtggaagaatattagcaactgattttgaacacagccttctagtgaatttatcaggctggattaattgtataatatacttagataattgaacagttaacccctaaatcgatatgatatgcatcaatttaatttgataagctatctttacaataatcagcaggcacttttgaatt

SEQ ID NO: 187834 - DNA, 601 bp, Human
gactgggcagcaatagcctgaatccaacacaaacaatatctcttctttgaagtgcagcatgttcctttcttcttggaaatggacatagattgtgaaaaaagagaggatatgtcaatacttgagcaaatacagtatctggggctctggagtattttgccatatcagaaggaagtctgtgtgtatatagcatattaggaatatgtgaaaattatatgtgctaaaatgtccatgttttgttgtactgattctatttttggccaatagcaggtcaatactgactgtgtgtacttggaatgaataygtctcattcttattccaagaacttacaccaactattatcaggttttatattagcataagagtcatgggacagttattttagtatagagtttatactcttttgagagacagaacaaatttagaccatttaacatgaacaaacacatattcacagcatttcaaatatttgagggcctactatgtgtttaaatattattagagagattttcactagtaaatcaagatcagagaaaaggaaaaagggttttgaactattccaataagagaaaaagtaaggagagatgtacaagttattgaggaa

SEQ ID NO: 187835 - DNA, 601 bp, Human
taaggtgcaatgcagtatacaaaaatatacaagatgttgttcctgttctaaagatgctcaccacctactagggcagacaatacacttccccagagaactacagcaacagctgtgcaggataagtatcttgcgaaggctgtaatagcagagtggcattgagttactgtggctcttttatgctttgactagtaaggaagagaaagagagaaatgggttggcaaaaattaaccaaagactttttcagtaattattttaaaaagaaaaatgttatatttagaatggtattttctttaatggtctycaatccaagattttttgttaaatggtgagttttttttgcatgttggaaaccaaacagctattgctgttgtagtttagatatttttagggtgcctgagtgaactagaagagcagttagtcatgtccatttcctgggcacccagacatgtgaatctacctgtaaagggtcagtttgcagaggcttactaccattccctcagtgtggccatttaatggactaatgtgtcccatatgggctcactgtaattttattttttactctaacacttaaaaaaagaagaagaaatgtttatcatagtag

SEQ ID NO: 187836 - DNA, 601 bp, Human
gatttctttgagttctcatttccatcaacattagtttgagtaagttaactttttccgtcaatggtaatctacaatattaaagtgaatggtggcccctggaattagagtcttgagcaagatggttaacttgtaattgttttacctacatttgaacaacttaaaaaaagatagtatttgtcatggtcctggaccacattgaagacccaattaatgtggatggtataggatttgaaacttgaggagatttgatttctcaactgtgggcattgcaatgatcatgaatactaagagttaaaaaggragataacgaaatgcatccagtctaccaattattacttgagtgcctgccatattgtagaatgttctagggacaaatatggcagagaacaaaacaaaccaaatctctgcccccatagctacttgtttggaagttgaagaaagaatgatgagaaagagacaataaacaaataaatatagtttgttagatggttgtaagtgtcacacagaaaaataaagcaggccgaggggatcatgcctgtgtgtgtaggggctggctggtggatgggtggatgaatattgccattttagaaagggtggttta

SEQ ID NO: 187837 - DNA, 601 bp, Human
caggaagaaaatatagacaagcagatcctgatgtctcctcatcattgccgtcagctacaggttttcacaggagacattgggacttacaaaggcggaaactgcttgtctgtcacgtgatcctagtccccagcctgggctcctgttattgccaggccctcctctgggcgtctctccttctgtaattaatccctgctggacctgtggcccctccctctgccctcattaacctccaggatgcaggcagcctggcagaaggccagagatcaggcctggggacgcccatacctgcttctgtcccctrcccatgtggcacactgtggaccttctttctgggagggcctaccagggctcaaggtgtgatagatggagaggcacccaggctaaattttaaaggaaacagggaggatgattcacaggcctggcccagaactccagctcagcctcccactagcggattgtccttaggcaagttatttgatgtatttgagcattgattttttttaactataaaaataataagactaggcacagtggctcatgcctgtaatttcagcactttgggaggctgaggcgataggatcatttgaggccaggagttcaa

SEQ ID NO: 187838 - DNA, 601 bp, Human
caaggtagacaagacagcttcaaaaccagactcccagcacctgcgatggaaactttatttcctcccatggaagggtccatctgggagggagaggagggcagggggccaaagagggtctgtgagaggagcagccgaggtcagcagcaaagggtggagggtgagggtggagggcagccctggtcacttgttgtcctctagaaagaagtcgttgtaggccatgcacagcatggtcaggaacaccgagtactccttgaagtcgatctcctggtcgctgttcttgtccaggctcttcatcaagtcrtcgatgctgctctccttcatcttttgtggacccaggtggagagacagctcagaccccgctcccagccctgccctcgcaccactgcatggtgtcatccccaccccgaaacttcagggtgagccccagctgagtcaatgacactgtcagcatctcgacccccagagtctgcccactgcccacacctagggaagggcctggcatgaggtagggggtcagggacctgactcctgaatggaaataaatgacagcaggaatgctagcctagcctgccttccctgcaatactgtcccccagccaaag

SEQ ID NO: 187839 - DNA, 601 bp, Human
cattccccttgctcccactatccccgaatcaaccaggagtgagcagttgcagggacaacgcctgcaggtctcctctcccactccctgggaactctggctccaaggaaaaggctcagacattcctctctccccttctgccacccaccagatggaagggataattttgcagaggcaatgggagcatatcccaaagaagccaaaatgacatgttcaggagagaacagagttgaaggaccaaaaggggcccccagctgctgacaggaaactcagagtcagtgagacctccctcccccagaaggcktaggccacccactggggctgccatcccctctaccaggctgaccgagggtaccagactgactccttgctaggggtgggcagcagaaggaaggctgtagtggacaccccagcccaccaccctcaacagcagagcttggctatgctagacaggcaaggtccagggtaaaaatagagccagaggaagcatggcccagtcctgtgaccacccctgcctgccccaccctcctcaatccctgcctgggcagccactgcagacatctaccacaggcctctggagccagcccagctccaactgctctct

SEQ ID NO: 187840 - DNA, 601 bp, Human
tccccttgctcccactatccccgaatcaaccaggagtgagcagttgcagggacaacgcctgcaggtctcctctcccactccctgggaactctggctccaaggaaaaggctcagacattcctctctccccttctgccacccaccagatggaagggataattttgcagaggcaatgggagcatatcccaaagaagccaaaatgacatgttcaggagagaacagagttgaaggaccaaaaggggcccccagctgctgacaggaaactcagagtcagtgagacctccctcccccagaaggcttasgccacccactggggctgccatcccctctaccaggctgaccgagggtaccagactgactccttgctaggggtgggcagcagaaggaaggctgtagtggacaccccagcccaccaccctcaacagcagagcttggctatgctagacaggcaaggtccagggtaaaaatagagccagaggaagcatggcccagtcctgtgaccacccctgcctgccccaccctcctcaatccctgcctgggcagccactgcagacatctaccacaggcctctggagccagcccagctccaactgctctctctc

SEQ ID NO: 187841 - DNA, 601 bp, Human
gcagagcttggctatgctagacaggcaaggtccagggtaaaaatagagccagaggaagcatggcccagtcctgtgaccacccctgcctgccccaccctcctcaatccctgcctgggcagccactgcagacatctaccacaggcctctggagccagcccagctccaactgctctctctccatgccccaaccctgattccctctggctggggtacagactgagggacacagagaacaggcctgcacttaggtctcttggggtttccctcacattgtaaaatctcagggaaagatcaattgcastagggctctaatcccacagctatttgagctgtcagccagggccagtcctgagggttcccctcacctagaccccaggtactccgggcctggtcctcagctcacttccatgatgggggtgggtaggtgcactgctgcaatgggctctgagctggagacggcgatggagaccctcatcaacgtgttccacgcccactcgggcaaagagggggacaagtacaagctgagcaagaaggagctgaaagagctgctgcagacggagctctctggcttcctggatgtgagcatagagtggtggagtgg

SEQ ID NO: 187842 - DNA, 601 bp, Human
gtgcaccggttttgaggttttattggactgggttcaaattccagccctgctactttctagctgtgggactttgggcatatttatttaaccaccgattaccaatttgtttcttctctagaatggaaataatgaaacatacctcacattatttgtattagaattaaattagacagtgcttgtaaagctcctagtgtagtgcttgctttattataggcactgaacatacggtaactggtgtcattattattcattctgccaggtgaaagagcttatgctgtaggcaacagaagccctcaagacytttgaggaggcctagaagagtcccataattcaatgcagttcctctcgctcatctttgcctcctgctcctcaaccacccccttacctctgactcagtgctgtacccttccctatacacctccctcttcctctcctcccaccacaggcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccac

SEQ ID NO: 187843 - DNA, 601 bp, Human
tttaaccaccgattaccaatttgtttcttctctagaatggaaataatgaaacatacctcacattatttgtattagaattaaattagacagtgcttgtaaagctcctagtgtagtgcttgctttattataggcactgaacatacggtaactggtgtcattattattcattctgccaggtgaaagagcttatgctgtaggcaacagaagccctcaagacttttgaggaggcctagaagagtcccataattcaatgcagttcctctcgctcatctttgcctcctgctcctcaaccacccccttrcctctgactcagtgctgtacccttccctatacacctccctcttcctctcctcccaccacaggcccagaaggatgtggatgctgtggacaaggtgatgaaggagctagacgagaatggagacggggaggtggacttccaggagtatgtggtgcttgtggctgctctcacagtggcctgtaacaatttcttctgggagaacagttgagcagacagccacattgggcagcgcccttcctctccaccctcccagacctgcctcttccccctgcttccacctcaccccacttatccctctccata

SEQ ID NO: 187844 - DNA, 601 bp, Human
ggcatataaaaatggaaagaggtcaagcacagtgcctcacatctgtaattccaatactttgggaggccgaggtgggaggattgcttgaacccaggagttcaagcccagcctggacaacatagcaagactccatctctacaaaaataaaaattggccaggcatggtgacaatactcctgtagttccaactacttgggaggattgcttgagcccaggagttcgagattacagtgagctatgatccagcctgggtgacagagtgagatcttgtccccccaccacaaaaaaaaaaaaaaaaaaaaggagtccgggcacggtggctcacgcctgtaagcccagcactttcagaggccgaggagggcagatcacctgaggtcaggagttcgagaccagcctgaccaatatgatgaaaccccgtctctactaaaaatacaaaaatcacttgggaagccgaggcaggtagatcacgaggtcaggagttcgagaccagcctggccaatatggtgaaaccctgtctctactaaaaatacaaaaattagctgggcgtagtgggatgcgcctgtagtcccagctactcaggaggctgagacaggagaattgct

SEQ ID NO: 187845 - DNA, 601 bp, Human
cggccctgggacctcagcggttgcttagtggtggcctgcttcagcccaggcatgtgggagaggcaccagacacaggatgtccctctgccagcccctgaagccccgtcccctgacgaggcgagtgtggacctgggggtgggggctgagggagactgtggacctgggggtgggggctgagggaaggtgtggacctgggggcaggggccgagggagggtgtaggcctgggggtagtaggggctgagggagagtgtggacctgggagtaggggctgagggagggtgtaggcctgggggtgggggytgagggagagtgtggacctgggggtaggggctgagggagtgtggacctgggggtgggggctgagggagggtgtggacctgggggcaggggctgagggagagtgtggacctaggggcagaggctgaaggggagtcacgggaggggacttctccggaggtggatttttgctctctggacggtgtgtcagcactgggtgagcccctcctgcctgcccaggctgagaggtctccctggcagccccctgggagtgtcgccagggcgggcctggaagtttcccaggcagctggggtggagacctga

SEQ ID NO: 187846 - DNA, 601 bp, Human
agtggtggcctgcttcagcccaggcatgtgggagaggcaccagacacaggatgtccctctgccagcccctgaagccccgtcccctgacgaggcgagtgtggacctgggggtgggggctgagggagactgtggacctgggggtgggggctgagggaaggtgtggacctgggggcaggggccgagggagggtgtaggcctgggggtagtaggggctgagggagagtgtggacctgggagtaggggctgagggagggtgtaggcctgggggtgggggctgagggagagtgtggacctgggggtrggggctgagggagtgtggacctgggggtgggggctgagggagggtgtggacctgggggcaggggctgagggagagtgtggacctaggggcagaggctgaaggggagtcacgggaggggacttctccggaggtggatttttgctctctggacggtgtgtcagcactgggtgagcccctcctgcctgcccaggctgagaggtctccctggcagccccctgggagtgtcgccagggcgggcctggaagtttcccaggcagctggggtggagacctgacacatcccaagggtgcttgttattaa

SEQ ID NO: 187847 - DNA, 601 bp, Human
aggtctccctggcagccccctgggagtgtcgccagggcgggcctggaagtttcccaggcagctggggtggagacctgacacatcccaagggtgcttgttattaaggctcaaggaaatgtctctgaggcctcaccgctcctctccccagggcctgctccctgcaaagcattgagaactgagtccgtccacagtcactgtggacccacccatccactggggctcagtggtagccagcaatgccaggctgggtgaggtggggttggtgggcaccaccctggtggacccccctccaccctggtgycgcagggtgtgtggctgagagcacagtgccatgggcttgggcctccttggtggagtccccaacacactgctctggtcctgggcctcggccttccccgtctgcagtgggggcccacagtgagcctacctcctggtggtgttggtggatttgctgacatgcctgagtgttgacagggggcttggtgcaggaagggctcagggcgtgggtgttggccaggggtccaaagggacctctgcctcagagagcccagcccagacaggcaggatgtgcagtggggaaggggctgcgggaaccctgcag

SEQ ID NO: 187848 - DNA, 601 bp, Human
acagggggcttggtgcaggaagggctcagggcgtgggtgttggccaggggtccaaagggacctctgcctcagagagcccagcccagacaggcaggatgtgcagtggggaaggggctgcgggaaccctgcagggtccagaaggacacagtgcagtcctgtgggctctggggaggctggtggggaggaggttgacaatggatatctgggtggggcacttgttagaagttccattttagagaggaaagaggccttgcctgtgggagaaggcagctggggtagcctgacctctttcccaggaagragcccacacacacacgcacaggcactcacacacacgaatgtgcacacacgcacactcccaccttcacacacactcacactcttgctgtctcccttcccaagccaaggtgcgagggggaaggtctgggcagcatgcacctgcgccctgaccgctttgggggccagtgagaactgggctccctgggtgcgtggcgggcccaagcagggaggacattgcagatgccctggccaagcagcgtggaaatcctgtcccttgggtgggtctcggagcctccatcagaggcggctggcacctgagacc

SEQ ID NO: 187849 - DNA, 601 bp, Human
tccaaagggacctctgcctcagagagcccagcccagacaggcaggatgtgcagtggggaaggggctgcgggaaccctgcagggtccagaaggacacagtgcagtcctgtgggctctggggaggctggtggggaggaggttgacaatggatatctgggtggggcacttgttagaagttccattttagagaggaaagaggccttgcctgtgggagaaggcagctggggtagcctgacctctttcccaggaaggagcccacacacacacgcacaggcactcacacacacgaatgtgcacacacrcacactcccaccttcacacacactcacactcttgctgtctcccttcccaagccaaggtgcgagggggaaggtctgggcagcatgcacctgcgccctgaccgctttgggggccagtgagaactgggctccctgggtgcgtggcgggcccaagcagggaggacattgcagatgccctggccaagcagcgtggaaatcctgtcccttgggtgggtctcggagcctccatcagaggcggctggcacctgagacccacctgctgccaggagcagggcaggagagtttgtgtcccgggacagggaa

SEQ ID NO: 187850 - DNA, 601 bp, Human
ggctaggacatcctgtgcctggtttcaccaagtgggtgtgtggactttccctggctcccccaggctgtctggctgcacagctttggggaaacggccactgggtcaagcgggccgagaagaggaagtctgtggtttgtctctgctacagactggccccagtgaggctgtccagcagtgcagggcacagagcaaaagcagggaggtatgggcctacttccccggtcgcccctgtggctggctgtggctctgccgggtgctgacaagtcactcgccctccctgcggtcaccagggtgcatgccygaaagccctccattctttcctgggtttgagggtccttctcctgcacccaccccagcgcccagttcagctcaactttcagaaatctggttcacccccaatccctttctcataactgcttccaagcccagacaaggagacagaccccagaagatccctacccctatttccgcacctgaaatcgcaccacgggaagagctttgctcatagagtcaataaggcttagagtccaggcgcctgtgcgagggagcaggtcatcacccttgtacccaccgtggttttagacaggaccctgaggttggg

SEQ ID NO: 187851 - DNA, 601 bp, Human
gactggccccagtgaggctgtccagcagtgcagggcacagagcaaaagcagggaggtatgggcctacttccccggtcgcccctgtggctggctgtggctctgccgggtgctgacaagtcactcgccctccctgcggtcaccagggtgcatgcccgaaagccctccattctttcctgggtttgagggtccttctcctgcacccaccccagcgcccagttcagctcaactttcagaaatctggttcacccccaatccctttctcataactgcttccaagcccagacaaggagacagaccccaraagatccctacccctatttccgcacctgaaatcgcaccacgggaagagctttgctcatagagtcaataaggcttagagtccaggcgcctgtgcgagggagcaggtcatcacccttgtacccaccgtggttttagacaggaccctgaggttggggtggggctggggctggagaggagccaggtgccctgccccttgcttgggccccgtgtccctgtgatccaggctgggcgtgctatgggtgctgggtgatattccagccctgcaggtgtccgccttgttcccagcacccctctgggcaag

SEQ ID NO: 187852 - DNA, 601 bp, Human
ccctccttcacccagtatctccaggggtacttcctcctttccttcctgcctcagggcctcactgtcctcctggggagggtgtctcaggccccagcacctcccagtggctgagccgaatgggcacttcccggtgtgtttcccatatgtgcagtccctaggtgtcggtgagcaggcacagagcccgcagcgtggccctgcctggtggaccccctccccaagagcatcaagggagggcctggactagagacacacagatgcccagcctgtacgtaaaggcgggtgagctgatgtaccatcgtcytcgtcccccactggggtgcctgggcaggacttggggtgaccacttggcccgtctgggtgggggtaagatatgggtggggcgaccagatccctgccctttcctgcagctgtgggggtgtgtgtgctggcctggagagctcccacccgaagttctggctcctggctgtccggggcctgcgggggcagcgagcagctggcatgggtaggggagctgacctaggcctgcccgggcagcgcctgctgccttttgctccctttcagctgcttcttggaaacagcggacaggctgggcaggaaccca

SEQ ID NO: 187853 - DNA, 601 bp, Human
accctccatccccaatccccagcagagcatcttgtggggtggggcggcttgtggggcggggcgccttgggaggcggggtgtctcgggaagcggggcgtctcgggaggtggggtggcttgtggggtggggcatttcctggggtggggcgtctcgtggggtgggacagcttggggggtggggcatctcgggaggcggggcgtcttgtggggtagggcggcttgtggggtggggcatcttgtggggtagggcggcttgtggggtggggcatcttgtggggtgggacggcttgtggggtggggcatctcgtggggtggggcatctctggggcccggccacttgggaggcggggcatcctgggggcggggcatctcagagggcgcctccggaggctggagtatcttgggaggtgggagcaggtggcagagaggcttcccacaggtgagctttgagcagggaggtgcctgtatggatggctctgtggggagaggggtgacaggagttccagattccggcacttatgaaacctcacagtgatggagagccgagtgctgctgtgcaggctaagttgtgtgcatgtcagcttctgcacttttatttcctt

SEQ ID NO: 187854 - DNA, 601 bp, Human
cctccatccccaatccccagcagagcatcttgtggggtggggcggcttgtggggcggggcgccttgggaggcggggtgtctcgggaagcggggcgtctcgggaggtggggtggcttgtggggtggggcatttcctggggtggggcgtctcgtggggtgggacagcttggggggtggggcatctcgggaggcggggcgtcttgtggggtagggcggcttgtggggtggggcatcttgtggggtagggcggcttgtggggtggggcatcttgtggggtgggacggcttgtggggtggggcatctcgtggggtggggcatctctggggcccggccacttgggaggcggggcatcctgggggcggggcatctcagagggcgcctccggaggctggagtatcttgggaggtgggagcaggtggcagagaggcttcccacaggtgagctttgagcagggaggtgcctgtatggatggctctgtggggagaggggtgacaggagttccagattccggcacttatgaaacctcacagtgatggagagccgagtgctgctgtgcaggctaagttgtgtgcatgtcagcttctgcacttttatttccttgt

SEQ ID NO: 187855 - DNA, 601 bp, Human
tccatccccaatccccagcagagcatcttgtggggtggggcggcttgtggggcggggcgccttgggaggcggggtgtctcgggaagcggggcgtctcgggaggtggggtggcttgtggggtggggcatttcctggggtggggcgtctcgtggggtgggacagcttggggggtggggcatctcgggaggcggggcgtcttgtggggtagggcggcttgtggggtggggcatcttgtggggtagggcggcttgtggggtggggcatcttgtggggtgggacggcttgtggggtggggcatctcgtggggtggggcatctctggggcccggccacttgggaggcggggcatcctgggggcggggcatctcagagggcgcctccggaggctggagtatcttgggaggtgggagcaggtggcagagaggcttcccacaggtgagctttgagcagggaggtgcctgtatggatggctctgtggggagaggggtgacaggagttccagattccggcacttatgaaacctcacagtgatggagagccgagtgctgctgtgcaggctaagttgtgtgcatgtcagcttctgcacttttatttccttgttt

SEQ ID NO: 187856 - DNA, 601 bp, Human
ggggcctgggcgggggaagtaggctgccatcctcgctaaaccaaagtgtgaaaattgagttgaaactcccataggagggcaggaggcacagctcctcagaagaaggtctgagaaaccacagcccaggttgttgtgtcgggtgtgtggagaaggtgctctggcagtcctgctacagggggaccatcaacagcccctttggggtgagagccccatggctgctggcaccagcagcccctatgaggcttattttatttttgagacagggtcttgctctgtcaccgaggctggagtgcagtggcayaatcataactcactgtagcctcaacctcctgagctcaagcgatcctcctgcctcagcctccaaaggtgctgggattacaggcgcttgctaccacgcccagccccctctggccttattgtttgccaggcccagctcaggtcccggaggaggggagacaggagtgtgagggaaagggggaagaggtatagagcccccagctcctccacccacccgaaccctcaccgaggccctagaccctagaccggcctgaccggggggtcctcaggccggggacttgggtgcaggccatggtgctggggc

SEQ ID NO: 187857 - DNA, 601 bp, Human
tcagaagaaggtctgagaaaccacagcccaggttgttgtgtcgggtgtgtggagaaggtgctctggcagtcctgctacagggggaccatcaacagcccctttggggtgagagccccatggctgctggcaccagcagcccctatgaggcttattttatttttgagacagggtcttgctctgtcaccgaggctggagtgcagtggcacaatcataactcactgtagcctcaacctcctgagctcaagcgatcctcctgcctcagcctccaaaggtgctgggattacaggcgcttgctaccackcccagccccctctggccttattgtttgccaggcccagctcaggtcccggaggaggggagacaggagtgtgagggaaagggggaagaggtatagagcccccagctcctccacccacccgaaccctcaccgaggccctagaccctagaccggcctgaccggggggtcctcaggccggggacttgggtgcaggccatggtgctggggcctgaagctcacgctctgctgagcacagccccctgcccaaccccaccctggggccctgcttccctggccagggccattggaacaggagtggggctg

SEQ ID NO: 187858 - DNA, 601 bp, Human
gtggagaaggtgctctggcagtcctgctacagggggaccatcaacagcccctttggggtgagagccccatggctgctggcaccagcagcccctatgaggcttattttatttttgagacagggtcttgctctgtcaccgaggctggagtgcagtggcacaatcataactcactgtagcctcaacctcctgagctcaagcgatcctcctgcctcagcctccaaaggtgctgggattacaggcgcttgctaccacgcccagccccctctggccttattgtttgccaggcccagctcaggtcccrgaggaggggagacaggagtgtgagggaaagggggaagaggtatagagcccccagctcctccacccacccgaaccctcaccgaggccctagaccctagaccggcctgaccggggggtcctcaggccggggacttgggtgcaggccatggtgctggggcctgaagctcacgctctgctgagcacagccccctgcccaaccccaccctggggccctgcttccctggccagggccattggaacaggagtggggctgtccaggtggtgttcttgggtccagccctcagtttctcttctgcagttg

SEQ ID NO: 187859 - DNA, 601 bp, Human
ctgtggtggggtcggcgcctggtgctggtgaggcaaggcctcagctgctgggacaggacctgcctggcacccagctggtggcagagccaagcattccgactcagctctgggagcagctgccttctgggctggcattctccgccaggggggttgtgccctcgtggccccccccgggtgcctcctcacctggctgatttcatctcctgtccccctgcctcctcctccaggaagcccccagggcctggccctccttgagagtggcatggaggaggaagaagactcgcccaggcccatgggagtyggatggtggccgcacttgtggggccctgaccccataggcttcttcagcacgccctggcctgggtgatccctgcctgagggctgtgcacggctcatctgccagaccagattttaggggattcttgtactgtcctcctggagcagcagggggtaaagcctgacccacccagactgtccagcaacaagggcctcctgctgtgggccagggaccctggaactgaccaattgtgtcctagggacgcagagtccccaggctgctagagggctgtggggccctgtttcatgcctgaagcaggaagaa

SEQ ID NO: 187860 - DNA, 601 bp, Human
tggctcctgggtgccgtgcccgtaaggaggtggccacctgcagggcattcctggcagaggcttcatctggccaggtaggaggctgggtggccgagccccaaatctgggtgtgttctctgcctggcggtgggtcctgccccaggcaccttctcctctgggctggctgggcagggacaatgggcctggctgcgaggagggggcctgggctgccttctgcattgcctcggtgacgggagatggcccctgcctgctgagggataggggagtgggcaggcagtgagagacactgacagctgtcccrcgggtacagggccctgtctgggtggccaggcccatgtctcgggcccacagtgcgccccccacccttggacggcgccttctccctccccaggtgcatgctgcccagccagggagcgtgggggagttcgggagggctggcctacacgccctggtccagctgtcccaggtggggtgctgggcttcagccctcagcccagggcctaggaagccaacttgatcctccccacacagcagccaggttcaaatgcaggtcccgtaacggaagtgctgctgtgcagcccagattggggggcaggagcca

SEQ ID NO: 187861 - DNA, 601 bp, Human
ggctcctgggtgccgtgcccgtaaggaggtggccacctgcagggcattcctggcagaggcttcatctggccaggtaggaggctgggtggccgagccccaaatctgggtgtgttctctgcctggcggtgggtcctgccccaggcaccttctcctctgggctggctgggcagggacaatgggcctggctgcgaggagggggcctgggctgccttctgcattgcctcggtgacgggagatggcccctgcctgctgagggataggggagtgggcaggcagtgagagacactgacagctgtcccgmgggtacagggccctgtctgggtggccaggcccatgtctcgggcccacagtgcgccccccacccttggacggcgccttctccctccccaggtgcatgctgcccagccagggagcgtgggggagttcgggagggctggcctacacgccctggtccagctgtcccaggtggggtgctgggcttcagccctcagcccagggcctaggaagccaacttgatcctccccacacagcagccaggttcaaatgcaggtcccgtaacggaagtgctgctgtgcagcccagattggggggcaggagccag

SEQ ID NO: 187862 - DNA, 601 bp, Human
cagaggcttcatctggccaggtaggaggctgggtggccgagccccaaatctgggtgtgttctctgcctggcggtgggtcctgccccaggcaccttctcctctgggctggctgggcagggacaatgggcctggctgcgaggagggggcctgggctgccttctgcattgcctcggtgacgggagatggcccctgcctgctgagggataggggagtgggcaggcagtgagagacactgacagctgtcccgcgggtacagggccctgtctgggtggccaggcccatgtctcgggcccacagtgcrccccccacccttggacggcgccttctccctccccaggtgcatgctgcccagccagggagcgtgggggagttcgggagggctggcctacacgccctggtccagctgtcccaggtggggtgctgggcttcagccctcagcccagggcctaggaagccaacttgatcctccccacacagcagccaggttcaaatgcaggtcccgtaacggaagtgctgctgtgcagcccagattggggggcaggagccagcagggcccccccaccctcttctcgcaccacactggggaggcagcattggttcc

SEQ ID NO: 187863 - DNA, 601 bp, Human
ccccaaatctgggtgtgttctctgcctggcggtgggtcctgccccaggcaccttctcctctgggctggctgggcagggacaatgggcctggctgcgaggagggggcctgggctgccttctgcattgcctcggtgacgggagatggcccctgcctgctgagggataggggagtgggcaggcagtgagagacactgacagctgtcccgcgggtacagggccctgtctgggtggccaggcccatgtctcgggcccacagtgcgccccccacccttggacggcgccttctccctccccaggtgcrtgctgcccagccagggagcgtgggggagttcgggagggctggcctacacgccctggtccagctgtcccaggtggggtgctgggcttcagccctcagcccagggcctaggaagccaacttgatcctccccacacagcagccaggttcaaatgcaggtcccgtaacggaagtgctgctgtgcagcccagattggggggcaggagccagcagggcccccccaccctcttctcgcaccacactggggaggcagcattggttccagttccggttcctgggctgccctctcaaccccggcctacag

SEQ ID NO: 187864 - DNA, 601 bp, Human
aggctggcccctggatgcattctgcagtggggagcgctgcgtacccctggccacctccccatgggttccctagagccaccgtccccctgggcacatccagggctgaccttgcacccctgctctctgcagcttgactgctgtggctccagcacactgactgctttgaccacctcagtgctcaagaacaatttgtgtccctcgggcagcaacatcatcagcaacctcttcaaggtgcgcgaggccggtggggccgcgcctgaccccccgcatgtcccgcccctgggtggggtcctaggggtgkgcaggtcacacggcagccccacagggagcgaccacactgggtggcatggcccctgtcagggctgctctgctgggagggttggggtgggaccgcatctggcccacgaggaaggcaggcgccctgtgctgcgcattccgggtgaagaaggtggaggctctggggggtgggaactcacctgcacccccagctccacgtgtgcactcgtgggtgtggacgcccctgacagcctgtagctggcagggcctgcaggccatatagtgccctgtggaagtttcctgctgaggcctcagtggaagtcgt

SEQ ID NO: 187865 - DNA, 601 bp, Human
cgcctgaccccccgcatgtcccgcccctgggtggggtcctaggggtgggcaggtcacacggcagccccacagggagcgaccacactgggtggcatggcccctgtcagggctgctctgctgggagggttggggtgggaccgcatctggcccacgaggaaggcaggcgccctgtgctgcgcattccgggtgaagaaggtggaggctctggggggtgggaactcacctgcacccccagctccacgtgtgcactcgtgggtgtggacgcccctgacagcctgtagctggcagggcctgcaggccrtatagtgccctgtggaagtttcctgctgaggcctcagtggaagtcgtcatcagtgatgctttaggggtctagtgacaccaatgaccgtgatctcagtggaaaagggcacagtgtgtcccaggcatttcgcgtttatgttaaaacgggtggaagatagcaagccggcagaggccgggccgctgcacccgcctgttccgaggtgggtagggggtggggggctgttcccaggattcccctctacgctttctgtggtgaccacggattactgcgtgacaacgggaagccgggagccgaggcccg

SEQ ID NO: 187866 - DNA, 601 bp, Human
cgtccaggacactggccagaagggtccgctccacccccacctcctgttgcctagcaacaagggcggtgggtcgcagtggccctcgggccacaaaactggctctgggagctggggggcggggagtctggctttaatgtcatttgggagcttcttccgggagctgggtcacctgcctcccggggcacagtggggccggagtgactaatgcaatcagtggtcacctgagccgctgtgctgggtgggtgggagagggcacactgccctgcccctgcctcttgtgctgccctgctgggagcccccsacgtgggaaatggtgggtgagggggatccaggggatgggcaaggcaagaggcacagtggggcttggtagcctcagccctaggggtgggctcaggatccctcaaaaacacgggggtgtggctagatgccatgggggctgagctgaggcctgagactcccctgctgcatcctgtgccggcctcgggggcctgggcagctgcacctctgctatagaggggtcaggaactcagcccacacagccccacccacaggtgaacttgccccagggacacgaaggccaccagctcacctcaaacacctt

SEQ ID NO: 187867 - DNA, 601 bp, Human
tgtggcctcggcaggttgctctagcccccctgggcctcagtttccccactgggatttggggacatggaaagccctggagcagagctgcctggcaggaggcactgatgctggtgacaagatgggtcctcccctttgtccttccctcccaccccccaggtccagcgtcagcctgcaggacggagtctgggtcccgagcgcaggggcccctcactgcctgtactggaaggcgatctcagcaatcagcttcctgcgctggcggtacacctggtccgagaagccctgagggcagaggggatgcacrggtcaggaggctgtgctggggtgggggcacaggccacggaggctcctggagccgacagactcctgtccagggttgggctaagggtaggggatgtgatcaggggcaggaggcctgagtgaggggcgcaccactcaccgggtggtccaagtccaggtcagggtcgaacttggtgaccaggtgatgacacttgtccagctctgacacttttcttgggaaccaggggactttatgggtgatggaggaagagatcttggtgagctcggagccgtggggctgtgtcacccaccttgaagcagcctc

SEQ ID NO: 187868 - DNA, 601 bp, Human
cgccctatgccgcgcgaccctcggggcgccgagcctccttggcggggcccgggagcaggcagcacacttcacccacccgcacatcgatccccgcccgcccccggcgccaagccagcccctgggtgaccccggctccctccgaggccgcggcgtacctgcgagaactgcgcgaaggtgcggtcggccagcatgggcacgtgccccagcagctcgtggcagcagtccctgcgcgtaggagggagaagggggctgaggggccgcccgtcgcaccccccaccctcgggctggcggccagggcgcscactcacggctcaggggagtgcatgggcgaggacgcgtggcggatatactgggtgcactggaacacgcggaaggccaggctggccaggaagtcccgggcggacagcaggccggccacaggccgcagctggaagcccgtgcgctctgcaaggggccacgcgggtcactgccgagccgggacgggctggagccgcgctggggtggggcgcttggctgaccatccccggccccccggctctgcgcccctcccgtctgggcacacccttcaggaagcgggagacgtcctccagctgggggatat

SEQ ID NO: 187869 - DNA, 601 bp, Human
cagacccccaaacccacaccccaggccctgcagggaggggtcaacccaccgtggacagcttctcaatttcctcatccgaggcccccagggacgccaggccaatgtcctgtggagcaggggaggatgaaggatggggagaggcagccctgggtcatgctcgaggtgggggcaccgggggtgtcagcagcccctccaggggtctctgggacacttcccgggcggcagagaccttccctggccgcccaggatccgcacctacaccgggcctcctccgccaggcagccctccttgaccatattcstaagcccgtgggcgccgttcccaggtagccggcaggtggcagcacaggccgtgggaggctccgctccagccccgccctatgccgcgcgaccctcggggcgccgagcctccttggcggggcccgggagcaggcagcacacttcacccacccgcacatcgatccccgcccgcccccggcgccaagccagcccctgggtgaccccggctccctccgaggccgcggcgtacctgcgagaactgcgcgaaggtgcggtcggccagcatgggcacgtgccccagcagctcgtggcagcagtccctg

SEQ ID NO: 187870 - DNA, 601 bp, Human
ggacggcaagagggtgaggcctggattcagacccccaaacccacaccccaggccctgcagggaggggtcaacccaccgtggacagcttctcaatttcctcatccgaggcccccagggacgccaggccaatgtcctgtggagcaggggaggatgaaggatggggagaggcagccctgggtcatgctcgaggtgggggcaccgggggtgtcagcagcccctccaggggtctctgggacacttcccgggcggcagagaccttccctggccgcccaggatccgcacctacaccgggcctcctcckccaggcagccctccttgaccatattcgtaagcccgtgggcgccgttcccaggtagccggcaggtggcagcacaggccgtgggaggctccgctccagccccgccctatgccgcgcgaccctcggggcgccgagcctccttggcggggcccgggagcaggcagcacacttcacccacccgcacatcgatccccgcccgcccccggcgccaagccagcccctgggtgaccccggctccctccgaggccgcggcgtacctgcgagaactgcgcgaaggtgcggtcggccagcatgggcacgtgc

SEQ ID NO: 187871 - DNA, 601 bp, Human
ggaggtccaggcctcagtttcctcccactgggagcctgtcccctccctgcaccgtcccccagccctgcccctctgctgggggctgcagcaaggagagactctcaccaggagctccccgtaggaggacagcagcccggcaccataggccttcacctccccgttctgcttacacagcccgaactccaccgtgaaccagtacagctgcggggaagccgggcagcatcagcccagagacagctgccgcccaccgggcagcccctggtcacccgtgaccaggacaccacccccagggaggccaggscaggatgcaggcaggccagggtgagggtcacaattcgtgggtggaaggagaggcctcagcctggacggcaagagggtgaggcctggattcagacccccaaacccacaccccaggccctgcagggaggggtcaacccaccgtggacagcttctcaatttcctcatccgaggcccccagggacgccaggccaatgtcctgtggagcaggggaggatgaaggatggggagaggcagccctgggtcatgctcgaggtgggggcaccgggggtgtcagcagcccctccaggggtctctgggacac

SEQ ID NO: 187872 - DNA, 601 bp, Human
cgcagcctcagggtcgaaggcccgaatctcaggctcctcagacaggcagtgctggcaggaggccaatggcatcactgactccactgcacccaggtccccgagggaactggggcaccgtggcctgacgctgggtgggttccttgggtagagtcacccccatctcccccgccgggccttcggaggcctgggataatgtggggtgaggactgggcagagacaagccttctcccaaacagagcctgagtcctggaggtccaggcctcagtttcctcccactgggagcctgtcccctccctgcacygtcccccagccctgcccctctgctgggggctgcagcaaggagagactctcaccaggagctccccgtaggaggacagcagcccggcaccataggccttcacctccccgttctgcttacacagcccgaactccaccgtgaaccagtacagctgcggggaagccgggcagcatcagcccagagacagctgccgcccaccgggcagcccctggtcacccgtgaccaggacaccacccccagggaggccaggccaggatgcaggcaggccagggtgagggtcacaattcgtgggtggaaggagag

SEQ ID NO: 187873 - DNA, 601 bp, Human
ggctttgctcccctctcctgacactctggtcactgcaccaaaggcccccagccctggggaccccactcccgccctgtcccccaccttgactctgtctatccccctgacttctccccatcccagggcagggggccgggacaggttccacaggacgtcctcacaaagctcaggctctgtcagcacctccaagactggccttgacccggccacccagcagcccccagtcctgtaggtctgcccctccccagacgctggggtccttctcacggatggtgtccctgctgtgtgggggctgctgcarccaggggtcggttttctcatctgtgacctgggctcacaggtccagccctgctcaaggccagaaggaaggcctggctggcccagtttgggggcaccatggggggcttgccctagcagcctagcccacctgagcttgtccttggcgtcactgaagctctcagacacgaagtagactgactggtacgtctggtcttggtagggctgcacggccgcagcctcagggtcgaaggcccgaatctcaggctcctcagacaggcagtgctggcaggaggccaatggcatcactgactccactgcaccc

SEQ ID NO: 187874 - DNA, 601 bp, Human
gtgggtaaaacaagtcaggcccctccacctccagagcccaccctttcttctcggcctctcactggggcccacccctgaaggctgcactctgaggcttggaaaggccaaggccatgcccaagaggaggctctgctggggttgggtgagtgaagactcagccccactggcccggccaccaggctgccatgtgtcagtgtggtcatcaggaggcctggggtggacatgattagtgatcgggctttgttacaggcgccttgcctctgagaggtcccagcagctcctggcccctgccaggccctcrggcccagaggctcagtgctgcctaccactgttggcccttcaggaacaccccacccaaggcctctgaccctcacttcctcctcatcttccctagacaggcagaggccagcgtgaaattcatgtgaagcctggggcagcgttggcctcacggagcccctcttaacttggtgctgggtgctcccaaggccagggccatgtgcagtgcctcagataaggccaccagagacccctcaagagcccctgtgctccccgtccaccaagacctgcacctaggctctcagaccccacatcccccgagacc

SEQ ID NO: 187875 - DNA, 601 bp, Human
ccgtgatgtacagaaccgctcagaagagcctgcttgaccttcagagaaatgcacagtccctacgagcaaaactggggtgctgctctgcagtgtttaagttcacaggtccccagctcagggttgacgcgagccaggcggggcagcagcgtgagctcccctgggggcgaaggtcaggcctgtgcagcctgcaggggcccagaagctgagttgacagtgaccgtgaggttctgcagtagagggaacttgcagttaacgcaccgaatgccaggcaggcctttccagaaggtacttcctagaacckcatcagtcccatcagccgcagagcaggcctaaccctgatgcggccactgggccccggggcagacgaggtggggcacctgccagccaggagcgtgcagagactgtcacctcctctcacaggcacttgcccggagcagggagccatgtggggctgtggagcaggccaggggttggttgggcagtgctcccactctgtggggtctgtgccactgccaccccatgctggtgtgcccagagtagggagtcttgcagccagcagcactggtgttgctggggctgcctggccccactagtgccgctg

SEQ ID NO: 187876 - DNA, 601 bp, Human
gacttgtcaggagtgagacccacagtttcaaagcctttctttgggctcttcattttgagtcccaggcaaacccagaggcactttctctctgggccaagatgtccacagcctgccccggccacctcctgggcctccccactctgcccctggggctggccttactgggtggggatggggttgtgttccggtgtaaatggtccctggaggccgagccggcgggccctgccactagatggcagtcacacgatggtggaaaccgcctcctgggccagccggcctgttgtggggctaaggaggcagtttgtgaaaaaggccaagttagcatggcagcttttctgaaaaacagtcacatttgttgttctaaacaggggcccccggaataatttggcctgatacttgctgtgcatgaaatcagccaatccaggtggggagagcagccgttggcctcataaaggcctctgtgtgctcagtgtcagtcgggcccatctgtctttgtcatggcatgtgggtggacatcccgtgtgccggcaccgccacgggcacttcagaggcagctacggttacaagtggcattcaagtcatccgagcccttgcgttcttc

SEQ ID NO: 187877 - DNA, 601 bp, Human
ctgagaccttgctcagcgtgtccccctgggccctgcgccagggcttagaatcactgctaattgcaaagcccagggagggagcattggaaagataaaattatccacgttatttggagttggccgctgtggaaaggccctgtcccacgtggcgggagtcccacatttctttctccgacaacctgataagcatctccttggcccaaagtcctgggagctgaaagcagcgcctcagtgacccacacaacaaaaagaccattgactgcccgctgccccgaggcttgtgtggatgctgagcagcgcrggaatgaagggcgcgcaggaatgaagggcgcacgacatgagaggcaactccagaacaaaccgctgccgccagctgggccgagctccgtgctcggggctccggcctccaggtccaggcaggcggcagcccccagggcgccctgggattcctgaaggcagggctgccttgtttacttgtcattgggacatttttctccattcctgttctttaccccgatcagctgtctctctcctttttggaaggatcaagggctttttttttttaggtacaaggtgaactcttctagaaaggggaagcccc

SEQ ID NO: 187878 - DNA, 601 bp, Human
gctgtggaaaggccctgtcccacgtggcgggagtcccacatttctttctccgacaacctgataagcatctccttggcccaaagtcctgggagctgaaagcagcgcctcagtgacccacacaacaaaaagaccattgactgcccgctgccccgaggcttgtgtggatgctgagcagcgcaggaatgaagggcgcgcaggaatgaagggcgcacgacatgagaggcaactccagaacaaaccgctgccgccagctgggccgagctccgtgctcggggctccggcctccaggtccaggcaggcrgcagcccccagggcgccctgggattcctgaaggcagggctgccttgtttacttgtcattgggacatttttctccattcctgttctttaccccgatcagctgtctctctcctttttggaaggatcaagggctttttttttttaggtacaaggtgaactcttctagaaaggggaagcccctgggaaaccatgcttggcatccccaaacggtgtttgtctcctgtaagaaacggattttctctcagcacctttccccatttcttcccgaagctgtgacaaatggccatgtttgtgctttaaac

SEQ ID NO: 187879 - DNA, 601 bp, Human
gtgctcggggctccggcctccaggtccaggcaggcggcagcccccagggcgccctgggattcctgaaggcagggctgccttgtttacttgtcattgggacatttttctccattcctgttctttaccccgatcagctgtctctctcctttttggaaggatcaagggctttttttttttaggtacaaggtgaactcttctagaaaggggaagcccctgggaaaccatgcttggcatccccaaacggtgtttgtctcctgtaagaaacggattttctctcagcacctttccccatttcttcccraagctgtgacaaatggccatgtttgtgctttaaactgtcattttgggttccccttgcctcggaaaactagcagaatcacctccatatagtcaaggtgaatctcccattctgggcagtcagcctcacgtgtaaacgactgccccttggtattttaaaagacgcaaagttcagagctgtgtaaggcaatcctcctgcaggccggctacggcgcacgcagtgccactctccccgccagcccctgcgctctgcgccagggatcagggtgcatacacctccctcgcagggtgggatctgggcctg

SEQ ID NO: 187880 - DNA, 601 bp, Human
gaggggagctgccggccagcaggcatccaggcatcacagctgagcctcgccaggggaacccgagttgcccccggtgcaggtcccagaagagatgggagggctcagggcgtgcggtgcagggacaggtagggctttgaggggcagaggggcgacgtgctaatggtcaggggatggggatccggtgctggggatagaggccggcctaggagcaggtcagcgggggctgtggcctggtgtgcggaagggaaggcgctggggcccaggttgcagaaagagtgtgatgcccgcagccacacaggayggacctgagaggaggcccagggtgacgctcacataccccaaaactgcagccagggctgctaccagtctctgccttggtgctgacagcagagggtcccggtctacccgacccggggcggtgcagggaccacctcccggccttcacacaaagctcctgtgctgttggtggctgcagtcactgtcctgtgtctgtgtccttggtggccgtcacattgctgtgggtctggtatgtgtgaggggtctgcatctctgacttcttgctgccaaatcccacttgggtacaggtgcggggggccactga

SEQ ID NO: 187881 - DNA, 601 bp, Human
gtcctgtgtctgtgtccttggtggccgtcacattgctgtgggtctggtatgtgtgaggggtctgcatctctgacttcttgctgccaaatcccacttgggtacaggtgcggggggccactgaagggaccccgagtgccgtgagtggagtggaggctaagcagaggccggggctggctgagggctgggtcgggacgtccgtgcctgtccccagggagaggtgggaggatgccctgcccaggccgtgtgcagggagacaggcttctgggtgcacaacagctgtgtcccagctgcaaaacgggcyctcctgtcagcaccacccccagccctggactaggtgctgctcctggtcacctcatgcccatagaagggcaggacatgagcctctgggctggggcacccccgccttcctccttggcctcatccttggccaccccctcccagctgtctcaaatgccctggatcccccgggccaggagcggggagggggggttggagtgggcatggccaaggcacagatgatcctggggcatcttggtgtagatcctgggaggccagggctgcacctgtgccggggctgtcaggcgctccagctggagagcgg

SEQ ID NO: 187882 - DNA, 601 bp, Human
ggccgtgtgcagggagacaggcttctgggtgcacaacagctgtgtcccagctgcaaaacgggctctcctgtcagcaccacccccagccctggactaggtgctgctcctggtcacctcatgcccatagaagggcaggacatgagcctctgggctggggcacccccgccttcctccttggcctcatccttggccaccccctcccagctgtctcaaatgccctggatcccccgggccaggagcggggagggggggttggagtgggcatggccaaggcacagatgatcctggggcatcttggtgyagatcctgggaggccagggctgcacctgtgccggggctgtcaggcgctccagctggagagcggcggttctcctgggctctgcaaagcctggaccccctccttggacatcccctgcccccgcgaattgcatggggtgcgcagccaagcctgacctttcagaatgaaactgagagccccagtggggtaggcttctcatttcacaaggtgactaagggaaccggggagtttcctgtctaggatgggacagaagtcccctgcacccaggcagggatgtatggcctgggaagcccccacacggga

SEQ ID NO: 187883 - DNA, 601 bp, Human
actaggtccagggcaggccaagcccctccagctggacaagtgggtccagcccctcagactgttgcatgatgtggcccctcccctcagactgcccgggacggggccagattcctcagaaccacccctccatgatgtggtctctcagatgcccccaggacaggactgtcctctcccacgaggcctcaggccaaagaaggtcccctgaccctgggcggggtccaggctccgcttcggctaccagccaggctggactgcggttcctccactcgggggcactcctgtctcgccccgctgtccagcmgacagtcactagcttgtccttgtcccttgggggcagggacgaggatttcacagagctgccttgtggctctggggggactctctggtgacgctgggggatgcctgccctctatagctcccaagagcaaggctctccccacactgaggaactatctggccttggaggccttgaggcgatgaggacggggcgtcctggtccacagctggggagggtcaggttgccctctcagaccttgggttcgacatatccagatgttggagcccagctctgcaggggtgtaccctccctggggtcacactg

SEQ ID NO: 187884 - DNA, 601 bp, Human
aaccacccctccatgatgtggtctctcagatgcccccaggacaggactgtcctctcccacgaggcctcaggccaaagaaggtcccctgaccctgggcggggtccaggctccgcttcggctaccagccaggctggactgcggttcctccactcgggggcactcctgtctcgccccgctgtccagccgacagtcactagcttgtccttgtcccttgggggcagggacgaggatttcacagagctgccttgtggctctggggggactctctggtgacgctgggggatgcctgccctctatagcycccaagagcaaggctctccccacactgaggaactatctggccttggaggccttgaggcgatgaggacggggcgtcctggtccacagctggggagggtcaggttgccctctcagaccttgggttcgacatatccagatgttggagcccagctctgcaggggtgtaccctccctggggtcacactgcatttttggctgcagtgcctgtccttggcccagctgcccgggggtgcccacccgcccaggcgtgcccaccccatgtccacacctagaaggcaagtctgcctgccgccaccctgtcc

SEQ ID NO: 187885 - DNA, 601 bp, Human
tatagctcccaagagcaaggctctccccacactgaggaactatctggccttggaggccttgaggcgatgaggacggggcgtcctggtccacagctggggagggtcaggttgccctctcagaccttgggttcgacatatccagatgttggagcccagctctgcaggggtgtaccctccctggggtcacactgcatttttggctgcagtgcctgtccttggcccagctgcccgggggtgcccacccgcccaggcgtgcccaccccatgtccacacctagaaggcaagtctgcctgccgccacyctgtcccacagacaccctggctgccctctcagtctgcccctgtgtagcccaggcccccatcaggatgaccctacccccagtctgttccccatgagcgaccaggccgtgtctcccacggaaagaaccattcaccagctacaggcaaagtccatggccctgggtggccacgccaggccctcctggcctggttgaactcacttcccatcccaccagctttcccagctcttcccagttttggaaggtgtcagagccctggcacatgcccctcctagcatcacccaaccgccctgctcctctgca

SEQ ID NO: 187886 - DNA, 601 bp, Human
cggggcgtcctggtccacagctggggagggtcaggttgccctctcagaccttgggttcgacatatccagatgttggagcccagctctgcaggggtgtaccctccctggggtcacactgcatttttggctgcagtgcctgtccttggcccagctgcccgggggtgcccacccgcccaggcgtgcccaccccatgtccacacctagaaggcaagtctgcctgccgccaccctgtcccacagacaccctggctgccctctcagtctgcccctgtgtagcccaggcccccatcaggatgaccctrcccccagtctgttccccatgagcgaccaggccgtgtctcccacggaaagaaccattcaccagctacaggcaaagtccatggccctgggtggccacgccaggccctcctggcctggttgaactcacttcccatcccaccagctttcccagctcttcccagttttggaaggtgtcagagccctggcacatgcccctcctagcatcacccaaccgccctgctcctctgcagaccttcaaaggcctgcccagcccgcggtgggaggccgctgcccagggctctggcagcacctgccatggacag

SEQ ID NO: 187887 - DNA, 601 bp, Human
ggagcccagctctgcaggggtgtaccctccctggggtcacactgcatttttggctgcagtgcctgtccttggcccagctgcccgggggtgcccacccgcccaggcgtgcccaccccatgtccacacctagaaggcaagtctgcctgccgccaccctgtcccacagacaccctggctgccctctcagtctgcccctgtgtagcccaggcccccatcaggatgaccctacccccagtctgttccccatgagcgaccaggccgtgtctcccacggaaagaaccattcaccagctacaggcaaastccatggccctgggtggccacgccaggccctcctggcctggttgaactcacttcccatcccaccagctttcccagctcttcccagttttggaaggtgtcagagccctggcacatgcccctcctagcatcacccaaccgccctgctcctctgcagaccttcaaaggcctgcccagcccgcggtgggaggccgctgcccagggctctggcagcacctgccatggacagggccagtcctggagccccgcctggcccatcggagcctccctcgcttctctgtgtgctgagctgagttgggaagg

SEQ ID NO: 187888 - DNA, 601 bp, Human
agctctgcaggggtgtaccctccctggggtcacactgcatttttggctgcagtgcctgtccttggcccagctgcccgggggtgcccacccgcccaggcgtgcccaccccatgtccacacctagaaggcaagtctgcctgccgccaccctgtcccacagacaccctggctgccctctcagtctgcccctgtgtagcccaggcccccatcaggatgaccctacccccagtctgttccccatgagcgaccaggccgtgtctcccacggaaagaaccattcaccagctacaggcaaagtccatgsccctgggtggccacgccaggccctcctggcctggttgaactcacttcccatcccaccagctttcccagctcttcccagttttggaaggtgtcagagccctggcacatgcccctcctagcatcacccaaccgccctgctcctctgcagaccttcaaaggcctgcccagcccgcggtgggaggccgctgcccagggctctggcagcacctgccatggacagggccagtcctggagccccgcctggcccatcggagcctccctcgcttctctgtgtgctgagctgagttgggaagggcaggga

SEQ ID NO: 187889 - DNA, 601 bp, Human
gtaccctccctggggtcacactgcatttttggctgcagtgcctgtccttggcccagctgcccgggggtgcccacccgcccaggcgtgcccaccccatgtccacacctagaaggcaagtctgcctgccgccaccctgtcccacagacaccctggctgccctctcagtctgcccctgtgtagcccaggcccccatcaggatgaccctacccccagtctgttccccatgagcgaccaggccgtgtctcccacggaaagaaccattcaccagctacaggcaaagtccatggccctgggtggccaygccaggccctcctggcctggttgaactcacttcccatcccaccagctttcccagctcttcccagttttggaaggtgtcagagccctggcacatgcccctcctagcatcacccaaccgccctgctcctctgcagaccttcaaaggcctgcccagcccgcggtgggaggccgctgcccagggctctggcagcacctgccatggacagggccagtcctggagccccgcctggcccatcggagcctccctcgcttctctgtgtgctgagctgagttgggaagggcagggatgacctgaggggct

SEQ ID NO: 187890 - DNA, 601 bp, Human
gtattggtgcgagctgaggtggtgcttgcggaggtgagattgagggccgggcctggccagggatgctgggaggggggcaaccctgtgcctggggctgtgagggtctcttgacgagaacaaaccctacctggggagaagtgacagagaaaagaaagaaagaaagcgaaggcacgagaaagaaatgagagaaagggagggaaaaatgctgagagggagggagagcaggggctgccttgaaggaggagggagggggagcagaagcgggtgcagggtggtggcaggatgggaagggcagagggasgggctgaggtgcgaatggaagctgtgtgagggtcccgggcactgccccttgccgccgaccccaggtgtgggaggagggatctctcccacgtgggccgcacctagcaggtgccggggcagaaggctcagagccgctgtctcacacagcttcttggtgctccaaagacgggcggtaggaggaagatcaaagaagcgagaaatggatgctggaggaacgcagtgaggccaggcgagggctggcgagcttgccaaggagaggacgggcgaggaaaatggggcgccccacagaggagggggcgtg

SEQ ID NO: 187891 - DNA, 601 bp, Human
ggacatcccaaggccatgtgagtctcccacggcccactgaagctggtccttcataccccattttgcaaacaggaaagctgaggctcagggaggcaccaaagcttactcccatcctggggcttggcagggggtgcccgcagcacccggggacatacaccggggagtctcctgggaaagaagtgccggcccaggggcagactcttttctgctctgccatgtcttccctgcacccccagggatgatgagtctgggaggggctggtcagccatgaaagcttcggggaggggccggtggccaggcygggcaccccagagctccacaggcagacatggtgtgggggtgtcaggaagagggcctggctgctgggtgctacggtaggaagatcccggtgctgtgggagtggagcaggtggttgaatgccaggctggcttggtccttctctctgggtgccggctgtggctcccgcccaggtgggcaccacgtctgaataatgtatgaagcctctggttgcgtggaggatgggagcgcttcgggcagcatctgtgggcagagacttcagggatgtgaggtacatctgggcatggctagctgggaaggaaag

SEQ ID NO: 187892 - DNA, 601 bp, Human
tctcctgggaaagaagtgccggcccaggggcagactcttttctgctctgccatgtcttccctgcacccccagggatgatgagtctgggaggggctggtcagccatgaaagcttcggggaggggccggtggccaggctgggcaccccagagctccacaggcagacatggtgtgggggtgtcaggaagagggcctggctgctgggtgctacggtaggaagatcccggtgctgtgggagtggagcaggtggttgaatgccaggctggcttggtccttctctctgggtgccggctgtggctcccrcccaggtgggcaccacgtctgaataatgtatgaagcctctggttgcgtggaggatgggagcgcttcgggcagcatctgtgggcagagacttcagggatgtgaggtacatctgggcatggctagctgggaaggaaagaggatggcagagcctcgagccgttgccagggactggttgcgtgtcccagaacgtgccaaaagcctgcctcgtgagcacggcaagagctctgccagggcagtcccagctggcccaggcgccgcagcgctcccgagggccgtcgagcaaaggcgggaggcgcagcc

SEQ ID NO: 187893 - DNA, 601 bp, Human
cggcccaggggcagactcttttctgctctgccatgtcttccctgcacccccagggatgatgagtctgggaggggctggtcagccatgaaagcttcggggaggggccggtggccaggctgggcaccccagagctccacaggcagacatggtgtgggggtgtcaggaagagggcctggctgctgggtgctacggtaggaagatcccggtgctgtgggagtggagcaggtggttgaatgccaggctggcttggtccttctctctgggtgccggctgtggctcccgcccaggtgggcaccacgtstgaataatgtatgaagcctctggttgcgtggaggatgggagcgcttcgggcagcatctgtgggcagagacttcagggatgtgaggtacatctgggcatggctagctgggaaggaaagaggatggcagagcctcgagccgttgccagggactggttgcgtgtcccagaacgtgccaaaagcctgcctcgtgagcacggcaagagctctgccagggcagtcccagctggcccaggcgccgcagcgctcccgagggccgtcgagcaaaggcgggaggcgcagccgggctgtcggtggacctgt

SEQ ID NO: 187894 - DNA, 601 bp, Human
gtatgaagcctctggttgcgtggaggatgggagcgcttcgggcagcatctgtgggcagagacttcagggatgtgaggtacatctgggcatggctagctgggaaggaaagaggatggcagagcctcgagccgttgccagggactggttgcgtgtcccagaacgtgccaaaagcctgcctcgtgagcacggcaagagctctgccagggcagtcccagctggcccaggcgccgcagcgctcccgagggccgtcgagcaaaggcgggaggcgcagccgggctgtcggtggacctgtaggtatcakggctccttggtcccctcctgcgggaagcaggcaccgagtggggctgcatgtagacgcatgcgagggtgagagctgcggcggaggacgctgatcgcggagtgcaggcgagggccccagaaaggtcccgcaggtcgcctcgctcgtggcacgggctcggcagcgttgtggttagtgacacggaggaagacagaaagccatatgcacagcacgcagaacaggaggaggggggaagaaagagcaggcacggggcaggcagagccgcagccacgccgccgggatgcagcaggcagggccacccac

SEQ ID NO: 187895 - DNA, 601 bp, Human
gtagagttggggtctgtctggctggcgtgggcacctttgggagggggtgtgtgtggcgggcagacctgggctgtagtcaccctggcctgcgctggtagagttggggtctgtccggctggcgtgggcacctttgggacggggtgtgtgtggcgggcatgcctgggctgcagtcaccccggcccgcactcagactagtcctggcatcaccactctggggcgaagttgatgcaggagctcagggccctcatgcagcactgggtgggtcatgaagctcagggggcttcagcaatggaggaggcgrccctatcccatcccaagttggacagcagtcccagcggtggggggtgggggtatagggggaagcaggtttggattgggtgggtaaggaacccagaggaacagacccctccctgtgcacctctccccagaggtggaggcagggagagatggaggcagggagaggtggaggcagggggcagagacaagcctcaggtcatcaagagttgagggctggcatctgggatacagggaggatggggagaggggagggctgtgcgggtggggggcggctctgtctccccttggctgtgcctccctgggg

SEQ ID NO: 187896 - DNA, 601 bp, Human
agccacaggctgacgggggaggcccagccctgccctagcgagtcccagagtgatgggggaggcacagccctgctcttagggagccacaggctgacaggggaggcacagccctgtcctcagggagccctacactgatcgaagaggcacagccttaccctcagggagccccaaactgatgagggaggcatagccctgccctcaggtagccccaggctgatggaggaggcatagccctgctgagcctcaaggagtcctggactgatggaggaagcacagttctcaggctgccccagaactgacrggggaggcacagccctgccctcaggtattctgaccacaggagacacagcccagagccagctctgtggcagacagggtctcccacacttggagtccagggcctgagcgggcgccgtgaggtgagtgtgggccctgggcagaggaggcagcagccgcccagtcctaagctcccccctgctaccctcagcctcagcctgaagccctcggaggcccctgaactggatgaggacgagggctttggcgactggtcccagaggccagagcagcggcagcagcacgagggggcgcagggcaccttgga

SEQ ID NO: 187897 - DNA, 601 bp, Human
tgacgggggaggcccagccctgccctagcgagtcccagagtgatgggggaggcacagccctgctcttagggagccacaggctgacaggggaggcacagccctgtcctcagggagccctacactgatcgaagaggcacagccttaccctcagggagccccaaactgatgagggaggcatagccctgccctcaggtagccccaggctgatggaggaggcatagccctgctgagcctcaaggagtcctggactgatggaggaagcacagttctcaggctgccccagaactgacaggggaggcayagccctgccctcaggtattctgaccacaggagacacagcccagagccagctctgtggcagacagggtctcccacacttggagtccagggcctgagcgggcgccgtgaggtgagtgtgggccctgggcagaggaggcagcagccgcccagtcctaagctcccccctgctaccctcagcctcagcctgaagccctcggaggcccctgaactggatgaggacgagggctttggcgactggtcccagaggccagagcagcggcagcagcacgagggggcgcagggcaccttggacagcggagag

SEQ ID NO: 187898 - DNA, 601 bp, Human
ccaccccaccccctgcacctgcctggctgcacagacctgctcctgaatggcccctctgtgtggctgctgctggctcagacccctgcccaccttgggcgggtgggtctgggtcttggctggcacgcacacccaggggcctgaaatcatggaaaattcgagaatttcccatcttctcctccaggttcagtcctgctcaaatgcagagccgctcaaagctgccagctggctggcctcccctcccccgcagccggcagccccttggccctgctcctcagtgacctggcccctacccctgcctagmcctccaaatgacccagcctccagtcccccaaacacccaagggcccccacagggagcagagcaggagtggtggccccagcagcccggcctcgcggggaccccgtcagaccaaccgggtgtgcaagcagctgccaagctgaggcccagccacaaagctggggattgaacccagcctcagtgcctgggggaccctcagtctgtagagccctgtctggcagggactgggcagttccccaggggcctcaggccctgacacaggggcccaagcagactgcgctggctctgaggccactggaccttc

SEQ ID NO: 187899 - DNA, 601 bp, Human
aaccaacgcccttccatccaatcagtgccgccttattcaaccaacaccctatccaaccaatgcttctccatccagtcagtgcccctctacccaatcaatgcccctccatctaatcaatgtcactccatgtaatcaatgccccccctttcaatcaatgctactccatccaaccaataatctcccatcctatcaatgcttctgcatccaattaatgttcctttatacaaccaatactcctgcaaccaatactcctccaattattcagtgttcctccattcaatcaatgcccccctcggaacartactccaccacccaatcaatgctctttcatcctatcaatgctcctctatccagccaatattcctccagtcaatcaatccccctttatccaaccagtactccttaatccaatcagtgcccctccatccaatcaagattcatccctccatccaatactactccatccaatcagtgcctctgcatccaatgtccctccatccaatcaatgtccctcccatccaatcaattctcctccatccatcaatgcttctccatctgaccaataccctccatccaaccaatactcatctatccaatgaat

SEQ ID NO: 187900 - DNA, 601 bp, Human
gggatattcccgcagacctcctgtctggggtggcccggccaagccgcccaccctggtttctgggcaccacgtgtttgcaaggacattgacaaatggcatctgtccgagccagaggctctctggtttggggaaggagggagtcctgggggctgccgctggtgggggctggctctgccaaggcaagaacagagctgctggaggggtgggggcggaaggagcctgcttaggactgctctcagctaccggcctcctctggatgacgggactgcaggaaccacgagaaccccagttctagctcccrgggtgggcaggctgcttggcaggcaggccgccttccctccaccaggagtcaggtctccagccagaggtcctgacccagggcacaagtgctcgcactgggaagcaggcctctgaggcaggacgtcttctcctgtggtggagtgggggtgtgggcagggcagggaggccagcagagagaggctcggggagcaggctctgtgggcttgcaggaggcaggtctgtggcccctccctggaccctagcctaatgccccctgcaccccatgcctatgttccagcttcctgggtctgcaggtccagcc

SEQ ID NO: 187901 - DNA, 601 bp, Human
agctttcttgttctccaccaaggtggcgatggtgttaactcctgctcgaaggacaggtggtctcttggtgggggcgtcccctttgccagcagctttcttctcggcctgggccaacagccttcttctcttgctttgtctctggtctgtacttgtgggccagcttaagcagctgagtagctgtttggcggtccagggcctgggtgaactggttaatcgcaggaggcactttcagccccttatagaggatggctctctgccgctgcaacctgatatagcagggccatttcacaaagcgggtgargtgtcttttgggctggatgtcctgtccaatgccaaaattcttaggccgtttctcaaacaggggattcaccactttcttagcctcctgcttcttcatgacagcaggggccggaaccaccttctttcccttggccttctttcctttcggcatcttgggcggcgggaggagagtgggcttgccatttttgaaagctggtgatagcgggcttgtgaatgtggtggcaggtatttctttccccatcaggtggtgggggctggagtgctgttctccgtgttttaactatccaaatacgtgcttgtt

SEQ ID NO: 187902 - DNA, 601 bp, Human
gatctcagacagttgagctttctagtattacctgccaactcttcctcaaactagtcagccttctctttgccttacaaccctgcttctgctgctttttgctagaatgtgacaaaaggtgacctgggcttgccatttttttttgaaggaaaatttgtattattttaattatttttatgtacagaaaactcaacagtgtacatttaacccagtttagtggcaagttctttagcctttgccttttcgagcttggcgatacgagccacggacttaggacccaggacgttgctgccccagtgacagyggatctcatcgtatctgtatctgtcgttgtaattggtcctgatagcttccaccagcttagccaaagtgtctttgtcttccgagttcacctgtgtgaagccgacagtggtgcaggtcttcctgtggactagacgtcccagtcttgccttccccttgataatgcagtaagggacccccattttacgacacagggcaggcaagaagacaaccagctcgatgggatccacatcgtgtgcaatcaccaccagctgagctttcttgttctccaccaaggtggcgatggtgttaactcctgctcgaa

SEQ ID NO: 187903 - DNA, 601 bp, Human
gaaacccttcagaagcatgtcagagattcctgtgcttcttgcccctgccaaacgacatttgcagtgacaactggtgccgaaaccctagcagcccacacagaactccttgggaaaggagaaagctgaagtttcaaggttgatgttttctaatgagatctcagacagttgagctttctagtattacctgccaactcttcctcaaactagtcagccttctctttgccttacaaccctgcttctgctgctttttgctagaatgtgacaaaaggtgacctgggcttgccatttttttttgaaggaraatttgtattattttaattatttttatgtacagaaaactcaacagtgtacatttaacccagtttagtggcaagttctttagcctttgccttttcgagcttggcgatacgagccacggacttaggacccaggacgttgctgccccagtgacagcggatctcatcgtatctgtatctgtcgttgtaattggtcctgatagcttccaccagcttagccaaagtgtctttgtcttccgagttcacctgtgtgaagccgacagtggtgcaggtcttcctgtggactagacgtcccagtcttgcct

SEQ ID NO: 187904 - DNA, 601 bp, Human; identical to SEQ ID NO: 103017

SEQ ID NO: 187905 - DNA, 601 bp, Human; identical to SEQ ID NO: 103018

SEQ ID NO: 187906 - DNA, 601 bp, Human; identical to SEQ ID NO: 103019

SEQ ID NO: 187907 - DNA, 601 bp, Human; identical to SEQ ID NO: 103020

SEQ ID NO: 187908 - DNA, 601 bp, Human; identical to SEQ ID NO: 103021

SEQ ID NO: 187909 - DNA, 601 bp, Human; identical to SEQ ID NO: 103022

SEQ ID NO: 187910 - DNA, 601 bp, Human; identical to SEQ ID NO: 103023

SEQ ID NO: 187911 - DNA, 601 bp, Human; identical to SEQ ID NO: 103024

SEQ ID NO: 187912 - DNA, 601 bp, Human; identical to SEQ ID NO: 103025

SEQ ID NO: 187913 - DNA, 601 bp, Human; identical to SEQ ID NO: 103026

SEQ ID NO: 187914 - DNA, 601 bp, Human; identical to SEQ ID NO: 103027

SEQ ID NO: 187915 - DNA, 601 bp, Human; identical to SEQ ID NO: 103028

SEQ ID NO: 187916 - DNA, 601 bp, Human; identical to SEQ ID NO: 103029

SEQ ID NO: 187917 - DNA, 601 bp, Human; identical to SEQ ID NO: 103030

SEQ ID NO: 187918 - DNA, 601 bp, Human; identical to SEQ ID NO: 103031

SEQ ID NO: 187919 - DNA, 601 bp, Human; identical to SEQ ID NO: 103032

SEQ ID NO: 187920 - DNA, 601 bp, Human; identical to SEQ ID NO: 103033

SEQ ID NO: 187921 - DNA, 601 bp, Human; identical to SEQ ID NO: 103034

SEQ ID NO: 187922 - DNA, 601 bp, Human; identical to SEQ ID NO: 103035

SEQ ID NO: 187923 - DNA, 601 bp, Human; identical to SEQ ID NO: 103036

SEQ ID NO: 187924 - DNA, 601 bp, Human; identical to SEQ ID NO: 103037

SEQ ID NO: 187925 - DNA, 601 bp, Human; identical to SEQ ID NO: 103038

SEQ ID NO: 187926 - DNA, 601 bp, Human; identical to SEQ ID NO: 103039

SEQ ID NO: 187927 - DNA, 601 bp, Human; identical to SEQ ID NO: 103040

SEQ ID NO: 187928 - DNA, 601 bp, Human; identical to SEQ ID NO: 103041

SEQ ID NO: 187929 - DNA, 601 bp, Human; identical to SEQ ID NO: 103042

SEQ ID NO: 187930 - DNA, 601 bp, Human; identical to SEQ ID NO: 103043

SEQ ID NO: 187931 - DNA, 601 bp, Human; identical to SEQ ID NO: 103044

SEQ ID NO: 187932 - DNA, 601 bp, Human; identical to SEQ ID NO: 103045

SEQ ID NO: 187933 - DNA, 601 bp, Human; identical to SEQ ID NO: 103046

SEQ ID NO: 187934 - DNA, 601 bp, Human; identical to SEQ ID NO: 103047

SEQ ID NO: 187935 - DNA, 601 bp, Human; identical to SEQ ID NO: 103048

SEQ ID NO: 187936 - DNA, 601 bp, Human; identical to SEQ ID NO: 103049

SEQ ID NO: 187937 - DNA, 601 bp, Human; identical to SEQ ID NO: 103050

SEQ ID NO: 187938 - DNA, 601 bp, Human; identical to SEQ ID NO: 103051

SEQ ID NO: 187939 - DNA, 601 bp, Human; identical to SEQ ID NO: 103052

SEQ ID NO: 187940 - DNA, 601 bp, Human; identical to SEQ ID NO: 103053

SEQ ID NO: 187941 - DNA, 601 bp, Human; identical to SEQ ID NO: 103054

SEQ ID NO: 187942 - DNA, 601 bp, Human; identical to SEQ ID NO: 103055

SEQ ID NO: 187943 - DNA, 601 bp, Human; identical to SEQ ID NO: 103056

SEQ ID NO: 187944 - DNA, 601 bp, Human; identical to SEQ ID NO: 103057

SEQ ID NO: 187945 - DNA, 601 bp, Human; identical to SEQ ID NO: 103058

SEQ ID NO: 187946 - DNA, 601 bp, Human; identical to SEQ ID NO: 103059

SEQ ID NO: 187947 - DNA, 601 bp, Human; identical to SEQ ID NO: 103060

SEQ ID NO: 187948 - DNA, 601 bp, Human; identical to SEQ ID NO: 103061

SEQ ID NO: 187949 - DNA, 601 bp, Human; identical to SEQ ID NO: 103062

SEQ ID NO: 187950 - DNA, 601 bp, Human; identical to SEQ ID NO: 103063

SEQ ID NO: 187951 - DNA, 601 bp, Human; identical to SEQ ID NO: 103064

SEQ ID NO: 187952 - DNA, 601 bp, Human; identical to SEQ ID NO: 103065

SEQ ID NO: 187953 - DNA, 601 bp, Human; identical to SEQ ID NO: 103066

SEQ ID NO: 187954 - DNA, 601 bp, Human; identical to SEQ ID NO: 103067

SEQ ID NO: 187955 - DNA, 601 bp, Human; identical to SEQ ID NO: 103068

SEQ ID NO: 187956 - DNA, 601 bp, Human; identical to SEQ ID NO: 103069

SEQ ID NO: 187957 - DNA, 601 bp, Human; identical to SEQ ID NO: 103070

SEQ ID NO: 187958 - DNA, 601 bp, Human; identical to SEQ ID NO: 103071

SEQ ID NO: 187959 - DNA, 601 bp, Human; identical to SEQ ID NO: 103072

SEQ ID NO: 187960 - DNA, 601 bp, Human; identical to SEQ ID NO: 103073

SEQ ID NO: 187961 - DNA, 601 bp, Human; identical to SEQ ID NO: 103074

SEQ ID NO: 187962 - DNA, 601 bp, Human; identical to SEQ ID NO: 103075

SEQ ID NO: 187963 - DNA, 601 bp, Human; identical to SEQ ID NO: 103076

SEQ ID NO: 187964 - DNA, 601 bp, Human; identical to SEQ ID NO: 103077

SEQ ID NO: 187965 - DNA, 601 bp, Human; identical to SEQ ID NO: 103078

SEQ ID NO: 187966 - DNA, 601 bp, Human; identical to SEQ ID NO: 103079

SEQ ID NO: 187967 - DNA, 601 bp, Human; identical to SEQ ID NO: 103080

SEQ ID NO: 187968 - DNA, 601 bp, Human; identical to SEQ ID NO: 103081

SEQ ID NO: 187969 - DNA, 601 bp, Human; identical to SEQ ID NO: 103082

SEQ ID NO: 187970 - DNA, 601 bp, Human; identical to SEQ ID NO: 103083

SEQ ID NO: 187971 - DNA, 601 bp, Human; identical to SEQ ID NO: 103084

SEQ ID NO: 187972 - DNA, 601 bp, Human; identical to SEQ ID NO: 103085

SEQ ID NO: 187973 - DNA, 601 bp, Human; identical to SEQ ID NO: 103086

SEQ ID NO: 187974 - DNA, 601 bp, Human; identical to SEQ ID NO: 103087

SEQ ID NO: 187975 - DNA, 601 bp, Human; identical to SEQ ID NO: 103088

SEQ ID NO: 187976 - DNA, 601 bp, Human; identical to SEQ ID NO: 103089

SEQ ID NO: 187977 - DNA, 601 bp, Human; identical to SEQ ID NO: 103090

SEQ ID NO: 187978 - DNA, 601 bp, Human; identical to SEQ ID NO: 103091

SEQ ID NO: 187979 - DNA, 601 bp, Human
taggggccgggcacggtggctcacgcctgtaatcccagcactttgggaggctgaggcgggtggatcacgcagtcaggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaaattargtacacaggtgaaacactgccacctcaagtaatacagcacttccatagggagaggtggttcttttaagtaaacagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataat

SEQ ID NO: 187980 - DNA, 601 bp, Human
caggagatcgagaccatcttggctaacacggtgaaaccctgtctctactaaaaatacaaaaaattaggcgggcatagtggcaggcgcctgtagtcccagctactcgggaggctgaggcaggagaatggcgtgaacctgggaggtggagcttgcagtgagccgagatagtgccactgcactccagcctgggtgacagtgtgagactccatctcaaaaaaaaaaaattaggtacacaggtgaaacactgccacctcaagtaatacagcacttccatagggagaggtggttcttttaagtaaasagtgtataagtctgagataattcacttaagctttgagttcttttgttgtcccttccttggaactggtgcacaggtaagtgtctatcaaaggatagtctaggctcccagctgctagccaagccctaattcatacttcagtgaacctgagtgttgccaccttgactctggcaactacaaacaccaccaataattcagaatgttcaaatgcaagctcgaattagaataatgtctccattctggacgtgtttaaaagaatatagtcttgttactttaaagtgcatctgtcatcactaaaatgcc

SEQ ID NO: 187981 - DNA, 601 bp, Human
cagtttgacctttcctggtttggaattccttgctttacattgggattacagtgaggagttattaataggctaattcattcatctcttcctccggagacctcttgcttcgtttatttctccctccctctcagtgttttttagccttttctgggttgcattttggctatttataaacatgtcttgtctccttcttaagaccgtaagcaccttggaagcaaagccctggctgtttaatctttgtttcccctgcagcacccagacctggaggtgcttgacaaatactgttttgaataagcgaaasctttcccagtgcatatgctgtgtgcttttttttttttctccccttttttggccttgcgtggtaagaataaacaacttgtactttgtatcagagttgaatattaatagatgtttaccagtccctaatcactctttcagatgtatgtattctcagattaagactttgatttggagttttacagtcccagagagaggctcaagttcaaaattacatacctcaagccaaattagtcctgtctccatctgtcctggcatgctgcttccttctctgcaacaaatactgtggaatggcattagggaa

SEQ ID NO: 187982 - DNA, 601 bp, Human
tcatcccgaactcctgggctcaagtgatcctcgtgcctccacctcccaaaatgttgagatcacaggcatgagccactgtgccctgctgaaatgtactgtttatgagctacctctcattaatgtgttcatttaatatgctttttaacatattaaaacagtatttcaccttccatagactgagtagtgttgaacatttttgttgctttgaagtcaccacatgaatactgtactttatgtaatatcgtgaaacaaattgaaatcttaggttttggatgaaacccttagtctgaatatgaaacarttctaccaaatgccattagatacactacattcttaaagccctggccagttagtatggcttgggacttcccaaggaactctgcttcagccatctgagacctgggagattacaaattggctgaaagtaattttgatgctaagcagcgatgttcagaaaggagctgaaaagtatatgtagtgggaaaatgccaggaatttcttttgaaattaagtgctggggcagttcgagagtgaggaaaaatctaatacaaaatctctacatatattagagtttatgccgtctacaatgggaataacaaat

SEQ ID NO: 187983 - DNA, 601 bp, Human
tttgaagtcaccacatgaatactgtactttatgtaatatcgtgaaacaaattgaaatcttaggttttggatgaaacccttagtctgaatatgaaacagttctaccaaatgccattagatacactacattcttaaagccctggccagttagtatggcttgggacttcccaaggaactctgcttcagccatctgagacctgggagattacaaattggctgaaagtaattttgatgctaagcagcgatgttcagaaaggagctgaaaagtatatgtagtgggaaaatgccaggaatttcttttraaattaagtgctggggcagttcgagagtgaggaaaaatctaatacaaaatctctacatatattagagtttatgccgtctacaatgggaataacaaatgaaacagaagaatacaattcaaattgctggttctatgctcatttttattaaaatatactcttaatgtttttattttgtgcttcattttgaaaacagcacagtattacagtatttgccatataattttgagaattatcagaatattttccttaaaaatgtatcattttaggctgttcaggttgaattgtgttccccaaaatatc

SEQ ID NO: 187984 - DNA, 601 bp, Human
ccactttctagctcatcccctgctgtccccatctgcctttgtgcctgtagttcacagtcctactttagtatatacctttgatctactgcagtttggggcattaggtaatagaggctgcttgaagtgaatgtaaaacaagtcagtcaattccaaatgaggtgtctcctgtagagttaatcttttttggctttatgtttgctatttcagtggctaggagacctttttttcctggtctttattttgtctgtgttcctgaatggctgacatttgctcaagattgaattctaattatttgatacctttcctattatctcatttgacttttctcatacggaaagttaaaagtacattagtaggatgtatctgttttagattttctgttttggggtgtggtctttcccttcaatcttaattcattctggagaaaacccttatcaggtgaatataattataaactgagtgagaaaaatttattgtgaatttgagccctcaagttaacgttcactataataaacaccgaatctaatttaagtgggcacaattatttaaccagttgacacttagttatataacctacataggcattttgccttcattaatt

SEQ ID NO: 187985 - DNA, 601 bp, Human
tatttcagtggctaggagacctttttttcctggtctttattttgtctgtgttcctgaatggctgacatttgctcaagattgaattctaattatttgatacctttcctattatctcatttgacttttctcatacggaaagttaaaagtacattagtaggatgtatctgttttagattttctgttttggggtgtggtctttcccttcaatcttaattcattctggagaaaacccttatcaggtgaatataattataaactgagtgagaaaaatttattgtgaatttgagccctcaagttaacrttcactataataaacaccgaatctaatttaagtgggcacaattatttaaccagttgacacttagttatataacctacataggcattttgccttcattaattactctgtaatatggctattcacctgttcctgttaagcctttctgtagttgttaagcactatacacttaacatataaaacatacacatggtatgctatatatatgtcatccactgttaagcaaggaaaaagaaaaaaccacagattaaaaatacaaaataaacccataaaactagtacagattctgccatattctgatat

SEQ ID NO: 187986 - DNA, 601 bp, Human
atttttttgcacatcaaatgcaacaatgatgggttgttgttgcccctcttctcagccctgtgaagatagtaccccgttgctttcggacctttggaatcaagacacctagtttctttacaagccttctttcctttctttcttattgcttttacagtcttcatgtgtattctgcagtttcacaattatgtatttatgtgtagatttatccttatttattcttctcatggttcagagttattttttatttgaacaatcctttaattttaattctataaaattctcagccattatttattttaayatgggctctctaccctcattctcttatttttttaatttcaaaattcctgttagatccatgttagatcgtttccttcaatcctccatgtctcttgagttcttttatatgttctgtcctcagctctcagtactgcctactggtaatctccaggttttattctgattcactaattctctcctcagttttgtccattttactctttaacctatccattgaataattagtttacagacagagtgctctgtcacccaagctggggtgtggtggcacgattctaactcactgcagccttgaacccct

SEQ ID NO: 187987 - DNA, 601 bp, Human
ctaaactaactttgctgccaactgaatatgcatatttctttgaatagtggctagcaaagggacaagttttattcattccaagagtagttttcagactttaaccttgcaaagtaattattcaaagagcacagtttggaaaaccactgaattaacatgtcagccaaatatcttaaatgtgaaaaggtaagtcaacatatgtattgtcatttcacaagatactcagttacctctttttcctgttatattaacaactaagatactaaatttgatgatcgtgatctaagaagaaattcacagcacyattttgaagttattttcacagtctctttttatctttcagattttttgtttaagttcttggttattggaaatgcaggaactggcaaatcttgcttacttcatcagtttattgaaaaaaaatgtaagtgtcatgaaattagtcattcttccgtgcatgtcttctgagagccctctcactcagatttgtttacagtaaacttaattttttcagaggaaaaaagtaatagtttgaaagtattttgaagggttatgttattgaactttgggtgatgtgattttttattaagttagcatttctatt

SEQ ID NO: 187988 - DNA, 601 bp, Human
tacagtaaacttaattttttcagaggaaaaaagtaatagtttgaaagtattttgaagggttatgttattgaactttgggtgatgtgattttttattaagttagcatttctatttaacaatggttcagtatatggttacttctactgtacattttgcagatgctgagagaccatatagtgatgttgaagatagcagaggggttctgtggcaggaatcctgtttcctgacagagcagccagagaagctctaggcatacattttggataaaataacaacatttggtcctcatagtgggcttgtrttgtagttaaggcagttgctgtcatcaattctgttttataggccagaaacagacctcttgaccacacagcccatcttttaccattgactttcactgttttggtaaaggaggttgaattttttatttcaaactatgtgagaccttggaaggctgtagaagactgtaggtttgaaaggcccttaaaacaaaaaatgctttttaataatggaaagaatcgtggagaaagacctgtctagttagtggcaggtgggtgaagggtcaaaaacagagtgtcttatttaattaagtttatcttaagaa

SEQ ID NO: 187989 - DNA, 601 bp, Human
agaggaaaaaagtaatagtttgaaagtattttgaagggttatgttattgaactttgggtgatgtgattttttattaagttagcatttctatttaacaatggttcagtatatggttacttctactgtacattttgcagatgctgagagaccatatagtgatgttgaagatagcagaggggttctgtggcaggaatcctgtttcctgacagagcagccagagaagctctaggcatacattttggataaaataacaacatttggtcctcatagtgggcttgtgttgtagttaaggcagttgctrtcatcaattctgttttataggccagaaacagacctcttgaccacacagcccatcttttaccattgactttcactgttttggtaaaggaggttgaattttttatttcaaactatgtgagaccttggaaggctgtagaagactgtaggtttgaaaggcccttaaaacaaaaaatgctttttaataatggaaagaatcgtggagaaagacctgtctagttagtggcaggtgggtgaagggtcaaaaacagagtgtcttatttaattaagtttatcttaagaaagtatatgtgaggcatggtag

SEQ ID NO: 187990 - DNA, 601 bp, Human
tttagtgacatggacccagtgtggcttagtcacagaactggtccttactgaatttaacaagtattcattcactggatagtttatttacaagttgccaagactttgtgtggtacagtcttagaaaagaatacccagagggtactgggccaagtacccagcttatgtaatcattctgtcctcctcagagaactcccctgcatggtcctctctgcaactcctcacaacagtaatgaacggaaggtctctctttgtaaccaggatgcccctggcctttagttactattttttttaaggatcttascctgcatttttcctggtagtttactcctaatggaatttccatactagttctatactgtctgggcatgaaacagactagcatagtcactgtaaccatttatctaccctctgccctgtaaataataaatccagttgccagtggcatccctgatctctgaaacaattaaattttgttctgcagttacaaaatataaactagccaatggactgtatagctgcgatattcaatttcagcttatctgtttatcatcacagaaatgttctttcataggcagtgtattcccgctgggtttagcaaaat

SEQ ID NO: 187991 - DNA, 601 bp, Human
cccacctaaaatcaaacatagtaaggaaaaagtccagaccagagcgtgccatgtgaaatttcagaacaccacagatgaagtaaggaagaccagaaaggttccaagagggaaaaagcagccacatataaagtgtgaaaaatggaattgctttgcacccttccacagcaacattggaagctaaaagaaatggaagcattgccttcaaaactcagggtgaaataattcttcaacctaaaattctaaacttagccaaactgtaagtgtgcaagtaaaggctgaataccaacagatgtgcaagaawgaggaggaagccaagattatctttctcagagacttcttagaaatgtactttcttagaaagtttaggaggatatacttcaccaggacaagggcatgatcccagaaagaggaaaatgaagccagcaggaagatccagctcagaatggcacaggtctagagggacagtgagggaagactaagacagcagtcagtatgtgatggcactgcccttccaggaggaccaggggaacaagtgaggggctctgtaagagctcacgactctgtcagagcggggaagaaacagctctgaaattcagtttcc

SEQ ID NO: 187992 - DNA, 601 bp, Human
aaatcatcattctcagtaaactatcgcaagaacaaaaaaccaaacactgcatattctcactcataggtgggaattgaataatgagaacacatggacacaggaaggggaacatcacactctggggactgttgtggggtggggggaggggggagggatagcaatgggagatatacctaatgctagatgacgagttagcggttgcagcacaccagcatggcacatgtatacatacatatgtaacctgcacattgtgcacaggtaccctaaaacttaaagtataataataataaataaataaaaggaaaaaaaaaagaaaatttaacacctcaaagtagtattcttaaatgtgtatatttgtatactggagtaatttgtataagaaactatttgtcaagacagtgttgtaaaataaatttgaaagtaaaattttaagaagtagatgtgatacagcttatcttgaagagaactcgtagttccctcttcctctagaagctaggtgcctgctgagcaagaatagaaaggcgctgcctcttaatagatgtgaacaagcgaggcctttccccctgccttaggaggctgtggggtgaagagcaaacagtcc

SEQ ID NO: 187993 - DNA, 601 bp, Human
tcgaatgttaagagagcccaggacccagctctggggaatcgcaatcccagcagggcagattcagaagaatgaccagagccagagaagtggctggtgagcgggaggaagactagcagagtgcagggcgcagaggctgcgcgagtgagtgaggacagaaatgcccactccagcttcggttgcagagagggtggggaccttgacaggcttttggggagtagcagagatggacactaggttggcggtgaagaagaggaagctgcaggtaaagacagctctttcagaaagttggatgtggggccaygcgtggtggctcacgcctgtaatcccagcactttgggaggccgaggcgggtggatcatccgaggtcaagagttcgagaccagcctggctaacatggggaaaccccgtctgtactaaaaatacaaaaattagccaggcgtggtggcgggtgcagctactcaggaggctgaggcaggagaattgcttgaacctgggaggcagaggttgcagagagctgagatcgcgccattgcactctagcctgggtaacgagcgaaactctgtctcaaaaaagacagttggatgtggagaagagcagacag

SEQ ID NO: 187994 - DNA, 601 bp, Human
tagctacatgtggctggtgactaccatatcaggacagattatagaacattcctatccatgaggaaatcacattcagcagtgctgatctcagtagcactgtcttagaaatgtgtcatctaaatggcatcatctgggggccctttctgggtaggaacctgtccagtgagaggatgtcactcagcagccgcttccctcttccaatctgtgtcccgggagccaggcgttctgagaggaggaaggcagtttctggcccagcccttcctgcacttgcccaggcagtgaaaggctcagcctgctaaartgtgaagtcatcaatcaggctagcaaagtgccatgagaagaactcaatccttagacacatgagggccaaaaatagtaagtctgagagttggtcctggagtcagacagagctggtcaagtcctgactttgccactggctgctgtatgacctagggcaacgtaattaatctctctgggccttggatttctcagagaaaaggggaataatggcagtctgtgtcatggaatctttataaagaatcaatgtgataaagtcctgtaaaacaaagtgctggcacattgcaaggattcattaagtggc

SEQ ID NO: 187995 - DNA, 601 bp, Human
gaggaggaaggcagtttctggcccagcccttcctgcacttgcccaggcagtgaaaggctcagcctgctaaagtgtgaagtcatcaatcaggctagcaaagtgccatgagaagaactcaatccttagacacatgagggccaaaaatagtaagtctgagagttggtcctggagtcagacagagctggtcaagtcctgactttgccactggctgctgtatgacctagggcaacgtaattaatctctctgggccttggatttctcagagaaaaggggaataatggcagtctgtgtcatggaatcyttataaagaatcaatgtgataaagtcctgtaaaacaaagtgctggcacattgcaaggattcattaagtggcagcaattagctatgaaatcttgcctaccagagtctagtgccttgcgcatgctaagagctcaatagatatttgtcaattgaatgaaggaacatctctttccttttgccccatgactgggcaaacgaaaaataacaaaatatctcacttgctgtctcattttaccagaaacaaaatggaacaaactgtgggtatggtatatacttggtgcattcacgttgtctgagttatc

SEQ ID NO: 187996 - DNA, 601 bp, Human
tttattttgtttgatgtccattttagagctgatgtttttggaaacaagtgcgctcacaggggagaatgtagaagaggcttttgtacagtgtgcaagaaaaatacttaacaaaatcgaatcaggtaaaagcctttccattaagcaacttttcttctgcatattttacactgtagctcagtagatcaccttttaattaatagtttcagggtgatttagtaaagaatgttctctctctacctgccaacctaaaatcatcacatatgggttcaaaggtcctgttcttatcaggatgaaagccccrtccttatcaggatggtttccatggtgatgaaagtggatgggcacaccagctcagctgtggaaaggtagtcaaggtttcagggagtgtttgcatttagaaccatagtctttctttggtccttcactaaacggaggaagaataggcctttgtccactctgtcaacagcacgctaattctgttgggccagtggtcatgtgtaagggagttataggtacatggtatagtgttgattgttgcagatcgggcatcatggaactatggagtccagagtaattttatttctgaagcttactgagcatg

SEQ ID NO: 187997 - DNA, 601 bp, Human
taggcagggggcagggacttaatcagagattccagcaccagggaaaaaagatacaaaaggagcattataaaaactatcccaactcaagttgcctggaaaattttgttcccacttcaatcattttgaaaggacgctggttgaagatgattctaatagtgagaaacacccaagacaaggtgcctggctgtccagggagacgttcctccagtgatttggttgcactctgtgggacagtgtgtccagcacccaacagacaacctgaaagtttagtgcagccaatatcccactgggcccagaagayaggaccctcaggtgccacaacacaccaaccatttactttggagtaaggtcacttgggaccttgggacacatctacctactcagtaaaatggggtggggggaggctacagagcaaagggggttgattagcaggtctctaaagtctctttgaattctaaaatacagtgctcctgctctcagtccctaatgtgtcttttttccctatccctttgccaacctgatattattcacagagatttggaggaagggatagtccagatgcttaggaccatacaaataaccattcagaggcaggcccatg

SEQ ID NO: 187998 - DNA, 601 bp, Human
ggtcggcaaaagaaaggctaagactggaggatccctagattgggacaggagtagaggattgcctcagatctacaactaagtatgatcccttgtttgtgtttataaaaacaaacgaaaaactacactgccccacagacagctccaaactcagtggaagagaggagggcgggtgggcggcaggtgtcaggtagcctccgctccacgcctttgttgactgtcgccgtcccccaccctcccagctcccgtacggggattcccgcaccaggcgacaggcgcctcggggcggggttctgaggaggtsgctaaggactgcaccggggcttccggcccgtctgggaagcttgcttggctgggccgggacggactcgacagggcgcggaagggagcggtgggcgcgccctgggaggcgagcgcgtcgcagcctcaccttggacaccattttcttgagctggctctccgacaccgccatgacggccgcctggcgactcccttccccgcaggcagagggtcagccgctgctgggctgccccagaccgtcccacacaatcgcacacccccaacccggcctcaaacaacaggaagtcggcaccactacaccact

SEQ ID NO: 187999 - DNA, 601 bp, Human
acactctctgcgggtcggcaaaagaaaggctaagactggaggatccctagattgggacaggagtagaggattgcctcagatctacaactaagtatgatcccttgtttgtgtttataaaaacaaacgaaaaactacactgccccacagacagctccaaactcagtggaagagaggagggcgggtgggcggcaggtgtcaggtagcctccgctccacgcctttgttgactgtcgccgtcccccaccctcccagctcccgtacggggattcccgcaccaggcgacaggcgcctcggggcggggktctgaggaggtcgctaaggactgcaccggggcttccggcccgtctgggaagcttgcttggctgggccgggacggactcgacagggcgcggaagggagcggtgggcgcgccctgggaggcgagcgcgtcgcagcctcaccttggacaccattttcttgagctggctctccgacaccgccatgacggccgcctggcgactcccttccccgcaggcagagggtcagccgctgctgggctgccccagaccgtcccacacaatcgcacacccccaacccggcctcaaacaacaggaagtcggcac

SEQ ID NO: 188000 - DNA, 601 bp, Human
tggaaaaagtctgtttttaaaaaagttttacacataatagtgtgttttattaaaaattgaaaccgcttaaaccgctgattgctaccattcttgctttgacaaaactatcccaagctaacacgttgaactggtcaagactcaactctcaatcattttacatagttttggaaaattacaacaaaacataacaaaagccattccactctggtgtgaggtgccacgtttgaagtaattatataaataaatcatggctttaaaatacaaaatgcttaactgcttttttaaaaattgaaaaaaaaaacactagtcttgagccgtgaagatcataaattaagctcaaagcaaataaatacgcgttataagaagcatacacttaaaagtagttactcttagaaaatccctgaaatggtaatggtatgtatttcacctggggcagtaagggactggtattttcgcttcttttctggagaatacaaaactgaaaaggccacactctctgcgggtcggcaaaagaaaggctaagactggaggatccctagattgggacaggagtagaggattgcctcagatctacaactaagtatgatcccttgtttgtgtt

SEQ ID NO: 188001 - DNA, 601 bp, Human
tctctcaggtgagctcaagtagattttttcagaaagacctctctttactatcagatataaaacggtgactcatcccatttccacaccctagcattccccatttcttccctgctttattttctctaaagcacttatcactttccaacgtacttcttgatgtatttattgagttgtttattgccttctataagaatttaaattccagaagcacagtttctttgtctgattgttcactgttgcatccctagaacctaaaacagtgagggacatatcaatctttattttattatttttatttatgtatttgtttttgagatggattctcgctttgtcacccaggctggagtgcagtggcgtgatctcagctcactgcaacctctgcctcccaggttcaggcaattctcctttctcagcttcccgagtagctgggattacaggcgtgcgccaccatgtctggctaattttgtatttttagtagagatggggtttcaccatcttggccagtctggtccaaaactcctgacctcaagtgatccgcccacctcagcctcccaaagtgctgagattacaggcatgagccattgcacctggccaattttgt

SEQ ID NO: 188002 - DNA, 601 bp, Human
gcagttaaataactttaggatgtattatacaatatattcttgctcgtctcggtgatacacaacacattagcatactaaaggctctgataaatcttcatgcaatgaaactcaattttgtttaatccataagttgctcaagcttaactatagaattctgcctctacccctgttcccagcataactaagggtctacagacaacactttgggaaatggactaaattatctttaacatcccctcctaggtttaaatttgcatagttctatgttagaggttttgttttttatttttttgagacaggktcttgctctgttgcccaggctggagtgcagtggcccgatctcggctcactgcaacctctgcctcctggactgcctcctggactcaagcaatccttccacctcagcctcctgggtagctgggactacaggagcaccaggccaactttaagtatttttttgttgagacgaggtttcaccatattgcccaggctggtctcaacctcctgggctcagtggtccacccacctcagcctcccaaagtgctgggattacagaaatgagccaccacatccaggtacagtatttttttttaacataaaa

SEQ ID NO: 188003 - DNA, 601 bp, Human
ttttctccccactgaagccatttaaaaactaactttaattttggtaatgtgaggcctttgtagttcaaaataccattgtacatatagtatgcagacagaaataaggtaggctgagatgagaaggaatcgtgtcctaggtttggaagaggactttgggttcatgtctttattgttcaggaaatgcagaactgattgcccctctgttgcttcccacctctcttcaccagtttcctaatgttttcaaagccttggaagcaaatgaaatttagaaagtctcagctacaaaattcagttccttgcyttcagagctaagggactcacaatggacaagcagcagcatgggttttccctcggccctggcatattattttcaaggagacagggttgaagaaattatgttaggatttggtagggacagaaaagactattttaaaataaggaaaactccaagcgttgtcttgccttacaactttgtctcaatagaaagtagagacaaactgttatgcttacctactctacagaattaaagaccacattaaataacattttcctcatctataaaatgaaagggacagtccagagtatagtttcgcaaaatgtg

SEQ ID NO: 188004 - DNA, 601 bp, Human
aaactccactgcaaacaaacaaacaaaaaaacactatcaaacaataccatactaaatgttaacctactgtctttctattttagagatgtgcagacatttatccctagtcgctcacagttatttatttattattgttttttggagacagggtcttgctatgttgtgcaggctatcctcaaactctaggctcaagcaatcctcccacctcagccttccgtgtagctgggactacaggcgtgcactaccatgcccagctttttttttttttagaaatggggtctaagttgtccgggctggactygaactcctggactcaaatggtctcctggcctcagcctccttagccagtattaaaatgaaaaaaagaaaagttcatagccaaatataaacaatttctttcaatctgtatttctcataccacacacatttttctatctataatttatgtctataattaatatggcacatagtttgtattggacagctattatttctaacaataatttggaattaacactatacccatagaggaaaggttgtaatgtgcagtacaaaaacatagaactatagccatctactgtgtaatgtttgggtctacaat

SEQ ID NO: 188005 - DNA, 601 bp, Human
ttccataactacctcaccaggatactattttttaaaatgcacttcccactatgtgaatcctgcctattttaaaaaggttcaactaaagccaacaaaatattgaatataagtattctgaaaattacaaagctctacagaaacccatttcttttagtcagccttttctaatttaccctcaactcagtgattagtccattatctgaacttatctatcctacctcgaatcctccttgagtgctaaaagaaagcagatgctagtgagcaaaatatataaaacataactaattcacagaacactatkaatacttacgtgtttccattcatgtagataaggaagatatatcttcccatttgcatcaacatgctttcctgttttaatagtcattgaactagtaggcttaacaaaacagatagggggattatatgggtatgtgtccagtagccataggcatattggaatattgtatgtattacctgaaaaagaaatagaaacttcagttactctatttttattatttttaaattgaagaatggttaaaggaacagaggtttagtctagatacaatttatacatatatccgcatcccccccattcctattt

SEQ ID NO: 188006 - DNA, 601 bp, Human
tctaccaagctgaattgcttggacctgggaggtggaggttgtaagtgagctgagattgtgccactgccctccagcctgggcaacagagtaaaactctgtctccaaaaaaaaaaaaaggaatcagtaagtaccctgggggaaaagttattggcagaactacctcatctctttgctgttttcttctctacagaatcttggccatacatgtcttgattgcctaaacagctttccaaagccttccaacaggtgttgtttgtattttctcttgcttttctagttatttttcataggaacattaatmtgtcacagttacactatcagacacataaacagaagttccctactattattcttgacagaaatgctttgagtaatcagatttgaattccataactacctcaccaggatactattttttaaaatgcacttcccactatgtgaatcctgcctattttaaaaaggttcaactaaagccaacaaaatattgaatataagtattctgaaaattacaaagctctacagaaacccatttcttttagtcagccttttctaatttaccctcaactcagtgattagtccattatctgaacttatctatcct

SEQ ID NO: 188007 - DNA, 601 bp, Human
tcaggagttcgagaacagcctcaccaacatggtgaaaccccacctctactaaatactaaaatacaaaacttttgtatttggtggtgggcgcctgtaatcccatctactcagtaggttgagtctaccaagctgaattgcttggacctgggaggtggaggttgtaagtgagctgagattgtgccactgccctccagcctgggcaacagagtaaaactctgtctccaaaaaaaaaaaaaggaatcagtaagtaccctgggggaaaagttattggcagaactacctcatctctttgctgttttcytctctacagaatcttggccatacatgtcttgattgcctaaacagctttccaaagccttccaacaggtgttgtttgtattttctcttgcttttctagttatttttcataggaacattaatctgtcacagttacactatcagacacataaacagaagttccctactattattcttgacagaaatgctttgagtaatcagatttgaattccataactacctcaccaggatactattttttaaaatgcacttcccactatgtgaatcctgcctattttaaaaaggttcaactaaagccaacaaa

SEQ ID NO: 188008 - DNA, 601 bp, Human
gtggcttatgcctgtaatcccagcactttagaaggccgagatgggtggatcacttgaggtcaggagttcgagaacagcctcaccaacatggtgaaaccccacctctactaaatactaaaatacaaaacttttgtatttggtggtgggcgcctgtaatcccatctactcagtaggttgagtctaccaagctgaattgcttggacctgggaggtggaggttgtaagtgagctgagattgtgccactgccctccagcctgggcaacagagtaaaactctgtctccaaaaaaaaaaaaaggaatyagtaagtaccctgggggaaaagttattggcagaactacctcatctctttgctgttttcttctctacagaatcttggccatacatgtcttgattgcctaaacagctttccaaagccttccaacaggtgttgtttgtattttctcttgcttttctagttatttttcataggaacattaatctgtcacagttacactatcagacacataaacagaagttccctactattattcttgacagaaatgctttgagtaatcagatttgaattccataactacctcaccaggatactattttttaaaa

SEQ ID NO: 188009 - DNA, 601 bp, Human
gctcattctacctctaagttctccctcctaagatgtgttcttccagtggtgccaactaacagcctaggatgtttacttgttccccttcttgataaggtactgaactccaattgcctcctcaacctaagactgctgaaaacttggctgattttcagaggcgttctgcttagttttttttttagcatcttatctttgaagctcaggaattcaacatatctcttaaggtgggaaaattcagagtatctcatcttttcttttcttttttggagacagatcttgctctgttgtccaggctggaggrcagtgatgcaatcatggctcactgcagcctcgaattcccaggctcaagtgatcctttcaccttagcctcctgagtagctggggtcacaggcacacaccaccatgccaaggtttttttaaaatatttttttatagagatggggttctcactatgttgcccaggctggtctcaaactcctgagctcaagcaatcctcctgcctcagctttccaaagtcctgggatcacagccatgagccaccatccccagagctactcacttctttatggcttttctcccaaatcttggatctaaaagtcct

SEQ ID NO: 188010 - DNA, 601 bp, Human
tgtaatcccagcactttgggaggccgaggcaggaggatcaaataaggctattttgcagcatgcataattttaaaaattctaggtctattccagtactttcccctccattttgtaatccagcttgagctcaggagtttgagaccagcctggtctctacaaaaaaattaactgtacatggtggcatgcgcctgtggtcacaactactcaggaggctgcagcgggaggatcacctgagccaggaaggttgaggctgcagtatgactgcgccactgcactccagcctgggttagagtgagacccygtttcaaaaaaacaaaaacaaaacccaacaacaacaatgacaacaaaaaacaacaaaagaaatatctaccaaccactaattaagctgtgctagacaaagttgttcaaaatggcttatttgattattcttcttttactccttaatctattttgtgtatatctcatctcacgtacttcattcataagttcactgagttctgaagaattactcaatcaccttgataggctaaccatcttcatagaaactactttttacacccctcctccccccagacaaggtcttgccatgttgcccagctca

SEQ ID NO: 188011 - DNA, 601 bp, Human
gtggttttaaacatgatgtgcagcaaggttcttgcttcaagtatataaaaatagcactagttaaagcagcatattgcaaaattcatagagttttgttcttcatttgactccacagaactaacaaaaatttattttattgccactgtacaatgtattataagtatactggtacaaatttagggatgaatatgagcaacagtcacaatattattaaaggccattaaaagacatcaatgatatcttggaaatacgtgttcttaaaattaatttttattaaagatattatgaactctgaaattayaggtagattctagccaagtgaggtggttcacacctgtaatcccagcactttgggaggccaaggtgggtggactgcttgaagccaggagtttgagaccagctgggccaacatggcaaaatcccatctctactaaaaacacaaaaattagccgggtgtggtgatgtgcgtctatggtcccagttactcaggaggctgaggcaagagaattgcttaaaccccagaggcagaggttgcagtgagctgagatcacaccactgcactccatcctaggcgacagagcaagactctgtctcaaaacaa

SEQ ID NO: 188012 - DNA, 601 bp, Human
aataagccccaacaagtctgactgtggctacaaaatgaaaaaaaattcaagtcagctacagagttgcttttcagtaaaaagaaaaaggttagccatttctcatcggttttcaactcagcttgataattttctttgtaggaccccaatcatgaaaatttcatttaattaatttattttaatagagttaagtggttttaaacatgatgtgcagcaaggttcttgcttcaagtatataaaaatagcactagttaaagcagcatattgcaaaattcatagagttttgttcttcatttgactccamagaactaacaaaaatttattttattgccactgtacaatgtattataagtatactggtacaaatttagggatgaatatgagcaacagtcacaatattattaaaggccattaaaagacatcaatgatatcttggaaatacgtgttcttaaaattaatttttattaaagatattatgaactctgaaattataggtagattctagccaagtgaggtggttcacacctgtaatcccagcactttgggaggccaaggtgggtggactgcttgaagccaggagtttgagaccagctgggccaacatg

SEQ ID NO: 188013 - DNA, 601 bp, Human
taaaccaagatgttcctcaggaaagaatggattaaaaaggaaaaagtataattttcagcagaagaaaaatgaaagcacatataatttgtcttgtaagataaacaagtttggttaattataatcttaaagaaaatttaccaaaaaaaaaaagtcacagctcaaaacacagtgaaatcaatgcagatttagtaaattcaaaataagtacaaccaactcacaattattcagagtgatttttaagtatcagtaagaattattcaagaaaatagagataacagagataatatattccaattagggsagaagcaacactctctccatgctcccaccactccacacaaggtaaaatcatgaattggctgtacgaaagagaagaaagctaagagctagatgtccaattgtgtatacccagaatagctgaatgtgaacgcttcagttgaccttaatccttatctacaacactgattttgtagttgcaaagagaaaggagaggtcagactacctttcaagttatatgtgcttccaagctgatcaaataaggctattctgcagcatgcataattttaaaaattctagctctattctacactttctcctccat

SEQ ID NO: 188014 - DNA, 601 bp, Human
agactaggaaatatttgatatcttttttttttttttttttgatacagagtcttgctctgtcacccaggctggagtgcagtaatgcgatctcagctcactgcaacatctgcctcagcctcccgagtagctgggactacaggcatgcaccaccacacctggctaattttgtatttttagtagagatggggtttcatcatgttggccaagctggtcttgaacttctgacatcaggtgatccacccccacctcggcctcccaaagtgctggggttacagctaccacacccggccaaatatttcgyatttcaaacttaagcaagatactctactcttgggcactagagtcaacagaatttaataagataaaaacaaatttctaatccaaaggaattaccagtacctttactaaaagaaatagtaatcctaaaatcaagcttattctgggaaggtagggaaggaaagagaaatgggttcaaaaattctttctgttaaattcccattcagcttataaaccaagatgttcctcaggaaagaatggattaaaaaggaaaaagtataattttcagcagaagaaaaatgaaagcacatataatttgtcttgt

SEQ ID NO: 188015 - DNA, 601 bp, Human
cccattcaggaagttaagtttgacatatggttgttttaccagttgatgaatttatagtcttggagctgcaagtgtttattcaagtaaagctctatggaaattgtattaatgacactgcatttactcttaaatggctaaatgctcttgcttggtcccagttatatgagagtcaccctcatagcagcggaaatgtaactagagtatttctaaggacaatccaacagcatcagaagcaacaagtaatttgtgagagaacttttccgatttctcagtctgtgggaaaatgatactatttaatttktacctgtggcttattggtaacctttggggatatttaacccgaaaacacttgtctttaaatagtttttttcctcttttgataacattcgtaccaaactcatctttagtttaaaaaaaaaccttttttctcactttctggacagtttctgtcattcatgtattcgtatcaaagtcagaggaactttccttagaggtattctactccaatcacctttccaacaatctcttatctacacacatcatttataacatccctgacaaatggtcatctttctctatttaacattaaacatcatttcaa

SEQ ID NO: 188016 - DNA, 601 bp, Human
acattattataggttttcctctaagaagaaagagtagtccaaaattcacaagtgaaatgtgcttttcacaacagggagttagactttgcttatatggtgaaacacaagttttcaagggtacttaccaacagtggtcacaggaggctgagaagggtactgagaacttgttgtggcaggatatggaccaccaggtgggtaaggacagcctgggtaaccactaaagacaagaacaaaaaacatttaacatttaagatgacccaaccttatagtattttgaagaaccccattcaggaagttaagyttgacatatggttgttttaccagttgatgaatttatagtcttggagctgcaagtgtttattcaagtaaagctctatggaaattgtattaatgacactgcatttactcttaaatggctaaatgctcttgcttggtcccagttatatgagagtcaccctcatagcagcggaaatgtaactagagtatttctaaggacaatccaacagcatcagaagcaacaagtaatttgtgagagaacttttccgatttctcagtctgtgggaaaatgatactatttaatttgtacctgtggcttattggt

SEQ ID NO: 188017 - DNA, 601 bp, Human
gggcaacagagtgagactccgtctcaaaaaaaaaaaaaaagtactctacagagatcaaataaacctggagattctggcacaagcacagctgacagtacatcctccaaagggaggggccaattagtccactgacattcctcacacataaattcacaacatatggaagtgtcactgagtggaacaccattctcttctgggtaccatactatatactaatatttttgaacatctggtaaattttaaatctttcttaattcagattacaccataaaattaaaatccaggctgggtgaggtggctyatgcctgtaatcccagcactttgggaggccgaggcaggtggatcacctgaggttaggagattgaccagcctggctaacatacaaaatacaaaaattagtgggtgtggtggcacatgcctatagtctcagctactcaggatgctgaggcaggagaatcacttgaacccaggaggcagagattacagtgagccgagatcatgccactgcactccagcctgggtggcagagcgaaactctgtctcaaaaataaaataaaataaaataaaataaaataaaataaaataaaataaaataaaataa

SEQ ID NO: 188018 - DNA, 601 bp, Human
atcatctatatagctttttaaaataagtcaaccttcaaaagagaactttcaccactgctgagactggagtaaggaatcaccaaagccttttaacttcctctttttttaccaggggcaggggtggtggttgtggtagagaaacttcatggtggctcacctggtgcccatccatacccactatttttcagggatcttgtatgtgaaactgattaagataggtatagtcagtttatgttttgctcctacagtaacaggaaaaagaatctttgtgttaagtttcaatgcatactaccagttaggtttttttttttttttttgctacatgaattggtttgttccttcattattcaccgactaccacctcctcattcccctagttagttttcaaaacactatgtaaactgaggttgaagatgtctatagcactctgataaaaggactctacatagatcaaggctgaggcaggagaatggcgtgaacctggagggcggagcttgcagtgagctgagattgcatcactgcactccagcctgggcaacagagtgagactccgtctcaaaaaaaaaaaaaaagtactctacagagatcaaataaacctgga

SEQ ID NO: 188019 - DNA, 601 bp, Human
taaaactggtccctgaatctctgttaatagcacccttccaaacttactgtttctgatccttgtttatttgatttttaggaacaaaatcttaaaatgacatttttaaaactcagaggttgaaatatacagtatttatgaagttttaccaagaaaaattctgtggtaggtattggctttaaccgggaataaacacctactcttcaattttactattattaaactgcaactactgaaaggtcaaactgtgtatatgttaaaggcctaaagcctaggattcagagctataaatcaactacaatcrtctatatagctttttaaaataagtcaaccttcaaaagagaactttcaccactgctgagactggagtaaggaatcaccaaagccttttaacttcctctttttttaccaggggcaggggtggtggttgtggtagagaaacttcatggtggctcacctggtgcccatccatacccactatttttcagggatcttgtatgtgaaactgattaagataggtatagtcagtttatgttttgctcctacagtaacaggaaaaagaatctttgtgttaagtttcaatgcatactaccagttaggtttt

SEQ ID NO: 188020 - DNA, 601 bp, Human
ttaagacacccggtttcatttatctcctaagagtatttacaaacgatcactacttcctggaactcaaatgaagctattttatattagagaaagaatccataagcccaaagtaaactataactcaacgataatttttctgacctcacccttaatcagcaaaagtaaactacctgcccagcatttttactcctggatgttacttgctcaggcccacataatggtcctaggtctggcatctgtgctacacagcaaactatggagcccaagtaatcccacacagtagcttactgaccatctattyagaaactagaccgagaacatatgaggattatttttctttcataataaaaaacaaaaaacaggtctatctctgaagaaggaagaacatttcagacaactgtatgagcaaaggagttctgatctgtgctattaagtgcaaacactgcaaatccattacatggcttacaaaagtcctttttatttatagtgtatgaatatgtaagcttctaatactacttacaggctttgtgcaggctatggagcttttcttccaaagaaattagggggcctcaatttatcttttaaacactcagaaaaatgc

SEQ ID NO: 188021 - DNA, 601 bp, Human
gtggtattccattcattggcacagaagttatcagaactaatgaaaacttaagagtctttttatagttagtgaatttttcacacataaacacatcaacatactttgttaaagctattatatctggtctaatgggtcaaattatactgatgctaaatttttaaatccttatttttaaaaacacacatttaaatcctggaatttacattctgtttctctttatagaatatgttcaggcaaatgctaccataataccaccaaataagtccttgccaagactttccagccaaagtcattaaccctyaaaataagaaccaagccgaggcagcagtcgcttggcctataaaggtcacagttcacctgaggaagttacaaacaccaagattagacctagtcttatctctatcacacatagacttcactgtgaagtatatctaaactttaaaaaatcgaactactttgtaaaaaaaaaaaaaggaattataactaagatctgaaataagaaagtaaaaaaagaaaaacccagagtttttcaaagaagtaaaagaaaaactcatcaaagttcaaaattcgatgaaccatgccactttaagataatgtttat

SEQ ID NO: 188022 - DNA, 601 bp, Human
agctgggcgtggtggtgcgtgcctgtagtcccagctacttgggaggctgagacaggagaatcgctggaacccgggaggcggaggttgcagtgagccgagatcatgccactgcactccagcctgacaacacagcaagactccatctcaaaaaaaaaaaaggatggtgggaaagaatgttttgatttcaaaatttaaaagccccaagccaggaaattcagtactcctcaagtgaaaggcaatctctacagaacatcattctatttttttttttttttggagatgaggtctccctacgttgtcyaggctggagtgcggttatttcacaggtgcaaccacagggcactgcagccttaaactcctacgctcaggcgatcctcctgcctcggcctcccaagtagttgggactatatgcctacaccaccatgcctgactcagaagattattcttaaaggtattatccaggaaacagataaggtcattcataaaacacacggcttttctttagctcagtgttaacaatgaaaatagattccattattgaagcacaagttgcaaattggtaacaaagtgaacacactgcagtagaaaaggggatttagtc

SEQ ID NO: 188023 - DNA, 601 bp, Human
cgtctctactaaaaaatacaaaaattagccaagcatggtggcaggcacctgtaatcccagctactcaggaggctgagtcaggagaatcgcttgaacctggagggtggaggttgcagtgagccaagattgcaccacttcactccagcctgagcgcaagagtgaaactctcaaaaaaaaaaaaaaaaaaaggagtgccttttgcctcccaccatgattctgaggtctccccagccatgtggaactgtaagtccaattaaacctctttttctctcaagtctcggatatgtctttatcagcagcrtgaaaacgaactaatacaaggtgcaaacaaaatggtctaaatattatacccctcccaatctaagaccaaatgccaaacataggctccactgtaaacaaaggtataaaaaattacattcaaatgtttaaagatgcctataattttctgaactcctactatgcccacaacatccagggaacatatagaacactctgccatggctacaattcaatccaaaaattttaagtctttaatgagtcacttactacttcttgatctaaacgggtaaccatctcttccagtttctggtgaccctttttc

SEQ ID NO: 188024 - DNA, 601 bp, Human
gtgcagatctttatcatggcttagaactctctaaacttatttcctagtaactggcaacatcaagcactcaaacagtcctcctttgggttaaaacatcctttgcctaaaacatttcctagggcaaaggtgtgataaggtttggctgtgtccccacccaaatctcaacttgaattgtatctcacagaaagggacctgtgtgcgtgtgtgtgtgtgtgtagcagggggtggggagggatggcacgcaggggtggtaattgaatcatgggagccggtctttctattctcgtgatagtaagtctcrcaagatctgatgggtttatcaggggttccagcttttgcttcctcctcatttcctcttgccaccaccatgtaagaagtgccttttggctgggcacagtggctcactcctgtaatcccaacactttgggaggccaaggtgggtggatcacctgagatcaggagttcgggacgagcctggccaacatggtgataccccgtctctactaaaaaatacaaaaattagccaagcatggtggcaggcacctgtaatcccagctactcaggaggctgagtcaggagaatcgcttgaacctggagggtg

SEQ ID NO: 188025 - DNA, 601 bp, Human
gtatgacctcaaagaaccaatggaaatctgatcgtacctcctgatccacccaggcacagaagagttacactcatcttaatgctgcctgtgggcagagaactgcagccaccagcccacttctcttcccctgctcagaccaatcctcagtactctgtaggtaaaaagatggtgcaaaaccctacatctcatttagtgttttttgggaagataaagaatcttaatccatactacaaagaaactctcttggtttgtggtttgcaaggtcagtgcctctacaacccaagttaaaaaatcttggaaygtaaaatgaagaaataccttcaggaagacatccaggtctatcacgccccttctcaaggcttctcccaagtaaaagatagtgtcttcaatagcgttttcttctgcatacagattcaggatctgtttgtataagggagctgtgggaatgataacttcatcgatatcattgttttcagactgattttccattttttccagagcagaactgagttcttcatccttctttttcaaaagttctatgtttttatcaacctcggcctgaaaacagaacagtccaagcattaataactgtacataatta

SEQ ID NO: 188026 - DNA, 601 bp, Human
gatggccttgatttcttgacctcgtgatccgcctgcctcagcctcccaaagtgctgggattacaggcatgagccaccacgcctggccttaagtagggacttttacttctttcccttactgttcgcttttggaatctggctattgaaatctgaatgaatacactccttgtatatagttccgtactctgtcacatgtgacaaaaacccagtttaaattagggtaagcagaaaaagacgaaatattgttcatgtaactggaaatagggcaaaactgcttcaggtactaccggattctgaagttsacacatatcaagacatagtctttgtatatcttggtttagattttctctgttggcttaattcgtagagcctttctatgtggtggtaaagatggctgtacagtttgttcttagattcttgttttttctccaactctacagtccttactaatgttcttagatttgcatgttattcttagagcttatgattccaaagaaaagtgagatgtaatcttccgtcttccattttcaaacttcatagacatgcttgtttcttatacctgggccatatgtccacttatgaactgatttctgtgaccagaa

SEQ ID NO: 188027 - DNA, 601 bp, Human
gaagcagtctggttataaaaccttactaaattttatgactttatttattttatttttggagacagtttcaccaggctggagtgcagtggcataatcatggttcactgcagcctcgaattcccaggctcaggtgatcctcccacctcacccttctgtgtagctgggactataggtgcacagcaccacacccagctaatttttaagaaattattatttgtagagatgcggtgtcactctgttgctcaggctggtctcaaactcctaggctcaagcagttgcaggtgtgagccaccacgcccarcccatttttatccctttctcaaacctagaaggacaatttttaaacaatttgcttttaatgtcttcccagggattaacttacttttcatagaaacaattatttttaatattaattatggaatacttgatagagaaaaagagattaacaataatgtaacattgggaggctgatgtaggagggtcgcatgaggccaggagtttgaaatcagccagaggcaacatagtgagaccctgtctccattgtgcctgtagccctagctttgcgaggctgatgcaggaggattgcttgagttcaaggttg

SEQ ID NO: 188028 - DNA, 601 bp, Human
agcaaaaacatctttcaagaacaaggacaaagctgggcctggtagcaggctgaggcagaaggatcactttgagaccagcctgggcagcatagtgaaatcttgtctcttaaaaaaaaaaaaaaaaaaaaaaaggagagtgaatgaaggtgttttcagaaacagactgagacaattactgtcaggccctccctaaaggaaacacaaaagtatatatatcaggcaaaagaaaagtgatctcacatacaagatctgtgatgcaagacaaaaaatgaaggacagagaaaatggtaaatatgaaggmaaatctaaataaacatcaattgtataaaactgtagtcttgggggattaaaaaatttttgaatatagcatataaatatacgggcgaggggtgatagtgatgaatgaagtagtgttctaagtttcctgtgtcattagggaagcaggaagtgtggtgattaactttgaactttgataagttaaaaatgcacgttgtaatttctttttctttttcaaatttttatattttatttttattttgagacaaagtctcacactgtcacccaggctgggtgcagtggtgtgatctcagctctctgcacc

SEQ ID NO: 188029 - DNA, 601 bp, Human
acaaagctgggcctggtagcaggctgaggcagaaggatcactttgagaccagcctgggcagcatagtgaaatcttgtctcttaaaaaaaaaaaaaaaaaaaaaaaggagagtgaatgaaggtgttttcagaaacagactgagacaattactgtcaggccctccctaaaggaaacacaaaagtatatatatcaggcaaaagaaaagtgatctcacatacaagatctgtgatgcaagacaaaaaatgaaggacagagaaaatggtaaatatgaaggcaaatctaaataaacatcaattgtatraaactgtagtcttgggggattaaaaaatttttgaatatagcatataaatatacgggcgaggggtgatagtgatgaatgaagtagtgttctaagtttcctgtgtcattagggaagcaggaagtgtggtgattaactttgaactttgataagttaaaaatgcacgttgtaatttctttttctttttcaaatttttatattttatttttattttgagacaaagtctcacactgtcacccaggctgggtgcagtggtgtgatctcagctctctgcaccctccacctcccaggttcaagtgattc

SEQ ID NO: 188030 - DNA, 601 bp, Human
tacaaaaattagctgcatgtggtggtgcacacctgtagtcccagctactcaggaggctgaggcaggagaatcacttcaacccggcaggtggaggttgcagtgagccaagatcactgccactatactccagcctaagcgatggagcaagactgatccaaaaaaacaaaaaaattagtaaagagaaagaagtaatattagataaacatacctaatgaattaaaaagaagatagaaatataagaataggacagcatataaaactaaaagtttagcaaggatgacagacaaagttagtaatcagaataggccgggcacgatggcccatgcctgtaatcccagcactctgggaggctgaggtggtggatcacttaaggccaggagttcgagatcagcctgggcaacatggtgagacccctgtctctactaaaaatacaaaaattagccaggcgtaatggtgcacacctgtaatccagctacttggtacgctgaggtaggagaatcacttgaacccggaggtggaagttgcagtgagccgagattgtggcagtgcactccagcctgggcaacagagcaagactccatctcaaaaaaaaaaaaaaatc

SEQ ID NO: 188031 - DNA, 601 bp, Human
aaaaattagctgcatgtggtggtgcacacctgtagtcccagctactcaggaggctgaggcaggagaatcacttcaacccggcaggtggaggttgcagtgagccaagatcactgccactatactccagcctaagcgatggagcaagactgatccaaaaaaacaaaaaaattagtaaagagaaagaagtaatattagataaacatacctaatgaattaaaaagaagatagaaatataagaataggacagcatataaaactaaaagtttagcaaggatgacagacaaagttagtaatcagaataggccgggcacgatggcccatgcctgtaatcccagcactctgggaggctgaggtggtggatcacttaaggccaggagttcgagatcagcctgggcaacatggtgagacccctgtctctactaaaaatacaaaaattagccaggcgtaatggtgcacacctgtaatccagctacttggtacgctgaggtaggagaatcacttgaacccggaggtggaagttgcagtgagccgagattgtggcagtgcactccagcctgggcaacagagcaagactccatctcaaaaaaaaaaaaaaatccat

SEQ ID NO: 188032 - DNA, 601 bp, Human
acaggaaaataaaaaccatatcaatataccattacacacccactagattggtagaagtgtgatagtaagtgtttgtgaggatgtggaacaataagtgctctcacacacagcatataggagtgtagtaaaaccagttaaaaaaacaagtttggccgggtgcggtggctcacgcctgtaatccagcactttgggaggctgaggtgggcggatcacgaggtcaggagtttgagaccagcctgaccaacatggtgaaaccctgtctctactaaaaatacaaaaattagccgggcatggtggtgcrcgcctgtaatcccagctactcaggagtctgaggcaggggaatcgcttgaacccaggaggtggaggttgcagtgagcctagatcgcgccactgcactccagcctgggccatggaatgaaactctgtctcaaaaaaaaacaaaaaaaccccacgagtttgtcattacctggtgaagttgaacatgaacatatcccacaacctggaaattacacttctaaatatagtcccaagaaaacttttgcacatgcgcactaggatacatgtacaagaacgtattgtagtagccccaaactgtaaacaa

SEQ ID NO: 188033 - DNA, 601 bp, Human
ttgtagtagccccaaactgtaaacaagtcaatgaatcccagtactaaattgtaaaattatgcagtgtaatattgcacagcagtgaaaatgaagaaactacaggaacacacattaacatggataaatatcagatacataatatttagttaagggaatacatgccttatgattcaaaaacagataaaatgtactatgtaatgctgggcatggtggctgacgcctgtaatcctagcactttgggaggccgaggtgggcggatcacttgaggtcaggagttccagaccagcctggccaccatggygaaaccctgtctctactaaaaatacaaaaattagctgggtgtggtggcacgtgcctgtaattccagctactcgggaggctgaggcaggagaatcgcttgaacctgggaggcggaagttgcagtcagctgagatcgtgccactgtactccagcctgggtgatagagccatctcaaaacaaaacaaaacaaataaaaaaacaattaatatgtaatttaaacatgcataggtagtaaagcttttttaaaagtaatgtgattttttgccagccacaagagtggttgatagacataatctgttag

SEQ ID NO: 188034 - DNA, 601 bp, Human
atttggggatttttttttttgttttgaaaaagggtcttgctttgttgcccaggctagagttcaggggtgtgatcatagctcaccacaacctcaaactcttgaattcctgagttcaagcagtcctcccacctcagcctccagaggacaaatgtgaactagatgtttattgtgcagttttggcagagttaatatttttaatttttttcattaaaaaattattatattttagagactaggtcttgccctgttaacccaggctggagtgcagtggcacgatctcagctcactgcaatctctgccycccaggttcaagtgattgtcgtgcctcagcctccccagtagctgggattacaggtgtgagccactgtgcttggccttttgtgtggttttaacagagttgtttaatgttttataaattgagtgtatatttcttatatgttattgtatatgaaatatttcacaatagaacattttaaaaatacattttgtgccaggcgtggtggctcacgcctgtaatcccagtactttgggaggctgaggtgggtggatcacaaggtcaggagatcaagaccatcctggctaacgcggtgaaaccccttct

SEQ ID NO: 188035 - DNA, 601 bp, Human
tcactgcaatctctgcctcccaggttcaagtgattgtcgtgcctcagcctccccagtagctgggattacaggtgtgagccactgtgcttggccttttgtgtggttttaacagagttgtttaatgttttataaattgagtgtatatttcttatatgttattgtatatgaaatatttcacaatagaacattttaaaaatacattttgtgccaggcgtggtggctcacgcctgtaatcccagtactttgggaggctgaggtgggtggatcacaaggtcaggagatcaagaccatcctggctaaygcggtgaaaccccttctctactaaaaataaaaaaaaattagccaggcgtgttggcaggcgcctgtagtcccagctactcaggagggctgaggcaggagaatggcatgaacccaggaggcggagcttgcagtgagccgagatcgcgccactgcactccagcctgggcaacagagcgagactctgtctcagaaaaaaaaagaaaaaagaaaaaagaaaatacatattgtgaggtctaatggggaagagcaatgatggaacatcgttgattagccacaatttttttttttttttactttttag

SEQ ID NO: 188036 - DNA, 601 bp, Human
tgggattacaggtgtgagccactgtgcttggccttttgtgtggttttaacagagttgtttaatgttttataaattgagtgtatatttcttatatgttattgtatatgaaatatttcacaatagaacattttaaaaatacattttgtgccaggcgtggtggctcacgcctgtaatcccagtactttgggaggctgaggtgggtggatcacaaggtcaggagatcaagaccatcctggctaacgcggtgaaaccccttctctactaaaaataaaaaaaaattagccaggcgtgttggcaggcrcctgtagtcccagctactcaggagggctgaggcaggagaatggcatgaacccaggaggcggagcttgcagtgagccgagatcgcgccactgcactccagcctgggcaacagagcgagactctgtctcagaaaaaaaaagaaaaaagaaaaaagaaaatacatattgtgaggtctaatggggaagagcaatgatggaacatcgttgattagccacaatttttttttttttttactttttagtttagagatggctgttcatgggcacaatcacagtgcactgcagcctctaactcctgggtt

SEQ ID NO: 188037 - DNA, 601 bp, Human
aggagatcaagaccatcctggctaacgcggtgaaaccccttctctactaaaaataaaaaaaaattagccaggcgtgttggcaggcgcctgtagtcccagctactcaggagggctgaggcaggagaatggcatgaacccaggaggcggagcttgcagtgagccgagatcgcgccactgcactccagcctgggcaacagagcgagactctgtctcagaaaaaaaaagaaaaaagaaaaaagaaaatacatattgtgaggtctaatggggaagagcaatgatggaacatcgttgattagccacaatttttttttttttttactttttagtttagagatggctgttcatgggcacaatcacagtgcactgcagcctctaactcctgggttcaagtgaccctcttgattcagcttcctaagtagctgggactactatgcccagctccacagatattttaaattatctcatatgtacagtgagtccaggtgcatggaacatagaggctgctaagatatttatggaccaggtgtggtggctcacgcctgtaatcccagcactttgggagcccgaggcaggtggatcacctgaggtcaggagttcaaga

SEQ ID NO: 188038 - DNA, 601 bp, Human
gagatcaagaccatcctggctaacgcggtgaaaccccttctctactaaaaataaaaaaaaattagccaggcgtgttggcaggcgcctgtagtcccagctactcaggagggctgaggcaggagaatggcatgaacccaggaggcggagcttgcagtgagccgagatcgcgccactgcactccagcctgggcaacagagcgagactctgtctcagaaaaaaaaagaaaaaagaaaaaagaaaatacatattgtgaggtctaatggggaagagcaatgatggaacatcgttgattagccacaatttttttttttttttactttttagtttagagatggctgttcatgggcacaatcacagtgcactgcagcctctaactcctgggttcaagtgaccctcttgattcagcttcctaagtagctgggactactatgcccagctccacagatattttaaattatctcatatgtacagtgagtccaggtgcatggaacatagaggctgctaagatatttatggaccaggtgtggtggctcacgcctgtaatcccagcactttgggagcccgaggcaggtggatcacctgaggtcaggagttcaagacc

SEQ ID NO: 188039 - DNA, 601 bp, Human
gctgctaagatatttatggaccaggtgtggtggctcacgcctgtaatcccagcactttgggagcccgaggcaggtggatcacctgaggtcaggagttcaagaccaacctggccaacatggcaaaagcccgtttctactaaagatacaaaaattagctgggcatggtggcgggtccctgtaatcccagatacttgggaggctgaagcaggagaatcacttgaaccagggaggcataggttgcagtgagccaagatcacgccactccactccagcctgggcaacagagcaagactccgtctcaaaaaaaaaaaaaaaaaaagatatttgtggaaagaagggagtaatgtgaaatcagtgaaatcagaacctattattaatattatggtgcttatgattaagttaggggtttaaataagacataaccatgagaagataacatatgctcttataaggactttttcataattataggcagtaagtgctataaaaaaattctgtgaagaaagtggtatttatgaatgatatgataaataatgaatgatatgatggctttatgtcttatttttatgtcagattttccaggtgccctgatcctgttaat

SEQ ID NO: 188040 - DNA, 601 bp, Human
cttttgttatattaccaaagttggttttctgattccttcttagcctcccaagtagctgggaatgcaggtgtgtgccaccacatctggctaatttttgtatttgttggtagagacagtttcaccatattggccaggctggtttcaaagtcctggcctcaagtgatccacctacctaagcctcccaaagtgccaggggataacaggcatgagccaccgcacccagccagtgatttgcttcactttgtagtaaatctgtatttgactctaaaacaattcatctatgtattcaggaaaaaaaaawtttttttaagttatgatgaatctttttctaacacaaaatttttcttcttagtggatattttgacatatatagtctggaagataagtggcttacctgtaactcgtgtaattggaagtggttgtaatctagactctgcccgtttccgttacctaattggagaaaagttgggtgtccaccccacaagctgccatggttggattattggagaacatggtgattctagtggtaagtataaatctattattattacgtgactacccttcttatctctactagtgcttatttcctttaaagtttttt

SEQ ID NO: 188041 - DNA, 601 bp, Human
taaatgaaataatatgtgattttaactattgaggccacaccaacctctctctttactgaatttaaacatttagtctctgctacatggttagaactttatactttttacagtgttctttaattgtgtcatgtatgtaaatcttctttccataatggcaataaaccaattgagaataaagaccatttgttcaaacattcatttatttattcaaaatatttagagtgcccttttctttataatccaagagccataatataacaaatactttatttgatttggacaaatatttcttcagccagakccttactttgaccctgttggcttgtgttatttttcctgaagttcattaaaactaattttctctggtatattttaatttctcacatttaatattctataactttatttttagaaaacagtatattctgattagtattaatttgaacatgtttagtattctatttagcatgatttttcggtttccttcctctttttctgttttccattggatctactttctttaatttcctctaatactttgaattatacacttaccttataaatggttatctataaatttttaacattcatacttgacctc

SEQ ID NO: 188042 - DNA, 601 bp, Human
aatatgtatgttgcttaaaaatgcctcctataccacacaattataaataaattctactacatattttctaacaaccttataattttatttcttacatttccctcttttatacatttgaaacctatttttatgtatggtgtaaggtggtgttttaggccatttttgtgttgctgtaaagaaatacctggccagggccgggcacggtggctcacgcctataatcccagcactttgggaggctgaggtggacggatcacgaggtcaggagattgagaccatcctggctaacacagtgaaaaccygtctctactaaaaatacaaaaaattagccaggcgtggtggtgggcacctgtagtcccagtgactcgggaggctgaggcgggagaatggcgtgaacccgggaggtggagcttgcagtgagccgagatcgcgccactgcactctagcctgggcgacagagcaagactccctctcaaaaaaaaaaaaaaagaaaaagaaatacctggccaggagtagtggctcatgcctgtaatcccagcacttttggaggccaacgcgtgtggatcacttgaggccaggagtttaagaccagcctggccaac

SEQ ID NO: 188043 - DNA, 601 bp, Human
gccaacatagcgaaaccccatctctactaaaaatacaaaaaaaagctgggtgtggtggcacacacctgtaatcccagctgctcgggaggctgaaacagaagaatcccttgaacttgggaggtggaggttgcagtgagctgagatcaagccactatgctacagcctgagtgaaaaagaaaaaaaaaacaaaagaaatacctgaggctgagtaatttataaagaaaaggggtttaatttagcttgtgcttctgcaggttgtacaggcatggctccaagatatgctcttgatgaggacctcagraagcttgcaatcatggcagaaggcaaaggaggagtagatgtgtcacatagtgagggcagaaacgagagagaggaggtgccatatacttttaaacaaccagatctcacatgaacttagagtgaagactcactcttcaacaggagatgatgctaagctattcatgagggatctgcacccatgatcagacacttcccacccccaacactagcggttacatttcaacatgagatttggaggagacaaacatctgaaccatatcaggtggcaacttaacttaaaaaaacaacactgaactcaaac

SEQ ID NO: 188044 - DNA, 601 bp, Human
ttagccagctgtggttgtgcgtgcctgtaatcccagctacttgggaggctgaggcacaagaattgcttgaacctaggaggcagaggttgcagtgagccaatattgtgccagtgcaatccagcctgggcaacagagcaagactctgtctcagaaaaaagataaataaataaaataataggctgggcgcagtggcttatgcctgtaatcccagcattttggaaggcctaggtgggctgatcatgaggtcaggagatcaagaccatcctggccaatatggtgaaactccgtctctactaaaatmcaaaaaaaaaaaaaaaaaaaattagccgggtgtggtggtgtgcccctgtaatcccagctactcaggaggctgcggcaggagaatcgcctgaacctgggaggcggaggttgcagtgagccaagatcacaccagtgcactccagcctggcaacagagcaagactctgtttcaaagaaaacaaacaaataaataaataaaataaaataataaaacaaaaatgtgtaagaattagggcagagactaaaaagtcataatataacaagtgatcatgggtgagtttttattctcttaaatgcctttt

SEQ ID NO: 188045 - DNA, 601 bp, Human
accctttacccttggtacctttccatgacctcagattattatctttgtatcatatattcttcagagttcatttgacaaacatttcttcaatattttataaatagaaaagacaagttagtacatctacaaccactagactctataagacacagtaggtaaacagaatccttcacaatgttttggtaattcttaaccaactagactgtttttttcccccctctatcatttactatcacttgcgtcttattaaaggtattgatacacgcattcaatcacatgttttatctctttctctctctcgtttttttttttttttttttgagacagagtcttgctctgttgcccaggctggagtgcagtggggcaattttggctcactgcaacctccgcctcctgggttcaagcgattctcatgcctcggcctcttgagtagctgggactacaggagcgtaccaccacacctggctagtttttatatttttagtacagatggggtttcaccatgttggtcaaactggtctccaactcctgacctcaggtgatctgcccgcctcagcctcctgaagccaccacgcagtttttatatttctaaagcaaatgt

SEQ ID NO: 188046 - DNA, 601 bp, Human
tatgtattaatattacagtatcttttcctgtccttctcaacaaaactgtcccttatgcccatatattttcagctataggggccaggagaccagtctccaataaatgcagggatctaactggtctggaggcacatccataccccccacccactaaggaacttgttttaaccgatagcggtttccaagtgttatggagcagcccatctacctcccatagggctgtcacagtgttggtctttatctacccagtcactaataattgtaccacagagaatggtagttcttttttttctttctttctttttttttttttttttgagacacagtctggctctgtcatccaggctggagtgtagtggcatgatcttggcttactgcaacctctgactcccaggctcaagccatcctcacacctcagcctcctgagtagctaggaatacaggtgcatgccaccatgcctggccactttttgtatttttggtagtgatggggtttcaccatgttgcccaggctggtctcaaactcctgagctaaagcaatctgcccaccttggcctcccaaagtgttgggattacaggtgtgagccactgtactcgggcag

SEQ ID NO: 188047 - DNA, 601 bp, Human
tgactcccaggctcaagccatcctcacacctcagcctcctgagtagctaggaatacaggtgcatgccaccatgcctggccactttttgtatttttggtagtgatggggtttcaccatgttgcccaggctggtctcaaactcctgagctaaagcaatctgcccaccttggcctcccaaagtgttgggattacaggtgtgagccactgtactcgggcagttcctttttaatttgagacacttgctttaagggaacaaggattaagatcacatttcccattgaagtcctgtgtgatttgaataycaaatattccaatgtgtttcagatcagtacttatcactattggtcctctcaactctgcagtatctaaaattaaattatttgcctcttgatcatttagcagaggatctataattataaataatcctcagggtgctgctaatatttatctaaaaactactcagctctttttacacaacagcttctgatttgctgttgtctaaccaccaattgcagaggaatgacatcatgatttaataggatgtccttacttgttcccaagagggcatttggtttacaatgtgtatcagtttttgtcttaaa

SEQ ID NO: 188048 - DNA, 601 bp, Human
tttgttgcctgtttataaattctgtaagaaatctatgggaaaattctaatacaattgcattgacatgtagataactttaaaatggatgcttgaagaatattatgttttctctgggttgacttattatgaatttgattttcttactttctacaactgtagtgcctatgaaattatcaagctgaaggggtatacctcttgggctattggactgtctgtgatggatctggtaggatccattttgaaaaatcttaggagagtgcacccagtttccaccatggttaaggtaggcttaaattaaatmttcatttatcattctttcctttaatatttattgggtcactactatatgccaggcagtgtacaagatgttgaggatataatagtgaataaaaaatacaaagaccttgacctcaggtcaggtcaaaaaaatacagataccttgacctaaggaagggaatcctgaaagagaaccaggtttgaagatcacatttacagttttggacacagttttgagccctggcatataaacagtgtgaagccaactcaaactagcttatgcaaaaagaaaatttattggcttatgtaactgaaatgccaagga

SEQ ID NO: 188049 - DNA, 601 bp, Human
atttttttttttttttttgagacggagtctcactctgtcacccaggctggagtgcagtcatgcgatcttggctcactgcaagctccacctcccaggttcacactattctcctgcctcagcctcccaagtagctgggactataggcacccaccaccacacccggctaattttttttgtatttttagtagagacagggtttcactgtgttaaccaggatggtcttgatctcctgacctcgtaatctgcctgcctcagcctcccaaattgctgggattacaggcgtgagccaccacggcctgtygatttctctatttttagtgaaaggagatagtgaaaggagtaggataacgggagtgggagcagaaggtttcataagtgaaaaaagtctagagagtggaaagaaagggaattttggttggattattcatatgtatattgaagttaacaaggataatggcagaaattgagatagacagggaagactgtgagccatgtgtcagtctgtgaatgagattgaataactaggaggttagtccttacaaagggaagaagagctgaattagatgatcttcaaaaaatagggagaatatgttttgttttt

SEQ ID NO: 188050 - DNA, 601 bp, Human
aaagagtacacaatggataccacacaccccttcttttctgaggctgcagaacctatgggagaataagcaactgcctctctaggactctggagaaagagtcagggaagtgtcaaatgagtaatcagtgaagaaactgagtaatatgggaatttaatagcctttaccgaacaagtcaatggacattatattttaatttaattttaatgttttggggagggatgaagtcttactctgttgcccaggctggagtgcagtggcgcaatctcagctcactgcaacctctgcctcctgggttcaagcrattcttgtgcctcagcctcctaagtagctgggattacaggcacgtgccaccacgcctggctattttttgtatttttagtagagaaggggttttgtgctgctgccaggctggtcttgaactcgtgacctgaagcgatccaaccacctcggcttcccaaagtgctgggattacaggcgtgagccaccgcgccctgctgagttatattttatagggaacatttaaacatttgacgttacaagcagagtcatttgtatattcttattttttctttctttcccacttacttcacttttactactt

SEQ ID NO: 188051 - DNA, 601 bp, Human
attttaatttaattttaatgttttggggagggatgaagtcttactctgttgcccaggctggagtgcagtggcgcaatctcagctcactgcaacctctgcctcctgggttcaagcgattcttgtgcctcagcctcctaagtagctgggattacaggcacgtgccaccacgcctggctattttttgtatttttagtagagaaggggttttgtgctgctgccaggctggtcttgaactcgtgacctgaagcgatccaaccacctcggcttcccaaagtgctgggattacaggcgtgagccaccrcgccctgctgagttatattttatagggaacatttaaacatttgacgttacaagcagagtcatttgtatattcttattttttctttctttcccacttacttcacttttactacttcacattttcaccaaatcaaggtgtgcagagtttatttcacattaatgtattaattggattttttttttttttgtcaaatagggaattctctttaaacaatctctgtatttcacagctggtccaagagcaaatgagaacaaattctaatatatccaggggaaattatcactaaccaggcataaagct

SEQ ID NO: 188052 - DNA, 601 bp, Human
atttttagtagagaaggggttttgtgctgctgccaggctggtcttgaactcgtgacctgaagcgatccaaccacctcggcttcccaaagtgctgggattacaggcgtgagccaccgcgccctgctgagttatattttatagggaacatttaaacatttgacgttacaagcagagtcatttgtatattcttattttttctttctttcccacttacttcacttttactacttcacattttcaccaaatcaaggtgtgcagagtttatttcacattaatgtattaattggattttttttttttktgtcaaatagggaattctctttaaacaatctctgtatttcacagctggtccaagagcaaatgagaacaaattctaatatatccaggggaaattatcactaaccaggcataaagcttaaagggaagagggtaggctgaggaggctagtggcaggtcacagttagcacacagggccaggcttggtcccaggattcaggcaggagcccttgttcccagcccacccagcagtcctcagatggcatgatgggtggacatgaattctcgaattccagtctgaggtgcctcttctagagagaagaga

SEQ ID NO: 188053 - DNA, 601 bp, Human
agcaaaacaggaacaaggggcacaccttgtgctcctgagtagagccccagagatggtgagagggaagaatggctgaatagtgcccatgggctctgcagcatggaaagctgtgaggcactgctccagagtcaaggagcctcccctcttccttcaacgccattcctggtaactgtttataatcagtcctggagaagaacaatgccctcccttctcccacaaccccagactcagccccaaagagaggggtaaagagtgatgagtggtaggaggcagggaagtgtgagggatctactgggtgtctttttttttttttaactgggtgtcttttaacattttttaaattttaattttttgggggtatattgagttttcctatcttccaagaccagggaggatagtatggaggtggtggaggctggtacctatgcatgtagatgttatgtgagttgcccaggttgtaataggctctggcagctgcttctcggccttggctgcaggaatggagggaattttggggcttctgatgggaggttccaggggcccaggatagggcagtgccatggggctgcacctgtttcatggccctatccatgatgggagg

SEQ ID NO: 188054 - DNA, 601 bp, Human
aggatagggcagtgccatggggctgcacctgtttcatggccctatccatgatgggaggtcccagatagaactcaggcggaggtagtggataggagtacagaagggcaggagtgcattccattgcagctggtgatgagaggcacaggccccaccgggcatgtaagagcatctataggctccactgggggtttacctctggaggcttaaaatgccacccgtagcacccattgtccaaactcaatgatgctccctgctgtaaaggtatgaagcagagccttcccagtcacctcctgcttcactrttgcctcgatgtagtttggactacacacaagttacttgattctcatagtactccttttgataaaatggcatcatgaaagaccgcatggcatcctttcccgtggaccaaaagatgacctggtaagggataaggtaaattgtatgtttctgggtccttctaaaggcctctggcatcttcttcatgtcactgaatgtaagttccacatggttataggacataaggatgctcttgcttttgctgaccatcactctgccaccctctgagcgattcttgttgaatgctttagtctctcctgtatac

SEQ ID NO: 188055 - DNA, 601 bp, Human; identical to SEQ ID NO: 188026

SEQ ID NO: 188056 - DNA, 601 bp, Human; identical to SEQ ID NO: 188027

SEQ ID NO: 188057 - DNA, 601 bp, Human; identical to SEQ ID NO: 188028

SEQ ID NO: 188058 - DNA, 601 bp, Human; identical to SEQ ID NO: 188029

SEQ ID NO: 188059 - DNA, 601 bp, Human; identical to SEQ ID NO: 188030

SEQ ID NO: 188060 - DNA, 601 bp, Human; identical to SEQ ID NO: 188031

SEQ ID NO: 188061 - DNA, 601 bp, Human; identical to SEQ ID NO: 188032

SEQ ID NO: 188062 - DNA, 601 bp, Human; identical to SEQ ID NO: 188033

SEQ ID NO: 188063 - DNA, 601 bp, Human; identical to SEQ ID NO: 188034

SEQ ID NO: 188064 - DNA, 601 bp, Human; identical to SEQ ID NO: 188035

SEQ ID NO: 188065 - DNA, 601 bp, Human; identical to SEQ ID NO: 188036

SEQ ID NO: 188066 - DNA, 601 bp, Human; identical to SEQ ID NO: 188037

SEQ ID NO: 188067 - DNA, 601 bp, Human; identical to SEQ ID NO: 188038

SEQ ID NO: 188068 - DNA, 601 bp, Human; identical to SEQ ID NO: 188039

SEQ ID NO: 188069 - DNA, 601 bp, Human; identical to SEQ ID NO: 188040

SEQ ID NO: 188070 - DNA, 601 bp, Human; identical to SEQ ID NO: 188041

SEQ ID NO: 188071 - DNA, 601 bp, Human; identical to SEQ ID NO: 188042

SEQ ID NO: 188072 - DNA, 601 bp, Human; identical to SEQ ID NO: 188043

SEQ ID NO: 188073 - DNA, 601 bp, Human; identical to SEQ ID NO: 188044

SEQ ID NO: 188074 - DNA, 601 bp, Human; identical to SEQ ID NO: 188045

SEQ ID NO: 188075 - DNA, 601 bp, Human; identical to SEQ ID NO: 188046

SEQ ID NO: 188076 - DNA, 601 bp, Human; identical to SEQ ID NO: 188047

SEQ ID NO: 188077 - DNA, 601 bp, Human; identical to SEQ ID NO: 188048

SEQ ID NO: 188078 - DNA, 601 bp, Human; identical to SEQ ID NO: 188049

SEQ ID NO: 188079 - DNA, 601 bp, Human; identical to SEQ ID NO: 188050

SEQ ID NO: 188080 - DNA, 601 bp, Human; identical to SEQ ID NO: 188051

SEQ ID NO: 188081 - DNA, 601 bp, Human; identical to SEQ ID NO: 188052

SEQ ID NO: 188082 - DNA, 601 bp, Human; identical to SEQ ID NO: 188053

SEQ ID NO: 188083 - DNA, 601 bp, Human; identical to SEQ ID NO: 188054

SEQ ID NO: 188084 - DNA, 601 bp, Human
tgggaatatcccctttccccgtagtgcagcttctcaggatgtgttaagtggatggatcacatttcagaagccgctgcaaggtgtatcaaaaacacatctcctgagccgtaagggacggggcatccagtaacaacgcacacggggtatttttgggcttccttaagatttgagccgctgccttaggttgtgctgcccaatgtgcctggggagctgctaaacagattagagtcgaggattgttgtcagttactcagagaaagaacaatcatcctttccaggagcacctgagctgtttgttttgmgtagaagatgcaaaataaggcctgcaatgggtataaaatgtccctcagcataaatcgcataggagtatgactaaggctgttgactcttctgtcttctttctccttcctccttcgatttcctagttggataatgtacagggctctttagcctcgctctgtcaggggctcccttcctggtttgttctgtttccattcttccttctccagccttcttgacaagagctgggaactaacgtgcctcaagcccccacaaggaccacagcattttctcatttagtttcagaatgactctgtgacgca

SEQ ID NO: 188085 - DNA, 601 bp, Human
aatgtagccaggcgtggtggcaggcacctgtaatcccagctactcaggaggctgaagcacgagaatcacttgaacccgagaagcagaggttgcagtgactagagatcgcaccagtgtcctccaacctgggtgacagagcgagactccatctaaaaaaaatgaaaaagaaagtgcagccaaggcagagcaccactgccctattgcttcctcaagcaacccacagcatcagtacagcctactaagaaagtatttagggacttttatgctcctaacagtcactggaactcacgtcacaatgacktgtattccatttgcaagaatatatactttaggtcggggtgcggtggctcacgcctgtaatcccagcactttgggaggccaaggcagggggatcacgaggtcaggagttcgagaccagcctgaccaacatggtgaaatccccgtctctactaaaaatacaaaaattagccaggcgtgatggcgcatgcctgtaatctcagctactcaggaggctgaggcagaagaatctcttgaacctgggaggtggaggttgcgatgagctgagatagcaccactgcactccagcctgggcgacagaact

SEQ ID NO: 188086 - DNA, 601 bp, Human
aaaatgcttacctgaaagattttcagggcttttataagtcctccaacttcattctttaaggaaaaaatgagacttgctcttcccctttctaaggaatggtctttgttctccttattgtcttcaatcatgatgaatttggagtaattctctaaaactaaagtatgaaaacaaagactacgggctaaaaaagaagttgcacaatgcagacaatatttgataactaagggctcatttacttctaggagcttcagtttcttaaccttttataaaacctggatatgcagataagctttgcaagaawctagtgagaccaaaataagatacaactttgcctgacacctgcctagaatagaatacatgttagtagttcccttttgttttttttctaaaccaatcgctcttttagggcatgactgaagcctgctggcttcttgcagtcttcccaactattgtagcctaaactagtcaggaaggcctacctcctccccaccttgcccacaatcttagcacttcattataccaggtctcaaatggtttccccaaatgttctattcgaacatatctcaccttctaacaaggcagcaagctcctccagagtggg

SEQ ID NO: 188087 - DNA, 601 bp, Human
tagttaaaagaggttgcctctagggagtgggactgagaatatggtatgtgttaggtaagaaaactgatgcttttcattacaagctcttctagactatctatatttaagatttttaattctttgaaatattctttgcaaacagctatataatagtatgtcatatgattattaacatagctaacatctattgttcacttactttgtactgtaccatcctaagcattttagagatattaactctactaatgctcacaatgaccctatgaggtaggtagagttctcattttatggacataaatcmtgaagtgtggagagattaatcaatttgcccacgatcacccaggtaataactgacagagcaaggatatgaatccaggtggcctgtctctggagaccagagcttaaccacagtggtgttctgctatcacaattcaacatcccctatattaggacaagtggcttatttataatttttagttcctataaacaataaatctttgtgtgtccctgagcccttaaactcagttaggtcccccaagttcaatgctgtcagaatatctggtatttctgtttcatgtcactttacacatagtgattattc

SEQ ID NO: 188088 - DNA, 601 bp, Human
taggcaggtggagacacacccagagaacaccatgtagcagttagaagaatgaatgagatgttcacacagcagcgtgcataggtcttaaaaacacagtgctggatgggaaaaagaatctttatagcacaatatgattatataaattactaatatacgcacacacaaagactacatattctaaagtgcagacaaagtaattcaatgtacatatcaaacatgagagcagctctctatcagaagagagaaatggagatagaattcaagaatgaaataaaacaggaagaggttgcacaaatcaacratgatagtgtacacgtgatttaatgagtgtgattaactcaagcttctgcacacaaggttgcaaaaaaattaaatggaactttggaatgaagagagatggagcaaaacactacttttttaaaaatatgttttatagtacaggttgagttgtttttaagctatgcacaattattcttcgattaaaaattaaatttaaaaaaagctgatggaagaagacatacaggtattttatttaaagacccaaaggtaatcaatagaatagctaaaagtaataataaaagtatcagatttggaaggactg

SEQ ID NO: 188089 - DNA, 601 bp, Human
aagaagttgaagaggccatcggaaggggagttgtgtcaagaaacctaaatttttacttcattgttgaaaatcaatagataattacctataattctagaaatcaagaagtagaagcagaataagcatataacttataagtgtggaagtaaatattagaaaaatagtttaaagagttgaaaatggttgcctccactaggcaggggataactaggttgtctccactaggcaggtggagacacacccagagaacaccatgtagcagttagaagaatgaatgagatgttcacacagcagcgtgcayaggtcttaaaaacacagtgctggatgggaaaaagaatctttatagcacaatatgattatataaattactaatatacgcacacacaaagactacatattctaaagtgcagacaaagtaattcaatgtacatatcaaacatgagagcagctctctatcagaagagagaaatggagatagaattcaagaatgaaataaaacaggaagaggttgcacaaatcaacgatgatagtgtacacgtgatttaatgagtgtgattaactcaagcttctgcacacaaggttgcaaaaaaattaaatggaa

SEQ ID NO: 188090 - DNA, 601 bp, Human
aaaatgtacctaaattatctatttgtcttttgcctcgagtgaactccaaggattttttttttaccagtagagatcttaacctttatctttgctacctgagtatctgaaacttcaaaaggctttattgtttcccatttgcttttggaaggaatgctgtacatcagttgttcctgtttttggcaccagggagtggttttgtggaagacaatttttccaagaaggaaagacggggaggtgggagatggtttcatcaggcattggattctcataagaagcacacaacctagatccctcgcactcrcagttcacaatagggtttacgctcctagacggagctcaggcggtaaggatcgccgggcctgctgcccacctgctgctgtgcagcctggttcctaacaggccacggacgagtcccctgctatacatattgtgtgtcatttcatagttgtgagcaactgtcaacattctcaacaaatttaaatattcatttactatctgctagatgacaagtcttatgagacttactaagtgctcagggattgtgaattataggtttgtcaaatcaagaaatgttgatgatttggaaattgagagataatca

SEQ ID NO: 188091 - DNA, 601 bp, Human
attcaagggatttaacaacaaatacaaaaggagcagtaatcactcaaaatagacatcagcagagtcctaggcttctgctctgcaaggtgttaaccctttagttgttaatgatgggtatgggacttcttggggggacagtatctggagcaacagaggcttcaggcatggtgaggagccctcaagggacttggggaagtagctctctgccagccagaagtggagatatatcagtattttaataattatatagctgtacgaacacatagcagatgaatagcagtcctgattacacctcaaataytgtggacataatctgaagagattattttagattgagtaccatatataaaatgtacctaaattatctatttgtcttttgcctcgagtgaactccaaggattttttttttaccagtagagatcttaacctttatctttgctacctgagtatctgaaacttcaaaaggctttattgtttcccatttgcttttggaaggaatgctgtacatcagttgttcctgtttttggcaccagggagtggttttgtggaagacaatttttccaagaaggaaagacggggaggtgggagatggtttcatcag

SEQ ID NO: 188092 - DNA, 601 bp, Human
ttaaattcagttggatgagagttttaattttagcttgtacatcaaggcaagatttatatgagttaggtaaattgccctatttctaaaaagtaaaatttattcaaaatttctgagctttaatttttttttgagtcttcaggttgatgtctaagttttggagaaatactgtactttagaaacagactgaaagttttaaaaatgcttaagctacatatttagttattcaacaaaagcagaataaagatgcacaactttatttacagaccaaggtacaaacttaataaaaacttcatttattttkgccgatggaaaagatcttagaaatcatttgtctttgccaccttgatcttctcaccattcctcagacacgcaagccctcataagactatggggttttataaatgctacttttctgcctggaatagctattccactcccattccctgccccaccctacccttctgttttcctgagaatatccgtcacatccttcaagacccaaatctaatgagatcttctcattccgcaaagccttccctcaccctgtaggtacagctaattatctgtcccctgggttcctgtgatgttatgtttctctcta

SEQ ID NO: 188093 - DNA, 601 bp, Human
tttgctttaaattgtttttataaaaatatttattaaacatacttactgggtgatagtttatgcctgttatcccagcactttgggagaccaaggcaggtggatcacctgaggtcaggagtttgagaccagcctggccaacatggtgaaaccccatctctactaaaaatacaaaaattagctgggtgtggttgtgggcacctgtgatcccagctacttgggaggctaaggcaggagaatcacttgaacccaagaagcagaggttgcagtaagccgagatcgtgccactgcactccagtctggrcagcagagcaagacttgctcttaaaaaaaaagaaaatacttacaggatggtctgcatctagttcagatccatacatcagaactctgttggcacaatggtccaggtcagaaatcttctttggaaaccaaggaacagtttccatacctgtaaaatttaaaataaaataaaataaaaaccagtaaaagttgaagagataatcttaaacaagacaataaagaagataaaattaaattcagttggatgagagttttaattttagcttgtacatcaaggcaagatttatatgagttaggtaaattg

SEQ ID NO: 188094 - DNA, 601 bp, Human
aatagagggagactctatcttgaaaaaaaaaaaaatcaaaaatcaaagcccaggagaaaaaaatgcaaataatgggaaagaaggggacatctgaaaagagagaatgagactcatctctttaatacagatctatgaggtagcacagatttactatgatttgtgctaaaatctggaaaaacagatatgaacaaagcacagtctggggcttaaaggagtttacatgaacctgttattgtaaaatgatacaataaatgtctcatcatattgtacagaacggcatgcacacttaagacgattgtgkggttcagggaaggcttcccagtgatgactctcgagctaagacacaaaagaagagtggaaatagcacagtgattaaaacaaacaaacaaacaaacaaacaaaaacagcatgttgtgcctaagaaaatataagcaaccccatgttgctcaaacttggagagtaaggcagagcatgttgaaactagttggtgtctgcaaattaaaggtccattaaggagcttggagtttagccttgggtaatgggaacccactggtgttttttaaataactttattgaggtataattcacataccataaaata

SEQ ID NO: 188095 - DNA, 601 bp, Human
tagtaattaataataaaaagtaattaatatttgaaatagtgacttaactgaatctagccttagattttatcacaaaatgcaaatatatttgccatttgcagaaacaatgatgatttaaaaagcagacaaaatagtaacattagaatttatactcatgaaaaaaaatttttttagacaaaatggctgagcatggtggctcaggcctgtaatctcaacactttgggagacctacgaaggagaatcacttgagcccaggagtttgagaccagcctgggcaacaaagggagaccctgtctgtacaaaaaaaatttaaaataacaattataactagccaagtgtgatggtgcatgcctgttgtcccagctcctcaggaaggtgaggcaggaggatggcttcagcccaggaattctaggctgcagtgaggtatgatggtgctgctgcatcccagcctaggcaatagagggagactctatcttgaaaaaaaaaaaaatcaaaaatcaaagcccaggagaaaaaaatgcaaataatgggaaagaaggggacatctgaaaagagagaatgagactcatctctttaatacagatctatgaggtagcacaga

SEQ ID NO: 188096 - DNA, 601 bp, Human
ttttaaatatccatactaaaaaatacttgacaaatgatatttgggaaacatttcattattactagagctattatattaaagggctacataattgatactatgagcaagcattatttagagatttatgatcatttttattttaaagtcaatgttacatgacagctttatactccagtagctacaaagataaaagatataatggatacaaagatggaattgtgcctacaaagataaaacagtttaaagaataagtaaaccaccatcccagttaaatacatggctcttttccaagggtgagggkttttttccttaatcatttgactatatcttgttatatttacctgtaatagtaattaataataaaaagtaattaatatttgaaatagtgacttaactgaatctagccttagattttatcacaaaatgcaaatatatttgccatttgcagaaacaatgatgatttaaaaagcagacaaaatagtaacattagaatttatactcatgaaaaaaaatttttttagacaaaatggctgagcatggtggctcaggcctgtaatctcaacactttgggagacctacgaaggagaatcacttgagccca

SEQ ID NO: 188097 - DNA, 601 bp, Human
cggtaaaaatttccatagtgatagaaatgttccatatctgtgctgtccggtaaggcaactactagccacatgtagccattgagcatttgaaatgtggttagtgtgactgaggaaccaaactcttgatttacatttattttagttatttaaattttaaacaaccaaatgtttctagtgtctaccatatttaatagtgcagatatccccttccaacttttgcttgaactttctgttagttttgatttctctttggtatttgaccttgaagcattttcagcagcacattctgcagccagcccasgctccagaccctaagagatcagctttcagttttgtgtgcattacaaagcgtttcctccaaatctcatgcaaatttgatgttacaacttccgtagcatatatttgtccatctttgtaagtccagcaatgttatgtgcattggttctctatcatccttaatcactatttctcaaaagtttagtttttatagaaaccacttacataatttcttcccttgtagaaactgtattgctctttcctgtttatttcttctagttttgtgtatagttgttgaatactgttaaggagttaaatagatatg

SEQ ID NO: 188098 - DNA, 601 bp, Human
tctctctctgttgcccaggctggagtgcagtggcacaatctcggctcactgcaacctccaagcaaagacaaattttctaatggtcattctgaatatgtacttttaaactacacagatactcatacaccctaccccaggtgaaaatatagctaattccagatttataccgttgccagtttttgaacagcctcctctgaagcgccaagagaagccaagccaatttcttgggagaattgggcaaaactaggttcagccaaaagcgggacatgacctaagagttcatggcaggtatctctgaaakagaggtacaagtttgtcacgctgcagtgcttaacatacgtttataatcaaccattcaatcaaatcgaaatccaatattttattctaatgatcgggtgataatactttagtaatggatcacaaaggacactaatcaaataaagaaacaattttggttcaaaaccttggccactcagactcacacatataagtgcacatcagatacctatggacatccacatgccactcccaaaaccacaacccccaacacccaaccccaccacatacacacccaaatcagatctctgctcagatatcacct

SEQ ID NO: 188099 - DNA, 601 bp, Human
atgtcaatgaactgcctgttacattaaaatccactgtgtgctttgaatggatcttttatctaggcatgattttgacctcaaggaccccataaaagagtctcagggaccccagaggtccccaaaccacagttttagaagcactattctatttcacgctgcctccctcactcttggacactctgctccagcttcttgctgtttccccagacacaccaagcaccaccttgtctttccttgtgtgccctcatcctgagatgcatttcttccttccttgctgagcacatcactcattttccatcarctaatccagatgtccttctcccaggaaaccttccccaggttctctatgctcccagagcaatgtgaactttgctataggctatctcatttgacataactgtctcctcaaacagtatataagctccttaaaggtagaaaccaggccttactcatctttgtatttccagcacagtgtcttgtacctagtactcaaaaacactttagcataattttaaggaaacctatcctttttattggaaaataaaagatagataacctattattgtaatcttgtttttctctaccttttttaaagctcatg

SEQ ID NO: 188100 - DNA, 601 bp, Human
tacttctcaaacttctgttctgatgacttttacgtactattaaaaattagaggaccccaaagcttttgttgtgcgtgtatgtgtaggttatcactagctatattagccatattaaaaattaaaactgagaggaaaatgcttgctaattcattttaaaatttaataaactcattttatggtaacaaagaatgttttaatacaaataactatattatacaaaacaaaaaactaagaaaagtagcattgtttcacaatgttataaacctttttaatgtctggctagaagacagatggagtctcrtgtctgcttctgtagttaaccttttgggatatactgtttgagtacatgagttacatcagcttcatgcggttatctagttagaaaagcattgaatatcttaacagtctttttggatagttgtggatattctccttttactctgcatgaagactcaacaagtggatagagtttctcaaaagttcaacggcaatgtggaatctgaattatgtcaatgaactgcctgttacattaaaatccactgtgtgctttgaatggatcttttatctaggcatgattttgacctcaaggaccccataaaag

SEQ ID NO: 188101 - DNA, 601 bp, Human
aatctcaaagaattccctagaaattatagaagttattgctagcatatcagaaatgatgaggaaacagcaagactttgtaagcaaagattttaaaacagtttttacttaaaatatacacataccatttcatatatatcagaaatatatcaaaatatttcatgtgtgtgtgtattactaatgcaatggctccaacctacaattccaaacttattttccacagctctattcaacccacagtatactccagcaaaagaagtagcttgctgttccccataaatgcccttataaaattcttattttttctatctatctatctatacatatacacacacacatatttggattatatgatataatatataattgggaaatagagaaaaatacattcaggtaatgattagtgacatccccaagtatgttccatagtaagctcttgttcaaaagcaaaaactatttcaggttttatcaattatgttaggtgaatatggttatatacaaagatttgcaactcttactttgagttcactgatagaagaaagtaagccagcaccaaagactcttagctgtccatcttgtttacatagaccaaactccacagtga

SEQ ID NO: 188102 - DNA, 601 bp, Human
atcttctcctttgcatcttcaaaactttcagatacaaagtagacatcttgaaaagttgtgataagacattcctgtttgcaggtaatcttgggatcaaagggctttactttggcatgtccagaaagtgcatgctagaagacaaagagtcagtgaatcaaagaataatatctatttttcatagatcatgcaacttccataattggctcacctctaaacatattactaatgcaatggccccaatctacaattccaaacttatttcctatagctctattcaacccacagtacactccagcaaaaraaatggcttgcccttccctgtaaatacccccaagatcctctccatggctttgttcttcctctcttctttgtgtaaaaggcacccaaggatctttatttatttattcctgtattatggcacctactttctacccaacactagttattcctatgtatgacttatatacccaccatcaagtgctccctgaaagcaagacagtaccttggatggtgtttcatacacattcattactcaacaaacttgagtttatttattcattgaataaataataaatctcaaagaattccctagaaattatag

SEQ ID NO: 188103 - DNA, 601 bp, Human
tgtacctcatcttctcctttgcatcttcaaaactttcagatacaaagtagacatcttgaaaagttgtgataagacattcctgtttgcaggtaatcttgggatcaaagggctttactttggcatgtccagaaagtgcatgctagaagacaaagagtcagtgaatcaaagaataatatctatttttcatagatcatgcaacttccataattggctcacctctaaacatattactaatgcaatggccccaatctacaattccaaacttatttcctatagctctattcaacccacagtacactcmagcaaaaaaaatggcttgcccttccctgtaaatacccccaagatcctctccatggctttgttcttcctctcttctttgtgtaaaaggcacccaaggatctttatttatttattcctgtattatggcacctactttctacccaacactagttattcctatgtatgacttatatacccaccatcaagtgctccctgaaagcaagacagtaccttggatggtgtttcatacacattcattactcaacaaacttgagtttatttattcattgaataaataataaatctcaaagaattccctaga

SEQ ID NO: 188104 - DNA, 601 bp, Human
cacacatcaagatgaccctgtctctcccaatgctcccgtcaaaccaacagcagcccaactcccccaacacatgcaagaaccggtcacagcagagtgtcagcaaataggcagggtctgtgccttgtgcgcggccaaacaccgcaggcctcacatctaaaggatgctttcgccaggctgggacagggtctccctcctccaggcatcaggagtgtggggggcacaggtggccccacggagctctgggaccgggcgatcctctccaccgagccctccgcgctgtcttccaggcgctattcgggcyggagggctctcgcggaaccagacgctctgccccgaggcaggttcttcccgcggcgccacagcccctccggccctgaccccgccagccggcaggcccctaagtcgaccgcgaagacccttccttccccgcccgcccgctcctcctccgctccccctccgctcccagcccaggatccttcaacccagagcccggctcggacctcagccgcccagcccctgaactgcccacgccgcggccagcagctcccacatctcggcgcccctcagggcctgcaccggcccgggggcggagtcacgtacc

SEQ ID NO: 188105 - DNA, 601 bp, Human
tcctcagaacaccatgatttcgatatgagaagagtcctaggcatccacaactcagccagtaatattcctcatctttcccttcttatgctccagcccccaggtactgccttttggagacagcacaggggttccttctgataaaagctaactacctagggaagctaaggaaagaaaaaaatgagagagaaatggcatcaaaatgggagggcaacatcctggaattagttcttgtttctcctccccacacccatgatgggaaaaccaacaatgactctggaatcaaagctggctaaggatttcktgccttaaagcaaggcacgtcattatttcatttgtacagtgaaagaggctggcaatgatctctaaagccctttccaagtacagtgctatgtgactccaagattcacatggtgagattccagtaaggggacagatttccccttgacaggcaatatgtctattattattattattatacaaaaagggtccataatccctaatctgaaatgcttacagtcagatgtatttcagattcagaattttacagcttttagaaaagtaatacagtacatatgtcatatatactgatgcaaggtccagg

SEQ ID NO: 188106 - DNA, 601 bp, Human
tgtattctggagccaaacaacacaaggccaagggcctcaaactaatacctacagagaaacttcaagtcttggcgcagtggtcaatcaatcaccaaactgagcatctactggaacaaaaagccaacaacatttattcaacattgagaacgtgccaggtactgttttaagagctttttgtgcagagcggacttatcctttaggcacagtgtctagggcccacaatgctttcagaggcccacagagtggcttaatttttagttatttttaaatgagaaaaagataatatagtaacaatgcatayataacactaaatctggagtggattctattaatatccatctttataccaacacagttgtaaaatataatttttttctttacaaaggaagaggtccataaagggaaaagcaccaacgacccatgacagtcggaatggagccctgctaactcactggttctcttcacccaccattattatcctcatgtaacagattcagaaactgtggctatttgcccaaggccacatagataataagtcacagaaccaggatctgaacccagagatttgattccagagctcatgttctcaaccagatgcaat

SEQ ID NO: 188107 - DNA, 601 bp, Human
taaaactcatttttgattcaagcatatttctttaaaaattctatattcctattatgatcacttacaatataaacttcacaaaaaggggtgattttaagtatgatgcactgaagtaaagagctctgaactagagccaagagtcctgtttaacacttgttttgtccaatatggtagccactacctacacatagctcttgaaaacttgaaatgtgattacactaaactgagacatattgtaagtaaaaaatgcataccagagttcaaagacttagtacaaaatcagtataaaataccttgttartaatttttatactgaattagctgggaatggtgccaggcacctgtaatcccagctactcgggaggccgaggcagggaactgcttgaacctgggaggcggaggttgcagtgagccgggatcgcgccactgcactccagcctgggcaacagagtgagactccatctcaaaaataaaaataaaaacaaaaaataactttatactgatgacatgctgaaataacaggcaaatctatagagacaaaaagtagattagtactcaccaggggctgaggggaagggagaataggaattgactgctatta

SEQ ID NO: 188108 - DNA, 601 bp, Human
caacaactgagttcagcaagctggcaggggcagacccaagctttctctagggaaaaaacatctcccactattaatcagagtttagggaaattagatcggagtgggacagcttaggtggtaaaactcatttttgattcaagcatatttctttaaaaattctatattcctattatgatcacttacaatataaacttcacaaaaaggggtgattttaagtatgatgcactgaagtaaagagctctgaactagagccaagagtcctgtttaacacttgttttgtccaatatggtagccactaccwacacatagctcttgaaaacttgaaatgtgattacactaaactgagacatattgtaagtaaaaaatgcataccagagttcaaagacttagtacaaaatcagtataaaataccttgttagtaatttttatactgaattagctgggaatggtgccaggcacctgtaatcccagctactcgggaggccgaggcagggaactgcttgaacctgggaggcggaggttgcagtgagccgggatcgcgccactgcactccagcctgggcaacagagtgagactccatctcaaaaataaaaataaaaac

SEQ ID NO: 188109 - DNA, 601 bp, Human
actttgctcccactgcctaaacatagtacctacacataatggttgtcattaaataaatgaatgaatttctattaaatttctctttggcacattgctcctattgttgcatagaatgtcacctgtcaaaatgtttttactctctgattctgtcaaccaacatattttaaccattgttcctctattccttaattatataaagtataattaagctaaattaattataacttatatgtaggtgcttacaaggccatctatttgcaattgggagctataatacttccttcagggactacagagcctmgactttgtgcataccatgggaaccatgacccgaaataacagtccacagaccaacaactgagttcagcaagctggcaggggcagacccaagctttctctagggaaaaaacatctcccactattaatcagagtttagggaaattagatcggagtgggacagcttaggtggtaaaactcatttttgattcaagcatatttctttaaaaattctatattcctattatgatcacttacaatataaacttcacaaaaaggggtgattttaagtatgatgcactgaagtaaagagctctgaactaga

SEQ ID NO: 188110 - DNA, 601 bp, Human
ccacccactctaccctggaacttcaacctcttccttatattccaaccatactaaactacttacgatatcccaaactctcctgtttcattccgttgcacctttgcttacatggttccttctgcctagaatgttcttcttttgcacccactctgagcatcctcctatcccaagacgggtaaacctctatttaacttttgagacctagcttaagcctcttctcaccccaccttcccccagatgctcaaaactccctcctttggggatatacatgcatctgtcatagttctgacatggtattacrtttaagtatttatgtgcctatcatgtcctaccaaactataaaactctcaactgctaggacaggtcttattcaactttgctcccactgcctaaacatagtacctacacataatggttgtcattaaataaatgaatgaatttctattaaatttctctttggcacattgctcctattgttgcatagaatgtcacctgtcaaaatgtttttactctctgattctgtcaaccaacatattttaaccattgttcctctattccttaattatataaagtataattaagctaaattaattataactta

SEQ ID NO: 188111 - DNA, 601 bp, Human
atttgaacatattgtcctttatatttttcttttgtttttccccaaaaaactaactgaagggctttacatgtgacttcagtctctttaacaccactcacctccacctcttactctccatcccaactgttgctgctttagtttgagccacaattgtttcatttggattgttagcaagagtttcctcagtaaccttccttcaatccatcttcctatctgacctccctaccatgttgttcttaccatgtgtcacatacaaccaccctgattgccccattcccacccactctaccctggaacttcmacctcttccttatattccaaccatactaaactacttacgatatcccaaactctcctgtttcattccgttgcacctttgcttacatggttccttctgcctagaatgttcttcttttgcacccactctgagcatcctcctatcccaagacgggtaaacctctatttaacttttgagacctagcttaagcctcttctcaccccaccttcccccagatgctcaaaactccctcctttggggatatacatgcatctgtcatagttctgacatggtattacatttaagtatttatgtgcctatcat

SEQ ID NO: 188112 - DNA, 601 bp, Human
ttgtggtattttgttacggcagccctaacagattagtactgtggtacatccataccatcaaatactactcagcaatgaaaaggaatgaattactgatatacacaacttggatgaatgtctacggaattatgttgaatgaaaaaagccaacctcaaaaggttatatactgtatgataccatttatagaacatttttgaaatgacaacatcatagagatggagaacagaagagtgcttagcctagggctaagaagtggttataggcaggtagaaatgggtgtggctatagaaaggcaacaggraggattcctgtggtaatggaactgttctatatcttgactgtatcaatgttaatatcctcattatgttattgtactatagttttgcaagataccattaggggaaaccgggagagaacacacagggtctgttttatttttgcagctgcatgtgcatctgcaattatctcaaaataaaaagttgaattttttttgaagtataatcaatgctaagcccaggactatcagcacagtcctgcattgagctcttcctcacctcctctctccttcctccactccacaagtggactcacgaagcacctg

SEQ ID NO: 188113 - DNA, 601 bp, Human
gatctcatttctacaaaaaatttaaaaattagccaagcatggtggtgtacacctgcagtcccagctgcctgaggtgggaagatcacttgcgcctgggtggtggaggctgcagtgagccaagatcacgccactgcactctagcctgggcaacagaatgagacactgtctcaacaaaaaaagcgagggaggagggtgcagtgcaaaggatttgaatagacatttctccaagaagatatacaagtgtccagtaaaaacatgaaaagatgctaacattgctaaccatcagggaaatgaaaacagrtatcacctcatacacattttgatgctactatttttaaaaaccagaaaataacaagtgttggtgagtttttggaaaaattggaacctcgtgcactcctggtggaaacaaaatggtacaacctctgtggcaaatagtatggtagttcctcagaaaattaaaaatagaattaccatatgaactaataatttcacttctgggtacacatccaaaagaattgaaagcaggatcttgaagagatatttgtacacccatgttcatagcagcattattcacaatagctaaaacatggaagcaactcaa

SEQ ID NO: 188114 - DNA, 601 bp, Human
gaagcatcttacctgtcactctgcttggttcctttgctgtgaaaaacaatggaagagtctgcccagggcacaaccgtcgtccacatgatgccaaaccagtcccccactggaacacgatgccactcgcttcccaacagaatggaagagaaagcagagaagatgcacatcaggataagactagattgccctttgaacctcactgctatgagaaattcccaattctttctcagttaatatgagtgttatggagaagctcaattgcttcaagaggtcctgtaactggcccagggattaccaccamgccaatcacaaatccagtcttcaggacagactaagaccatcaaagcaaattccaatatcacataacttcctacaaaaagttccaggacactccttcagagtcaaatcagtggaatgacaccttattcatgattaacctgaaaagacaactcagatcccagacaaagcagaaaagaaccttgaagatcatcaaatccattcctcacattcagtagatgagaaaactgaggccctgaagagaggatgcgatttgtctcctcaggcaggaaggtaacagcagagaaaatgccaggactcagct

SEQ ID NO: 188115 - DNA, 601 bp, Human
ttcgcgtagagagatttccctgtgggaacactcctggcccctctgtctacatcctcactcactcctgcttcctttttgggagaaggaactggccatgcaaggcatggtcttcctgggttccctctttggggtgtgcctgcctgaagagagggtacatcctcatgtcctcttggtcaggcgttaagtttagtagggccaactctatacaagtaccccggtgcttggtgggtaaattcaatctgagtttcagaattaggggtttgaagacaatatatagtcatagtgagcctctaatcatgtyttccaacctagcttttaacagttctagagttaccatttcaatctccacctacctgacttgcatctatgcctcaatcggttccaaactctggcagcaaagagggttgcttctactgggccaacaaacaatgccagcaagactaacagaccaactaatagagaaagttagagagaccaagaaatagcaaaatcaaaaatccatttaatcctcttctgcatgtttatgtctctacttcctgacaaagaacaaatataggactaaagaaagaagcatcttacctgtcactctgcttggttcctt

SEQ ID NO: 188116 - DNA, 601 bp, Human
aaaatgctgcattgccttggaaggaaaagtcactagacagtttatactgtattggctcggtgtttcaaatggaaggatgaatgcgcagccaaagagagagatatagtgtaggataaaaaaacagttaagacagaaaaacagatagatcaaagagatgaagtagataaattagagaaacatataacaatataaaatatttacaaaactatatatctagagttagatatatagacacacagattagatattacaaagattaaagataaatagatacttaggtaaacagagtagatagatacayaaatggagactgataaatggattagaaagatatagatggataaaacaggttactttgagattagacaactagagagtatacacaggtagagagcttagacagttacaatacacaccaaaatagattagatggataagagagcagcttctaccctcataatcgtaggtatatcagaaaactacaaagaattcataattatattacactgtgttatccatatatgttatatataaatttactgttgattacatgatttgacaaccaccattaccctgagaggaagacattattatccttatt

SEQ ID NO: 188117 - DNA, 601 bp, Human
gagaagggattactgtcactttcaagaaaatgctgcattgccttggaaggaaaagtcactagacagtttatactgtattggctcggtgtttcaaatggaaggatgaatgcgcagccaaagagagagatatagtgtaggataaaaaaacagttaagacagaaaaacagatagatcaaagagatgaagtagataaattagagaaacatataacaatataaaatatttacaaaactatatatctagagttagatatatagacacacagattagatattacaaagattaaagataaatagatacwtaggtaaacagagtagatagatacacaaatggagactgataaatggattagaaagatatagatggataaaacaggttactttgagattagacaactagagagtatacacaggtagagagcttagacagttacaatacacaccaaaatagattagatggataagagagcagcttctaccctcataatcgtaggtatatcagaaaactacaaagaattcataattatattacactgtgttatccatatatgttatatataaatttactgttgattacatgatttgacaaccaccattaccct

SEQ ID NO: 188118 - DNA, 601 bp, Human
aatccattaagtggactgctgagctacaaagatgccactgacgatgaagcctgtgtaaacaacttcacttatcttagtagctctaaaccatctttttgaaagtcaaactgtcttccagatgaggatcattatgctgttgcctcagcaggtaaaattaaattctgctgcaatgccaaatagttatataatctacaaccactccagagaaagtgtctaaagagcattgaacaaaatccaatgtgtaacagcttgaactagatgaagaaagagagggctattaatcttttttttttttgagacrgagtcttgctctgtcacccaggctggagtacagtggtgtgatctcggctcactgcaacctccgtcacccgggttcatgcaattctcctgcctcagcctcccaagtagctgggattacaggcacgtgccaccacacccagctaattttgaattttttggtagaaatggggtttctacaaaaaaactccattttttagtagaccagtggccaggctggtcttgaactcctgacctcaagtattccatctgcctcagcctccaaagtgctgggattacaggtgtgagccacagtgtccagcag

SEQ ID NO: 188119 - DNA, 601 bp, Human
cccctcagcaaagtatcaatccattaagtggactgctgagctacaaagatgccactgacgatgaagcctgtgtaaacaacttcacttatcttagtagctctaaaccatctttttgaaagtcaaactgtcttccagatgaggatcattatgctgttgcctcagcaggtaaaattaaattctgctgcaatgccaaatagttatataatctacaaccactccagagaaagtgtctaaagagcattgaacaaaatccaatgtgtaacagcttgaactagatgaagaaagagagggctattaatcttttttttttttgagacggagtcttgctctgtcacccaggctggagtacagtggtgtgatctcggctcactgcaacctccgtcacccgggttcatgcaattctcctgcctcagcctcccaagtagctgggattacaggcacgtgccaccacacccagctaattttgaattttttggtagaaatggggtttctacaaaaaaactccattttttagtagaccagtggccaggctggtcttgaactcctgacctcaagtattccatctgcctcagcctccaaagtgctgggattacaggtgtga

SEQ ID NO: 188120 - DNA, 601 bp, Human
cctacatgtggctattaaacacttgaaatgtggctagcccaaactgagatacattgtaagtgaaatgctactctctcacacaatggactgcaaagacttagtgcaaaaaagagtgtggctccttataatttgatatgggttacatgttgaaataatattttggatatactgggttaagtagatatattattaaaattaatcccacctgtttctttttactttttgaactatggctcatattatatttctattagcactgttctagaagataaattaatcaaggctggaagatattaaattmcttttcaggatcacatggctaataaggagtcaaatagggactagaagccaggtcttctgctttcactgcattttgtagcttcccaataaaacttgatagtattgcttgccctagggcagtctagtatattccaaaaaactgacagaaagtcaaacagtatcattaaggggcttcagactaaggttcagaagtctccagttcaagttccatctgttacccgatcactgtttgacactgggcacatcacttcacattctaggtctgtttcctcaactccaaaatgagggagtataaatcagt

SEQ ID NO: 188121 - DNA, 601 bp, Human
gataacagatcttgggaatttcaaattggctggggaactctgtgaaatcaacaggcaggaaggcagggatgaatagaggccatgaaaaaacaaaatctgaggacaaagtcaacaatatgaaggccaggaaagtagaactgccctaagggaaagatgagaaataaacgaagattcaagaaaagatgaagatgccaaaagctgtatggcatgatgtggtaacatctgagggaatatatgagatgtctgaaccaatacacatagtttattaggtcaacaaaagtttaaatcagaattccatgcyagctatgaatcaaaataatgttcctacctcaatctttagatatttatctttcacttaacattttctgatgcttttaatttagacttagacatgcaaatagctatgacaaagtaagaacttcccaacaagctggacaaatttctggatgatgcttgctgcaatggatcccttctcaaaacctcatgggctcttaggaccggaaggagttaacttaacccaggcttgcctttttgggtacaaacctgtgactctgagaggaaaagccacatatctggctggtggcagaactagatcccagta

SEQ ID NO: 188122 - DNA, 601 bp, Human
gtcagagacatgggttccaacctcccaccccaagggctgggctgctggcccagatgtgggaatcgcatcagctagaatgcttcaaagctaaaatcaaagaagcaacatctttatgtctttcattagtcaactacctgactagttaaagggtttactgacagacaaccaaattcaccaccatttggtagtaagtgtattttaatgtactgcaattcttggaagactgactaaccatgaaatgcctacctgtgaacacccaatcactcaagactactgctaatttctatgcgacttttgcccyttgtacttagctgtattgttgcacatctcatactggaatgtagtaaaattttatcacaggtctatcacccctagtggacagtggactccttaagggcaagatttacatctagtacaaggcatggtacataaaaagaccctcactatttgtatgatgcatggatgataaagttttccatctctatattcttaggcttacacctatctacatattctagtgggaagatatggcctatgtcttttctcctccatttccccaaggcttaacacattgctcaataggtgcctaataaacattaac

SEQ ID NO: 188123 - DNA, 601 bp, Human
aaatggcattatacttaatctttgaatacatccatgactatttctttaggccagttttattttttataggatagaatttcagagctggaatgacccttaaagattattatgtaaacgtattggccagatggaagaaagggaccagagagtttagtgtcttgccagaggacaaagagaaagcaagagaagcaagtcaaactctccatctattaaaatgtgaccttcccaaagcccaaccacaatttcacacccttccctgaccaacttcacccacactgacctctccttcccctgaaatccwagagcctgcagtgtctgggtcactccttcggcccttggccacaatctttttattcttctactaaatatttagttgctcatccaaccacaagcttcctaaaggtggttctggattttatattcccctgtattctgtagcatagtactatatacatatagataagcatttcacaaatatctgctaaaggactaaagatacctatgaatttccttccaattgcttgccgaaatgtagtatcactgtcaaaagctggggaaagatgtttctttgaagggtaaaagaagtttagctgatgagtta

SEQ ID NO: 188124 - DNA, 601 bp, Human
aattagaagttacagtatggttaatcattcttttcacttactataccacgagcgtattcctgtcattaaatatccttctaaaacattctatttaatgacaatataatattccaacatatggctctgccacaatttgtttaaccaatctctcttcaattttatttgtttccatacctttgtttttgtcattataaattaggctgcagtaaatggcattatacttaatctttgaatacatccatgactatttctttaggccagttttattttttataggatagaatttcagagctggaatgayccttaaagattattatgtaaacgtattggccagatggaagaaagggaccagagagtttagtgtcttgccagaggacaaagagaaagcaagagaagcaagtcaaactctccatctattaaaatgtgaccttcccaaagcccaaccacaatttcacacccttccctgaccaacttcacccacactgacctctccttcccctgaaatcctagagcctgcagtgtctgggtcactccttcggcccttggccacaatctttttattcttctactaaatatttagttgctcatccaaccacaagct

SEQ ID NO: 188125 - DNA, 601 bp, Human
tagctatgcaggaatcacagagacgagcattcctggaagaaagaactgctagaacacaggcacagaggggaaaggtatttaaccatttctcagtgggctttataccaccagccaccactccctaacctgctccaataaatacctgccctttcctgcttcaaaggcctcctccctctggcagttcaccaccgtaactcccccagaagctttctccaggaaggagagacaaaatatctgttgccccctccctaaagcctaaagggctgctacagactgaatggttgtgtccccatcaaattcrtatgttgaaatcctaacccttaatattatggagacaaggcctgtgggaggtgatgaggtcatgaaggtagggccctcatgaatgggatcattggccttataaaagaaaccccagagagctcctttacttcttctgccatgtgaggcacagcaaaaaggtgagagtctatgaaccaggaggcaggtcatcaccagacaccaaatcttctggtattttgattaggacttcccagcctccagaactgtaagacataggtttctattgtttataagccacccagtctatatcacttggtatagc

SEQ ID NO: 188126 - DNA, 601 bp, Human
tccactgtcagtggtttggggacttggcacttgcattgagcagtggcaataatgagcatcaccgaaggaggccactgaggagaacatacaatgttcaaggacccaccaggaaagggaagataatcaggagacttagagtcccagtaattccaaagtagggggttgggagaggtttggggttaaagtccactgtcaaggctagtagatggtgtgacaaatgcttgtcacattcaaatggcttgtctagaggtccatggcctcatggtatggaaaaggaggggttgccagggcagacccaggrtgggacggccacctttcccttccacatctactaatctccctcctgctctgctccctgctcccatctgtccctcaggccccagaatacaaacaccctctactagcagctcaactgccaagaacctccaagtcaccaatgtgaccttttgtaaaaacttgacacagtttaagattatctttcagggtgctcacacttagtcccaccagagacagttaccacccaagctacagtactttccttggagaggaggacttttccatggccagggcctgggagaggcatctgctactgaggattttt

SEQ ID NO: 188127 - DNA, 601 bp, Human
agaagttctactatgagtaaatgctatcaaacagcattgcatgctacagagaaatcttgtgaaaggaagagttcaactgatgtggcaaatttcactattgtctcattttatgtaattgtcacagccactccagtcttcagcaaccacatccctgatcagtcagcagccatcaacatcaaggcaagaccttcttctaaaaggccaccagcaaaaagatcacaactcactgaaggctcagaagatttgcattttttagccataaaatatgttttaattaagatatgtacactgttttatagasataatgctattgtgcatttaataggtatagtatacagtatagtataacacaacttttatatacactggaaaaacaaaaaaattgtgtgactcgctttattggatatttgctttattgctgtagtctgggaccaaacctgcaataactccaaggtatgcctgtacaagtcaacttttccaagcttccattgagacctgcctcacctaattatcatgggcttcctaagctccttggcagggaagagcagacaggtgatgtccccacgattcctcactgcctccatcccagggatggcttttg

SEQ ID NO: 188128 - DNA, 601 bp, Human
ctagtacatcttgtccacagcttcttagaaaagtataggcatacttcactttattgcacttcacagataactgcggtttttgttttgttttttacaaattgaaggtttgtggcaaccctgagtccagtaagtctattggcgccatttttcgaacagcatgtgttctgtgtgacattttggtaatttttgcaatatttcaaacttttcattgttattattacatctgttatggtgatctgtaatcaatgatcattgatgttactactgcaattattttggggcatcatgaaccatgcccatrtaagatggcaaacttaatcgattgtgttctgactgctccaccgaccagcccttcttccatctctctccctctcctcaggcctccctatttccggagacacaacaatattgaaattaggccaattaataaccctaccatggcctctaagtattcaagtgaaaggaagagtcacatatctctcactttaaatcaaaagctataaatgattaatcttagggaggaaggtatgtcaaaagccaagataggctaaaaagctaggcctcttgcacctgttaagcaagttgtgaatgcaaaggaaaa

SEQ ID NO: 188129 - DNA, 601 bp, Human
caaggcccaaaacaaaagcaacttaactactcaaggtcaaatagtgagttagaagtaagactagactagaacccaggtcgccctgacttctagtacatcttgtccacagcttcttagaaaagtataggcatacttcactttattgcacttcacagataactgcggtttttgttttgttttttacaaattgaaggtttgtggcaaccctgagtccagtaagtctattggcgccatttttcgaacagcatgtgttctgtgtgacattttggtaatttttgcaatatttcaaacttttcattgktattattacatctgttatggtgatctgtaatcaatgatcattgatgttactactgcaattattttggggcatcatgaaccatgcccatataagatggcaaacttaatcgattgtgttctgactgctccaccgaccagcccttcttccatctctctccctctcctcaggcctccctatttccggagacacaacaatattgaaattaggccaattaataaccctaccatggcctctaagtattcaagtgaaaggaagagtcacatatctctcactttaaatcaaaagctataaatgattaat

SEQ ID NO: 188130 - DNA, 601 bp, Human
aaactccctcccatcatggagcttaaatctaatgaggggaaagacagacaacaacaacaacaaaacattacctatggcaaatgacgttaattgctacagagaaataaaaagtagggaaaggagacaggcagtgctggggagggagatggaggcccaggaccagtgtccagctcccatcttcctttgtgagcttctcctctacagcacatcacctttcctaatggaagaaccttaaacttacaagtcccagccaactcaagcagaggcaatgaaacttgctcaagcaacctctcaagcctaygatgaaaaggcaggcaataaacataaatgcactttgtaaactcttaaatgctagtgttaataacattatgactatcactctctaaagccagtttacaaagaaccaacatgagaggctggaccacgagtccctgctctgagatgtgccggctgaggtcttggttttcctgttcctccagggtccagcagcacatcacactgctagttacacctagaagctgcttggcaacctgagaaaaatccctgattgaggccagtgactctacagatgtttcccaactcatttcacattcaaactcta

SEQ ID NO: 188131 - DNA, 601 bp, Human
actgaacagaacacataaaacttaatcctagcacttttgtaggccaaagtgggaggatcacttgagccttgagtttgatcgcttgagtttgagaccaacctgggcaacacagcaagatcctgtctctacaaacaatttaaaaaaaactagttgaacaggtagtgcacacctgtagtcctagctattccagaggctgaggtggaaagattgcttaagcctaggaattcaaggttgcagggagctatgaccatgctactgcactccagcctgagtgacagaacaagaacctgtctctaatttaaaaaaaaaaaaaaagacaaaactccctcccatcatggagcttaaatctaatgaggggaaagacagacaacaacaacaacaaaacattacctatggcaaatgacgttaattgctacagagaaataaaaagtagggaaaggagacaggcagtgctggggagggagatggaggcccaggaccagtgtccagctcccatcttcctttgtgagcttctcctctacagcacatcacctttcctaatggaagaaccttaaacttacaagtcccagccaactcaagcagaggcaatgaaacttgctca

SEQ ID NO: 188132 - DNA, 601 bp, Human
ccctccaaacatagggttatttgactgcatatcttagtttgcccactgaagggtgaagaacaatgatcttttcttattctctcagtattccccacagcacctaacacagagcctgacccagaggtggtgttcagtgtttgttgaacagtaggaattgtaggtattgctgttaccaccaaggatatcagagaccatctaaacctactctccaaagagaaaacaaaactaaggaaaacaaataattttccaagtcacacagcctatatagatagaaacagatccaggcattcacaatattgarcaaatagttattgagcactttctatacaccaggtgctgtcctaggtgctaggggctactgcactgaacagaacacataaaacttaatcctagcacttttgtaggccaaagtgggaggatcacttgagccttgagtttgatcgcttgagtttgagaccaacctgggcaacacagcaagatcctgtctctacaaacaatttaaaaaaaactagttgaacaggtagtgcacacctgtagtcctagctattccagaggctgaggtggaaagattgcttaagcctaggaattcaaggttgcaggg

SEQ ID NO: 188133 - DNA, 601 bp, Human
ggcacagctgcaataataacaataataattgctaatattttgagggctatttcatgctaaactcttcatatggattatcccttttaatccacagaaataccctgagtaggcattataatcctcaaattatagatgaaaatattaacgcatagagagaggttatgtctctggctcagagccagcagctttcaatggcaaagctaggatgggacccaggggcctggcaaccagagtcagtgccctcagtcattgtcctgcaggggatgcacaggtctgtctgacctcagctccacttttcacktggtcacactggctcttcaaaagtgaacattcgcaaggacttcctgaggttgttcagagtcacagggacacacacgtgggctggaggcacagagagagcccagctgatgagtgagtgagcttcatccatccttgacctatatggcaaaggtcagattcccaaaacatagaagtattccacacagctgctccattttcaccactgactttattagctaccaaatcgggggcagcagtgatagaagtgaagacagactgcaccctgaggaacaccaagactgagtgcagaactatctacaac

SEQ ID NO: 188134 - DNA, 601 bp, Human
tgcctctaatgataatcaaaaaagagaaagaacattgaaagctctatcatggaattttgattttttttttaagattcaagcatagtggcttgcacatcagaagcctctaatgtacgagacaaaacaaattaattaaaggtaggaaaaagaaatgagtaaaaggaacaacggagaagaaagatgaagcaagattcagttggaaaagagaagagaggaagcttcaactcaagactcgtaagacttgaattaagattcaggcctaatcctggcttctcttctaggctgcatggccttgaacagrtcccttctgctttaggcacccagttttcccatctataaaatgagagaaccgcaatagatgacctcttggatacctccctgatctacattttaattatgatgcctaaaaatcttcagtattaaaatgactggtatacaatttaattttattgtcacctttggaatatttagtctgaccactgtccaaaaataaagcatgcactctaatatcaaagactactcatatagttcctagcgtaaataaacattaaaacttgactgtatagtttgttattttttagtaaaatgtcacaagtttcca

SEQ ID NO: 188135 - DNA, 601 bp, Human
tatccaggctggagtgcagtggcatgatcttggctcactgtaacctccacctcctggattcaagcaattctcccgcctcagcctcctgagtagctgggagtacagtcatgcaccaccatccggccaatttttgtatttttagtagagacagggttttgccatgttggccaggctggacttgaactcctgacctcaagtgatctgcctgcctcagcctcccaaagtgctgggattacaggtgtgagccaacacgcctgacgtctattagtaaaatattttttaacacatcaccgatatatgyacattaatttatttattaaagtatgtacattaaattacatttattaaagtaagtacattctctgtacagtatcctgcttattcttgcaacaaccctgtgagttaggcacttttaccatccccatgttactgacagggaacaaggtacttacccaaagtcacagaggtagcaagtgaaaagagaagaaaagaaagaaacaacaacaataacacaagtctaggatgcatcaaggcctaaactagaatagaagtcataggaaaacaaagaagaaagaatttacagggcttggcaccccattag

SEQ ID NO: 188136 - DNA, 601 bp, Human
cacttgaacctgggaggcagaggttgcagtgagccgagatggcaccattgcactccagcctgggcaacagagggagactctgtctcaaaaaaaaaaaaaaaaaaaaaaaaagtcaaaaggcaggagagtgaataagggtcacaagagaaggagactagaaagggagtcaagattgccaggctggggccagccacagagaagtgccatggctggatctggatctcaccctccagaccagggatccctaaacttggttgcttactattagtaaaaaaaaaaaaaaaaaaaaaaaaaaaaaaatttttttttgacacagagtcttactgcattatccaggctggagtgcagtggcatgatcttggctcactgtaacctccacctcctggattcaagcaattctcccgcctcagcctcctgagtagctgggagtacagtcatgcaccaccatccggccaatttttgtatttttagtagagacagggttttgccatgttggccaggctggacttgaactcctgacctcaagtgatctgcctgcctcagcctcccaaagtgctgggattacaggtgtgagccaacacgcctgacgtctattagtaaa

SEQ ID NO: 188137 - DNA, 601 bp, Human
tgctgcttaaatgaccgttcctctgctgggaaaaactaggaagttgttatctctaagactacagaaataattttaccagaaatcacacattgaatcctttctttcacatgaagtaaaacatcttagagctttcctgttattgattattgaagtcaaagacaggcaagactggcagaatatggtgccaccattattatatccccaatagcaattcagccattccacttacagagcacttttcaccttcaaagcactttacaaagattaactaattaatcctcatactctctggggaggccayagacattctggttaagacaagtccagaaaccaggctgacttaacgttcagtctttagtctcaagcctaaatttaacacactctgaacttgtctatttctcctcaaaataaactctgcatcagaaggctcacccaggacagaagagacccttttatttttccttttcttttaaacagacatttactgacctcttcccaggtacccagtacattcattgacgctggctcaatcctcacaataatgctatggcatatagagtattaagcttattttacagatgaggttaaatgatgagagtta

SEQ ID NO: 188138 - DNA, 601 bp, Human
tgagactgttgctgcttaaatgaccgttcctctgctgggaaaaactaggaagttgttatctctaagactacagaaataattttaccagaaatcacacattgaatcctttctttcacatgaagtaaaacatcttagagctttcctgttattgattattgaagtcaaagacaggcaagactggcagaatatggtgccaccattattatatccccaatagcaattcagccattccacttacagagcacttttcaccttcaaagcactttacaaagattaactaattaatcctcatactctctgsggaggccacagacattctggttaagacaagtccagaaaccaggctgacttaacgttcagtctttagtctcaagcctaaatttaacacactctgaacttgtctatttctcctcaaaataaactctgcatcagaaggctcacccaggacagaagagacccttttatttttccttttcttttaaacagacatttactgacctcttcccaggtacccagtacattcattgacgctggctcaatcctcacaataatgctatggcatatagagtattaagcttattttacagatgaggttaaatga

SEQ ID NO: 188139 - DNA, 601 bp, Human
actagttctatgaaacctttcttgactccccagctctccccagaaagggtgaaagtcaccctcctgtgagccacctttatcattgtactcatccactactatgccgccatttggcaggtgaaaaaaattaaggttcagagaagtgactagcccagggtcacacagctaagccacatccctttctactagcccatggtattactctgcattggttattaagcactagtcactgcataatcactcaacactcttccttcacttctgcaagattagcctcttaaaaacccatgtgcccaggacycatagggcatccaaaactggcaaattgtccctctacctgagctggctaggatttctaaccagattgctcagcaggagattcccaagaaaccaggggatgagactgttgctgcttaaatgaccgttcctctgctgggaaaaactaggaagttgttatctctaagactacagaaataattttaccagaaatcacacattgaatcctttctttcacatgaagtaaaacatcttagagctttcctgttattgattattgaagtcaaagacaggcaagactggcagaatatggtgccaccattat

SEQ ID NO: 188140 - DNA, 601 bp, Human
cagacatcctatctgagacaccagacaattcactcctcctcctgcttatcccttggacattaaaggcaactaagaagaattaaaggcagttggtcagctatgtgccacactcaggtcctcaagggtcaggaaacatcagcctagtccaacactgttcctgcacctccaggtatctctgcacctctctggccaagcccatgaccaaggtagcacctagtttagtgtggctcttgtcttctccaaggtgaacccactcttagtagcatatagctgcctcctggcctggctctctcttggcctsgagcaaatacatgcctagcaggccagacctggatatccacagctggagacaattcccagacccaatttaccagagagtaatagcctggagtctgaacctgaaatgagatcagagcgtctacactccagcaccccagagactggagctaggaaggaaggagctctaaaatgaagctgccagggggctcagggctcaagcccactcctgataagctacgtaaaattcacatcaatgtcaggctcttagactaaattttgcactggtcatgtctgtcacagtgctgcatactgtggctaccac

SEQ ID NO: 188141 - DNA, 601 bp, Human
agttcaagacccaggctcactgtttacctattgtgtgatcagtagaggccagttgagtttacccattcttagccttagtctccttattcataaagcagcaattgtaacacctgcacacaggtttatcatgaagacaaaataatatctgcaaagcatttagcatattggcctataataagcactaaataactttgtgtttctttgctttctttggttcccaggaagggatggttataccacagtctagctctgtctacctgtgttttcctctcctgcttggctatccttctggacccttctktgcagacatcctatctgagacaccagacaattcactcctcctcctgcttatcccttggacattaaaggcaactaagaagaattaaaggcagttggtcagctatgtgccacactcaggtcctcaagggtcaggaaacatcagcctagtccaacactgttcctgcacctccaggtatctctgcacctctctggccaagcccatgaccaaggtagcacctagtttagtgtggctcttgtcttctccaaggtgaacccactcttagtagcatatagctgcctcctggcctggctctctcttggc

SEQ ID NO: 188142 - DNA, 601 bp, Human
attcccaggtctgccaaagttgagttagcagctagggattagagaccttagctatgaaactgacttggaaagtagagagctgctggggtatacatgtgcagtcaagcagcaaacaaacctgttcacatacatcctgccctgacatgcgcttggtgggattaatccagatcactgtactacccaccctggaattttccaggagtgcctagagaggcccagtatctaaggtaaaactgacagagaatgaaacacagaagtttttaccactgtaaggacattaaaggaaggcctacaaggtctaaaatctcaaataaagtgtttctcaggctagagaggagacatggctcagaagaaaagaattgaaacacttagggcattagagacccttattcccagatttcaagaacccagcaaagggttccacccaggaaagggcacatagaaagaaggacctcaattttactttatctatagagtatgtgaccttcttcaagcacttcaagttcaagacccaggctcactgtttacctattgtgtgatcagtagaggccagttgagtttacccattcttagccttagtctccttattcataaagcagca

SEQ ID NO: 188143 - DNA, 601 bp, Human
tcttttttgttagtgtcttcagaattgaccattccatctttagtgctcctttggccttttgtacatacctctaatagcacttttcatctatacagtagatattaacttacatacctggaagttctttgagggcaaagactgtgtatttttcatccttgtatccacctccccatccacttccactgtatggccaacactggtgcatgacaggtgtcaaccaatgtttatggaatgggcaagaactcaaaagtcaagaaggaggtaaatgtcagaaagatccaggagagcataaaaggtgggrcagcacacaaacagccagtggtggggatggtgggcaagaaatccaagaaggcagtgtcactgaggtcagtcctaggcaataagggcacagccatagggatgacagtcaaagctgaactgcaagttctgggaagaccagacagggatttcatcttggaaacacaaagaattgaacagggagcaggagcactctcttgaggtccagggaataaggaacagcagcatcataccaagtcccacaacgtaaactggaataggagggcttggggacaagaaacaagggcagagaatagaggcaggg

SEQ ID NO: 188144 - DNA, 601 bp, Human
atcatcaatagcctttgtaagaaacttcagggctgttctgagcaccatataggctcacagcctatctgtgctggctctgcagggcatctgatgaccaaatgcctgaaaacatggaaatgcctattcccaaactggcctgggattgagaagcacagactatggggaagaagagaagaagcagtgaaaatgggtacatacctccaaaaccattactttcattcatttttcacttattcagtcagtaaacattcactaagtacccacaaggtgccagggactattctagacactgggatcacawctttgaacaagacagagaaggcccttgctctcttggattttctattttagtgagaaaagagagatgataaatataaataagaaaatagtgggtggtagtaagtgcttgtttcaccatctctctcaaacatgacagctcttcctctcttctgagtgttcatggggacaaatccggtccaccactttgaggtttgttttgtgttatttctccccctgctatgtcagcagctacagcacagatgtgctagatttttaaatctccagtgaaaccatctttgggtgcacactactacccatttta

SEQ ID NO: 188145 - DNA, 601 bp, Human
gtactgtgactttgagcagtgacagctttctttctcaacttcagtttcctcacccccagaatgaggacagcagcatctgcccttcccgccactcaggggtcagagccaataatggtgtcttccttctcccatttccaggcagtcacctgacagtgctggaagaacccattacagagtaaagtgaactagtccctcccaggtagcctccctgccctaatctcatcactccagcagataattttccttccaatctaaccacgaagatttaagccaaccaacatgagctctcacacttttttcrgcacaattctattattacttactttgtaccaaaccttgccctaattatacaaagataaataatgtctgtcctcaaagaacttcaagtttgatttagaaataggcatgttaataattactacattactaataaataccacattgcagtattgggcagcaagtttgacttttatttgtgaattcttggtgcctgtgcatggcccacagtaggataaagtaaacatctgttgaataaataaataaaactaacataaaacctgatgacaaaagaggtacacagttcaatgaaagcactctcttc

SEQ ID NO: 188146 - DNA, 601 bp, Human
ggcatgtttgtaagactaggtggcaggaataccaagatgattataagacatcatccttgttagctactgagaaataggtagtagttgtccaaggagccaaaggcaaagggaagcagaaccagcatgcaaagacccagaagtatcaaaaaacctgatgcattattggttaggcatagataaactgcagaatacagggagagactggtagaaggtgaggctgggtattttgacagaagctggatcaagaagagcttcttatgaaaatccagagattttagacttcattcaggataggaagccrtcagaaagtaagggcacacattcatccctataacaatcatttgctcagcacctgctgtgtgctgggtgctatgcaaggtgatgaggagacagtggtgaacaaggccaacaacagtcctggagcttacactctaatgactccattctttgcacactggctgtgcagtttatgggttgtgtgtttctcctacccattgagaatagaggctgggtcttaatctccactatatcttaaatgcttggctaagtttctttcacatagaaagtcgctatctaataagtgtgtattatgggaataaat

SEQ ID NO: 188147 - DNA, 601 bp, Human
gctgcatcccacaaacactgatgtgctctactttcattattgttcgaagtttttcaaatctttttattttgaagtaaattcaaacctagataaaagttgaaagaaccacacaaagaactcctgtttacaattaactcatattcccaaatctcaacgtttcactagctttgctcgctatatccccttccctctatttgttttttggtttatttgtttgttttttgagacagagtctggctctgttgcccaggctagagtgcagtggtgcgatctcagctcactgcaacctccacctcccagrttcaagcggttctcctgcctcagccttccaagtagctgagactacaggcacgtgccaccatgcccagctaattttttatatttttagtagagacggggtttcgtcgtgttagccaggatggtctccatctcctgacctcatgatccgcccgcctcggcctcccaaagtgctgggattacaggtgtcagccaccgtgcccggcctttatttttttctaaactgtctctgatcaagttgccaaacttgatgccccattattctaatatgtcagtgtgtttgccaccaaaattgacatcactg

SEQ ID NO: 188148 - DNA, 601 bp, Human
tttctgtttggtatagtagcccttctaataggtgttgggtggtatctcattgtggttttgatttgtacttctctaatgattagggatgttgagcaacttttcacataatcttggtcatttgtatattatctttagagaaatgtccattcaagtcctttgcccttttttaaaattgggctgtttggtttttgttgttgctgagaccttgtagatttatagcaaatttgaagtcgggttaggtggatcttgcaacttcattcttcttttccaagattactttggatagtcacagccttttatrtttccatataaatgtcagaatcagcttatcaacttcaacccccaaaaaagtctcttgagattttgattggggttgctttaaatctacaagtcaacttgggaagacctgacaagttaacaacattgagttttccaatctgtgagtgtgatatctctctccaattaattgggtctttaacttctcccagcagtgttttgtagtttttatgtacaagtcttgcacgtttttgttaagtttatacctaaatattttgtactttttgatataactgtaaaattataatcgtaaaaaaactgcttt

SEQ ID NO: 188149 - DNA, 601 bp, Human
ctcaccaattcagaaaaggaaataatctaatggtaaatctgcctgaaatttcccaggactctatctattcttttaatagcatccaaagtaaatcagtataacaagcagaatgttaaaactatttggtaaaaatgttaaacagcaccttagaagcacatacaaacatgatattaattgctgcacttggctccacaacaagccaagaatgtgaccaaaaagaattagaagtgaggacctagttgccctattcttctgggtaatactggataagatgattaagttctctgagcctgagtttccytatctataaaataagagggcagggtaagatattctctgaggttctacattatcatttgaatatcaaagccccctaatgtgctaaaagcattatgtaatatctcagtagtcatatcagcattacgatttgaatccaaagtagccctaataataacacattacatttatagagttctccagttttcaatgtgttttcatattcattattctcatctgacaagtaacagaacaggatttttttttcatgttctaataaagaaggctggcccttcagtcaatccaaggtaatacgaagcttcct

SEQ ID NO: 188150 - DNA, 601 bp, Human
gaatttctaatagaactatataatcagaaattttatcctgattttctttttgcataagtaaatgaaattatttgaagaaagaaaacttcatctacaattccaccacctaataccacgtcacatctttttttcattattcaacattcccttcaaatccatatctaagcataaacagaattttcactcaaagacatgacccaggtcctatttctcacttaatttagacaaagattttctcaaactaagtcctatagggccctagtgctcctggatgtgcctcaggagccaccacaaaggaaayctgccagtaggcagccaagtgataaggcttccttctcccatccctgactttcctatccctattcccaattcaaccagaacagttatatttttatctgttttagattttgatgctctgcatacaattttaaaataaaataaaataaaataaaaatggtgtattactactaagcatttaaaaataaaagaatgttcccagcaccttgggtggccaaggcaggaggattgcttgaggccagtagtttgagactaacctcagacatagtggaccatgtctccacacacaaaaaattttttttaa

SEQ ID NO: 188151 - DNA, 601 bp, Human
atccaaatgcaattttcctccagtataccacaaaatgttgaatactgaggaagacaataataatgaaaagtcagctgtactataacagcaaatttcctgtagagatgatttgaggttctacaggtcactaaggaaaagatacacatggttaatcataaatccatctaaagatagttcatttctatcatctttcattttaaatggaggtttatacaactcttggcttggagggttgtaaatttaataatgttgttccaattcactactagtcctcattgatcttattttaatctgtattgaytgattaatgtcatcttgtgacatccaaatggcaaactgaggaagaaaaatgatatgcattgagttggacttctattggaaagagcactaaactgggtatcaagagacctggcttctaacatgctcagtcactactagctactgtccctgggaaagtcactccatctatctgggcttcaggttcctcatatataaaattaaacaataatatctgccataattcaacaaactgttgtgataagcagatcagaaaacaaaaagttgttactatgagacagtatctatattcccttaagttcaa

SEQ ID NO: 188152 - DNA, 601 bp, Human
cagccctaagaggagaaaggagccatagaaggagaaaggaggtaatgaaggaatattgaaacatttcttagcctctgccaccaggtggtgaaatcaacccagcacagcttagttgctgcccagagctactgcttggatttatcttttcttgtttgtcattgcattggggtgggaatagagatgcggaacaaatggagaggcagagcaacttcaagctgggtggctgggagcagggagagtataatgagaaatggattgtttttatgcatactaattcagtggccctaattaaagagcatcrttatattttaaaatgcatggacaatcatgtaataaaaagtgctcatgatgataaaggctatactgaattatacattaatgtttaactccaactaagttttaaaataatacatttgattttaaaatatctgttttcctggaatgaaactcaatgtcaagttaggtctaatgttatcatccaaatgcaattttcctccagtataccacaaaatgttgaatactgaggaagacaataataatgaaaagtcagctgtactataacagcaaatttcctgtagagatgatttgaggttctacaggt

SEQ ID NO: 188153 - DNA, 601 bp, Human
ctgtatttcaggtattctttcttattttaaataagattaggtagagtattagaaagactaatcaatataactgccaaatgaaatttacccagaaaacaattttctcctttgtttccattgtaataacagcaatatctataatgaattgctgacctgcaataaaaatcatactactatcagaaagaacatgggggcaaaaatataatgcctacttcacaaacatgtaatgccacacacagtaaggtagcccattcataacccagaacctttttcttacagaaacactgcaaataatactcamatgtcctgggcctgctgccttgcaatactaaccacctccatccaaacacatacccaacattcactaaatgccatttaatatgtcctacccattcttcttagggctggagaaccacagtaataagacacaattactgtccttagacaaagtctcagcctaaaggtcaagtggtcccagctgtgaaagaaaaagtggcaaactagaacccagtccatatgccacaaggtgacttctgtgagcacttaggccaaagaatggactgcaaaacatcacccaatatctgcattataaaagaccact

SEQ ID NO: 188154 - DNA, 601 bp, Human
gaacaaatgaacaaactgggatttatagccaagctacaggctctgagagatatagcggaataagtgcaggatttggagctcaacagacccaaatctgaaccccagctgtaccactcattagctaggtcaccttaagcaagtcccataatctctctgagccttagttcctcatgtgtgaaacacagacaaaacttcatagagatgtagtgaagattaaataacatgatgtgggtaaagtaactggcacaaaatagatgctcaacaaatgttatcctcctacccacttcccaacttgcctatrgttacgaaagagttgacaacaccaaggcagggccccaattctatcagaacttatcaaaacaggattcaggcacaggaataagggaaggtcaaagatagcatcccagatgacatcttactgactcccaagctttgaacttgagctccttcagtgtgtctgaccaaggtacaatactaggcccacgactaagcctacagatggaggatccaatggctgcagccatggggagaagatggcagagactgagcccattccttttggcttttgaagcatttagacaaaagcatacaaaactccctt

SEQ ID NO: 188155 - DNA, 601 bp, Human
agtggtgaagactcccgcttccaaatccagggagaagccagtttctgacttcttatctgtctctcccacagactgcaagctttgtgaggacaggactgtaaaacttgtctctagctatagtggcctgcacatagaagtcattcaacaaatgttttatgagtgaatgaatgaacgaaccaaccaatgaaaaaaaaacaataaagaaacaaggaccaaagatcattcgcttggtttcatcagtgtcagtcgagactacccttcaaactcgtgaactaagcttactcctcagtccaaaagccasaacagaagaccccaaggggtctaggagatttaaacctgaaaaaaaaagggactcaaactagcttggcatttttttctggaccaaggtatgctaacaaacaggctattctaaccttttccaggttttgtaatgttttatgctactcttaccagaatttccaggcaagaaattcttttctagaaactagatgctatttatattttagttattaaatgcaatgtgaaagtacctaacacataatcatcatctacattaacatttgttgaaactcaatctatagaattctatttctctatgtca

SEQ ID NO: 188156 - DNA, 601 bp, Human
ttaaactcagctgcaatccataaaatgtctctcaagtacttagagtctctaaatttgaagtctttagataaaatgactttaaaaatactaattatgcacggaagtctaaccatgaaccaagcattagtgaatccaaagctccttctgtactggcatgctgccagcaggcatgaacagaagctctaaaatcagcaaggaggtcacctctgtaaccacagcatttctcccggcctcacctgtctcctgactggtcctcacctacagaacttcagtctcagttggaatctcacagacaagaccmcattgaaaggaacactgtctgagcctagacagtatggcaaaggtgagagagggctacaaactctggggtcacagacccacagagtcagtccatggaggagaaagggaaaaaagggagaagcagagtggaaccagcacagactgaatatttagtggtgaagactcccgcttccaaatccagggagaagccagtttctgacttcttatctgtctctcccacagactgcaagctttgtgaggacaggactgtaaaacttgtctctagctatagtggcctgcacatagaagtcattcaacaaat

SEQ ID NO: 188157 - DNA, 601 bp, Human
atctgaatccccacctaataaaccgtttcaccaagaccagagtcctaccttgctattactccaaaagactatcttgatgcagaatccacctggagggcctcctgagaccagagctctaggaattcatctccacatctcccactgtgcagttcagtatctggcatgtaatgggcacacaacaaatatttatagaatgaaaaggttacccactggtctagatcactgcagactgtctgctcctatgcccctccccaactcacaggacctctttgacggataaaccaaccatcgcctgtcaccrtgttctttggctgctttgttgttccaactccaggcccctgacagggtctctgggtcaaacatacctactctattcccggtatgccctctttgccacttagcacatcctaaaagaaagagtgctaagcaaattctgaagtctgaaggctgcttcagtgtcccagacacaccttttgctcctggattatgagggttaacccacactagagactcatttggggccatctggcaatttttggcaccacccacttccccttgtccagtgtggaagggactcaagtcctgttcaacaagcactact

SEQ ID NO: 188158 - DNA, 601 bp, Human
acgtccacaccaggtgacctttactccagcgtacccctgtcttctatcaggaaagatttcaagtttcagaggttagcagctcagaagcagcctcagtgtgctgcccattcctgccctgatcttgttccttggtttccatcactgggtatctgccttattctagaaaccatgccctcctttatgccagaggttcagcaagtgtgaccctgaattgattgtttcctctatctgaatccccacctaataaaccgtttcaccaagaccagagtcctaccttgctattactccaaaagactatctygatgcagaatccacctggagggcctcctgagaccagagctctaggaattcatctccacatctcccactgtgcagttcagtatctggcatgtaatgggcacacaacaaatatttatagaatgaaaaggttacccactggtctagatcactgcagactgtctgctcctatgcccctccccaactcacaggacctctttgacggataaaccaaccatcgcctgtcaccatgttctttggctgctttgttgttccaactccaggcccctgacagggtctctgggtcaaacatacctactctatt

SEQ ID NO: 188159 - DNA, 601 bp, Human
aacaggcctgggatcccggccagcaattttttattcacatgcaaacttggggatggagttccaccgacaaaatctttcaggtgtactcttttttttcttttgttttttaagccatttacaggaacccaaggtcctccttgtacttcagagaaatgctttgtatttaatttgttcttaaagaaaaaacaatagcctctttgctctacatgactaggccactgggcaccacgaaagagatacagtaacccaccaagtctctaaggtcccagaagtccatctgtctgtcacacacatcacaaasacaccactcatggcagaagaaatacgctactgcagggtgaaagggactgcattctagaagccttctggagggcaaaggaaggaagagaagaagaaaagaagggtgaaaaagggggagggagtgttcaagaccatacatgaccacttctgctaaacacaaaatagttgccttttctgcttctttccttgctttcaatctaattagacagaaagagctaatgagtaggcagcaatggtgcttggttcagctgttccagaccctagtgtttcctccttattaaaaataaagagacccaagggc

SEQ ID NO: 188160 - DNA, 601 bp, Human
attgcaactggcccttggcattccccaagacttcttcatataaagtgtaggtctatgagttgtaataaatcaccttccttccatgtttgctgtcttacaatttgtgcaatagaggagcatgaatatggaaaattccagctgaaaactttgaccgcatgaacaggcccagaggtcacagtcaccactgatggttagatgaaaccatctacaaacaggcctgggatcccggccagcaattttttattcacatgcaaacttggggatggagttccaccgacaaaatctttcaggtgtactcttytttttcttttgttttttaagccatttacaggaacccaaggtcctccttgtacttcagagaaatgctttgtatttaatttgttcttaaagaaaaaacaatagcctctttgctctacatgactaggccactgggcaccacgaaagagatacagtaacccaccaagtctctaaggtcccagaagtccatctgtctgtcacacacatcacaaagacaccactcatggcagaagaaatacgctactgcagggtgaaagggactgcattctagaagccttctggagggcaaaggaaggaagagaag

SEQ ID NO: 188161 - DNA, 601 bp, Human
tcccaggcctaccaattactagctttgccaagtcatttaaactctctaagcctcaatttcctagtctgtagagtgaagatgataataatctctacacccaaggaggaagaaatgagtgaacttctctaaagcccttacttatcccaatccctgactgagagtcaatactcaaaaagggttagctagtgaatgaatttggggcaatgaatttgaggtaagagggagagaaaaacattcaaacaaatggttctggaattatgtaataaataatatagtaggaatacatttgaattactctgaragcagaaaggaaagcaccaaattttgccttggcatatatagaaaacttcacagaggaggtaacacttgaactaaaatctaaagatctaaaatcaggccaaaggaaggccatgtgtgaagtcagagaggcaggaaagagaacctggtatgttcaggaactgcaagtctggctataagaagggtctgtgcaaaggaatggtggtgacacacagggtgaagagatgacttagagccaaaaattccctgcaagctctgccacagagaatggatttctcctggaagatactgaaaagccactgca

SEQ ID NO: 188162 - DNA, 601 bp, Human
tatgtgaatggggcctggaccagggtggaggcagtacagattccagactcactgggaagggaggtgttgcagatggactaatgagaatacagagagtgaagcaaaaggtgactgagattttgagtcctggtcacaggggaaaacaacttaacacagtgctaagtgctagggatgcagaggtgggtgtacacacagctccagccctcccccaggataagttagttcccagcactctgctgccatagcaccctggacaccctcatcattgcactcagcatcctggactgacactatgacttayctgtctcacctgctacatcacaagctccttgatggaagagactgtgtcatactgaactttatatctacagccatctagcatagtgcgtggtacaattcccaggcctaccaattactagctttgccaagtcatttaaactctctaagcctcaatttcctagtctgtagagtgaagatgataataatctctacacccaaggaggaagaaatgagtgaacttctctaaagcccttacttatcccaatccctgactgagagtcaatactcaaaaagggttagctagtgaatgaatttggggcaa

SEQ ID NO: 188163 - DNA, 601 bp, Human
tctattggtccagccctgccataggcccaggtctagccaggcttctgccctcatccagtttagcctactggatccttagtccctggagagcaggggccatacctcagtgcgctcagctctgtaagcagctcaggatccagtacacagcagaggctggccagaagtggtggggtgagagggactcggtgccagagggcccaatcctgggacatgttcttagaagttctgtcctgaggccaagaaaaaatttcctaggatggaaatgctccaggaaacctaggcaatgacaaatgagctgagmacaggcaatctccagagactcctggtactccagaaaccttcacactctcatgcacattcctcacacgcttgctgcagattatgtgaatggggcctggaccagggtggaggcagtacagattccagactcactgggaagggaggtgttgcagatggactaatgagaatacagagagtgaagcaaaaggtgactgagattttgagtcctggtcacaggggaaaacaacttaacacagtgctaagtgctagggatgcagaggtgggtgtacacacagctccagccctcccccaggataagtta

SEQ ID NO: 188164 - DNA, 601 bp, Human
tagctcttggaaaagatgatcatgctcagaacaaggaagagaaagtaaaaagaacctgaccctttgcagaaaacattggggtttttttctaagtattataacacagcctatgctggcaaatatttcattaacaactttttgctccttgggtggcagtttcatactggtcagtttttggcgtactatgtggtactcaggagtttactcaattgtctccactgggggtattttttagtcccctgagaacaagcagaacactgaggagaagctctggaatcatacctggcttcaaatactgctygttcttttgtgtcctcactgtatgacttgcagtctcagtttccccattcataaatgtagattcatggggtttctgtggaaactaaataacataccatgcacctggcacaatgcacataagggagctatttacattttgttctctattccctttactccttttgtgtcctggaaaaattagaatggtttcctatctggatactgggttcacctcttttgatttcagattaaaactgccatcctagtctctgctggtttgaaactaacttccacctggaggttaccctaacagaaagaaatc

SEQ ID NO: 188165 - DNA, 601 bp, Human
ctatattgttttaggattattcatcaaggtaccaacagacaagggtctttcagagatcttagggtcatgaggttacccatagctcttggaaaagatgatcatgctcagaacaaggaagagaaagtaaaaagaacctgaccctttgcagaaaacattggggtttttttctaagtattataacacagcctatgctggcaaatatttcattaacaactttttgctccttgggtggcagtttcatactggtcagtttttggcgtactatgtggtactcaggagtttactcaattgtctccactgsgggtattttttagtcccctgagaacaagcagaacactgaggagaagctctggaatcatacctggcttcaaatactgcttgttcttttgtgtcctcactgtatgacttgcagtctcagtttccccattcataaatgtagattcatggggtttctgtggaaactaaataacataccatgcacctggcacaatgcacataagggagctatttacattttgttctctattccctttactccttttgtgtcctggaaaaattagaatggtttcctatctggatactgggttcacctcttttgatt

SEQ ID NO: 188166 - DNA, 601 bp, Human
acagatcacacacactcacagagagggctctagcaggccagcctatattgttttaggattattcatcaaggtaccaacagacaagggtctttcagagatcttagggtcatgaggttacccatagctcttggaaaagatgatcatgctcagaacaaggaagagaaagtaaaaagaacctgaccctttgcagaaaacattggggtttttttctaagtattataacacagcctatgctggcaaatatttcattaacaactttttgctccttgggtggcagtttcatactggtcagtttttggcrtactatgtggtactcaggagtttactcaattgtctccactgggggtattttttagtcccctgagaacaagcagaacactgaggagaagctctggaatcatacctggcttcaaatactgcttgttcttttgtgtcctcactgtatgacttgcagtctcagtttccccattcataaatgtagattcatggggtttctgtggaaactaaataacataccatgcacctggcacaatgcacataagggagctatttacattttgttctctattccctttactccttttgtgtcctggaaaaatta

SEQ ID NO: 188167 - DNA, 601 bp, Human
agggatactgtaattagaaccagcctagaatgaccgacacagggggaacagatggtcatgagacctgcaatggcccctctttttttgttaaagtgactaaatgcactgactcctcagcacaatgggaagtggctgagcttgccttgtagcccactttccctagtgcaaactcccagtaaggtgatctcaagccccagccaccaccaagcctcatggacttgtctcaaagatgagatgggagagatttctctttaaaagagaacttgatgaaatctaagttacccaatggcaacgtctgaasatgctgagtcagctgcacttcaggaaacagagtgtccttggagaatagagcatatcactttacacacagaaaaccactcctgtctacgaaggacaaactgcaaaatgcttaacactggccttcaattattaaacgagcccaaatgagctctggcagtgagacagatcacacacactcacagagagggctctagcaggccagcctatattgttttaggattattcatcaaggtaccaacagacaagggtctttcagagatcttagggtcatgaggttacccatagctcttggaaaagatga

SEQ ID NO: 188168 - DNA, 601 bp, Human
tccctttttaacacccatccagtggatctgcacttggtttaattgccattctgatccccccacataatccatacatcacaagactcacatttacagttcagtacattatcacactggagctgctcaaaataaacgggtttggcaaagtgtaattatttccagcaaaagagttggttctgcattttgacagtcatctgatacattattgtactcaatgctaaactgtgaaactgcaaaattaaaagaaagtaatttttttaagttttaaaagtactcattattaaattataaagcaggtcakttatgatgagtcagtccaaaaacagaaggatgataatgaaagactgaaggaagattggcttctttgtataacctctaatattcacaatccaaggccattgtgaaaattaaatgagactgcccatgtaaaatatctagtccagtgcctaagacataataggtcctcagtaaatgctgattttcttccttaaaaattcctcagcagcagaatttacaaaccacctcaatttgttcatttgttcatacattccatgattccctcattcccaaagagctctcagtctgctggggaaaggcaagt

SEQ ID NO: 188169 - DNA, 601 bp, Human
ggaggctgaggcaggagaatcgcttgaacctggggagcggaggttgcagtgagctgagattgtgccattgcactccagcctgggcaacaagagcaaaactccatctaaaaaaaaaaaaaaaaccgcagccaggcacggtggctcacgcctgtaatcccaacactttgggaggccaaggcgagtggatcaaaaggtcagggaatcgagactatcctggctaaaacggtgaaaccctgtctctactaaaaatataaaaaattagctgggcatggtggcacgcgcctgtagtcctagctactcrggaggctgaggcaggagaatcgcttgaacccatgaagcagagattgcagtgaaccgagattgcgccactgcactccagcctgggcaatagagcgagactctgtctcaaaaacaaacaaacaaacaaaacagcaactcacactttccccagaactcctaaaatcccttaccctgctctcacttttttcttcttttgattatatttattatcttctaacatggtatttgagtttatttcttatgtctaggtttaatgtctgtctctcctcactaaaatgtaaactccataaagacaaggatt

SEQ ID NO: 188170 - DNA, 601 bp, Human
atcatggcttctacaagaacatgcattctgaattacagcaccagaaggtagcagctccctgcagggtcaatacatctgggctccaggaacttgtcagcacttcatttatatcaacataagaaaaagcacctccaaggcaaatccctccccagatgtcatggcctgggaaacatccattcattccctcattcaaagatttactgcctcctatggaaaaggtgctgtgccaggtgctgtaggtgaaaatgtccccatgacttaaggaattcataatcagtaagataaataaagcaggaacagccacacacacacacacacacacacacatacacacacactctctctctctctctctttctctccccctacctactggaagttcagagaatgaagtgatcaattaggacctggacatcagggaagactttccaaggagatgccatctaaagctagtctggaaaaaaagcagaatatggattaggcaaaaagcactcctggcaaagggaagagtgtgagcaaaggtataaatgtgtgaaagagaagtcaagttacagaactgcaagttatccccttaggtgaagcaaaaggttcacttaacgtg

SEQ ID NO: 188171 - DNA, 601 bp, Human
ttttattttattttatttttatttatggagaaagagtgagagaaactcaaggtatttctaatatgcaaccatagttaaaaaccattgtcctcgttaaaagagatctctcctctcactgagctcccataacattttatctaaatatcttttatgacacatagtttctagcttctttcatacatattttatttttaaagtattttattgagggttattttgtgtcaggcactgttctaggcactgtaatataatagtgatcaacacaaagggccctgctctcatggagtttaaattctgatgsggaaacagatactaaacagataaaataaggtcagatgataagtgccagtaaaagcaggaaaggaatggagaataaaagaagaggtcctctcttagagaatatggttaggaacggctttccttattgcaatcttacgtcccttttagatggcatattgactgacaacaaaacctgtgtctaattcatttttgtatctctcatagctttttgtatagtgcttgcataaataggtgctcaataagtagatgctcgttgtatgaatgaatgaatgaatgaatgagtaaatggatcaatgtgcct

SEQ ID NO: 188172 - DNA, 601 bp, Human
ttttgagacagtctttctttgtcacctaggtttttttgagacaggatctctctgttgcccagactggagtgcagcagcacgatggctcactgtaatctccacctcccaggctcaagtgatcctccccgctcagcctcccaagtagttgggactacaggtgcgcaccaccacacccagctaatttttgtattttttgtagagatgggatttcatcatgttgcccaggctgttctcaaacttctgggctccagcaatctgctcatctcagcctcccaaagtgctgagattataggcattatcyaccatgcccatcctacactagtaaaatctttaccacaatcaagatgatgagcatatctatcaccaaaaagtcccctcgtacagccctgagcagtttttgaatgacaactcattaatggaagcagggaagtcaagtggaggtagctgggtagtagtttggagtttaaaaaaatgacaaatttagctttggatatgatgagtttgagcttatattcagcaaatagtcaaaaacagggaactagagaggggcttggtaagtggaggtgggaatactgattccagaataaagataaaagtaaga

SEQ ID NO: 188173 - DNA, 601 bp, Human
cttggatcaaggggttaaaggaggcctacagttcccctaagatccaaaagagaaggtgaattcagaggaacagacttggaaccatttgccacctacacacacacacacacacacactctctctctctctctctctctctctttccctccaaggctaaatcttgtaagttcagggttggttagttggtttgcttagagacagggtctcactgtgctacccaggttagaatgcagtggtgaactcatagctcactgtaacctcaaactcttgggctcaagcaatcctcctgcctcaacctccygagtagttaggactacaggcatgtgccaccacgcccagctaattaaaaaaaatttttttatagagatggagtcttgttatgttgtcgaggctggtcttaaattcctggcttcaagcaattctctcccgctttagtctcctaaagagctgggattatagccatgagccatcatgtctggcctgttgtgggtttgttttaataagctaaatcatgggaatttgtcgtctgaagtctccctaatattttgcaaatcatacaccattcactcattcattcattcattctacttttactgaaaac

SEQ ID NO: 188174 - DNA, 601 bp, Human
ttgcatccaccccttagggccagagactgagtgtcctagactaagtgagccagatgcttcacatttcttctctctttgtctagttccctatctctcatgcactatcattcagacaagtcagaacactgccagcctgcctcagctgcactcaggggactcacagtaaggtcagggtccaaacttggatcaaggggttaaaggaggcctacagttcccctaagatccaaaagagaaggtgaattcagaggaacagacttggaaccatttgccacctacacacacacacacacacacactctcwctctctctctctctctctctttccctccaaggctaaatcttgtaagttcagggttggttagttggtttgcttagagacagggtctcactgtgctacccaggttagaatgcagtggtgaactcatagctcactgtaacctcaaactcttgggctcaagcaatcctcctgcctcaacctcctgagtagttaggactacaggcatgtgccaccacgcccagctaattaaaaaaaatttttttatagagatggagtcttgttatgttgtcgaggctggtcttaaattcctggcttcaagcaatt

SEQ ID NO: 188175 - DNA, 601 bp, Human
agaggaccaggctagagttaggggagttgcatccaccccttagggccagagactgagtgtcctagactaagtgagccagatgcttcacatttcttctctctttgtctagttccctatctctcatgcactatcattcagacaagtcagaacactgccagcctgcctcagctgcactcaggggactcacagtaaggtcagggtccaaacttggatcaaggggttaaaggaggcctacagttcccctaagatccaaaagagaaggtgaattcagaggaacagacttggaaccatttgccacctacacacacacacacacacacactctctctctctctctctctctctctttccctccaaggctaaatcttgtaagttcagggttggttagttggtttgcttagagacagggtctcactgtgctacccaggttagaatgcagtggtgaactcatagctcactgtaacctcaaactcttgggctcaagcaatcctcctgcctcaacctcctgagtagttaggactacaggcatgtgccaccacgcccagctaattaaaaaaaatttttttatagagatggagtcttgttatgttgtcgaggctgg

SEQ ID NO: 188176 - DNA, 601 bp, Human
actgaaacattaccaaccctttcctcattaccgtgcagaactctcaaacccagtttcagcctcctgacaaaaccagctctgcaaagccaaaagacttgatccatggtttagaataccagtggctaacgaagtttcggtctaaaccagtctctgtcttttttattgagaaaaagccattcttgagctgcgagatataaaagctttgtggtctttagagaaacagaaggcaaaatggccacaggaacaatcacctgcaaagggggttggtggggtgggggttgcagcacagagctaagtgggrgtggggcgcttggtggctcaggctctaggagacagtgccatgctgtggccacctgccgcctctgcgccgccttctgcagcctctgcaggtacaggaggcctgtttcctgacccagttttctccccaatctctatttagctgttcgctagtgatgctcctggcatgccaatcagatactgcagccggcagtgcagtttgttacaacaaattcacagttcctagtaaattcagtggaaaagtactgtgtcaagcagcctaattaaactgacgtaatttccacagccatacacttctatcaaa

SEQ ID NO: 188177 - DNA, 601 bp, Human
tccctctttctttattttagtaaataccaactagatgcaaggcctaccagtctgcaaacagatataaccttccaagaccaaggaaattatttagaggcatttaaaaccaccttctctgacccaaaacacaatgcaatgcagtgcaagacagaaacttctgcttgagaactggatcagtcctggatgcctgattccctgggtcatcaaagcctaattctcacaggcagaagtttcacctatcctaatgggttcatctgtttttccaactttgctcaacccagagactacttgacatctgaawtatcaactgtcttccaaaacatgttggtcttgaaattggccctgaaagatcctacacaaatacttcatttgattagcaaactttagtacatctataagaatatgggtacacatttctgcatttcagttgtaacatcaatacttggtccaaagacaacattcctcatactggagactatccaaaatatccaggaaaatttattagggagattgcttttattccaccctctgtttctcttcaaaagcgaaagagatgctgtacagaatttaaatgttctaacaaacattgtctttaaagcaa

SEQ ID NO: 188178 - DNA, 601 bp, Human
ctggagcactctcatcaagctgaatcacagagaaccccaagcctcggtaactagaagaacagaagaacacccagaagaatggagggatttggggaaggtaggaggtgtcaggggagcagcacatgtacaaagaacataagtttacttttttagttaggtggaacatgggcagaaacgaggaattagtgcctggtggccctcaaggactgagaagccacttcagagacaaacaaacaaaaaatcattttgtacatgagcgcctgcaaggattagctgaacaagaagcatgcaggactagagatgccaacatgctgagctcatgagctttctagaagacaagggacaagggatatctgcctatctaccagacatcacctgccccaaggaaatgacttctaagctgtctttccttccttacactaacaaggcatgttattacaaaaggaggtcctaaactgttttatctgcaaagagaatccagagagttgatgccttttccaaattaagagttggctttcctcggaaggataaaatctggcattaggactcataatttattagctgggcagctttaggttggtcatttaaactctctaggtct

SEQ ID NO: 188179 - DNA, 601 bp, Human
ggaccaggaatggtggcagtcgtggtgaagaacactgaacatagatgtgaaataggcaattcacctgcacctaaaattcaagctgcacaaaacagaacacaccgtctacccccacctcatcccttcccacccccaaatctgtttcccttactgatcctcctatttctgttaggtgctgccatcaccatcattgtagttacctcagaatcacctcctcctcccactccccaagtgtggccaaccaccaaatcctgtaattctgccttcctggttctgctctcatgttgcccctcttttccayctctactgccactctactagttcaggccctcaaaacacctgtactggacaatggcaatagtttcttaagtgtttcctctctctgctgtttcttcttctctccaattcattggatgcccaaagtaacctttctagacttcagctcagactagcaactcctctgctcaaaacctgctaatggctcccctgagcctatagaacaaaccacgaatcctttagctagacgtttaagtgttcatcaatgaacaggttacagctcacttttacagcctacatcccaccacatcttccaccacaagaa

SEQ ID NO: 188180 - DNA, 601 bp, Human
gcccagactggtctcaaacccctgggctcaagcgatactcccacctcccaggctcccaaagtgttgagattacaggcatgagccactgcgcctagctgatttttatttctaaaaatcattctccactaaaaaattattcttggagaaatggctgattctaggactgaggcagggaaagtataagatgaacctgtaacatcttgtgtcagagagcaaaaaaaagtgctcaaaaaatgatgggggcatgtcaaatgacacagaagcaaacttgaaggggttcccactggctaaatataagacratttgagcatcaaaataaataatgatactcattggaatataagccagagactaaaacagaaatcttcctatgtgaagctcttacctagaggcatcttgtggtttaccaaggaatatggccctcaatttggcctaactaaacttctgatcaacaaattggataaagactgaaggtttgcttactaaacacacagaatttataatgctgggagagacagccagtaccttggatgagatgctctggactcaacgagatgaacaagtagaaacacataggttataatttaaaatgtgaattcct

SEQ ID NO: 188181 - DNA, 601 bp, Human
agggaaatgaattacaactgaaagagtgagatatagaaggaactctgtagtgctgcattataactaaagacgctggcgtgaactcattattttcaaggcagacagagaaacagaaatatatatagaaaagtagggctgtgtgtgtgtgtgtctgtatatgcacaaactcatgtttttctcacgttttctctcacatgttttctcagctttgtccactgagggagcctgtgagcagcaatctccaatgatacaagcacacccagacctgagattgatggactgattgattttttgtagagayggggtcttatgatgtggcccagactggtctcaaacccctgggctcaagcgatactcccacctcccaggctcccaaagtgttgagattacaggcatgagccactgcgcctagctgatttttatttctaaaaatcattctccactaaaaaattattcttggagaaatggctgattctaggactgaggcagggaaagtataagatgaacctgtaacatcttgtgtcagagagcaaaaaaaagtgctcaaaaaatgatgggggcatgtcaaatgacacagaagcaaacttgaaggggttcccac

SEQ ID NO: 188182 - DNA, 601 bp, Human
gggtcggtttcatacaggagaactgagcaagtaagtaaatgtattgaagataatgggagccaggtttctcatagtcagggaaatgaattacaactgaaagagtgagatatagaaggaactctgtagtgctgcattataactaaagacgctggcgtgaactcattattttcaaggcagacagagaaacagaaatatatatagaaaagtagggctgtgtgtgtgtgtgtctgtatatgcacaaactcatgtttttctcacgttttctctcacatgttttctcagctttgtccactgagggagsctgtgagcagcaatctccaatgatacaagcacacccagacctgagattgatggactgattgattttttgtagagacggggtcttatgatgtggcccagactggtctcaaacccctgggctcaagcgatactcccacctcccaggctcccaaagtgttgagattacaggcatgagccactgcgcctagctgatttttatttctaaaaatcattctccactaaaaaattattcttggagaaatggctgattctaggactgaggcagggaaagtataagatgaacctgtaacatcttgtgtca

SEQ ID NO: 188183 - DNA, 601 bp, Human
tagttaattcagacaagaatcatcaatgcatgttaaaactactgggcaaaagtctgaagaggaaaagggtattcacatagtcttaaagtatctcttcacagattacttcttaattacaaaggataaatggtagccttatagcagagaaaggaggcaagcaccaccttacacaagaaatgtaggttagaatcactaataatgtgccaaactgacatcaggtgcctcctcatatgatgcactaaagacagacacaacatcacttatttagtattcctgccaaaagtgtgtaagtgaaatccamtcatgaggaaaaatcagataaaaccaattgagggacattatatacaaaacaactgtcctgtactcttaaaaaatgtcaatgtcataagagataaagaaaagctattccagaataaaggaggcaaggggacatgacaactaaatgcaatatatgattctgaactggatgctagatcaaagtgaaaaattgtcataaaagacatcattgagacaactggaaaaatatacagaagctctgtagattagataagagtattctatcaacgttaaattgttttaaaaagagagaggacacaaatgt

SEQ ID NO: 188184 - DNA, 601 bp, Human
tgcagtcctgcttcctggggccaaacctaattggactatggatggacacctgtctcaatgtggattaatgcatagattgaccacagcctgtgaaacggcttagtgaaaattctgccttgaaacagttctagggagtgagtcctccagttggtagctggagcagtagctggaagaaatagacacaaggaaggttaagatgaggaggaggtacaagcagaggagtcagaagcagcaggaaggaacagtaaagtgaagctaagtcaccaggatgtgagttctaaaggaagaatcaatagatccyactgctgagggctcaagaaggtttaggcttttgagttgccttgggttctaaatgactttcccattgttcttttataaggcatttgcttcacctgttttcctcacttatgctaaagtacaatacagtcttcacaataataatctgctaatatctctggtccttgccaactaaaaaagcctaacacaacaatacatctggatttcagtaaaggcatgccaccaagttacttaagttactcagtacttgtactgagaacaaaatggaaccatgtgagttggacaatcaaactaaaagacaggc

SEQ ID NO: 188185 - DNA, 601 bp, Human
aaacccggtttccatccgtgtatctctggggtgacaaccagaatttccaaactattagaaacgcagtgcttggaagctgggcacgttttacaggcacactgcaatccagtgagccaccagagttccacctctaagctcagaaatggtcccaactggggaaggccatggcgacaccagagaggcagcacggctgtttgcttctggaagaacctagccttactaagatatctttaactctctctgtgggcttgaatttgtattttatttcatatatatgtgtatatgttatatatacattttwaaaaaaagcacattgtatgtatgcctgtgaaaaaaatgatcttgaactaggttctgctatcttccagagaagttggggtgagaagaagagagctaaagtttggttaagtgcctggatgtcaagcatgtgacattatagaatttcactttacctgcaatacctcccatcttcacagccactctgagaagtgggaatctgtctccctacatagcaggccagcaaacccgctcagagcagttaagtcactggtcccaggtctgctttggtccaaagcctgtaagctaactcactacacatact

SEQ ID NO: 188186 - DNA, 601 bp, Human
tctttactgctacatcatgttacttttgttattgttttaaagttattttattttacaaaatgcagagagagaaaagccctgcttctgactgctggggttcaccctggggctgtgactgtagagctgaccagccttgaggaccaggggcttccagaaacaagccattgacaaatgtcagtatcagacagcacattaatgaatgagacagtgatgaattgattttgtcaaaccaatgtagagcttgaagctcaaagttccccactgcttcttgctgtctgtgtgctggcatagaggtcaggasactgaacaccacaggctgcaaaatcccagtgttatactccctcagtgaaactgtatcaatgaccatttgcttcataatgctcctgtcagcatctacccactgctcagctgcaggcagctttctagaagatgctgttaacaatggcaatgcgcccaagagaaagagattcaggaccaggaagctagatgagtcccaggtcctcctctttctggctctgagacctaaagggcaaggtatttgatttgacctcttgggcctcagtgttctgaggtgtaaaaagtagataacagtgtcttccct

SEQ ID NO: 188187 - DNA, 601 bp, Human
tctttgctgttgcttctaggcagactcaggtgcacctgtccttatgcccttaaatgtacccccaccgtagcaaccatcttgttgccttttatcattgtttcctgtcctcttatgagactacatctattttgagaacatggttgagtctcattcacctctgtattgcacagatggattggacaaggcctgggattcagttaacatctgctaaatgagggaatgaatgaaagaacaaagtacataaaagaacaaatacctaatacataaaagacaatttttggctttctgaatccagagtttccaaccagtgggagatacttcttgcccttcagtctccatatgtcccaactgctagcaggaggaagtgactgggaatacaaaggcataaatggttccccaggactaattaagaggagctctaggctttagagaattatcctgtgacctttatcaggatactcactttagctcctggcaagaggaatgtttcaagtactctggaatgttaatactggaagggccctggagatcacctatgttatgagaagatggaggcttgggagggagaaataacttacttacctcaggtcccagggcaagt

SEQ ID NO: 188188 - DNA, 601 bp, Human
tgtcaattgactcacaataaactttcttttctcaaagccagtgtcacagcattcgcttctatgtgcgctgggcagcgagtccattgctcaggtaacactgctacttatctctacaacctgtttaacccatttaacttctgagtctgtttcgtctctacaaagcagatacaacaaatatactttgaggagttgtgtccactaacctaagacagactaggttctcaatcatgtcctttcaccattctctgtttcacctccctttccaagttgattcatctgtcacacattcatcagacattarggttgcttatacccttgggcaaagtttggctgctttatgttctcttctagtctagtctataactattttgtgccttttacatgtgggacacagcaccaggcactgaagggctagagttcagggaatgaaactgaaggcagggaaatccctctaaagcaggcaaaggcagtaggattgaggggaggagctcaaccccatgagaaacatggctttaagctggcaggaactcttcttcacctgcaacttgtctccctcttgctagcctcctgctaggactaacaggcagcttcttgtagcttc

SEQ ID NO: 188189 - DNA, 601 bp, Human
acagaagaaactagtaacaggcattacctgcacatgtggtagaagggttttggggagctagagagagggggatagcatggaagggagtttttcatcttaaatactgaaacaaaaagatgaagtactcctatctggtggctttaaaaacaggccagactgtcaccagtctgcaggaaggcagcatcggtccacaggctctgaaattagaggtgggggtaaaagacctaacacacaaattcttcctacttgtgtgacctgggtggagtaaactgctcaccttcagcttcattttcccgtaccyagaagatgggattaaccagagtaccagctcatcaatttgctgtgaggattaaatgggatgaggtaggtaaagcatttacattctgcctatctcattgtgcacagaaacatacaaatttgtatctgcctctaagctctctacaaggccctagggtttggagatatcaccactcagaggaatatccagtgccaaaaaaagagttatttctctattttcctattaaattcttacatgaaattgcttgatggtttcatgccaaggttagatgttctgccatacatattataaaggtacaatggt

SEQ ID NO: 188190 - DNA, 601 bp, Human
aatgagtatagtatgctaccatttatgtaaaaggaaggataaaaacatatcttagtattcacttacatatgtaaaaggacactagaaggatacagaagaaactagtaacaggcattacctgcacatgtggtagaagggttttggggagctagagagagggggatagcatggaagggagtttttcatcttaaatactgaaacaaaaagatgaagtactcctatctggtggctttaaaaacaggccagactgtcaccagtctgcaggaaggcagcatcggtccacaggctctgaaattagagrtgggggtaaaagacctaacacacaaattcttcctacttgtgtgacctgggtggagtaaactgctcaccttcagcttcattttcccgtacctagaagatgggattaaccagagtaccagctcatcaatttgctgtgaggattaaatgggatgaggtaggtaaagcatttacattctgcctatctcattgtgcacagaaacatacaaatttgtatctgcctctaagctctctacaaggccctagggtttggagatatcaccactcagaggaatatccagtgccaaaaaaagagttatttctc

SEQ ID NO: 188191 - DNA, 601 bp, Human
aaattgttgggaaaaatcaggcactgagaaatgagtatagtatgctaccatttatgtaaaaggaaggataaaaacatatcttagtattcacttacatatgtaaaaggacactagaaggatacagaagaaactagtaacaggcattacctgcacatgtggtagaagggttttggggagctagagagagggggatagcatggaagggagtttttcatcttaaatactgaaacaaaaagatgaagtactcctatctggtggctttaaaaacaggccagactgtcaccagtctgcaggaaggcascatcggtccacaggctctgaaattagaggtgggggtaaaagacctaacacacaaattcttcctacttgtgtgacctgggtggagtaaactgctcaccttcagcttcattttcccgtacctagaagatgggattaaccagagtaccagctcatcaatttgctgtgaggattaaatgggatgaggtaggtaaagcatttacattctgcctatctcattgtgcacagaaacatacaaatttgtatctgcctctaagctctctacaaggccctagggtttggagatatcaccactcagaggaat

SEQ ID NO: 188192 - DNA, 601 bp, Human
gcatgtaaaaaggtactccacatcattagttatgagagaaatgcaaattaaaatcagtgagattccacactgcacactcaacagaattgcctaaatctataagattgaaaatatctggcgagagtatagcacaaatggaactctcatattgctggtgggggtgtaaattggtgcaactactttaaacactgttgcgcagtatttactaatactaaatatgaactagaattcctagtcttaatcatgcacccaagagaaataaatgcacatatctatcaaaaggcgtgtataagaatgtacrtagcatccccaaactagaaacaacccaaatgttcaacagttaaatggttaaataagttgtggtatatttatacagtagaatattaccaagcattacaaaattactgctacacacaacatgaatgactcttacagacacaatgtgttgaacaaaagaagccaaacaccatccacgtgaagttcaaacaaaggcatctttggagacagaagtcagaagaatggttagctctgggggtgggttatagacagagatggagcatgaactagtcttccagggtgctggaaatgttctatatcttgc

SEQ ID NO: 188193 - DNA, 601 bp, Human
cctggctaacatggtgaaaccccgtctctactaaaaaatacaaaaaattagccgggtgtggtggcaggcgcctgtagtcccagctactcgggaggctgaggcaggagaatagcgtgaacccaggaggcggagcttgcagtgaactgagattgtgccactgcactccggcctgggtgacagagcgagactccatctcaaaaaaaaaaaaaaaaaaaagagtaagccactggctgggagaagatgtttgcaatatgcatattcaacaacggactggaatctacaagatataagggatgcctgmaaatcactaagagaaacatagacaaaacccaacttaaaacaatgggcaaagacttaaagtcttcggacttaagtctttgaatttgacaaaagaagccacccaaatggcctataagcatgtaaaaaggtactccacatcattagttatgagagaaatgcaaattaaaatcagtgagattccacactgcacactcaacagaattgcctaaatctataagattgaaaatatctggcgagagtatagcacaaatggaactctcatattgctggtgggggtgtaaattggtgcaactactttaaa

SEQ ID NO: 188194 - DNA, 601 bp, Human
agtaagccacacgaggtcaggagatagagaccaacctggctaacatggtgaaaccccgtctctactaaaaaatacaaaaaattagccgggtgtggtggcaggcgcctgtagtcccagctactcgggaggctgaggcaggagaatagcgtgaacccaggaggcggagcttgcagtgaactgagattgtgccactgcactccggcctgggtgacagagcgagactccatctcaaaaaaaaaaaaaaaaaaaagagtaagccactggctgggagaagatgtttgcaatatgcatattcaacaamggactggaatctacaagatataagggatgcctgcaaatcactaagagaaacatagacaaaacccaacttaaaacaatgggcaaagacttaaagtcttcggacttaagtctttgaatttgacaaaagaagccacccaaatggcctataagcatgtaaaaaggtactccacatcattagttatgagagaaatgcaaattaaaatcagtgagattccacactgcacactcaacagaattgcctaaatctataagattgaaaatatctggcgagagtatagcacaaatggaactctcatattgc

SEQ ID NO: 188195 - DNA, 601 bp, Human
gatcagcctgccttgacttcccaaagtgctgggattacaggtgtgagcgactgaccctggccacgtatcccgatttttaggcaatgcatgaccatactagaataaaatataaagaaagaccattatactctggaggagagaaggattccctgactcaaaatccaaaagccatacaggaaaagactgatacatttaatctatagtaaaataaaaggttgcatgacaaaatattacagacaaaataaacaaaaacatcaaaaacagaagataaaaagctgggaaaatacatttgcaattcaamtcacagaacaatgcctaatctccctaatatgtaaagaacacctagacatttattagaaaaagactgacaatataaaaggctgtcttagtccttctgggctgctataacaaaataccttagaccggaaaatgtataaataatacaagttctggaggctgggaagtccaagatcaaggtaccagctgatctgatggtatatagtgagggcctattccttttagatggcaccttttaaatgtcctcacatggcaaaaggggtgaacaagctcccttggacctcttttataagggtactaacac

SEQ ID NO: 188196 - DNA, 601 bp, Human
ctatcatgagaacagcatgagaaagacctgctcccatgattcaattacctcccacaaggtcactccccacaacacatgggaattcaatatgagatttgggtagggacacagccaaaccatatcagccatgttgaccaggctggtctcaaactcctggccttaagtgatcagcctgccttgacttcccaaagtgctgggattacaggtgtgagcgactgaccctggccacgtatcccgatttttaggcaatgcatgaccatactagaataaaatataaagaaagaccattatactctggagkagagaaggattccctgactcaaaatccaaaagccatacaggaaaagactgatacatttaatctatagtaaaataaaaggttgcatgacaaaatattacagacaaaataaacaaaaacatcaaaaacagaagataaaaagctgggaaaatacatttgcaattcaaatcacagaacaatgcctaatctccctaatatgtaaagaacacctagacatttattagaaaaagactgacaatataaaaggctgtcttagtccttctgggctgctataacaaaataccttagaccggaaaatgtata

SEQ ID NO: 188197 - DNA, 601 bp, Human
gatcaaagtcactcaacaagtctctagggggctccaaactttcccacattttcctgtcttcttctgatccctccagactgttccaacctctgtctgttacccagttccaaagtcgcacccacattttcgggtatcttttcagcagcaccctactcctggtatcaatttactgtattagtccattttcatgctgctaataaagacatacctgagactgggcaatttacgaaataaagagatttaatggacttacagttccacatggcaggggaggcctcacaatcatggcagaaagcaaggmggagaaagtcacatcttacatggatggtggcaggcaaagagagagcttgtgcagggaaactcccctttttaaaaccatcagatctcgtgagacttattcactatcatgagaacagcatgagaaagacctgctcccatgattcaattacctcccacaaggtcactccccacaacacatgggaattcaatatgagatttgggtagggacacagccaaaccatatcagccatgttgaccaggctggtctcaaactcctggccttaagtgatcagcctgccttgacttcccaaagtgctgggat

SEQ ID NO: 188198 - DNA, 601 bp, Human
ttttgatcaaagtcactcaacaagtctctagggggctccaaactttcccacattttcctgtcttcttctgatccctccagactgttccaacctctgtctgttacccagttccaaagtcgcacccacattttcgggtatcttttcagcagcaccctactcctggtatcaatttactgtattagtccattttcatgctgctaataaagacatacctgagactgggcaatttacgaaataaagagatttaatggacttacagttccacatggcaggggaggcctcacaatcatggcagaaagcmaggaggagaaagtcacatcttacatggatggtggcaggcaaagagagagcttgtgcagggaaactcccctttttaaaaccatcagatctcgtgagacttattcactatcatgagaacagcatgagaaagacctgctcccatgattcaattacctcccacaaggtcactccccacaacacatgggaattcaatatgagatttgggtagggacacagccaaaccatatcagccatgttgaccaggctggtctcaaactcctggccttaagtgatcagcctgccttgacttcccaaagtgctg

SEQ ID NO: 188199 - DNA, 601 bp, Human
aattttctgaaactttatgctctgtttcccttttaaaactgaacgcctttaacagtgcccaagtcacctgttgaatgctttgctgcttagaaatttcttccaccacataccctaaatcatttctctcaagttcaaagttccacaaatctctagggcagaggcaaaatgccaccagtctctttgttaaaacacaacaaggatcacctttactccagttcccaacaagttcctcatctccatcttagaccacctgagtctggattccattgtccatatcattatcagtattttgatcaaagtyactcaacaagtctctagggggctccaaactttcccacattttcctgtcttcttctgatccctccagactgttccaacctctgtctgttacccagttccaaagtcgcacccacattttcgggtatcttttcagcagcaccctactcctggtatcaatttactgtattagtccattttcatgctgctaataaagacatacctgagactgggcaatttacgaaataaagagatttaatggacttacagttccacatggcaggggaggcctcacaatcatggcagaaagcaaggaggagaaagt

SEQ ID NO: 188200 - DNA, 601 bp, Human
taaaatggccagcatgaaagagtaatttagcaagtatgggagcctcctcaacagcctggcaccctcacctgtggtgtcatatagaatgactcctgtggagtgatataaatgtcgcttctttaggaacagtgaaaaatccaccttgattgagaggtaaaaagttacatcttgggatttgaagctatgccttgaaaatgtatgacttaacagaaatgtgacttgagcaataagcaagattctgtaaaaaaaacactctgtatttattgtgaaacatctttcttaaatgtaaaaggtttatcaygtttctggcctgttggagaggaaaatatggtgccccaagcggccaggtgtggtagtggcaacgaatatatcagttccagggctgagaaaggcaagatctgggacagagcactggtaaccaagagagctaaaaaactgttgctctgcctttagctgctgtctccctgtctggcaaacagctcaggcaaccacttgagaaagccccttgagaaccaggcaccatctccttctgaatagcacaagctaaacttgagtgctagtcccagctctgctactgaccagctgtgcaattttgggtaat

SEQ ID NO: 188201 - DNA, 601 bp, Human
gtaagaatgaaaagagttggtgagtcaaagagcctgatacactatgaagcagtgagcacacatgaggacctactgacacatgcatgcgtgccgcaagggctacactgtggagcttcctaagtcagctgtttggcttggttgtcatgggaagagaaaagggctggctttggcctaggcctggagttgccaactagaatggggcagaatctggataaaggagtctgatggggattctagagccacagtcagactgtaaatcatgacatcccctatccaataggttggtagcatcttgtctcgytaaaaagcaaaaacttaccaaattaatatcttacaaagccacaagattgaaaccactgccattcctcccaggtttctctgttgaacagtactagcttctaaaaatagatcaaatcaagtcatttctctgctttaaaacctttcctgcacctttaccccacaggatgaagttctagttccttagcctgacattaaagcttttacgatctgaacgtagccatcactgtagccttgtctcccactgctctgctcccctccagaggccctcatttcccccagtttgccatgccttctccatact

SEQ ID NO: 188202 - DNA, 601 bp, Human
gagaacttcagagttactgtaagaatgaaaagagttggtgagtcaaagagcctgatacactatgaagcagtgagcacacatgaggacctactgacacatgcatgcgtgccgcaagggctacactgtggagcttcctaagtcagctgtttggcttggttgtcatgggaagagaaaagggctggctttggcctaggcctggagttgccaactagaatggggcagaatctggataaaggagtctgatggggattctagagccacagtcagactgtaaatcatgacatcccctatccaataggtyggtagcatcttgtctcgttaaaaagcaaaaacttaccaaattaatatcttacaaagccacaagattgaaaccactgccattcctcccaggtttctctgttgaacagtactagcttctaaaaatagatcaaatcaagtcatttctctgctttaaaacctttcctgcacctttaccccacaggatgaagttctagttccttagcctgacattaaagcttttacgatctgaacgtagccatcactgtagccttgtctcccactgctctgctcccctccagaggccctcatttcccccagtttg

SEQ ID NO: 188203 - DNA, 601 bp, Human
attagtaattggtatatagaaagtcagttaaaggaaggggaaaataaacaggcaagtttaactccaggaaaagaaaagtatagcataggaaccatatcatgatatattacttggcttagcagtgagaacagtatttacactactcataataatagactaatgacttaactacacgtgaggatggagggaagggaaatgaaggtggtggtataagataattaaatttttatttataagaaagcaacagataaaatttattttaaaattgatatcttaaatagacatttagtttagaaatatrgagatagacaccccaaaataattcaaaatggttggctccggaaattggacaaaagagtgggaaaaggtgaggcagaaattgccattactaagccttttagtatttagaaaatttttaaactatgtacatacactattttgtaataaacaaaaggtaatctaatttaagagtgcatgctccagaatcagataacctagctcaaatcctggtttcatcaaatatgagtttaagatcttaataggtttagcttttctgagcctcattttcctcatctgtagaacagggttatatgttaagaat

SEQ ID NO: 188204 - DNA, 601 bp, Human
taaataccagaacaatgaataaagaagatacatatcaaggcatgtcatcataaaatttcaaaacactgaagtaaagagaagttcctaagaatttcaaggaaaaaaaaatggcaacgtacaaagaaacaggaattagaaaaagcagcagacttctcaatagtaacattagatgctagaggacaatgggaaatgcatgcaaaagtcagaatgaaaaaaattgccaacctagatttctacaaacagtgaaagtgtcaatcaaatgtgaaaatagagtaagtatattttcagaatttcaaagaaycaaaaaatttatcttcaactcctcttttccgggaaaggtactgagtcctgtgccccaccaaaatgagactaatctaaagaagaaggaagatagggaacagggatttaacacagggaaatggtatagagaagtcatcacgtaaccacggtgcaggcctagagtaaccatttcagagtggaacagaaaggctgaaccccagagtggcatgtggtgaaagtgggggtggggagactgctgaaagagttgacgtctttgaccatgttgcaaagcgtgtaagaggtgttttatagatgttttgga

SEQ ID NO: 188205 - DNA, 601 bp, Human
atttttcccccttcttgctatgtaatgccatttggtgaaaacttcttcaagtaagttcccagctgatcttagtaaatttccttcacaagaagtattcatctcagaggtgctgcccgaataaaatgaacagactcacaaaactcacaaatacaaaggccacggtgccaaggcttcagctttgagtggcttcccttctgtcatactgtgcagtcacacaacttccagcctgcctcacattctcagggccactgtgggaccactttctctatccttgtcagctgtggcctacaaagagcagtakgaacttccattaatcgggatagattgagcccacacctttatctctatttccttccaaaaccctcttaagccaactgtaaaggaacaaagaaagtatgaatccaccaagaaaagaggaatagaagaagaaacaagatagttcaacacatttcagatgaataccacagatgaaggaggtaactgattatgcagagtggaggaggctgaaaccctgtgcctgctgcagggaacagtgagaaggaaacaaattttgtcttggaagacaatgaaaagcctcaggactgagaagcaccaagtgtct

SEQ ID NO: 188206 - DNA, 601 bp, Human
agctcacctctaaagttgccgacgttctatctccagaggggtgtaatgtgccagctgaagttaggacttgtgggtgaccgttccggacatagcccataacttgctgtgtgacttagggcaaatcatttccaaacttaggccttaatttcctcttctgtaaagattaggctgtttctaaagtcccctccaccatgaaagtctgtggttctatgaccccagggttcttcttacattagatcagctaagattttgcttctccccgctctgaaaagcagtccctcccagactagaagcatatacrtcttctttggctaccctcgccatttggcaaaattaaaattttaaaaagcatctgtctaagagctccccatatttttcccccttcttgctatgtaatgccatttggtgaaaacttcttcaagtaagttcccagctgatcttagtaaatttccttcacaagaagtattcatctcagaggtgctgcccgaataaaatgaacagactcacaaaactcacaaatacaaaggccacggtgccaaggcttcagctttgagtggcttcccttctgtcatactgtgcagtcacacaacttccagcctgc

SEQ ID NO: 188207 - DNA, 601 bp, Human
atttgcatctccttctgggtctgtttctctagttgaacctggactgacacactctgtctttgaaactaaaactaaattcttattttagtagaataacattttgtttctcacctttgacaggtaaaaattgataactggatcatgctaagttctggcaaggatgtggagctatagaaatctgcatttactgcttctgtcaagcatcaggcactaagctcagtcctttatatatattatcccgtctaactgtcatagttgctctgagcattttcattctttatctacatagggaaactgaggytcaaggaggttataattcactcaacgttgcattgctaggaaggagcagagctgagtttctttcatggacttagtgtccctctcaaaatcacgtcaacttcatttgaaaattataatgaaactattaaaactataatattcttactttttatacaaaattattatctttcttttccaaccatacttgtacttgttacaacctcagaaggcctatataaagtaaagcgggggagtaggagagccagagtattatctttattttatagatgtgctattggagcccttggagggcgagtaaatt

SEQ ID NO: 188208 - DNA, 601 bp, Human
cagggtaactctcagcatttacataaacactttcctagcaatttattcatctgatcctcataataccctggtagatgttagtatctccattttacagatgaagaatgtgagggttagatctgaggtccaaggtcagaccgtgggtaggataagaacccaggtctcctaattctcgctcagtgcttcccataagccactcacccaataaagtgaagacagaaatccatgagaactatcagagaaagaactctgtagtcttgcccctctgcatgacaggaccagggaggggaaagtggctgcracagtatcagagagtagtagcacggagtctggaactgtgggctcaggaacatttttcaagtcccaccttagatatatactactacataattgtgtgaccctaggcaactcatttaatctctgccctgatttcctcacttgtaaaacatagcaaacaatagtacccacttcatatggtggttgtgatgactaaatagaaaaaaaaataccatacatgaacagtgcttggcgccaaggcaaacaatcagtaagtgttagctgtcactgttttcatcattatcatcatgaacgtgcccaacac

SEQ ID NO: 188209 - DNA, 601 bp, Human
cctcgatgtccttttacataaaatagggatgatacctaccttagataaattagctaacctccctagggcagtatttcctctgctgtgaaactgtcacaattactatgtatatatctgtaccgtgtgctggccctgtgctgagggctttgcatgtattctttcactcctccttacagtcctgtgagacgggtgctattatctccagctgacagaagaggaaacctatgctcagaggagttcaataatttgtaccaggtcatataactgttaagttacagagttaggattcaaaccttggtcsccttgatttgaaatgcagtgcccttaaccttgaaaccacattcctacttaccagagagctgttgcaaggaagaaatgaagaaacattaattattatgtgtctcctgtgtatctagtagtttgcatccctcttctgtaagacacatgagtacaaggatgctctatagagcccccgcacatgaggctgctctgtgactgtggggccctgtgtggggatatgtgcattttgagaaggcaagggacagacaggacctggtagaaaagtatttactgctgtgctccccaaagtcatgaagtcagc

SEQ ID NO: 188210 - DNA, 601 bp, Human
ataatagatgagcctcctagtatgttagaggtgtttcctgaagggattctaatctcctgaggaagactagggcccaagaccttaagcaaacccaggcaagagcctctgtgtcttagatgtgtgtgtgtattaccccctagtggctccacagtaatgattacaactgcagtcatgtgaggatgtcagatctgcacctcacctccacactggctgtgcgagaagtgagcaagcctcctggtgacaggggaggctgttcctttatcaggcagcaccgctgcagcccctgacctactttcttacyaaaaatagctcttcttaggtcactgccgcaaattgaattccactgcttcactgcaccctgtaagcaggtgggtgggcgccagagcacatttggtgagctgcaagcctctgcttatgtggtgcattgctgcccaaggatgctaattccacatgcctgagcagacggcagaacgtgtctgcactcagcagggctgtacgtgaccctgctggggttcctttatttggggggaagggggacagggaggggcagtgagggaaattctagatccagttttgaagtctgacagaactgaattgaaac

SEQ ID NO: 188211 - DNA, 601 bp, Human
tggagatgtcctgcccactgaaaaaatgatgggcctcctgttgccagcttctttgcagtgatctcaatccctttgcctcacaagagcatcagaaaggtcccctgcccttccagctttagattcctttcattggctacatgtagaagacagacatgggccaggggtatagagaggctctacgccagaggtgtccaatcttttggcgtccctgggccacactggaagaagaattgggccacacaaaaagtacactaacaacagctaatgagcttaaaaaaaaacaaaacaaaacaaacaaaamaaaaaaaacagaacaaaaaacccctgttttaagaaagtttacaaatttgtgttgggctgcattcaaagctgtcctgggccacatgcagctcgctgcccgtgggttagcaaggctgctctaagacaatgagtgtaggtaggcccttctataggtcctctgagttcatggagcaacttctcagcagccatctccaccaggttcccttcttctgttgtttcactgtggtttgcctctgtaactgcttgttcgagaactctgtcagcaaactctacatgctctgcttcaacttcttcatgtcca

SEQ ID NO: 188212 - DNA, 601 bp, Human
catatagtagatatatattaatagcaaatatcttaataaataaaagcacacatgtcaaacacaaatatctcaatcacagatttggaaaaacatctcaaacaacatgcatcaatatctaaattgtttcccctaaagcagcagagtctctccccagactgttcctgttccttcttaggctgaattctcccttttcaggatactctggtaaggaaatagaaccacaagggtgggaagcaaaccatgagtcctcaggccagctaccaaacaaggctgacccccagagaggctggatctgggtcasatttctcggggcatcctaaggccattgtggcctacccttggtggccatgggcatggaatatccatacccagatgtctaaaaggcacctctagtgcagtgtgttcaaattcagatcagatcttcctctccaaacctgttcaccttctactgtttatttttagcttagcgaatggcagggccattcccacttatgcacccagaaacctggggcttatgcttcacatctttcttttcctcacagctacattcaatccatcatcaagtcctgctaattttacctgctaaatatctcaaaccatg

SEQ ID NO: 188213 - DNA, 601 bp, Human
caacactagaagtcagaagacctgggtgccatatgtggcctctcatgaagcacaacataacaacacgaaagagtccaggtaaaatgtcaaagtaagggaagcaacctgtttttgccttagagaaagctaggaaagaagaaagccctgtggctagagaggccagggtaggctttagcggtccagaacacagccctggggcaaatgtcaggggtgcagcatgccagggaaggatgatgtttcctgaactggcataaaactaaacaggcggtatctgacagagagacttgaagtggcctctggrcagtagggaagagtgtgatagagagagctatggagaggacttaagcatgaccttagcttccaaatgtatttagtggggtgcagtagaaagaccactagattagaagtcagaggaggaactagggaaaggaaacaagtattgactgagcacctcctctattccaggctctgtgctgggcagtttacacacattatctcattcagcccttatcatcaccctcccagggagatattaatattcttattttatagagaaactggggctcagacagggaaagctactttagcactctgaatttca

SEQ ID NO: 188214 - DNA, 601 bp, Human
ccatcattaactagttgtctgaccttgggttagcaacttccccttttgggattctgtcattatgtgtgagatggcgatatggtttggctgtgtccccatccaactctcatcttgaattcccatacgttgtgggagggacctggtgggaggtaactgaatcatgggggcaaatcattctcgtgctgttgtcatgatagtcaataagtctcatgagatctgatggttttaaaaagaggcattcccctgcacaagctctctcattttttgcctgcaaccatgcacataacatgtgagttgctcmtccttgccttccgccatgattgtgaggcctccccagccacgtggaactgtaagtccaatttaacctctttctttggtaaactgctcagtttcaggtatgtgtttattagcagtgtgaaaatggactaatacagtaaactggtaccagtagagtgggctgctgctgaagatacccgaaaaagtggaagtgactttggaactgggtatcaggcagaggttggaacagtttggagggctcagaagaagacaggaaaatgtggggaaagtttggaactccctagagacttcttggagacttgct

SEQ ID NO: 188215 - DNA, 601 bp, Human
aagcctcattaatctccccagagcataggtttcatcacagagtgtaaaaagtccactatatctgaagctagaagatctggttctggccccagctccagcaccatcattaactagttgtctgaccttgggttagcaacttccccttttgggattctgtcattatgtgtgagatggcgatatggtttggctgtgtccccatccaactctcatcttgaattcccatacgttgtgggagggacctggtgggaggtaactgaatcatgggggcaaatcattctcgtgctgttgtcatgatagtcartaagtctcatgagatctgatggttttaaaaagaggcattcccctgcacaagctctctcattttttgcctgcaaccatgcacataacatgtgagttgctcatccttgccttccgccatgattgtgaggcctccccagccacgtggaactgtaagtccaatttaacctctttctttggtaaactgctcagtttcaggtatgtgtttattagcagtgtgaaaatggactaatacagtaaactggtaccagtagagtgggctgctgctgaagatacccgaaaaagtggaagtgactttggaact

SEQ ID NO: 188216 - DNA, 601 bp, Human
ggtaagtttccctcttgtctgtcttccacatccaagtcctgctgactggacctctatgttctctcccatcagccccttcttcatcagcccacttccaaagccctaattaaagaccttgtgcattacctttcatctgaactgtaaaaacatctcaaggctctccctgactcttgcctctccttcaaactacctcccctagaaagcctcattaatctccccagagcataggtttcatcacagagtgtaaaaagtccactatatctgaagctagaagatctggttctggccccagctccagcamcatcattaactagttgtctgaccttgggttagcaacttccccttttgggattctgtcattatgtgtgagatggcgatatggtttggctgtgtccccatccaactctcatcttgaattcccatacgttgtgggagggacctggtgggaggtaactgaatcatgggggcaaatcattctcgtgctgttgtcatgatagtcaataagtctcatgagatctgatggttttaaaaagaggcattcccctgcacaagctctctcattttttgcctgcaaccatgcacataacatgtgagttgctca

SEQ ID NO: 188217 - DNA, 601 bp, Human
ttcaaacctagagtcacaggatgggaggcaagtcacatgtatggcactttcatggggcctggtggcaaagccaaaaccagggacacactcagacaatgagggcagttccaagagcccatgagtaaaatcatgaagccagaatagtagctggcaaatggatcccatttctgaggacttaagagctggaaggccaggttctggaaaagaattaggccttctagggaagaggaacaacaacaacaattgcaaagaggctcatttggggaaatactggaagtgtttgatgtatttatcttggctstataccctttcttttccactttgagatagcctaccaaatggacaattcagtaaagaacaataactgaagacagggtaagtttccctcttgtctgtcttccacatccaagtcctgctgactggacctctatgttctctcccatcagccccttcttcatcagcccacttccaaagccctaattaaagaccttgtgcattacctttcatctgaactgtaaaaacatctcaaggctctccctgactcttgcctctccttcaaactacctcccctagaaagcctcattaatctccccagagcata

SEQ ID NO: 188218 - DNA, 601 bp, Human
agagagagagagagagagagagggaaagagggagggagagggagggagagagagagagagagagagagagagagagagagagagcacatgtacatgcaagagtaagtcaggatgaaccgactccctccataacagcattagtccattcataagggcagacctaaacacctcttacacgtcccacctcttaatgctgttataatgaccaagttttaacatgaattttggaggggacaaacattcaaaccgtatcacttagtaagcatacattttctaagtgtgagtactcagaccatttacyggttttcagtgtatttcagtctaagaaatatttcaaattttctttatctcaagactgtaaacttaataatatgtgataagtaaatatgtataaacttttagcatcttcccaaagtacttttctattttcacggtaaactgaatatataattttcctattttaaaacaaggaaactgaggtccaggaaaaaaaactatctaaggcagaatcaaactttaggtaaataaaaatcacttggtgcacttgtcaaaactacaagttcctgtcacctacctccagagattctgattcagcaggatg

SEQ ID NO: 188219 - DNA, 601 bp, Human
cgttttaccttaaaacacaaagaagaccatgaattaacccttgattctttatgggtaagcaaaatagtgattatttatctagtaaaataacaggagctggggtaaaccagttgtcaccaatcctctccccacaccacccaaaaaaaaatccaacaactactaaccaacaaactgcaacactcctcctatcagctgtgaaaaagtaaacctacaaacaaaatccctaatagagcttaaaactatttcagatgaaaacttttaggggtgacaatgtaaactaccctgatcctcaaaaaagcaytgttttaagaccaagtgtttatgactaaacctaagtgttggttttgagtataaaagcagatttgggtaggttgaaaaagaaaacaaaaaacacataaacattgagttcctgagattagtttgatggaggaggagaggaaattgatgacagaatttaatggaatggaagaaggaagccagtgacaaggactgtaaaaagggctttcctccttcttggaacaatcctatactccaaggccaactccttggtgacacctttcctgacaggctcagatagaggtgatttctgctctggttgcca

SEQ ID NO: 188220 - DNA, 601 bp, Human
tgaatgtcctggaaagtaccattttctgatcaaatcctagtcaacgttcctctaaattctatgtgcagttcattagctcttagatactcattgaataaagccagagagttccatggtttgcacacatgcttttggtttcctactttagagcttatggaagactgtgagagatcacttcactcacagagagaatggggactggtaaatacagaaagctctgaagcttggacattaggtgtatgattttaagaataagaaacagcaagatggtatgaccctagaaaagggccagggtatacaraaagatgaaacatcaagatgaagtcagtacacctcactcacagggttcctttcttggtgtatcacaacaggcagcatcttataagagaaagagtatgggtttgaatcccagctctgctactctataacttactagctctgtaattttgggggctttagcagcccagagactcagtttcctcagataagatgaaaatggtgtctacctatcatgggaattaactaccaaaacatatatgtaatctctgccatagtgcaattatggtaacaaaagcctacatataagggcctgatctgtgcc

SEQ ID NO: 188221 - DNA, 601 bp, Human
aggcctctctttgtcctttctcccttctatctggctgaatattgctagcaaccatcttggaccttgagaaaatcttgaagacaaaggcctatgttaaggatagtgaaacagagagatagaaataattagggcccttgatatctgtagaactattatagcaatcttgtggggggatatcatcagacctgtcatgcgtgaatgtattagtctgcttgggctgccataacaaaaaataccacagactgggtagctgaaacaacagaaattaattttctcacagttctagaagctagacgtctayaatcaaggtgccatcagagttggtttctagcaagtctctccctggcctgcagatggctgccttcttgctgtgtcctcacatggcctttcctctgcatgtaaagggagagcaattcctagtgtctcttctgcatctcataatgatatgtcatattagattagggctccatccttaagacctcacttaaccttcattacctccttaaataccttatctccaaatacagtcacattgggggttagggatttaatctacgaattttggggagaaacaattcagtccataacagtgagagaaaat

SEQ ID NO: 188222 - DNA, 601 bp, Human
aggccgaggcgggcggatcacgacatcaggagattgagaccatcctggctaacacggtgaaaccccgtctctactaaaaatacaaaaaattagccgggcatggtggcgggcgcctgtagtcctagctactcaggaggctgaggcaggagaatggcgtgaacccaggaggcggagcttgcagtgagccaagatcgcaccactgcactccagcctgggtgacagagcgagacaccgtctcaaaaaaaaaaaaaggcctctctttgtcctttctcccttctatctggctgaatattgctagcarccatcttggaccttgagaaaatcttgaagacaaaggcctatgttaaggatagtgaaacagagagatagaaataattagggcccttgatatctgtagaactattatagcaatcttgtggggggatatcatcagacctgtcatgcgtgaatgtattagtctgcttgggctgccataacaaaaaataccacagactgggtagctgaaacaacagaaattaattttctcacagttctagaagctagacgtctacaatcaaggtgccatcagagttggtttctagcaagtctctccctggcctgc

SEQ ID NO: 188223 - DNA, 601 bp, Human
cttaaaagggcctctttttggccgggcgcggtggctcatgcctgtaatcccagcactttgggaggccgaggcgggcggatcacgacatcaggagattgagaccatcctggctaacacggtgaaaccccgtctctactaaaaatacaaaaaattagccgggcatggtggcgggcgcctgtagtcctagctactcaggaggctgaggcaggagaatggcgtgaacccaggaggcggagcttgcagtgagccaagatcgcaccactgcactccagcctgggtgacagagcgagacaccgtctcaaaaaaaaaaaaaggcctctctttgtcctttctcccttctatctggctgaatattgctagcaaccatcttggaccttgagaaaatcttgaagacaaaggcctatgttaaggatagtgaaacagagagatagaaataattagggcccttgatatctgtagaactattatagcaatcttgtggggggatatcatcagacctgtcatgcgtgaatgtattagtctgcttgggctgccataacaaaaaataccacagactgggtagctgaaacaacagaaattaattttctcacagttctagaag

SEQ ID NO: 188224 - DNA, 601 bp, Human
agacttcaaattttattcaggataaacatatgcccagctaaaagtctcacttcccagccctcataacaggtttggctatgtaactaggctctggccagtttttagttgacattgcttggtaccacttcagggaaagtgccttaaaagggcctctttttggccgggcgcggtggctcatgcctgtaatcccagcactttgggaggccgaggcgggcggatcacgacatcaggagattgagaccatcctggctaacacggtgaaaccccgtctctactaaaaatacaaaaaattagccgggcrtggtggcgggcgcctgtagtcctagctactcaggaggctgaggcaggagaatggcgtgaacccaggaggcggagcttgcagtgagccaagatcgcaccactgcactccagcctgggtgacagagcgagacaccgtctcaaaaaaaaaaaaaggcctctctttgtcctttctcccttctatctggctgaatattgctagcaaccatcttggaccttgagaaaatcttgaagacaaaggcctatgttaaggatagtgaaacagagagatagaaataattagggcccttgatatctgtagaac

SEQ ID NO: 188225 - DNA, 601 bp, Human
gagtagtgccctacagtcaagcacggggcttggactaatctgtaggtgagagccatctcctctcatcaccttgcttagggcactcagggtactgctcaggtgctgagaagtgggactgttttatgagtgagatgctgacttccagcttcctttattccccacaattctcctgctctttgaggcatagattgctggttacctacttattatccattctcctcttctttcctggtaacagacttcaaattttattcaggataaacatatgcccagctaaaagtctcacttcccagccctcatracaggtttggctatgtaactaggctctggccagtttttagttgacattgcttggtaccacttcagggaaagtgccttaaaagggcctctttttggccgggcgcggtggctcatgcctgtaatcccagcactttgggaggccgaggcgggcggatcacgacatcaggagattgagaccatcctggctaacacggtgaaaccccgtctctactaaaaatacaaaaaattagccgggcatggtggcgggcgcctgtagtcctagctactcaggaggctgaggcaggagaatggcgtgaaccca

SEQ ID NO: 188226 - DNA, 601 bp, Human
tataagagcaagctatcaagagaggtgaaggggaagttacccacacagaaattctggatgaaaaagaactccaaatggggacagggcagggttttgctaggtaccagcaactgcagcctttggggaaacctctggagcggctccctgtgtggagtttcagagaggcaggagtggaatctgcatttgaacaataacgtgtgaagcacccaaagccatcccaagggccaaggctcactgattccaaagtgccatcaggcacactgtctcactgaagtttttttcctatcctgcagtgaaggtrcgtcacccccattttacatcgaagaaccgagcctagaggggtcaagtgacttgcccaagtcataccatcagtgaggaggagcacagagatttcatttaataaactcttaattttagaatagctttaggtttacagaaaagttttaaagatagtactaagttcccaaatatccctcccccagtttcccccattgtcaacatcttatattactgtggtacatctgttacaactaagggaccagcactggtacattactattagccaaacgtcatattgtatttagattttgctagtttctcc

SEQ ID NO: 188227 - DNA, 601 bp, Human
ctcttctctgcatgcctttccttatcacatagattaatctctctatattaattccgtgccaagtacattgctgtaatacagcagttcttacattgcactctaatcatgtgtatatgtgtccatctcactcaaaagagaagagcttctcagagggcaagagagtaatgtgatttactgcttctaagtcctcagcatccacaacataggacacagctacatacacgtagagcttccccctccttccacatatttcagcactgaaagggcaattctccccaaaaaaggggtaaatcttaccagyctgaggcccagaaataagcctacaggatccaaagagtccatgagccccttctagacctatttccaaactccctctaaacagaagccatagacagaaccttatgactgcagaatcctgggaatggtattgtttaattaaacagagactcaagtcaccagcatctggctcaggctgggcctctgggacttgagcaagcaacatttcatcattaggaggaaaggagatgacaaactctttcctgaaagaacccagcaggcaggcagcagaattactggatgtggataaataaaaccattattt

SEQ ID NO: 188228 - DNA, 601 bp, Human
aggaatgcctggaaacaccagaagatggaagagtcaagagaactgtctctcctagagcctccagagggagcatggccctgctgacaccttgattttggacatctggcctccagaagtgagagcataaatatgagagaataaattcctatcataaaccacacagattgtggtactttattatgggagactaataatttttaggttacgaatactaataattattcatattattatgctaatacacactgcctatctccttaacttatcatgtatcacccctcatctccctcatacaaactaygttacaagaatgcaagctttgggagaatggaaccttatctaacttggtcattatcaaaaccctaatgattagcatggcaccaggtagacggtaggtgctccatacatttttttaaataaatgaattaattgcagttcctcaaacataatatgctatgtcatgcctccatgtctttgcatatgctattccctctgcctagaatgccctcctcattcccttacaaacacctataaaattatccttcaaaactctactgagatatcacctcttctctgcatgcctttccttatcacatagatt

SEQ ID NO: 188229 - DNA, 601 bp, Human
atgtatcaccctaggtctgtgaggaagtggaatttctcttaagaactctgggacagaattcctggccaaagcaaataatgttgctgattcctctgagttctccttctccttggggatgcagttaacaccaaagggaactaggagtatgaacaattttgctcattcaagcaggatgacctgcttttacaaaacatagtcttcaggatggctaggtgcgctcaggcctataatcctagtgctttgggaggctgaggtgggaggatcgcttgagcccaggagtttgagaccagcctggactacrcagcaagaccttgtctctacaaagataaaaaattaaaaaattagccaggtgtggtggcatgagcctgtagttctagctacttgggaagctgaggcagtaggatcctttgagcccaagagtgcaaggctgcagtgagctaccatcgggccaccacagtccagcctgggtgacagaatgagatccatctcttaagaaaacaaaaaacaaaaattacagtctttaggttatgatctacattcttacctgggatctgtttctggatttagggttttgatctatataaatacttcggggtttcat

SEQ ID NO: 188230 - DNA, 601 bp, Human
ctgatgaatacacatgggatgggatgctttcatctaatttacctaatttcatcctccaaatgacccttggaggtaggttttgctattttgatgcttgtttgcacatgaggaaaccaaagcttgctaactatgattccaaagcccatgtatcaccctaggtctgtgaggaagtggaatttctcttaagaactctgggacagaattcctggccaaagcaaataatgttgctgattcctctgagttctccttctccttggggatgcagttaacaccaaagggaactaggagtatgaacaatttkgctcattcaagcaggatgacctgcttttacaaaacatagtcttcaggatggctaggtgcgctcaggcctataatcctagtgctttgggaggctgaggtgggaggatcgcttgagcccaggagtttgagaccagcctggactacgcagcaagaccttgtctctacaaagataaaaaattaaaaaattagccaggtgtggtggcatgagcctgtagttctagctacttgggaagctgaggcagtaggatcctttgagcccaagagtgcaaggctgcagtgagctaccatcgggccaccacag

SEQ ID NO: 188231 - DNA, 601 bp, Human
tctacctcacgaagctggtgtgaggaccagagatgatgaatggtaaaagtgctctgaaagcagccaagtggtgtctgtgcaaagatgaggtggagttttgtttccagaatcttataaaaaggtagctgaggcctaagctcatgaggtgacttgctcatgatcatgtggggagacagtggcaaagcagggttccagtcttctaattcttggtccagagctcttttcacaaccttttgctaccttagagatcccatctaaaacattcttcaactttggcaaaagcaattccacattccattamaatgagaagcattttggatcacctgcagagtataaatctctgtcatggaatggagtccagctctctacttccaggcagaatgccacctgaaacattctaggcagggagttaactcttactcccccacaaaaatctttccttacagtctctcagtcactgctaactaacctgtgccagaaaggtcatcctggtagctgaaatattctcactgtggcagagcccacatcttctgatcaaacctcagaaacaaaaataaggaatgcaacaccgcaaacattagagaagcagattgaaaacaat

SEQ ID NO: 188232 - DNA, 601 bp, Human
ccagccaaagtcatttctgtacttgcagagcacagcacaatgcctggcacataaaagacactcaatgtagagttgctgagtcaatgcatgggtgaatgaaactagcatcccaaagggaactgaggtgcagttccagtgcttgcagagaaaaggtctgcccaccaaatgtggtcctgcccccctccatctgcagaaggggcaggaggcagctggtgggtccagaaatgctgacagagaaggacagagcttccagccccaacccacttctccatggcaacgagctgacagaaaactgcacggragactgagaaaccagttttaaaataaagacacaaaacactctcagtctaaaatcacacatgcaaagcaacagctcctgcctctcagccccttaagaggggtaggcacaatcactaagaaaagtacctccttccaacctgcccatttctctgccaggggcccatgggcctcccctcctgctgtatactcctctaagagctgccaggcagaattcctcttgctttgcagtatatgcttcagggcattgcatcaaatctgacaagcaatggtaaagctccaccagggttagatctggcaggtt

SEQ ID NO: 188233 - DNA, 601 bp, Human
aaacaaattcagtccttcaaattctgaaaagaatgaggttgaggaacagtaacagacagggatgttgtaacagaacaggctggcagggtccaccacagatgtacgtgccaccagccaaagtcatttctgtacttgcagagcacagcacaatgcctggcacataaaagacactcaatgtagagttgctgagtcaatgcatgggtgaatgaaactagcatcccaaagggaactgaggtgcagttccagtgcttgcagagaaaaggtctgcccaccaaatgtggtcctgcccccctccatctgyagaaggggcaggaggcagctggtgggtccagaaatgctgacagagaaggacagagcttccagccccaacccacttctccatggcaacgagctgacagaaaactgcacgggagactgagaaaccagttttaaaataaagacacaaaacactctcagtctaaaatcacacatgcaaagcaacagctcctgcctctcagccccttaagaggggtaggcacaatcactaagaaaagtacctccttccaacctgcccatttctctgccaggggcccatgggcctcccctcctgctgtatactcct

SEQ ID NO: 188234 - DNA, 601 bp, Human
gtccttaggtatcactggggtggccccaagcccctgaggattagggccctcagatggaaggcaacagctgcctgctctgatatttctctcacttcttgtatcccacacaaaccctgtgctctggtcagaagggcttcccacactctgccctcagcctgggatctgtctatcctcacacctccccatcccgcaatcaggaatgcccttatcctgggctaatccaaatcctagcctagccttcaaggctcagctcaagtcctccttcctctaaaatgtctacaacaatcatgcctacactgarctatagttaaatttcagagcagcaagggaatctacagatcattggcccaaccctcaaaattctaccgaacagaaaactggggcctggagaagacagaataagggctatgcctagaacccaagtccatagcattcccttgatgagcttcccatgaactttgtagttctttatttcacctgtccatgtcacagattgtgagactgtctgtgaggacgatgacttttgtatctctttatcctccactgtgcttagcacagagccctgggtcacaggtggctcaggaaatagaatccttaatag

SEQ ID NO: 188235 - DNA, 601 bp, Human
tgcaggctctacaggaagcgtggtgccagcatctgtttctggtgagggcctcaggaagcttccaatcatggtggaaggcaaagggggagcaggcacattgcatggtgaaagcaggagcaaaagagcgagcagggggaagtgccatgcgcttttaaacaaccaaatcacacatgaactcagaaagagaactcacttataaccaaggagatgatacaaaaccactcaagagggatctgccctcatgatccaatcacttgccaacaggccccacctccaacattggaaatcacatttcaacacragatttggaggggacaaacatccaagccatgtcacccaatgataattaccttaagacgcttgctgtcagacccctggtcacaaatgggccctccaggatagtgacatttccaggataatataggcccctacaccttgtatgactgatccctatctcaacccagcaggggccaacttcgtagctagtattccccatatttctaccctttcctgccagtttgctgtaagaggagccaattggcttgtatacactttatagggtcatgaccatgtggagccagctaactgaatacttgtccat

SEQ ID NO: 188236 - DNA, 601 bp, Human
gcaatgagtgtcagcctgggattggcctttccaaatggtggcctacagggtggcatgatcatgacttgactttgaaatggaagcaagggcctggtaagccaggctgtgaaccaggaggggaggcaggactcatatctgagcctagctatatggcagccattgcctcccccagtcctgcccacttaagggaaatgaagaccagaacaaggtgtttccaaattgagaacatgccaatttctaagtcagtcctgacccaggaagagagcccatttccctttgatagccctgctgaccccctagwatgtgcagccacaagattagtgtcccctaatctgagagtttcttggggctaaaggcctgagtcaaactcttactggctgagcaggaccctcacactctgcctaggctctcctgacatcccactaccaagggcctgaacttcttatctgtcctccaagttgctgcctggcttgggccccttggaatgtgaatgtgcaatgtattagtccgtgcttgtgtcgctacaaagaaatgcctgaggctggataatttataaagaaaagaggtttaattggctcacagttctgcaggctctacagga

SEQ ID NO: 188237 - DNA, 601 bp, Human
aagaccctggtccttggtgaatggctcccctgtctccacaacttgctctgtttataatggagaagagcagtgttccttctccatctgaatctgtcacagtagcagatgccagtaagggttgcctggaatgtccggacatgtgatgctgccatggtaacagcagaccaaggttcggaatgctttatccctgatgagctgccccggcagtgccatgccaggctgcttgtggaatcttcctcaaagaactcccccccccaaaaaaaattcaccaaaacccatgcaacaacaacacaacccattratggacaagcaactgctgagcactggtgccaaggttcagctcctataaacatactttgggccactcacctggtccctttactgataaggaagccaggccctggctgtctgcactgtggctcacccagggggtaatgcggtttttagctggctcagccaacgaagcaggctgtccccaactccagcccccaaattaccacttctcttgtttgatgccgccaaccagggatctgccggcgtggaccctggcaattagcacagcacttgcatttgttggggaattaggagccactgattaccc

SEQ ID NO: 188238 - DNA, 601 bp, Human
tatttcatcaagaagcccccaactcgatggaatagcattttctttaagaccctggtccttggtgaatggctcccctgtctccacaacttgctctgtttataatggagaagagcagtgttccttctccatctgaatctgtcacagtagcagatgccagtaagggttgcctggaatgtccggacatgtgatgctgccatggtaacagcagaccaaggttcggaatgctttatccctgatgagctgccccggcagtgccatgccaggctgcttgtggaatcttcctcaaagaactccccccccaaaaaaaaattcaccaaaacccatgcaacaacaacacaacccattaatggacaagcaactgctgagcactggtgccaaggttcagctcctataaacatactttgggccactcacctggtccctttactgataaggaagccaggccctggctgtctgcactgtggctcacccagggggtaatgcggtttttagctggctcagccaacgaagcaggctgtccccaactccagcccccaaattaccacttctcttgtttgatgccgccaaccagggatctgccggcgtggaccctggcaattag

SEQ ID NO: 188239 - DNA, 601 bp, Human
tcaaatactatttcatcaagaagcccccaactcgatggaatagcattttctttaagaccctggtccttggtgaatggctcccctgtctccacaacttgctctgtttataatggagaagagcagtgttccttctccatctgaatctgtcacagtagcagatgccagtaagggttgcctggaatgtccggacatgtgatgctgccatggtaacagcagaccaaggttcggaatgctttatccctgatgagctgccccggcagtgccatgccaggctgcttgtggaatcttcctcaaagaactcccccccccaaaaaaaattcaccaaaacccatgcaacaacaacacaacccattaatggacaagcaactgctgagcactggtgccaaggttcagctcctataaacatactttgggccactcacctggtccctttactgataaggaagccaggccctggctgtctgcactgtggctcacccagggggtaatgcggtttttagctggctcagccaacgaagcaggctgtccccaactccagcccccaaattaccacttctcttgtttgatgccgccaaccagggatctgccggcgtggaccctg

SEQ ID NO: 188240 - DNA, 601 bp, Human
gttctgacaattccagtgctgtggtgaggctcatggaagagtgaatggaaaccttttgtatgttataaagttagatgtcagttaccatgaataccatttattgggcccaaaggtagggaggaatccatcccatttgtccttcaagaaacccaaagccctgggaagtttaagtcctgggccacagggcagctggatatgaaacctgaatgagcaagtcacttgacttgcaagctgagctacacaggacagactgtaagcttggcctggctcccaccctatggagactaaactgcaccaaagstgaaaacactagacagaagtatagagcccagcaacatggatggttccttgttcccatcattcgcacattcaactagtcaacaaacattcctctaatatcaattctagataaagtgatatttgggtaccttatgtatgcaaggaaagagaaggaggaaggagcaaagatgaatacgatggtccatttatgtggaaaataactaacatttaataatgaacatttcctgagctcttaccatatatcaagaactatgctgtactatttctgttatctcatttcacacccacaataagccaagag

SEQ ID NO: 188241 - DNA, 601 bp, Human
tggctgtgctgggcgtacagccttgctgagctcacggtggctcatggatacagtgctcttctcctcagtcactcatgtggagttttagaccttccaaagctccatcagccccaccacaaccctgaagcaagaaggtcagagaataagcaccttgggaagagaggtggctcatttcagagctgcaaacttgtaagtgacagggtcatgaccaaaatcaaggtatttcaactccaagcctagtattctttacctcattgggatcatatcctaaaagaactacagaccctaaaagcttcatgcrgtggaaagaccaccagtgttagagtcaaaagatgggtgcgatcccctcttcctgctctcctgtgtgtgcttctggaccagccactccctattactgagactcagtgtctttatccataacatggggctattgttctgacaattccagtgctgtggtgaggctcatggaagagtgaatggaaaccttttgtatgttataaagttagatgtcagttaccatgaataccatttattgggcccaaaggtagggaggaatccatcccatttgtccttcaagaaacccaaagccctgggaagttta

SEQ ID NO: 188242 - DNA, 601 bp, Human
taagtcctcagaggcctcaatggactgttactctcctactgtctgtaactaaacttccagaaggtgttgcagggtttggagaaccattggtctaaaagcctccatctaaaaaatatcttttctgagggctaagaatatccctcaatttgatgtcttctaaatagaacatttctctattatcccaatttacttccatgatcatatattactttcataacaaaaaaagtttggaaaacaaagactgttgaaaatactgtctgatgcacacagttctctgagaaactctttatctaacagtttmaaatgaattcaaatgagatactcaggcaagagaaaatgcaaaattttcccttcctaacagccacatggctccatggcagtgtggggctgagtgtcagacctgggctctaagtctcagctctgccattaactcaacacgtggtcttgggtgagtcactacctctcacagggtctcagtttctgcacctataaactgaaagcaccagctatggtgatctgcaagggccctcccggatctgatggttgatgttccagacaatgaagtgtaactttcccaatatacccaggctgtaattctaca

SEQ ID NO: 188243 - DNA, 601 bp, Human
gagctagaggttgaacagaccacctccaactctaggatcaaccctgtcctggcaggcctagcctagcctagtccatcccagcccttcaaatgagcacccatccatctgcatgtaggctgaccctctgctttctgagatgaaggaaagccagctgggcagtatatatctcaagtcctcacccagtgggtcagagaactgggagagagttgttgctgctcagtagttttggagccagacaggcttggatttgatcttgcctctgtcacctactgtatatacctaattcttggtttcttcatckgtaaataagaacaatcgtcttttccttgcctttttctaaacgaatatgtaaagtgcccagcacagactccatcacgtgacacacgctcactggacacttgttcccttccccatcttcccctctgctgttgggattgcccacatctcctgcccaggatctacttctcagccttcctcgatctggtgtatcttgaggccagctattagtgaatctgggaaaaccgtccaatacaggggcacatggcaaaattgtgtcatcccttctccttcttcccatctccatggaccccttgcatggaac

SEQ ID NO: 188244 - DNA, 601 bp, Human
tctggaccttagcctataaggtcctataccatctgatcccagctacctctctgatacccactgctgccactcgcgtcctcacctttcctaatccactcctcttcagccacactggtctccttgctcttcctccaactggccagtcatgcttccagctttagcctttgcaccagctgttccctctgcccggaaccttcctccccagataaccatatggctccctccctccctcccttcaatcagggcatcattcaaatggcactttctcagagggccttccctgatcacccaatttcatcckttcattctctttatactgcttaattttccttcccagcacgtaataccctatcatatacttttgtttgtctgtttccccaccagaatgaaaagctctatgagagcaaacatttcattttattcaactgctgtatctccagcacttagaaaaggtatgagtatataaaaggtgctcaataaatatttgttttagcaatgaagagttgtcacttgccccaggaggggctcattcccttgaggggaacccaaatcaaagtgctgggcagaccatctactgggatcaccaatctgaagcaactgc

SEQ ID NO: 188245 - DNA, 601 bp, Human
ccttaaaattgaaggggaaggccgggcacggtggctcacacctgtaatcccagcactttgggaggccgaggcgggtggatcacgaggtcaggagatcaagaccatcctggctaacacggtgaaagcccgtctctactaaaaatacaaaaaattagccgggcgtggtggtgggcgcctgtagtcccagctactcgggaggctgaggcaggagaacggcgtgaacctgggaggcggagcttgcagtgagccgagatagcgccactgcactccggcctgggcgaaagagcgagactccgtctcaaaaaaaaaaaaaaagaaagaaaaaaaaattcaaggggaagcagggccttgggatgccaggtgaggagttagaagtttgagaatgctgagaagctagagagggttttaagcagggaatgacaaattctgatttacatttgaaaaggctgctctctgaaggctggattacaaaggcaaaatgcagggagcagatttaggaggctactgcattgcagagaaccaggcagtgcaggaaggtggctcaaagtaggctggtagcagtggggacggagataaatggatttataaactgttttggata

SEQ ID NO: 188246 - DNA, 601 bp, Human
gagttgcgacctgtaggacaagaaggagccagccatatctgtgggaagaacttggcaggcagaagaaatgacaatacaaaggctggaaggaggaaggcattttgccagttccagatatagcaaggagggtgaccacgtgtgtctggggccaagtgagccaagggagaggcaggccttaaaattgaaggggaaggccgggcacggtggctcacacctgtaatcccagcactttgggaggccgaggcgggtggatcacgaggtcaggagatcaagaccatcctggctaacacggtgaaagccygtctctactaaaaatacaaaaaattagccgggcgtggtggtgggcgcctgtagtcccagctactcgggaggctgaggcaggagaacggcgtgaacctgggaggcggagcttgcagtgagccgagatagcgccactgcactccggcctgggcgaaagagcgagactccgtctcaaaaaaaaaaaaaaagaaagaaaaaaaaattcaaggggaagcagggccttgggatgccaggtgaggagttagaagtttgagaatgctgagaagctagagagggttttaagcagggaatgacaaattct

SEQ ID NO: 188247 - DNA, 601 bp, Human
tcttaaacagtttctggaggacttgttctcctatctcttacctggcctggcccgtatgctggtggtttagacctggctgggactttcaggttgtttccattaaaagtcatcttattaaatgaacatgccaatctccgaggggcactagcagaggggtggaggaatggatgccattctgggaccaggagcagctgcactgttgccattcctgaagcctggtcaccaccagagcctccttaccttgctctcctcaagcctgtttgggaatcaccagtgtgcagaagaggaagctagggaattrgggcaatagtggaggtggtagtaagaaggtctgctctggaatccagtggcaggtccagaagaatccacatgcaggaagattagggtactagagttcacatggggacggatgacacaaatctgagacagaattctccctagaagttccaatcactgaataaatattgtacctacttagtatctggtccgtgtctggtgctatgcccaattcagttcaattcattttgtacacatcaactaggctcccacaaagcccaagtgctgggttagagagctgagcgtccatcccacagtgacagca

SEQ ID NO: 188248 - DNA, 601 bp, Human
gtccccattgcctaccagggccccctcagcagattctcagtcatcatcatccctctagaagtatggtacccagagctggctgaggtccagagatgaagggcccaccaagatgcacacatagtccccaaggttccacctctgttagcttagcctgaggccacattcgctgctttggaggccaagtccacttccccttgctgaacccgcggcctgcaaaaactcttaaacagtttctggaggacttgttctcctatctcttacctggcctggcccgtatgctggtggtttagacctggctggractttcaggttgtttccattaaaagtcatcttattaaatgaacatgccaatctccgaggggcactagcagaggggtggaggaatggatgccattctgggaccaggagcagctgcactgttgccattcctgaagcctggtcaccaccagagcctccttaccttgctctcctcaagcctgtttgggaatcaccagtgtgcagaagaggaagctagggaattggggcaatagtggaggtggtagtaagaaggtctgctctggaatccagtggcaggtccagaagaatccacatgcaggaagat

SEQ ID NO: 188249 - DNA, 601 bp, Human
aagggcatgcacacagcaccttcggatctgaatcccttcaggtgttgctctcctgtcctccaagatttcttcaatcctggtgatacctcctccctctgtatgacctggtagcttgtccccattgcctaccagggccccctcagcagattctcagtcatcatcatccctctagaagtatggtacccagagctggctgaggtccagagatgaagggcccaccaagatgcacacatagtccccaaggttccacctctgttagcttagcctgaggccacattcgctgctttggaggccaagtccrcttccccttgctgaacccgcggcctgcaaaaactcttaaacagtttctggaggacttgttctcctatctcttacctggcctggcccgtatgctggtggtttagacctggctgggactttcaggttgtttccattaaaagtcatcttattaaatgaacatgccaatctccgaggggcactagcagaggggtggaggaatggatgccattctgggaccaggagcagctgcactgttgccattcctgaagcctggtcaccaccagagcctccttaccttgctctcctcaagcctgtttgggaa

SEQ ID NO: 188250 - DNA, 601 bp, Human
cccctggcatcactgcaggcacctcatctgacagcagcccagtgaggcacgtattggatcaacactgcatggaagagaaaactgcatttgggtgcggttcagaaacagccaagctgggacaggcagaggccagccctccccacccccagccccaggagtaggaggctgctgaggctgctgtggacacatttcctcagtcacctgcagtgagagcgtgctgtggcacgttggctccagtgggtgactattcttagatctagggagctatgatgacggatttagaacttacaaggtggaaacrtgttggcctgttttataaacaactgaaatcctccctacagactgtctttctgaattctgtgttctctcagaactgctggctttctgggcttattggctgccttgcgagagggggcagaaagagaaactaaccctcttgagggcctactatgatcacatatggcgttatgggcttttgtatcacccatctcatttaacagctctgggaagaagatattttggtcacactctgtggatgaggaaacaggctgggagaggtccagaagcaagcacaccctgtgatgtggtacaagagtgaggc

SEQ ID NO: 188251 - DNA, 601 bp, Human
gaggctgtggctgtccaccaggtaagaaaagggcagggcctgtggaaaaagggtttggggaaggtaatgtgcaaaatacagccaggatctggccacttctcaccagtgccatcacccctcaagggctgcccaactggtctctctgctgcctctgtttccctgtatgttctattctccacacagcaacttgagtgattgtgttaaaacctatgtcagacaaggcactgcactgtttagaatccttcagtggcttctcctgttactcagaataaacaacagcgggtctccagctccttctctracatcatgttctatcatgatccactctgctaacatcaccatagtgacactgactttcttactgttcctcaaacagtacttgcctcaggacctttgcacttattgttcctgctatctggaatgctcttggccctgacagccacaggttcattccttcatgttgttcaggtatttgtgagagtcccaccttatttgagaggccttccctgacaactttatatgaaatagcagtctacccctactcccgtcttatctcttcacctgctctatttttcttcattttttttttacagtttattta

SEQ ID NO: 188252 - DNA, 601 bp, Human
aggccctttcaggaattagtccatccatcactctccagggccaaggataccctcgaggcaggagctgaggcagcagaaagaagctactccagaatcaaaagtggggctgttcacccacaggattactctggggatgtttcgggtttgtggcccacattgcttcagagaaggctgtatgtgggaaaacagacaggcctagggtccccttcacaccaagatccacagcagccctgagaatgaggtgagaggagtagatggggggtgagggttggaggcaaggaggccagcaaggaggctgtgrctgtccaccaggtaagaaaagggcagggcctgtggaaaaagggtttggggaaggtaatgtgcaaaatacagccaggatctggccacttctcaccagtgccatcacccctcaagggctgcccaactggtctctctgctgcctctgtttccctgtatgttctattctccacacagcaacttgagtgattgtgttaaaacctatgtcagacaaggcactgcactgtttagaatccttcagtggcttctcctgttactcagaataaacaacagcgggtctccagctccttctctaacatcatgt

SEQ ID NO: 188253 - DNA, 601 bp, Human
acagaataaagacatttcccaacctttcttgcagctagctaggtgtgatcagtgagggtcaagctgaaatgttctgtaattgcttatgggacttttccttaaaagacagatggcatacactctttgctccttcttctttgtccctcttgcatcctgtcactgggaatgtggatgcgatagctggagttgtagccactacctctgaccatgagcatgagggctgcgacctagggatggtgcttctcagtttcataaaaatgtcaccttaatttccacggcaaccctcggaggtactactacktccattttacagatgaagaaccaggctcagagaggtaaagtaatttgtctatagccacacagctattctagtcaggactagaatccaggactcccaaatctcaggcgccttcactagttccaaaccatgtgaaaatggtaacagaatcattgaatacttggtatatgccaggccctgtgataagcactttgcaaatattcattcaccgaatcctcacaacaaacttgtgaagtgcaatctaatattatccccattttgcagagagatgacgtgaactgtgcaaggaaacaagaggcagag

SEQ ID NO: 188254 - DNA, 601 bp, Human
gggccaccttttcaggggcacaatgaagctggcaaggccctccagactcagcaagatgctactatgcaggctgttctcacacagaagtaagaggaaggagagtggcctacagaaagcctctccctaagcgacatggaacatggaacgtccagttttcaaaacaggtaagttagaggacgatccctggctttacagagggctctctgcagtgtgcttggcacttgtcaggtcttcgaagacaccagaatcccacctggttgacggagatctgctttgctggtcctggggcacatggctgagmcttgggtggagagccccatatttacagagggattccctaggcccttggagttcaggcctcctgctcacagggctcaatctaggctgtgacgagtgatggagctcacagcccaccacacttgcgtcagcctaagagccctgcaggcaacggaacctcaggactggcagggtccctggcacaagctggacacaatacccaaatctgttcaggtctgtggcacctgcccgagcttcttggcaactaagtcctcatagggccttatggtgctgggactgcagcccagtgctagggagggggcag

SEQ ID NO: 188255 - DNA, 601 bp, Human
gtaagcatgtttatgtttagtaagtgtggccaaatatctctccaatgactagacatttatattctcatcaacaatagatatgaatttgtttccttagatcttacctttagactcttgccattctcatgagtacgttcaattagtttgcatttccctgactactagtgagatggagcagtagcgctttctgttgattacccgtttaagttgcctcttctgtgaattgtctatatacattctctgttttgttctttggttgtttgccttttccttattgatttgcaagtattctttgtgtatkattttgtttctatgattctttgttgttatgtgcatttggaagtatcttcttccagaagtctgtggtgtgtctcttcacttggtttatggtgtcttttgttatacacatttacttataatggctgcctaattacctattatgaagattaaacaatttacttaacctgcattctattatcagatccataggttgtttccaatttgtcattattttatatagcattgctatgaacatctttatgcatgagtctttgtctgtctctctaattattttctcaaattagattcttagaatgggaat

SEQ ID NO: 188256 - DNA, 601 bp, Human
ttaaagaacagaaaataatttaatagaaagacgcagatctccacccagattaagaacattagctagcattttgccatatttgcttcaacccttctcttaaaaaaaatcttaaagatacagtttatgccccacctcccattcttgtccctctatccaaccctccttcccacaagtaaccactatttgaagttggtgcacatcatttgcatggtttcatatttttctacatagatgtgtccttaaatattgtgatctgtttagtttgttttaaagacttacacaaatagaatcattcacatatttttttttttttctgcaagttgctctttacactcatcattgttttcgaaatttatctgagctggtagttacagatctagttcagttattttaattttaactgtgcatagtatcccattatgtataaatcatatttcacttacccatgtcccttctgatggctagttatttaataatatcattgttgctgttttattatataacaatggaaaatatatagtattatgcaacaacaatactaatatggttgctattatagacagtattgcaatgaaagtctttgaacatatctccttgtaca

SEQ ID NO: 188257 - DNA, 601 bp, Human
atctctcaaagccctcagtttactgggcttccagacctcttcatgttttccattccagttgtcgctcagaggccagggtccctgaccacccaatccaaatcagattctcatgactgcccttgtattcttccctcatgaggatctggcactctgtagtgagggatgatttgtgtggtgatgtgtttactgtcccctcttcactagactgcactctgtggtgagggaagaagcgtgtatactttcttcactgctgtatctctaggacagtgcctggtacacagttggtgctcaacaggtgttyactgaatagatacaaaaatgaacaaattcatacagccagaaagtggccaagccaacattcatgcccaggtaactccaacagtccacccatcataacacgtcttcctaggttttagacactgtcctaggtctaaactcattcatgtttttctgtggtcgtttaaaaaaaatcttctggacataaaaataatacatcttcatgacaaaagaaaagaaaagaaacaatggacaatatggatgtgtaaggaaaagcaaacttgcagaatcttgcccttgccactactaggaatattttggatat

SEQ ID NO: 188258 - DNA, 601 bp, Human; identical to SEQ ID NO: 34687

SEQ ID NO: 188259 - DNA, 601 bp, Human; identical to SEQ ID NO: 34688

SEQ ID NO: 188260 - DNA, 601 bp, Human; identical to SEQ ID NO: 34689

SEQ ID NO: 188261 - DNA, 601 bp, Human; identical to SEQ ID NO: 34690

SEQ ID NO: 188262 - DNA, 601 bp, Human; identical to SEQ ID NO: 34691

SEQ ID NO: 188263 - DNA, 601 bp, Human; identical to SEQ ID NO: 34692

SEQ ID NO: 188264 - DNA, 601 bp, Human; identical to SEQ ID NO: 34693

SEQ ID NO: 188265 - DNA, 601 bp, Human; identical to SEQ ID NO: 34694

SEQ ID NO: 188266 - DNA, 601 bp, Human; identical to SEQ ID NO: 34695

SEQ ID NO: 188267 - DNA, 601 bp, Human
gcacagtgagtctctggccctaccctgtcctcctggaggcccctctcccctcagggcccctctccgtgtactcaggataggacctgaggcagcgagggctgagccacacgggcttggggtgcagtcgggctcacatgtggtggtaatccacgtctccccagggccctccaagagcacagagcagggtccggaggcctctaggagcctcccttccacttcatcacccagccccacttctgcaggagctcaggtgacgggcccagaatttccccaggggaccctggccacctaggacagtggsaggcagggcacggccagccgcaagcagcagctcagccgtccaggtcaggagggccggagggagggagctcaggtggccacgcccacttgacaggtgagaaccgccaaggcccagagagctctccgggcagtcagggccccgccaggggaggggcagccccacgccacagcggaatccccaggtcctcaccggtatctccagggtgagatggagcgctggtgggtgtctgcctccaacacctcctccggccgcagcaccgggcactgggtcgtagctgagggcctctcgtgcctccccctg

SEQ ID NO: 188268 - DNA, 601 bp, Human
cagtggggggctgtcctccagacacggggaatgcccagaccccaagggtagtgttgggggaggcatataaataacaataaatacacataaatagggggtgccctctggggagcacacgtgtccagtctaggggccccacggcctcggcggtcacactgaacggggcagcacgcaggtgcagccgacggggacgtggatgaactcggtgtggaaggcaaaggccccaggtgtggggagccccgagccgtcgcgggagcagggccggcggcgcagcaccagcaggctctggagcagccgcacrgagttgagcgcagctgtctcgcggcccgtccgtgcatcgatacagcctctgcacaggcactcggcgaaggccagcttctgtggatagcggtcctcatccgtgtccacactgcgggacggggtgcacagtgagtctctggccctaccctgtcctcctggaggcccctctcccctcagggcccctctccgtgtactcaggataggacctgaggcagcgagggctgagccacacgggcttggggtgcagtcgggctcacatgtggtggtaatccacgtctccccagggccctccaagagcaca

SEQ ID NO: 188269 - DNA, 601 bp, Human
cccttggccattgtccccaaaggctgaacctttgatcaatgcagcccaagctgcacgggcagagaaagggtgcggggtaggggccggggttgggcgctgagctcctctgaaccggttgccaggcaacagaatggaaattcacgggcggctaaatggagctccgccacaaatgttctgtggcaaacccggacccagtcacatcgccctttctcccccctcccaccccactgagttttctcatctgtaaatgagaagggtgcagagaagactcttttcttcggagtcagtgcctccggtttgcactgcttttcattcataagctgacttagtttagcgcagacataggatggagggacgcgctgtcagcggacagatcatgggtgcactggctacgcccgggatggttgcagctgcgcggcggggtggggcttcacgggcctccttcccatgtgagacggtggttgtgcccaggccctgaagtgggtgagcagacactcgccaaaggagcacacgggtctcccagccacgtcaaagacgctcatcttttaacggcattacttactggaatgattcccgcgtagactatctgggtgatttcttt

SEQ ID NO: 188270 - DNA, 601 bp, Human
gccaagggagggtgtggaggcagggcgattggcatccaagtggtgcagaaatcctcctgggaaattcgtgaaacagaatctcacaggagtccaggctcagggcctgccaatctggctgcttgcactgcccggggttctgattggacaagaattttcacaatttattggaaccaaatccaaggttgagccacctccaggaagcattctaaggaaattctcatgccagtcaataaaatttgtagtgggtgggggccagggtggcagaggaccagcgctgttccttattctaacttttctgctscttctgacttagtaaattcctccccttgctctcttcctctcctctccttccaccctcaccccccgcccccaccccgcctccaggtttcctggcagctctggggaaatgttttattgccttttgggggtagtcctaacctggacaaaggggaggaagactggcgctcctggctacttcacagagaatcgtgttacagtccctgggaaaacaattcctgggcttgaaccgaggttctcagcattagctgccctgtagtatcacccgggggacttagagttctagggttattagggccgcttc

SEQ ID NO: 188271 - DNA, 601 bp, Human
tgcactgcccggggttctgattggacaagaattttcacaatttattggaaccaaatccaaggttgagccacctccaggaagcattctaaggaaattctcatgccagtcaataaaatttgtagtgggtgggggccagggtggcagaggaccagcgctgttccttattctaacttttctgctgcttctgacttagtaaattcctccccttgctctcttcctctcctctccttccaccctcaccccccgcccccaccccgcctccaggtttcctggcagctctggggaaatgttttattgcctyttgggggtagtcctaacctggacaaaggggaggaagactggcgctcctggctacttcacagagaatcgtgttacagtccctgggaaaacaattcctgggcttgaaccgaggttctcagcattagctgccctgtagtatcacccgggggacttagagttctagggttattagggccgcttcgtgggcccagatcagttaggtcagaatcttttgagggtggggcacaggcatcattttttttaagtaccttaggtttttctaatatgctaccgtggtcaggaaacactggcacaggagatc

SEQ ID NO: 188272 - DNA, 601 bp, Human
agatctcaggtgatgtcagtgtttggaaaccactgccttagatggtatttgaaatttcaagagctgggcctaaggcgaatttgtaaagtatagtcatatttactgtatttagtgaccctccaaattccccttattccttgcttctctgacttttcgtgggctacagggacacactgcctctgagtcacactgcttaaagctggctgtcagctaatccttgctagggtgatggtttaacatagtatctccctagggatattgacatttttcgtaaaggattttgaaagatctaaaaaaatcmcctaaaaatttttaagagaactcacccagtagtgcaattccaggccccaagacaggctgacacagaactgaaagagaattctaggatgggaattctatcccaagcccctcatattcctatcactgggctccttgtacaagttatagctactgtaggtccacttctggactctatactgatagtgtgaagagaaaaccttttgcgggtaagtagaatccaagcagcaagccatgccacctgccaatgaagcaattctatttcatcttaatccatgtagcagtaggaaaggggtatttcatc

SEQ ID NO: 188273 - DNA, 601 bp, Human
aggattttgaaagatctaaaaaaatcccctaaaaatttttaagagaactcacccagtagtgcaattccaggccccaagacaggctgacacagaactgaaagagaattctaggatgggaattctatcccaagcccctcatattcctatcactgggctccttgtacaagttatagctactgtaggtccacttctggactctatactgatagtgtgaagagaaaaccttttgcgggtaagtagaatccaagcagcaagccatgccacctgccaatgaagcaattctatttcatcttaatccatktagcagtaggaaaggggtatttcatcatcagaggctagaatggggtaaaatctgattgccatgactctgaacataggaaggacagttcatttgaacaaagttattgcgtaccaatgttggattctctatatagggatactagagaattacagatttcctaattgctgtcaatgccatgttaactgccacattacctgactcatctattaaagaatctacagaaagataaacatgacagcgctgcgttttaaagtacgcttatacctactaggttaagtaaattacacactggaagtacaa

SEQ ID NO: 188274 - DNA, 601 bp, Human
gggaattctatcccaagcccctcatattcctatcactgggctccttgtacaagttatagctactgtaggtccacttctggactctatactgatagtgtgaagagaaaaccttttgcgggtaagtagaatccaagcagcaagccatgccacctgccaatgaagcaattctatttcatcttaatccatgtagcagtaggaaaggggtatttcatcatcagaggctagaatggggtaaaatctgattgccatgactctgaacataggaaggacagttcatttgaacaaagttattgcgtaccartgttggattctctatatagggatactagagaattacagatttcctaattgctgtcaatgccatgttaactgccacattacctgactcatctattaaagaatctacagaaagataaacatgacagcgctgcgttttaaagtacgcttatacctactaggttaagtaaattacacactggaagtacaagggaaagtattacatagttgtaaacatccgacttccctgggactgggggaataatttactcatgaaatacatttgaaacaccccgagccttgtaagccagccggactatcagga

SEQ ID NO: 188275 - DNA, 601 bp, Human
aaggaaaatgaagagggtacaatgtcttgcatcatgaagcagctttctgtaactttttcacaaaccaatccttcactttctgcttcccatcttatatcaaaaatgaactattctagggaatgatttttttttttttttaagacagtatctttttctgtcacccaggctggagtgcagtggcgagatctcggctcactgcaacctctccgtctcctgggttcaatcaattctcctgtgtcagcctccagagtagctgggattacaggtctccgccaccacacctggctaatattttttttttgtatttttagtggagctggggtttcaccatgttggccaggctagtctcaaactcctgacatcaagtgatctgcctgccttggccacccaaagtgctgggattacaggctcacgccactgcgtccggccaggaatgactattgtttaacttagcacaacgtcgttacagttttaatttttctacttcgatctttattctatttttcttcctcttctgttcagaattttagtcattttgccatctttggtgcttccagtagtgggaagaaaagtagacaatattttaattagacaattttgt

SEQ ID NO: 188276 - DNA, 601 bp, Human
atatgagaatacaataatggagacagaaatgtggtaactgaagagcagttcgtttgagggatattaggggtttgtgtttattcctttacaaatattgtgcaggtgagacatttagtgaattctctccatctctcttcacgtcagttactcattgtagtggggtattactgaattccagctaatttgcccgcccgttatctcccaccctattctgctcccttacagaggaaacctcttaaaaatggggaagagggccgggcgcagtggctcacacctgtaatcccagcactttgggaggccsaggacggtggatcacttgaggtcaggagttcaagaccggcctggccaacatggcaaaaccctgtctctactaaaaatacaaaaattagccaggcgtgggagcacacctgtaatcccagctacttgggaggctgaagcaggagaatcgcttgaacccgggaggcagagatttcagtgagccaggactgcaccactgcactccagccggagtgacaaagcgagactccatctcaaaaaaaaaaaagagcttggggccatggcactgtcactgggcttgagaaattcagccttgtctcataac

SEQ ID NO: 188277 - DNA, 601 bp, Human
ttacaaatattgtgcaggtgagacatttagtgaattctctccatctctcttcacgtcagttactcattgtagtggggtattactgaattccagctaatttgcccgcccgttatctcccaccctattctgctcccttacagaggaaacctcttaaaaatggggaagagggccgggcgcagtggctcacacctgtaatcccagcactttgggaggccgaggacggtggatcacttgaggtcaggagttcaagaccggcctggccaacatggcaaaaccctgtctctactaaaaatacaaaaaytagccaggcgtgggagcacacctgtaatcccagctacttgggaggctgaagcaggagaatcgcttgaacccgggaggcagagatttcagtgagccaggactgcaccactgcactccagccggagtgacaaagcgagactccatctcaaaaaaaaaaaagagcttggggccatggcactgtcactgggcttgagaaattcagccttgtctcataacatctgacttaggatgtcctgtggtttaatacttctctgtgggaggataggtgtttaatggagcaaaaagagaagtgatatccatg

SEQ ID NO: 188278 - DNA, 601 bp, Human
agatgcttatgatcggtttattatagaggaaagagaactggattaatatccaggaggcttgaatttgggctctagttcttagtattattcttttttgtaatattttcttcttttttttttcttcttttttgtaatatcttgttcaagccacttaaccaaatttctaggtctccttccttgtctggaaactgtattggctagatcagcatttttcaaaaagttactacttttccaaaatgttctgcaagaaaaggccgtagaagcactttctattctattcctctctttgaggtttacaaayctttctcctgttaatgccctgacaaggccagaagtaaagaagcctgctaacttggttcagcagagtttgaactgacttttactctctaaccccttttggctgaaacccccttgtgtcagacccaggcctctctgcccccacacccactcctgaaccttctcctgttgtcctcatagatcaggggagggaccccaggaggctgcgtttccagctgctctgctcttctgtggctccagctctctctggtccccatcttatgctagggaccccttggctctcctccctccttcataagaggga

SEQ ID NO: 188279 - DNA, 601 bp, Human
ttggctagatcagcatttttcaaaaagttactacttttccaaaatgttctgcaagaaaaggccgtagaagcactttctattctattcctctctttgaggtttacaaacctttctcctgttaatgccctgacaaggccagaagtaaagaagcctgctaacttggttcagcagagtttgaactgacttttactctctaaccccttttggctgaaacccccttgtgtcagacccaggcctctctgcccccacacccactcctgaaccttctcctgttgtcctcatagatcaggggagggacccyaggaggctgcgtttccagctgctctgctcttctgtggctccagctctctctggtccccatcttatgctagggaccccttggctctcctccctccttcataagagggaacgtggcttcctgcagttgccaatccatgggctgcctcaccacgacctgcttggccgtgtagccctcccgcttctgtgccaccagatccctgcattaaatcccctctgttgtaaactcttgcagaaggttctctgttccaggttggaccctcattgctaaaggctcttaattccctggaacacagttgagaaa

SEQ ID NO: 188280 - DNA, 601 bp, Human
ctctctggtccccatcttatgctagggaccccttggctctcctccctccttcataagagggaacgtggcttcctgcagttgccaatccatgggctgcctcaccacgacctgcttggccgtgtagccctcccgcttctgtgccaccagatccctgcattaaatcccctctgttgtaaactcttgcagaaggttctctgttccaggttggaccctcattgctaaaggctcttaattccctggaacacagttgagaaaccccaggctagataattcccaagacgattctttttaaattttttgktaatgcagcttaatttgacacattgacgtataaggaacagcttaaagtgtacagttcgataaacttagacataggtaggcatggctgcaaccatcatggcagggaagatggtgaacacattctgagctacactttaaagcatctcctgtgctagggaatgaaatcatcactcccaacacacaggaagtgctgtgcaaagtcccatctttcatcgacaccttggctcttcttgcttttctcttatgggctttgtacatccttaagaatggaatttgctgaagatcctcatggcttgttttc

SEQ ID NO: 188281 - DNA, 601 bp, Human
ccccttggctctcctccctccttcataagagggaacgtggcttcctgcagttgccaatccatgggctgcctcaccacgacctgcttggccgtgtagccctcccgcttctgtgccaccagatccctgcattaaatcccctctgttgtaaactcttgcagaaggttctctgttccaggttggaccctcattgctaaaggctcttaattccctggaacacagttgagaaaccccaggctagataattcccaagacgattctttttaaattttttggtaatgcagcttaatttgacacattgacrtataaggaacagcttaaagtgtacagttcgataaacttagacataggtaggcatggctgcaaccatcatggcagggaagatggtgaacacattctgagctacactttaaagcatctcctgtgctagggaatgaaatcatcactcccaacacacaggaagtgctgtgcaaagtcccatctttcatcgacaccttggctcttcttgcttttctcttatgggctttgtacatccttaagaatggaatttgctgaagatcctcatggcttgttttcttggatcagagaaccatggggtcaaatc

SEQ ID NO: 188282 - DNA, 601 bp, Human
gtgctagggaatgaaatcatcactcccaacacacaggaagtgctgtgcaaagtcccatctttcatcgacaccttggctcttcttgcttttctcttatgggctttgtacatccttaagaatggaatttgctgaagatcctcatggcttgttttcttggatcagagaaccatggggtcaaatcttcatagggtcaagcctgctcttggcaactgtgattgacctttaccctatgtctcactttccacattgattttgggaaataataataaaaataggcagacttcttttctaattttggaakcaagtgtctgggggtagttttgcgttgtggtgaccctgtcagcattttgtttctaaagactgaaatttagaagatttgatcctgccggaacacagcacaaagatgcttccctgtgtttctgttttaaatttgggcaatttgggtagggcacaaatccaagaactctaggaaagtagactccaatttacccctgacattttccctatgctcatccttctccaaatattctggaagcttaaatagaaactgcatttttttctgcacaaaaatacaagtactgtatttctttatggccttttg

SEQ ID NO: 188283 - DNA, 601 bp, Human
gccttgacttttgcactggtctctctgctgtgaatccctccctgcatccctgacaggctggcttttctgtggtgcaggtgtgatctgttagtcctcctccatcaccttcattggctcctgtggccactagattaagctgatgtctctgaggtccaccctgtccatctcttctactcatctttccatatgctgttatccagccagcacactctgctctgtgattttgcctatttacctggtgaaactgcccactgccacattctcaattctgttttttaaaccccagttcaaatgccatctygttaagaaaggctttctgaaatttgcttacccatgtgccatggctctttagaagaacatttggggccaaatgacaggggacttgtcctatgcagagaggcatggagcagcattctttattatcattattattattattatttttgtagagacagggcctctctgtcacccaggctggaatgcagtggtgcgattataggtcactgcaaccttgaactcctgggctcaagtgatcctcccacctcagcctcttgagtagctggactactaggcgtgtaccaccatgcctggctagttgttt

SEQ ID NO: 188284 - DNA, 601 bp, Human
tgcctatttacctggtgaaactgcccactgccacattctcaattctgttttttaaaccccagttcaaatgccatctcgttaagaaaggctttctgaaatttgcttacccatgtgccatggctctttagaagaacatttggggccaaatgacaggggacttgtcctatgcagagaggcatggagcagcattctttattatcattattattattattatttttgtagagacagggcctctctgtcacccaggctggaatgcagtggtgcgattataggtcactgcaaccttgaactcctgggytcaagtgatcctcccacctcagcctcttgagtagctggactactaggcgtgtaccaccatgcctggctagttgttttaattttttgtagagatggggtctcattatgttgcccagactagtctcaaactcctgggctcaagtgatcctcccacctcagcctcttgagtagctggactactaggcgtgtaccaccatgcctggctagttgttttaattttttgtagagatggggtctcattatgttgcccagactagtctcaaactcctgggctcaagcgatcctcctgctttggcctcca

SEQ ID NO: 188285 - DNA, 601 bp, Human
ccatgtgccatggctctttagaagaacatttggggccaaatgacaggggacttgtcctatgcagagaggcatggagcagcattctttattatcattattattattattatttttgtagagacagggcctctctgtcacccaggctggaatgcagtggtgcgattataggtcactgcaaccttgaactcctgggctcaagtgatcctcccacctcagcctcttgagtagctggactactaggcgtgtaccaccatgcctggctagttgttttaattttttgtagagatggggtctcattatrttgcccagactagtctcaaactcctgggctcaagtgatcctcccacctcagcctcttgagtagctggactactaggcgtgtaccaccatgcctggctagttgttttaattttttgtagagatggggtctcattatgttgcccagactagtctcaaactcctgggctcaagcgatcctcctgctttggcctccaaaagtgctgggcttacaggcatgagccaccagacccagcctagagcagcattctaatttctgatgcctgtttgcagctgagctgcatgaggcttcaacgaaggagtt

SEQ ID NO: 188286 - DNA, 601 bp, Human
cagactagtctcaaactcctgggctcaagcgatcctcctgctttggcctccaaaagtgctgggcttacaggcatgagccaccagacccagcctagagcagcattctaatttctgatgcctgtttgcagctgagctgcatgaggcttcaacgaaggagttggaggtctgaagttccagcgttggctctgctacccctcagctgtgggatttggtgaatcaccttcaacactgacttctctgattcctatcctattaaaatgttttattcatctttgacacatccctcctccccccaagtgcytagcatggtgcctttccttcatcgatacccaataagtgcacattgaataaatgtcagtttctcaaaaataaaactggtgtatgccgtctccttccattctctcattacaaataacatcaagcatttgaacgagagaattacaaactgtgaagcatgtgtgctattataagaaatgcttattaagttctgtatgtggcagtggttataaaaagggaaaagagaagttaccttcttgcagggtttatgttctgtgactttctaaatttttttaaaggctttgggaagaagaaatattatttt

SEQ ID NO: 188287 - DNA, 601 bp, Human
tgacataatgtctattgaagcaaagtcacttagctccccgctaggcaacagggagcatttaaaaactgaaaactgatcaaagccatgggcaggattgagatacctttacccagggggcgggtggtctcttggttcgttgcccgaaacagatgtgcattattgcttcactgtatttccagaccattggtgaaatgaatcaggcagaattaaaccctgagtggccaatccggagagcctgcttaagtgggcacaagtgtgtccaaataggttggaaaaaatgtcaaatcagagtaggcgcatwcaagatgtgatgtttctctttttatagactgctataaaagttgtttaaaattaaacaacccttcagtacttaaattatgtataatgagacaggtaggtcctggaacagagatctttcccccccttcttatcccacttaaattttgcactccctaccagagtatgtgagatataaacactttcatttccaggatatagtgtagtcttaggatggagcaaagggagagagagagatggcttgacatagaccacagaagtagcaaatatctttcacattttattccatgaacttcaaggatgt

SEQ ID NO: 188288 - DNA, 601 bp, Human
gacataatgtctattgaagcaaagtcacttagctccccgctaggcaacagggagcatttaaaaactgaaaactgatcaaagccatgggcaggattgagatacctttacccagggggcgggtggtctcttggttcgttgcccgaaacagatgtgcattattgcttcactgtatttccagaccattggtgaaatgaatcaggcagaattaaaccctgagtggccaatccggagagcctgcttaagtgggcacaagtgtgtccaaataggttggaaaaaatgtcaaatcagagtaggcgcatamaagatgtgatgtttctctttttatagactgctataaaagttgtttaaaattaaacaacccttcagtacttaaattatgtataatgagacaggtaggtcctggaacagagatctttcccccccttcttatcccacttaaattttgcactccctaccagagtatgtgagatataaacactttcatttccaggatatagtgtagtcttaggatggagcaaagggagagagagagatggcttgacatagaccacagaagtagcaaatatctttcacattttattccatgaacttcaaggatgta

SEQ ID NO: 188289 - DNA, 601 bp, Human
tgtcctatcaagtggtaatcttctgtattttacacttccaaaatatatgtagatatagaggaaggtgtattctatagtgtatactccctctacccccctcccaaataagtagtttattgctgttttgctttttattttggggggctgtatttaggaacgaacaatagtatataatgttgcattattcagggttgacaaggttaatgtgtcttgacaatcgaaatatctgtgccctttttttccatttggccggcttctgttagaatcatttatcttgtgcctgtaggatgcaatctaactrgggcactgctattctcctctcagtgttggatgacatgagatgctcttttctgaagccaatggattgggcatctctgatttcttgttcacctagaggactttgttttcagggcaggataaatgcttgtttattctcatgcatgcatgctctccctccctctctcattgaacgtgatgttttcgtggccccttggtgcttgagacctggctcataggaagctgaactcagaatcaaaacttctcctgaggtgccacctagcatcactaaccccagagatgaccggggtagccctgttaacac

SEQ ID NO: 188290 - DNA, 601 bp, Human
tataatgttgcattattcagggttgacaaggttaatgtgtcttgacaatcgaaatatctgtgccctttttttccatttggccggcttctgttagaatcatttatcttgtgcctgtaggatgcaatctaactggggcactgctattctcctctcagtgttggatgacatgagatgctcttttctgaagccaatggattgggcatctctgatttcttgttcacctagaggactttgttttcagggcaggataaatgcttgtttattctcatgcatgcatgctctccctccctctctcattgarcgtgatgttttcgtggccccttggtgcttgagacctggctcataggaagctgaactcagaatcaaaacttctcctgaggtgccacctagcatcactaaccccagagatgaccggggtagccctgttaacactacacaaataaaatatgtcaccagaacatttcactgagatgaggaatttatttccatgattctctaaggttcaactatagtacatgctgctttttcctactgggcagcaaacatgttttactaaactcttacctaagtgctttctgtttacaattccacaatgaattcc

SEQ ID NO: 188291 - DNA, 601 bp, Human
cattaaagttcaatgtttatagatttttgaggtaaaatttctatacaatgaaatgcacatttcttaagcataccatttgatgagttttggtgtgtgtatacaccactgtaacccaaacctctgtcaagatacagaacattactagaaagttccctcaggctgcttgttatctgccctgagcatgggtggtccaggagtcacccagaatttaggaccataactctcttcatctttcctttctgaggttcccttcctttctgggatgccccagatctgttctctgattctccgggcagaaagrctgttggtttcctgttggcattcctgctggccagcctggtgcagaccaggccctccctttaagccagaagtcatgaaattgggaaatacatacagtgctgtttcccgcctccagtatcagtgcccagaatgtgcctagttttggtcaatctccagtgccttcaggtagctgggtgttattttttaaaaatcatttttgccagagtttatgtttctaatctgtgggagggtcagtccaataggatcgtattggccattgccagaaatggaactctgttcattgttttaataattttctgtg

SEQ ID NO: 188292 - DNA, 601 bp, Human
gctggagtgcagtggtgcaatcatggctcaaggcggcctcaaactcctgggctcaagcgatcctcccaccctagcctcctgagtagctggggctacaggcgtataccaccacactcagctatttctttttttgtagacatggggtctcactatgttgcccaggctggtgccttaattcctggcctcaagggatcctcctaccttgtctttccaaggcactgagattacaggcgtgagccaccatgctcagccttgaataaaaggtttttaaactcagggagtgtcttcagtgttagacatsacagagttaatttggttgtccagtgtttattggtccctttcaaggcactgtggtgagtactggctgcagtagggagggggcaggatgaggatacaaatgacaggaagatgtggcagctggcttgagggaaggaggagatgcacagacagctggcccaaacagagcatgatggtatctatgatagaggtgaaaaaaaaaagaggccgggtgtggtggtgcctgcctgtaatcccagctattcgggaggctgagacaggagaatcacttgaacccaggaggcggaggttgcagtgggccgag

SEQ ID NO: 188293 - DNA, 601 bp, Human
tagctggggctacaggcgtataccaccacactcagctatttctttttttgtagacatggggtctcactatgttgcccaggctggtgccttaattcctggcctcaagggatcctcctaccttgtctttccaaggcactgagattacaggcgtgagccaccatgctcagccttgaataaaaggtttttaaactcagggagtgtcttcagtgttagacatgacagagttaatttggttgtccagtgtttattggtccctttcaaggcactgtggtgagtactggctgcagtagggagggggcargatgaggatacaaatgacaggaagatgtggcagctggcttgagggaaggaggagatgcacagacagctggcccaaacagagcatgatggtatctatgatagaggtgaaaaaaaaaagaggccgggtgtggtggtgcctgcctgtaatcccagctattcgggaggctgagacaggagaatcacttgaacccaggaggcggaggttgcagtgggccgagattgcgtcactacattccagcctaggtggcaagagcaaaactgtctcaagaaaaaaagagagagagagaatattgagggagca

SEQ ID NO: 188294 - DNA, 601 bp, Human
aagaggccgggtgtggtggtgcctgcctgtaatcccagctattcgggaggctgagacaggagaatcacttgaacccaggaggcggaggttgcagtgggccgagattgcgtcactacattccagcctaggtggcaagagcaaaactgtctcaagaaaaaaagagagagagagaatattgagggagcaccaaggaaggtatggttaagttcagggtacatgacattcaggctgagcgtggaaagagaatttggatttcccttggtaggtatagaggcaaaggcattcccgccggaggaatgcrtcaggggcagtgttgattcgatggtgctgcgggagccctgagaggtccgaggtgcctgaatccgagcgtgagtggctactggtgctggcacagtactcggcaggggaagagattgcaaaggtaggctgacgccagatgctgagggataatgaagccagtctaaggagtttggactttattttgtaggcaatgaggaactatttacaactttttagtaagactgtggaatgactgatgtgtgctttgggagatattcctggctgcagtgtggaagaggcctgaaatgggagacgaactggg

SEQ ID NO: 188295 - DNA, 601 bp, Human
tcccttggtaggtatagaggcaaaggcattcccgccggaggaatgcatcaggggcagtgttgattcgatggtgctgcgggagccctgagaggtccgaggtgcctgaatccgagcgtgagtggctactggtgctggcacagtactcggcaggggaagagattgcaaaggtaggctgacgccagatgctgagggataatgaagccagtctaaggagtttggactttattttgtaggcaatgaggaactatttacaactttttagtaagactgtggaatgactgatgtgtgctttgggagataytcctggctgcagtgtggaagaggcctgaaatgggagacgaactggggcatttttgcaattgtctaggtaacatcccccctcccgtttaatctgtatttacagcatttgagggtctttttgaaattttaaaatagtttacattttttctttcctgcaattaaatttagactgtttaaccaagaggggcaattaggtgacaaatttgtgaattgcacccaagagatgaaaacttgtggaaaaagtactaattccagtaactaaaatctgaaaggttacgatttaaatagacatttaaataga

SEQ ID NO: 188296 - DNA, 601 bp, Human
agtaagactgtggaatgactgatgtgtgctttgggagatattcctggctgcagtgtggaagaggcctgaaatgggagacgaactggggcatttttgcaattgtctaggtaacatcccccctcccgtttaatctgtatttacagcatttgagggtctttttgaaattttaaaatagtttacattttttctttcctgcaattaaatttagactgtttaaccaagaggggcaattaggtgacaaatttgtgaattgcacccaagagatgaaaacttgtggaaaaagtactaattccagtaactmaaatctgaaaggttacgatttaaatagacatttaaatagacttaacccgatcctcctggaactctttccctcattcctccttacaattaaaaacacacctttgtgagctggttgcttagaattaggagtgtcatctgccgtcacggtgcagacggtattcgcgtctttgaagctagttggcccacgggaaacttcatcagtgagctgggccttgttcacaggtgctcagccacctgaaatgaccagattgaaatccagcttcattttccacctggtttgtctccactctgttggccaact

SEQ ID NO: 188297 - DNA, 601 bp, Human
ggcctctggaagctgggaagggccctgagctgacagccagcaaagaaatggggagcccagctctgtacttgtgaggagctggattctgccaacaacctgaatgagcaaggaaacatatcctccctcttccctccagataggagcacagtcctgctgacacctggttttcagcacagggagacccctgttggacatttttttctttttcagacaaggtcttgctctgttgcccagactggagtgcagcggtacaataatggctcactgtagcctcaacatcccgggctcaagcgatcctctygcctcagcctccccagtagctgagagtacaggcatgcactaccttgactagctaatttttttttttttgtagagatggggtttctccatgttgcccaggctggtcatgaactcctggcctcaagcgatcctcctgcctcagcctcccaaagtgctgggattataggcgtgagccactgtgccaggctatggacttctaacctgcaggcctgtgagagaatacatttgtgttgttctgagctgctcagtttctgaaggcagcaataagaaatgaatacagtgttatttatacagggctttg

SEQ ID NO: 188298 - DNA, 601 bp, Human
tgtttggttttcggtgagttttcctctctgtgctccagtttagcactgtgaaatggaaataataaatgcattgggttctcagggtggttgggaggattgagataatacatgtaaagagcctagcccagtggttggtacctcttaagtactcagtagttagaagcttttattagagttgtttgcaataaggggccattaaaaagatcttcctgttccatacctgtcatactatttcagacatcattctcttatgctaagagcaggaaaccatcaaaaagaaaactggaacagtttaggcagygcttactgggtttctgaggtctagaaagcacttatatatgatggaccctctggcacttgagcagctcatgcttatgagagaaacctacgaggctgaagcattatgtcaatgcaggggaaaatgaagtagaacccttgggggctatgccagtttggaggaccacaaataccccgtgaataagctcagttcctacagtcagcttctgactggggcggagatgtttcccattattaagcttaccgaggtgaatgatcaagattcattgccagtgtccagataatcatcatgtcctgagaaata

SEQ ID NO: 188299 - DNA, 601 bp, Human
gggaggattgagataatacatgtaaagagcctagcccagtggttggtacctcttaagtactcagtagttagaagcttttattagagttgtttgcaataaggggccattaaaaagatcttcctgttccatacctgtcatactatttcagacatcattctcttatgctaagagcaggaaaccatcaaaaagaaaactggaacagtttaggcagcgcttactgggtttctgaggtctagaaagcacttatatatgatggaccctctggcacttgagcagctcatgcttatgagagaaacctacsaggctgaagcattatgtcaatgcaggggaaaatgaagtagaacccttgggggctatgccagtttggaggaccacaaataccccgtgaataagctcagttcctacagtcagcttctgactggggcggagatgtttcccattattaagcttaccgaggtgaatgatcaagattcattgccagtgtccagataatcatcatgtcctgagaaatatttccaattccttagtcgtgcaatttcagaatgtcatgctcccataatttccatagtcctctaatgctcttgcatctcaccataccccc

SEQ ID NO: 188300 - DNA, 601 bp, Human
cctgtcatactatttcagacatcattctcttatgctaagagcaggaaaccatcaaaaagaaaactggaacagtttaggcagcgcttactgggtttctgaggtctagaaagcacttatatatgatggaccctctggcacttgagcagctcatgcttatgagagaaacctacgaggctgaagcattatgtcaatgcaggggaaaatgaagtagaacccttgggggctatgccagtttggaggaccacaaataccccgtgaataagctcagttcctacagtcagcttctgactggggcggagaygtttcccattattaagcttaccgaggtgaatgatcaagattcattgccagtgtccagataatcatcatgtcctgagaaatatttccaattccttagtcgtgcaatttcagaatgtcatgctcccataatttccatagtcctctaatgctcttgcatctcaccatacccccatctctaggattgtgaatttcctgctatgttatgatgatgtcctaatcctggaatcagtagaggatgaatctgtcaaagcaaaaaatcgagaaatcctgtattatttagcagcatcaggtgtcttggtaa

SEQ ID NO: 188301 - DNA, 601 bp, Human
cagacatcattctcttatgctaagagcaggaaaccatcaaaaagaaaactggaacagtttaggcagcgcttactgggtttctgaggtctagaaagcacttatatatgatggaccctctggcacttgagcagctcatgcttatgagagaaacctacgaggctgaagcattatgtcaatgcaggggaaaatgaagtagaacccttgggggctatgccagtttggaggaccacaaataccccgtgaataagctcagttcctacagtcagcttctgactggggcggagatgtttcccattattargcttaccgaggtgaatgatcaagattcattgccagtgtccagataatcatcatgtcctgagaaatatttccaattccttagtcgtgcaatttcagaatgtcatgctcccataatttccatagtcctctaatgctcttgcatctcaccatacccccatctctaggattgtgaatttcctgctatgttatgatgatgtcctaatcctggaatcagtagaggatgaatctgtcaaagcaaaaaatcgagaaatcctgtattatttagcagcatcaggtgtcttggtaaaagaggaaagacctg

SEQ ID NO: 188302 - DNA, 601 bp, Human
gacaagagcttagcgctttcctgcagatttccattgtccacagtgtgtttcatctacaaaaggcaatcactgatgaacccttgtacctccaccggggaggggtggagatcaggattccacgtcaccaatatgatttgcagagtatgaagctgtgcttagctcggattgccagtatcaggaaaattcagtatttttctaaccaactgttgttttatcttatgaatattgagactcttataaatgaacatgtttctatattctttggtcacttcaaaagtcagatcaacctctctttatcatrtggtatttagtatcctatattaactgtatcttattttcttgccccattttcccttcattcctatttccacatatgttcaatgtttattccataaaatggtatttctataagttgtctcagatctattttcagaacgaggcaggagcaaaacgaattactgctcaaaatcaataataaatggtcaaaggaactatagcctgttgtcatgggagccagtaggtcccacacctatctctatggtcatgcctttgggactctcctctgaggatgagcctacaccctgtattatgtcaccatatg

SEQ ID NO: 188303 - DNA, 601 bp, Human
ttccataaaatggtatttctataagttgtctcagatctattttcagaacgaggcaggagcaaaacgaattactgctcaaaatcaataataaatggtcaaaggaactatagcctgttgtcatgggagccagtaggtcccacacctatctctatggtcatgcctttgggactctcctctgaggatgagcctacaccctgtattatgtcaccatatgtgtggggctggagtcttttgccaagtggttatgtgtcaggcacagccctgagtgcagacgggacaccgtgacattgcctggttgatkcattgtgaaggcatcactaccaggtttgacttgacatttaactttcttaaagtatggttcatggataatgagcatcagaatcaatggaggggcttactcccagagatttcaatttagtatgtctgatctgggaccaaggaatccgcattttaagaagcatcccagatggtttttaatcaagtggttcatgggccagattttgagaagtactgccttaaagggttggtaggatttaaagaggcagaggtgtgcacttcagagtatagaacgggtggaaacagaggcacagattctggcaat

SEQ ID NO: 188304 - DNA, 601 bp, Human
ctggacctctgagtaattgatgacataaaatgatgcagaatctcagaagttatttaatggtgtacctttgaatggtgtatacatctccttcagcacaattctaagctggggtcctttaagagctgcttaaacgcttccagctacaggaaactcactacttcacaaacacacttcatttgaattttgtactgtgatagttgatagctttctactcagtggaataattttctacctccttaaaacttattggtccttggtcatccttctagagcaggagttggaacatttttcttaaagggcsaaatggtaaatattttcagctttgcaggtgtgatctttgtctcagctactcaactctgtcatggcagtgtggaagcaatacttcaacaaacagacatggctgtattccattgaaacgttatttataaaactaggtggctggctcatgagctgtagcttggtgactctcattttagacctgtgtaatctaggtcctgaaaatgaattactcaaactcttaattccaggtgggttccctgacatataaggggcacttgctctccctttgtataggcttgatgagtgaactaagaaagtctat

SEQ ID NO: 188305 - DNA, 601 bp, Human
gctggctcatgagctgtagcttggtgactctcattttagacctgtgtaatctaggtcctgaaaatgaattactcaaactcttaattccaggtgggttccctgacatataaggggcacttgctctccctttgtataggcttgatgagtgaactaagaaagtctatctaatgccattcaactaatcttatcaaagtttttaaagtcctagtagaaatgcatttgtaactggaattatctgtggttctaaatacgtacctcatgttattatggagttcaacataggttttttttttttttttttgctttttagaaggaggtcattttaatgctatataatttgttgtgtgtgccagaaagccataacttcaggaaggtgcttttagtgttccatcattgagctttctgggatgggaggtggcaatctggaggtgagaaagatacaggtgaacaaaaatctttgccctaaaagtgtagactatttttatggttctgaatacagccctcctttcagatccgtggattataatttagatatcagcacagaatagctatctgaagcattgctcatgtgttttcccccttttctcttggctcttctgta

SEQ ID NO: 188306 - DNA, 601 bp, Human
catgttgcctaggtctcaaactcctgagctcaagcgatctgccctcctcggcttcccaaagcgctgggattagaggcatgagccaccacgcccagcccaaatctttactggctttctttgtacttgctctatcaattactggatgttgaaatctccaactataattaaggatttgtctacttcttttttcagttctgtcatttatttttccccttcctgtgttttgaagccctgttcctgggaaatccacatttaggactgttatgtctctggatgaacttgattattctctttgtccttrataatagtctttgttcagtagtcatctttgtctgaaattaatatgaccactctagctttcttttcatttgtgtgcacacggcataatgttctaaccttttttgttgttgttgtttgtttgtttgagacagagtctcgctctattgcccaggctggagtgcagtggtgcgatctcggctcactgcaagctccgccccccaggttcaagccattctcctacctcagccccctgagtagctgggattacaggcacttgccaccacgcccggctaatttttttgtatttttagtagagaccggg

SEQ ID NO: 188307 - DNA, 601 bp, Human
tttcttttcatttgtgtgcacacggcataatgttctaaccttttttgttgttgttgtttgtttgtttgagacagagtctcgctctattgcccaggctggagtgcagtggtgcgatctcggctcactgcaagctccgccccccaggttcaagccattctcctacctcagccccctgagtagctgggattacaggcacttgccaccacgcccggctaatttttttgtatttttagtagagaccgggtttcaccgtgttctccaggatgatctccatctcatgacctcgtgatctgcctgcctyggcctcccaaagtgctgggattacaggcgtgagccaccgcgcccggactaattttctaacctttttaacttttaacttatctgtgtctttagtctttatatataaagtgggtttctcataaataacatagagttaggtcttgtttatttcttgaagcaacctaacaatttctgccttttaattggtgtgtttagaatatttacatttaatgtgattattgatgtgtctgggtgtaaatctaccatcttgctatttgttttctatttgtcccatctgttctttgttcccttcccccctttt

SEQ ID NO: 188308 - DNA, 601 bp, Human
tgttctccaggatgatctccatctcatgacctcgtgatctgcctgccttggcctcccaaagtgctgggattacaggcgtgagccaccgcgcccggactaattttctaacctttttaacttttaacttatctgtgtctttagtctttatatataaagtgggtttctcataaataacatagagttaggtcttgtttatttcttgaagcaacctaacaatttctgccttttaattggtgtgtttagaatatttacatttaatgtgattattgatgtgtctgggtgtaaatctaccatcttgctmtttgttttctatttgtcccatctgttctttgttcccttcccccctttttctgccttcttttggattgtgtattttttgtgattttattttatttccactactggtttagacctttatgttttatttatttttagtagttgctctaaggtttatagtatatgtgcttaacttaccacagtctgtttttaaatattttaccacttcacgtagaatgtaagaattttacaacagtatacttcaatttccttcttctgttctttgtactattgttttcatatattttatttctgtttatgttac

SEQ ID NO: 188309 - DNA, 601 bp, Human
tagtcagattggattaagggcccaccctactccagtatgacctcatcttaattatatcaacaaggatgctatttccaaataatgtcacattctgaggttctgggaaggacgtgaattttggggggacactattcaacctagtacctatggcaactgtgagtcccaaagttgctttgatcccttgataaggaaattctttatgctgagataagactagtttcagatatgctgcctgcatcatttccagactgctctccctacgtctctgcaccctacctggtaatctgtgagtgttctttcrtaattatacaatgtatccacagcttcatcttcatagatcaggaatgcccatttccttgcaggttccctgtctattcctgaacttcagggcagtgagaaaattccatcttgtgtgccactgaatgcccttcgtagcttcagtcataactgttcatcatcactctctcaccctgctaaaatgcccactctgaaagtttgtctatttcagaatcttgcctctaattatcttcacaagtttcctttgtgatgcactgccctagaagtggctcattttccatatcaaagttctgcagatgagaaa

SEQ ID NO: 188310 - DNA, 601 bp, Human
atgctcacacgcacatgaggtgcagccactgtccccttctctgtgtgctcccttgtccacggatgcatttgtggttggaggggagtcggtgcagccatggtagaatagaggtcctcgtgtaagactaacatgagtggtctatttactcatctgtgctgcccactagaccaagagctcctaagagcagagactgtcttattcttgtttatatcttcaatgtccagcacagtgtctgctcaggacagccattgaattatctcctgaatggttagatggtataaggaaggcttcccttaaagartatcttgccgctgtcttgggatttgacattcaatgaatcaggagatgattcttgaagtttcatatccgttaagttcctcattaccatgtatgtatgtatgtatgcttgatactagtaatatcatcaatcttaccaggaacgtggtgtccccaggaaggtcatacattgccacagaatctggccaaatggttccttgagcagttccacgtggaggggacgtctgtgcacatgagtagataaaaaatgcaagcaatgttgttgaaagttagaactcagcttttttccccttgaggtcctcgg

SEQ ID NO: 188311 - DNA, 601 bp, Human
tgcaagcaatgttgttgaaagttagaactcagcttttttccccttgaggtcctcggccaccactcagctgctgaaatccagaacactttggttctagtcctggttctgacatgaatgccctggtgaccttcgattcacttaacctttccagaccctagttttgcctcatcagcaaaacacatgctctttaaggcccttataaccctaaactcttgccttgaacctgctttgagttttaagtaatgaacacatgagactaaacaaatcagattttaaaagcttgagtgaaataaaagaattwaaaaaaaagaagtgaattttaaagactaatttctttcttcttctttttttttttttttttttttttttggagactgaatctcactctgttgcccaggctggagtgcggtggcacaatctcaactcactgcggcctctgcctcccaggttcaagcagttctcctgccttagcctcccaagtagctgggattacaggtgccagccaccatgcctggctaatttttgtatttttagtagagatggggtttcaccacattggccaggctagtctcagaactcctgacctcaggtgatctgccta

SEQ ID NO: 188312 - DNA, 601 bp, Human
tctttcttcttctttttttttttttttttttttttttggagactgaatctcactctgttgcccaggctggagtgcggtggcacaatctcaactcactgcggcctctgcctcccaggttcaagcagttctcctgccttagcctcccaagtagctgggattacaggtgccagccaccatgcctggctaatttttgtatttttagtagagatggggtttcaccacattggccaggctagtctcagaactcctgacctcaggtgatctgcctaccttggcctcccaaagtgctgggattacaggygtgagccactacacctggcctctttcttaattttatctaagaaagcagaatttcacatcttaatttttatttttcaacttttttttttttttttttttagatacaagatctcgctctgtcacccaggctggagtacagcgattatagcttactgcagcctcgaactcctggcttcaagtaatcctcccaccccagtctcccaaattgctgggattataggaatgagccagtgtacctgaccttcaagtatattttttgaggtggtatgatagactagtgaaattgaaacaggaactgtga

SEQ ID NO: 188313 - DNA, 601 bp, Human
cggcctctgcctcccaggttcaagcagttctcctgccttagcctcccaagtagctgggattacaggtgccagccaccatgcctggctaatttttgtatttttagtagagatggggtttcaccacattggccaggctagtctcagaactcctgacctcaggtgatctgcctaccttggcctcccaaagtgctgggattacaggtgtgagccactacacctggcctctttcttaattttatctaagaaagcagaatttcacatcttaatttttatttttcaacttttttttttttttttttttagatacaagatctcgctctgtcacccaggctggagtacagcgattatagcttactgcagcctcgaactcctggcttcaagtaatcctcccaccccagtctcccaaattgctgggattataggaatgagccagtgtacctgaccttcaagtatattttttgaggtggtatgatagactagtgaaattgaaacaggaactgtgaaattataatttatttgttccttttcctaaatacctttgtcagtctgcatgtgaattaaagtaattatttactttatatcagagtagagcaaggaacac

SEQ ID NO: 188314 - DNA, 601 bp, Human
aggtgccagccaccatgcctggctaatttttgtatttttagtagagatggggtttcaccacattggccaggctagtctcagaactcctgacctcaggtgatctgcctaccttggcctcccaaagtgctgggattacaggtgtgagccactacacctggcctctttcttaattttatctaagaaagcagaatttcacatcttaatttttatttttcaacttttttttttttttttttttagatacaagatctcgctctgtcacccaggctggagtacagcgattatagcttactgcagcctygaactcctggcttcaagtaatcctcccaccccagtctcccaaattgctgggattataggaatgagccagtgtacctgaccttcaagtatattttttgaggtggtatgatagactagtgaaattgaaacaggaactgtgaaattataatttatttgttccttttcctaaatacctttgtcagtctgcatgtgaattaaagtaattatttactttatatcagagtagagcaaggaacaccgtctttccaccttgactttgctgctctgggtgactttgggcaagtagtttagctctcttgga

SEQ ID NO: 188315 - DNA, 601 bp, Human
tgctgggattacaggtgtgagccactacacctggcctctttcttaattttatctaagaaagcagaatttcacatcttaatttttatttttcaacttttttttttttttttttttagatacaagatctcgctctgtcacccaggctggagtacagcgattatagcttactgcagcctcgaactcctggcttcaagtaatcctcccaccccagtctcccaaattgctgggattataggaatgagccagtgtacctgaccttcaagtatattttttgaggtggtatgatagactagtgaaattraaacaggaactgtgaaattataatttatttgttccttttcctaaatacctttgtcagtctgcatgtgaattaaagtaattatttactttatatcagagtagagcaaggaacaccgtctttccaccttgactttgctgctctgggtgactttgggcaagtagtttagctctcttggaccatagttttacttatttatttatttatttgtttctttgagacagagtcttactctgtcacccaggctggagtgcagtggtgcagtctcagctctctgcaaccttcacctcccgggttccagcg

SEQ ID NO: 188316 - DNA, 601 bp, Human
gaaacaggaactgtgaaattataatttatttgttccttttcctaaatacctttgtcagtctgcatgtgaattaaagtaattatttactttatatcagagtagagcaaggaacaccgtctttccaccttgactttgctgctctgggtgactttgggcaagtagtttagctctcttggaccatagttttacttatttatttatttatttgtttctttgagacagagtcttactctgtcacccaggctggagtgcagtggtgcagtctcagctctctgcaaccttcacctcccgggttccagcrattctccctgcctcagcctcccaagtagctgggattacagacgcctgccaccacacccagctaatttttgtatttttagtagagatggggtttcaccatgttagccaggctggtctcaaacttctgacctcaggtgatctgcctgccttagcctcccaaagtgcggggattacaggcgtgagccaccgtgcctggctggaccgtagtgttttaacatgtgaaagtagatgtctggtgaataaaagttaaagtaaagttttgaatgcatcaaaaacgtctctttgaaataagtgctgttat

SEQ ID NO: 188317 - DNA, 601 bp, Human
tctgttggagcttatgagtcagattactgttaccaaaatgtttgtgaaatcacttcttaagtcatatatttgcatcatgtacaacctgtttgacaatcaaaacattatgcccttcagcacttggctggttatgatagtaagttttccagtagagtgttccagcagaatataattgggcagtagacagaaggagcacagtatattattttaacatagaattccaagtgcatttctcttcttgtaagattgagaaggacacataatattctgtaatagactcagggtgatcaattaatagcayagagaaattccagtgcagctggggcattaccaagtgcagccctggagccaacaggggtggatggaaggatggaatggccggaacacaagacgcagacatggccactgacacagcactgcctgtctgtgttggtcagtatctcaggcacctgctgacactggctgttctttacctgctcttggccaaccttcaaggcccatctcaaatggtggctccttcaaaaaggcttcattgatatcttcagagtagacttagagactccctttcctcaaagtctttacggcattttctttgtacttt

SEQ ID NO: 188318 - DNA, 601 bp, Human
ttggatttcttttcttttctttttttgagacggagtctgactctgttgcccaggctggagtgtagtggtgtgatctcagctcactgcagtggcgtgatctcagctcactgcaacctccactttctgagctcgagcaattctcctgcctcagcctcccgagtagctgggattacaggcgcccgccaccatgtctggctaatttttgtatttttagtagaaatggggtttcaccatggtggccaggctggtctcgaactcctgacctcaaatgatccacctacctcagcctcccaaagtgctrgcattacaggtctgagccactgcacctggccaaccttggatttcttaaaaggaaggggttgtatcttgattaaggtgtgagtggtcaaatgtcaatgcagtgttattatatgtcatttttcaaaggacacatccaaattcagccagtgacatcctgggttgacacttgaaggtctgctttaatgatcttgaaggtttgctttaatgatcttgaaggtttgctttaatagtctttcgcagtagtcctgggcactgacttttgctaaggcatgacgtgggggaattcaaacttctatgcagt

SEQ ID NO: 188319 - DNA, 601 bp, Human
aaacggcacataaattctatagaaatataagcttcatccccagcttactaaataaatattctttctagctctgaacataattgcatctgtaacaatccttatattctgattaaataaaaagatgcaactcaatgtgcatgtctgagtgtgtgtccacgcattttaagtgtttttccagtgcccataatatgtcttatcaacatattgattttctgtccatattctcgcagttcttctccaggggataggagtatgttgctagaggggatcttaatagttggcttgatgtttaagccgccgkgcgacgcagatgtgcagccagctgaagtccgttttgcaatgacggtatcctgggagtctggaggagaaaccttttaacgactgtgagatgtagccacagcccataaaacatggccgtgcggcaggcgcccagctctccacctgacctgtaaactcctatgcgcctttgcatccccacactctgctttgcagatactcttatgaattctgcaagtcttggtaaataggttagcttttagaaacctgtgttttaaagtacaaagcatgcatctcagatgcgagtttagaacttggagaaagt

SEQ ID NO: 188320 - DNA, 601 bp, Human
taaataaaaagatgcaactcaatgtgcatgtctgagtgtgtgtccacgcattttaagtgtttttccagtgcccataatatgtcttatcaacatattgattttctgtccatattctcgcagttcttctccaggggataggagtatgttgctagaggggatcttaatagttggcttgatgtttaagccgccgggcgacgcagatgtgcagccagctgaagtccgttttgcaatgacggtatcctgggagtctggaggagaaaccttttaacgactgtgagatgtagccacagcccataaaacrtggccgtgcggcaggcgcccagctctccacctgacctgtaaactcctatgcgcctttgcatccccacactctgctttgcagatactcttatgaattctgcaagtcttggtaaataggttagcttttagaaacctgtgttttaaagtacaaagcatgcatctcagatgcgagtttagaacttggagaaagttctcccgtgttttcagcctccactgtctgcagccaaccccaggggaggaatagtatggaagagaactcaaagaaatgaaagcacaacatacccctttactttgaaacaag

SEQ ID NO: 188321 - DNA, 601 bp, Human
aaaaagatgcaactcaatgtgcatgtctgagtgtgtgtccacgcattttaagtgtttttccagtgcccataatatgtcttatcaacatattgattttctgtccatattctcgcagttcttctccaggggataggagtatgttgctagaggggatcttaatagttggcttgatgtttaagccgccgggcgacgcagatgtgcagccagctgaagtccgttttgcaatgacggtatcctgggagtctggaggagaaaccttttaacgactgtgagatgtagccacagcccataaaacatggcygtgcggcaggcgcccagctctccacctgacctgtaaactcctatgcgcctttgcatccccacactctgctttgcagatactcttatgaattctgcaagtcttggtaaataggttagcttttagaaacctgtgttttaaagtacaaagcatgcatctcagatgcgagtttagaacttggagaaagttctcccgtgttttcagcctccactgtctgcagccaaccccaggggaggaatagtatggaagagaactcaaagaaatgaaagcacaacatacccctttactttgaaacaagaggcc

SEQ ID NO: 188322 - DNA, 601 bp, Human
tagccacagcccataaaacatggccgtgcggcaggcgcccagctctccacctgacctgtaaactcctatgcgcctttgcatccccacactctgctttgcagatactcttatgaattctgcaagtcttggtaaataggttagcttttagaaacctgtgttttaaagtacaaagcatgcatctcagatgcgagtttagaacttggagaaagttctcccgtgttttcagcctccactgtctgcagccaaccccaggggaggaatagtatggaagagaactcaaagaaatgaaagcacaacatayccctttactttgaaacaagaggcctgtaagtattcatgtaaaaagtcatggtaaaattctgtgttcttacagaatgatgatcctcttattttcaaagttgtggggaggcactcttatgggaataaaaagactccaaaaacaaaacaagaagaaaaagtatttttctacacagaaaaacttcaagaaaacatcccatcgccttttatgtcctaggcttttatccttattcttttaaaacacccattaaaaagaaagaggctggcgggtttcatgctaaaagctatttgctacaggggacaa

SEQ ID NO: 188323 - DNA, 601 bp, Human
aacctctgatggactccactggactatttactgggctgacccctctgagaagtggggacactgcccctccattttaaggaaatggcaggctcagatggtgaatgcaggtgcagtccttggccctgctaaaaggaaagaaaaaaaaatctatagaatgtggagcaaataatacaagtttgccctccatggtgaccttctctctgcccaccctcttggctcacatcaatggcaagttataattggactacaaggaccaatatattgtgtagtctagaggggaaaatgccaaaagaaaaactcygttggatcaagcgtatgtgtcctgcgttcatttctaggtctgtaaacaaacacagctgttgagtgaaggatccgtcttcagaaatggtgaaaaaacagccatgccctgccagtgagagcgcagcaggggagagttgttccagggcttgggaggagcaggcgaggcgcagcagggccgggaccatgtgtctcctccgtattccaggagaggccattctgtgttttcagctgaggctgttggagcatggagaatgatgagtgtgggaagattgggagggaagaggattctgaaatttcatct

SEQ ID NO: 188324 - DNA, 601 bp, Human
tggcttgaggcttcccttcatgccttcatttatataatagacattttcataatactctgtgcaggtaattcgttgacttcctggccaaattttttctcgatagtgggagactggtcgaaagtttgaactttggctttttgcagttgtattcctccctgctcccacttgcagtgtcgttttgagtgaatcactgcccaggcatggaccattcccgagacttgtaggcctcgagtttcccagtgattggttgatacttctgccttctgattggttgggtgagttggctggtgcagggatgctratgagcccaggattgtggatttattcccccaaaagtttaaattagtttcccagagagggggaaaccccagtttgaccacatttattattttatttgctgcctcaggattgtaggagggacaatgtaataatgtaataatctaataattggaccaactcagcagtacaggtaaagaacaaaagattcccctcaaaaacaaaacaatacaaagctaggtcaatccttgcttggtgcagttaggtaccttgccccgtgaccacacctgattttaataagggatgcgtaagtgtatcaaaaaca

SEQ ID NO: 188325 - DNA, 601 bp, Human
tggttgggtgagttggctggtgcagggatgctgatgagcccaggattgtggatttattcccccaaaagtttaaattagtttcccagagagggggaaaccccagtttgaccacatttattattttatttgctgcctcaggattgtaggagggacaatgtaataatgtaataatctaataattggaccaactcagcagtacaggtaaagaacaaaagattcccctcaaaaacaaaacaatacaaagctaggtcaatccttgcttggtgcagttaggtaccttgccccgtgaccacacctgatwttaataagggatgcgtaagtgtatcaaaaacacacattaaccaaggtacatttctcgccatgtcagcagcatcatctcccagggggagggaccaccctgattcctgcttctctatcactcattggcttgacgctcttttagcacatgctggtagacggcaagcatgtttcttgtggctgctgtcacaaattaccacaaacctagtggcttacaacaatccacggttattctctcacagctgtgtaaagcagaggtctggcatgagcctcactggattaagatcaaggtgccggcagggcc

SEQ ID NO: 188326 - DNA, 601 bp, Human
ttttatttgctgcctcaggattgtaggagggacaatgtaataatgtaataatctaataattggaccaactcagcagtacaggtaaagaacaaaagattcccctcaaaaacaaaacaatacaaagctaggtcaatccttgcttggtgcagttaggtaccttgccccgtgaccacacctgattttaataagggatgcgtaagtgtatcaaaaacacacattaaccaaggtacatttctcgccatgtcagcagcatcatctcccagggggagggaccaccctgattcctgcttctctatcactmattggcttgacgctcttttagcacatgctggtagacggcaagcatgtttcttgtggctgctgtcacaaattaccacaaacctagtggcttacaacaatccacggttattctctcacagctgtgtaaagcagaggtctggcatgagcctcactggattaagatcaaggtgccggcagggccgtgttccttctggaggctctaggggagaatccatttcctcgctgtttccagttcctagtaaccgcttgcattccttggcttgtgataccctccttcaagttcagatttctctccgttact

SEQ ID NO: 188327 - DNA, 601 bp, Human
gacaatgtaataatgtaataatctaataattggaccaactcagcagtacaggtaaagaacaaaagattcccctcaaaaacaaaacaatacaaagctaggtcaatccttgcttggtgcagttaggtaccttgccccgtgaccacacctgattttaataagggatgcgtaagtgtatcaaaaacacacattaaccaaggtacatttctcgccatgtcagcagcatcatctcccagggggagggaccaccctgattcctgcttctctatcactcattggcttgacgctcttttagcacatgctrgtagacggcaagcatgtttcttgtggctgctgtcacaaattaccacaaacctagtggcttacaacaatccacggttattctctcacagctgtgtaaagcagaggtctggcatgagcctcactggattaagatcaaggtgccggcagggccgtgttccttctggaggctctaggggagaatccatttcctcgctgtttccagttcctagtaaccgcttgcattccttggcttgtgataccctccttcaagttcagatttctctccgttactcccacttccatcaccacatttccttctctg

SEQ ID NO: 188328 - DNA, 601 bp, Human
tcgccatgtcagcagcatcatctcccagggggagggaccaccctgattcctgcttctctatcactcattggcttgacgctcttttagcacatgctggtagacggcaagcatgtttcttgtggctgctgtcacaaattaccacaaacctagtggcttacaacaatccacggttattctctcacagctgtgtaaagcagaggtctggcatgagcctcactggattaagatcaaggtgccggcagggccgtgttccttctggaggctctaggggagaatccatttcctcgctgtttccagttcytagtaaccgcttgcattccttggcttgtgataccctccttcaagttcagatttctctccgttactcccacttccatcaccacatttccttctctgactctcctgcctcctgcattccctttgtgggcccagctgaataatccagatcctttctccatctcaaaaatcttaccttaagcattcctggaagatattcacagcttccagggatcaggatgaggacatctttttttgagcggcagggaaatggcctttctccatcggccacaataaacttaatgtcttcacaatgactcacagt

SEQ ID NO: 188329 - DNA, 601 bp, Human
gtaattcatagacaatttccttgctcctaagtgtagacttgttttaaagaatagcctacatcattaaataaaatcagttatatattttgaaggcctatcttctatgtcttcatggtacatgtgaagacattttagctatcattcctatcctattggtgaatttattgctctatttcaaaaaagtcaaacaaaatcaaaaagaatcaaataccttcagacacttaggattggcccagtaaggtgtaaatcaaatggatatggaatcgtataatttttatttttattttttatttatttatttatttttttaaatgatagtttgtttgttttttttttgagacggagtctcgctctgtcacccaggctggggtgcagtggcgcgatctcggtgcactgcaagctccacctcccgggttcacgccattctcctgcctcagctctccgagtagctgggactacaggtgccggccaccacacccggctaattttttgtatttttaggagagacggggtttcaccgcgttttcgatctcctgacctcatgatccacccgccttggcctcccaaagtgctgggattacaagcatgagtcacagcgcct

SEQ ID NO: 188330 - DNA, 601 bp, Human
tagacaatttccttgctcctaagtgtagacttgttttaaagaatagcctacatcattaaataaaatcagttatatattttgaaggcctatcttctatgtcttcatggtacatgtgaagacattttagctatcattcctatcctattggtgaatttattgctctatttcaaaaaagtcaaacaaaatcaaaaagaatcaaataccttcagacacttaggattggcccagtaaggtgtaaatcaaatggatatggaatcgtataatttttatttttattttttatttatttatttatttttttaaatgatagtttgtttgttttttttttgagacggagtctcgctctgtcacccaggctggggtgcagtggcgcgatctcggtgcactgcaagctccacctcccgggttcacgccattctcctgcctcagctctccgagtagctgggactacaggtgccggccaccacacccggctaattttttgtatttttaggagagacggggtttcaccgcgttttcgatctcctgacctcatgatccacccgccttggcctcccaaagtgctgggattacaagcatgagtcacagcgcctggcggaat

SEQ ID NO: 188331 - DNA, 601 bp, Human
ccagatgtcagctgggcttgtccagctccttaagctgactgcattgaatctccagtccatgtcctcagagcatctgctaatttgatgtttgtgggactctaccggcctctgccttggtgtctgctgctgtgcctagagttgttctgcactgagttgacccagatgtgaaatcacccctccttcacacaaaaccctcataataataccatgtgtatatagcacccacataaggtaattgctgtcattatccccactttgcagatgaggaaactgaggcagagaagttacataacgtttttcstagattatccagtaagtgcgtggtggagcggacattaagcccaggcatattgaccccacagcctgtgttgaggtttcatggtcgtatttgctggcctctcagcagcattctactgaagacttaggcagggcatggaggggtgttacacagggtggtgcagggcaggctgtatagcagaaacccaaaactgcgcatcagccattcctttccttagaagtccttttaggtcggatgcggtggctcatgcctgtaatcccagcactttgggaggccgaggcgggtggatcacctgaggtcagg

SEQ ID NO: 188332 - DNA, 601 bp, Human
tgagttgacccagatgtgaaatcacccctccttcacacaaaaccctcataataataccatgtgtatatagcacccacataaggtaattgctgtcattatccccactttgcagatgaggaaactgaggcagagaagttacataacgtttttcctagattatccagtaagtgcgtggtggagcggacattaagcccaggcatattgaccccacagcctgtgttgaggtttcatggtcgtatttgctggcctctcagcagcattctactgaagacttaggcagggcatggaggggtgttacacggggtggtgcagggcaggctgtatagcagaaacccaaaactgcgcatcagccattcctttccttagaagtccttttaggtcggatgcggtggctcatgcctgtaatcccagcactttgggaggccgaggcgggtggatcacctgaggtcaggagtttgagaccagcctggctaacatggtgaaaccctgtctctactaaaaatacaaaaattagccaggcgtgatggtgggtgcctgtaatcccagctacttgggaggctgaggcagagagaattgcttgaacctgggaggtggaggttgc

SEQ ID NO: 188333 - DNA, 601 bp, Human
cctcataataataccatgtgtatatagcacccacataaggtaattgctgtcattatccccactttgcagatgaggaaactgaggcagagaagttacataacgtttttcctagattatccagtaagtgcgtggtggagcggacattaagcccaggcatattgaccccacagcctgtgttgaggtttcatggtcgtatttgctggcctctcagcagcattctactgaagacttaggcagggcatggaggggtgttacacagggtggtgcagggcaggctgtatagcagaaacccaaaactgcrcatcagccattcctttccttagaagtccttttaggtcggatgcggtggctcatgcctgtaatcccagcactttgggaggccgaggcgggtggatcacctgaggtcaggagtttgagaccagcctggctaacatggtgaaaccctgtctctactaaaaatacaaaaattagccaggcgtgatggtgggtgcctgtaatcccagctacttgggaggctgaggcagagagaattgcttgaacctgggaggtggaggttgcagtgagccgagattgtgcgattgcactccagcctgggcgacag

SEQ ID NO: 188334 - DNA, 601 bp, Human
gcagagaagttacataacgtttttcctagattatccagtaagtgcgtggtggagcggacattaagcccaggcatattgaccccacagcctgtgttgaggtttcatggtcgtatttgctggcctctcagcagcattctactgaagacttaggcagggcatggaggggtgttacacagggtggtgcagggcaggctgtatagcagaaacccaaaactgcgcatcagccattcctttccttagaagtccttttaggtcggatgcggtggctcatgcctgtaatcccagcactttgggaggccgmggcgggtggatcacctgaggtcaggagtttgagaccagcctggctaacatggtgaaaccctgtctctactaaaaatacaaaaattagccaggcgtgatggtgggtgcctgtaatcccagctacttgggaggctgaggcagagagaattgcttgaacctgggaggtggaggttgcagtgagccgagattgtgcgattgcactccagcctgggcgacagagcaagcctgcctcaaaaaaaaaaaccaaaaaaacaaaaaaaaacaaacccaaaaaaacccttttagctttcatgcttcaacc

SEQ ID NO: 188335 - DNA, 601 bp, Human
gtccttttaggtcggatgcggtggctcatgcctgtaatcccagcactttgggaggccgaggcgggtggatcacctgaggtcaggagtttgagaccagcctggctaacatggtgaaaccctgtctctactaaaaatacaaaaattagccaggcgtgatggtgggtgcctgtaatcccagctacttgggaggctgaggcagagagaattgcttgaacctgggaggtggaggttgcagtgagccgagattgtgcgattgcactccagcctgggcgacagagcaagcctgcctcaaaaaaaaaaaccaaaaaaacaaaaaaaaacaaacccaaaaaaacccttttagctttcatgcttcaacctcttagggtcatccttgggaaccccacactcccctccctctattttacagaccactctgctctcaatgtgcataaccaaactcattcaggtcctaagccaacagagtggcctccagttaacgagacaccctgtgtcttcttgtcattgttcacggaaaaggcatagtcctgttcgttacttttcttgctttctcacatacagaattatacctgttgggatcttttcgttggtgaattcagaa

SEQ ID NO: 188336 - DNA, 601 bp, Human
ctttgggaggccgaggcgggtggatcacctgaggtcaggagtttgagaccagcctggctaacatggtgaaaccctgtctctactaaaaatacaaaaattagccaggcgtgatggtgggtgcctgtaatcccagctacttgggaggctgaggcagagagaattgcttgaacctgggaggtggaggttgcagtgagccgagattgtgcgattgcactccagcctgggcgacagagcaagcctgcctcaaaaaaaaaaaccaaaaaaacaaaaaaaaacaaacccaaaaaaacccttttagctktcatgcttcaacctcttagggtcatccttgggaaccccacactcccctccctctattttacagaccactctgctctcaatgtgcataaccaaactcattcaggtcctaagccaacagagtggcctccagttaacgagacaccctgtgtcttcttgtcattgttcacggaaaaggcatagtcctgttcgttacttttcttgctttctcacatacagaattatacctgttgggatcttttcgttggtgaattcagaacctgtcttaaaggcccacggcccaatctgtcagtaatgaatttat

SEQ ID NO: 188337 - DNA, 601 bp, Human
tacagaccactctgctctcaatgtgcataaccaaactcattcaggtcctaagccaacagagtggcctccagttaacgagacaccctgtgtcttcttgtcattgttcacggaaaaggcatagtcctgttcgttacttttcttgctttctcacatacagaattatacctgttgggatcttttcgttggtgaattcagaacctgtcttaaaggcccacggcccaatctgtcagtaatgaatttatttatttatgatgaaattataaggactgagggggaccagaccactctagtcaaacagccrgaacactctctccctgtagatggggccaaagcaagccaaatcccaaactcaatgccagtttgttgatttacagtgagaatgacaactgccaatgggaccgagtaccatgcctttctgccattgcatcctctccctcagggccagtgctatgggggtaaaattataaccaagagctggttaggcaaaaccagaaccaggatgcaagaatcaatgagacttccaaaatttggatttcttctcagaatccatgaggctaagtctcctctccccctggacaccgcttggggagaacatgtcctg

SEQ ID NO: 188338 - DNA, 601 bp, Human
aacagccagaacactctctccctgtagatggggccaaagcaagccaaatcccaaactcaatgccagtttgttgatttacagtgagaatgacaactgccaatgggaccgagtaccatgcctttctgccattgcatcctctccctcagggccagtgctatgggggtaaaattataaccaagagctggttaggcaaaaccagaaccaggatgcaagaatcaatgagacttccaaaatttggatttcttctcagaatccatgaggctaagtctcctctccccctggacaccgcttggggagaacrtgtcctgtctttgtctctggacccttctatctaaggtcccatggctggcaggtgacagattcccctcccctagttggtgttcccattctcacatttcttctttagctattttactgaacatttgatctgattactttcatgcttgacaggactgggacccaatctatctccttgtggtgctttaatttgtcttaattgagttcattaggcgttgattttaaaatgcaattttctgagggcaattttctcttatttccagagtcttggaggggactcttccaaggccctccaagggcccta

SEQ ID NO: 188339 - DNA, 601 bp, Human
gactggaaggcagaggtcactgtggagagtatcctatagacaagatcagaaataggggaagggataagccagtctctatgtcatgcataaacataggctcagaaaggatatgcaaatgactcatacaatagcagaatgtgcacagtagctctgtttccattcaacgtattttctttcagaaaaagcatccaaaagttttaaaaggaaagggataaagaaaaatgtgaacaatggttaaatttaagcacaggacttaaaaatttaaatattctaagggaagccttctagcttaattgaatcmtgtacatggggccttttcagaaacagctcactagattgcttgggatttccacgcgtttactacctgacttttggtcatcttgtttaggctagggttaatgggacaggttctcttcctcatttctccctcttctgagtgagcctattttcctaggctgtttggagtttttggataatggcattttatccacttggtcgttattccctgggaatgtatgaaagggccaggagccctgaacatctttgaccatcacctctgttatttccagagagacgtggtcattccagcctcacctgccgg

SEQ ID NO: 188340 - DNA, 601 bp, Human
tgttacaagtaatacatgaatactttcttccaagtattctaaagctccctcagagtacctctgtgtcagtggaatgcccccctctggctccagtatggggactggagaatcgaagatacagaggaaattgaactcccttgaggccagttgggtaagaaggaagtgccatgtttcttagaagacttctggtgtttgtagatttgagaagggaggtgggagaggacttaggtgaatattaaaacaaacacataaaccaaatgaagacctctatctttccggcatcactaataaaaaaaaaaaagggagaaaaagctgaaagtaaagcataaaaccccagtaaacacatcagaactaccaaattagtcctctgcacaaacacacctttatatttagagctggaaccactttgggagtgacctttctcggaggttgctggcttgggcggcagtgggactctcccaagcgacaaacactctttagagcccccgtccgggacaccactgtatacattagttcatgttttctttggcttaaggaatagtgatggcattgcccttctgtttttccccctttcccaaaatgagtgctaataacttttata

SEQ ID NO: 188341 - DNA, 601 bp, Human
attgttattattatcattattattttgagacagtctcactctgttgcccagactggagtgcagtggtgcagtctcagctcactgcagtgttgatctcggggctcaagccatcctccccgttcagcctcccaagtagctgggactacaggcaccccctaccacacctggctaatttttgtattttttgtagagatggagtttcaacatgttgcccaggctggtctcaaactcctgagctcaagcaatcctcctgccttggcctcccaaagtgctgggattacaggcatgagccactgcgcccagctaacaactcttttttcaatctgtacctcttaacgacttcctagtccacacagtacagtgcatcgtgttgctgtcctttatttgccctaacactatcattaaagctatgtccatggttacttcttgttccctcttattgaatatttagtattcagtagccaagagactgtttatattctgcttaatcctcaccaaatttctgcaaaataagtagtatcgttacttttattaccactttacagataaggaagccaaggcacagaaagattgagtgatgtgctaaagttcacatggccag

SEQ ID NO: 188342 - DNA, 601 bp, Human
ctgcttaatcctcaccaaatttctgcaaaataagtagtatcgttacttttattaccactttacagataaggaagccaaggcacagaaagattgagtgatgtgctaaagttcacatggccagtaaatgacaaaacccatgctcgttcatacgtaccatgccactgtctctgtcagcttcaaggtgtgcttcttggggatgtgggctgaggcttagtgagctcgtctatttttgctgtgtttgtacagattcagcctcagcaagcacacagcaggcctggctgtgggaggcagtgtggtttakagcaaagagtatgatggcctttagcatttgttagtctggctttggcttgtactctgtcactcaccgcctcaccacattatttaattgagtctctctccattcattcattgtttcatccccgtgttcactgagtgcctattgagtgtccggaactatgcccagtgatacacttaaataaaaaacagacatggttatcaatcaagtgatcatagttctgagtataatgacaaactgagtgaagttccctgaacgagcaaaagccagtaaggaagactgggaggtctgggaaggtttcctgga

SEQ ID NO: 188343 - DNA, 601 bp, Human
agcagagggagttcacctcttcttcatggaatgagcatggtccttgtcctttattatttggtttctgtctcctagcaaatgacattaaaacattttgcaggccttgtggaattctggtcactgttgccctccaaatgccacacatgagccctcaggatgagccctacagagtttcatccttgtagataggaagatgtgtatttgggaacgaggctaaagccatggccgatttccccaacatgctttctatttctattttcgttaatctttttaagttcaatttttaaaatcatctaaatgratctaaacattctttagcaatttgcttaaatcatcttgtatattatatagaaatgttagatgcatttatttctagcctgcttactctgtatttcacataggaaccaaaaatagtctttccttcttcccagtttccttttgtgattgttgacatttttttacgtttcatcattaaatttatgacttatcttcttgtacctctgcccttcttattatctaagtccatcctatctatttttaaggaatatgaaagtatgaaagtaatcttcagtaccagttctttccaaatgaatcgactgtc

SEQ ID NO: 188344 - DNA, 601 bp, Human
ggaagaagtaaaagtccaattgaagagggcagtatcagggagggaacagaagtaaagagtttgggagatcattccttgaataactaagtgttgatcggctcttgggaaaatgtgttgatttgtcttctggccagttgtacatatgcagatacaccatctgtactgaaaaatatgcgtgaacttctctggaagcgcctgagtgagtcagtgtctgaaaaggagctacacctctaaaacagttatcaagtatttagggatgaggtgctgcaaagccaagagagtgaaaacaatccttaaaggygtgtttggccagctctcaaaaatcttagacagttgcaacacagtccttggctcagacactggatttttcccattcatgtacttttttgacagatgaattgttgcaggctgcaaaaaaagctcgaagaggaatctgttagactcctcactcagagcagggatctatttgcttgcaatcctgttagcaaaccaaggtgccatttgctttgtgtggtgtgctacttggccactttttcttagccgtggctgctctgtctgaaacggtcatggtctcattcagctctagcatatttgcgtgtta

SEQ ID NO: 188345 - DNA, 601 bp, Human
atgatgaatgtttagttacaagaatagttcagaccctcaggtatgggtattctttgcacaactctggaatatatttcttgaatcactggaagaagatggagtccttggaaacatgttgtcaggggctcaattacctttagacctttaagtgttcttggccaaaggcttggtagtaattatttgagggcattagtgatagaccacatgttaaggctgtagctgaaaccaagagtcatcatatgcatcctgtatggaaagaactggggatcatacttcagtctttccagccaaactatgtgtrtaccatcactaacttaagaaacacagtgtatgctattgtgtgctggtacacaatggggaaaatgactggctgccttcaaatcctgtcttctatgtctaggctcaacaacgggggacccctctgtatgtttttatgccgagaactaaagaattttaaaaataaacttggatagttttaaagggtgtaatatcctatgaattgtaacactgtatatatgctttaagtgtattatcaaagagtcaaagttatggacttttctccttcatacttggaaaatgttcatcattgtaaaacaaatgg

SEQ ID NO: 188346 - DNA, 601 bp, Human
tggaaactgaggttctggaaatgtaatctacttttaagaatcaaccacacctgtgcctcctccagaaaatctttgtagtgcatgactcttaccaggcgtatatgtagaggaaaaggtcaaagaaaaacatttccaaagatactgtgaaaaataaaattgtattttatcatagaattataaaaggtataactggggaagtttaaacatgggtagaaaaatggaaagaagaatgagacccatgagacggtaattcacatgaatcattgatgtgaaaatatgtggatgatattgaggggcagayggacagacaggttggcaggtgctcctggagtctcatggagagggggtcacttgctcccaagcagccagttccaaagtgtcttgacggcttcctttctggaagtactcggggctggttagtaattatttcccagcttatgggatttcttagactctccctggctggccttttaaaaatgaatgaccctcctatcctttcaagatgaagcaggctctttaggccctctgataccccttgccagcccacactgagcctgtgggacctagagacaggcagcttttcacaccttctggattgctg

SEQ ID NO: 188347 - DNA, 601 bp, Human
aaagaaaaacatttccaaagatactgtgaaaaataaaattgtattttatcatagaattataaaaggtataactggggaagtttaaacatgggtagaaaaatggaaagaagaatgagacccatgagacggtaattcacatgaatcattgatgtgaaaatatgtggatgatattgaggggcagatggacagacaggttggcaggtgctcctggagtctcatggagagggggtcacttgctcccaagcagccagttccaaagtgtcttgacggcttcctttctggaagtactcggggctggttrgtaattatttcccagcttatgggatttcttagactctccctggctggccttttaaaaatgaatgaccctcctatcctttcaagatgaagcaggctctttaggccctctgataccccttgccagcccacactgagcctgtgggacctagagacaggcagcttttcacaccttctggattgctgattatggtagactgatttttttttaaataaaatcaagtcattttgatgaaatgaccaactcagcctgatataactgggtctgctgcaggagcaggctggctgggttctgtgtccaaag

SEQ ID NO: 188348 - DNA, 601 bp, Human
taccacacaactaccagttctctcactccataggacatcgccacatggcccaatactccttcttgcaggtctgtccttgtcacacggaggattctaacatgattgactctgttgggtcaatttctactcccagctcttctagcctcacaaatccacttatctccctttccatttgcatgttcgagtccaccctttctgtaggctccttcccatgagcatttatacacgcttgagtctgtctgacagaaacctcccttggccccttcaccctaaagcacatgtgttctctcccctctcctcmgacaaaatccaaaagtatggtctacactcatacttcccttccttctcttctgctccccttgactcccttgcctctggtttaccccaccagagggtggagggggcatggtcacttgtatgagaggatggcaaagttccttctttcttaaaatatgtgacttctccatcatcccagagcaaatcacatcctgttccactacttatttaactaatgtcaacgactttggacgatcctaaagcattttcagtagacctctgagtccctcctctgtgtttgcgtccactcccactgcttcggtga

SEQ ID NO: 188349 - DNA, 601 bp, Human
ctgctgccccttaacccagaattctgtctctggaacttttgactctcctaatggcgctctgaacatcactacctggaagtcccagaagcccctcaaattcagcatgtaggaaacttatttcattgtgacccccatgcctgccactctttctgtgttccctctccagcgaatgacgttgccatgtactcagcttcctaagccagcaaaaagggctttatcttagattccttcctacctgttgtcttatccccagtttcaatggccaaatcacatccattctacctcagtatattttatatcmgtctacttatttttatcctttgccaccctttgcctcctacttaagaatcaaaaaccctgtaagacttccttgacctcataagaacaggttagattcttgtatcagtcagagaaacaggaccaattggatggatggatggatggatggatggatggatggatggatggatggaaacttattttaaggaattaatcttgaggctgacaattcaaaatccataactgcgggaggagggtgctaacaattctgaatctgtagggcaggctgtaaactcaggcgggaggtgatgccaaagtgtcg

SEQ ID NO: 188350 - DNA, 601 bp, Human
ccacaccacacatcttctaaacagtattttactatattgaagtgggctgtgtactcacctgtgtcccccactggactgcaggcaggtattatgtcttgtccacctaatggctgcataaaataggaatacacacagacatacccgactcaaacagatacaaacacatagacaggcacacaggcatacccagatgcgtctacatatctgaaagtgaatgaatgaatgttcttagccttctgttttttcatggatggtctgtaggaagcaacattccaacaaggcagagccagtaacagaggaygcttgatggcagggaatggttgtcagatatgaaaaatgtttcaatgggccctacaaccaacatgtggaagtttactctagcctaggtcttgattcagccatagcagacaaactgcaagagggaaaccaaagacaagatgaacccctttgcagctgagtgtttcatactcaagggtctagtaacataaactaactgttgtctaccatgtatcagatgctcaaatatagttacgtgtttttttcattatgtagcaactgtgcatcttcatgtcacaaacttgcaagaaatagaatttcttta

SEQ ID NO: 188351 - DNA, 601 bp, Human
atgttcttagccttctgttttttcatggatggtctgtaggaagcaacattccaacaaggcagagccagtaacagaggatgcttgatggcagggaatggttgtcagatatgaaaaatgtttcaatgggccctacaaccaacatgtggaagtttactctagcctaggtcttgattcagccatagcagacaaactgcaagagggaaaccaaagacaagatgaacccctttgcagctgagtgtttcatactcaagggtctagtaacataaactaactgttgtctaccatgtatcagatgctcaartatagttacgtgtttttttcattatgtagcaactgtgcatcttcatgtcacaaacttgcaagaaatagaatttctttattatcttataaattggtttgtctcacttgtcccacttctgcctgatgggagaaacttgatatacagttaatgccaggaaaactcagtcgattaagagtttttttcaggtaagtcttaatattcctgtagatgaatggataaacaaactggcacatccagacgatgggctattcttcagcactaaaaagaaatgagctttcaagctacagaggaatatagagt

SEQ ID NO: 188352 - DNA, 601 bp, Human
tctgttttttcatggatggtctgtaggaagcaacattccaacaaggcagagccagtaacagaggatgcttgatggcagggaatggttgtcagatatgaaaaatgtttcaatgggccctacaaccaacatgtggaagtttactctagcctaggtcttgattcagccatagcagacaaactgcaagagggaaaccaaagacaagatgaacccctttgcagctgagtgtttcatactcaagggtctagtaacataaactaactgttgtctaccatgtatcagatgctcaaatatagttacgtgwttttttcattatgtagcaactgtgcatcttcatgtcacaaacttgcaagaaatagaatttctttattatcttataaattggtttgtctcacttgtcccacttctgcctgatgggagaaacttgatatacagttaatgccaggaaaactcagtcgattaagagtttttttcaggtaagtcttaatattcctgtagatgaatggataaacaaactggcacatccagacgatgggctattcttcagcactaaaaagaaatgagctttcaagctacagaggaatatagagtttgctctacatat

SEQ ID NO: 188353 - DNA, 601 bp, Human
atatgaaaaatgtttcaatgggccctacaaccaacatgtggaagtttactctagcctaggtcttgattcagccatagcagacaaactgcaagagggaaaccaaagacaagatgaacccctttgcagctgagtgtttcatactcaagggtctagtaacataaactaactgttgtctaccatgtatcagatgctcaaatatagttacgtgtttttttcattatgtagcaactgtgcatcttcatgtcacaaacttgcaagaaatagaatttctttattatcttataaattggtttgtctcacktgtcccacttctgcctgatgggagaaacttgatatacagttaatgccaggaaaactcagtcgattaagagtttttttcaggtaagtcttaatattcctgtagatgaatggataaacaaactggcacatccagacgatgggctattcttcagcactaaaaagaaatgagctttcaagctacagaggaatatagagtttgctctacatattgttaactaaagaagccaaactgaaaaggttacatactatatagttccaactgtacgacattctgggaaaggcaaaactgtagagacagtaa

SEQ ID NO: 188354 - DNA, 601 bp, Human
caacatgtggaagtttactctagcctaggtcttgattcagccatagcagacaaactgcaagagggaaaccaaagacaagatgaacccctttgcagctgagtgtttcatactcaagggtctagtaacataaactaactgttgtctaccatgtatcagatgctcaaatatagttacgtgtttttttcattatgtagcaactgtgcatcttcatgtcacaaacttgcaagaaatagaatttctttattatcttataaattggtttgtctcacttgtcccacttctgcctgatgggagaaacttratatacagttaatgccaggaaaactcagtcgattaagagtttttttcaggtaagtcttaatattcctgtagatgaatggataaacaaactggcacatccagacgatgggctattcttcagcactaaaaagaaatgagctttcaagctacagaggaatatagagtttgctctacatattgttaactaaagaagccaaactgaaaaggttacatactatatagttccaactgtacgacattctgggaaaggcaaaactgtagagacagtaaaaacattagtggtggccaagggtttggggga

SEQ ID NO: 188355 - DNA, 601 bp, Human
ggtctagtaacataaactaactgttgtctaccatgtatcagatgctcaaatatagttacgtgtttttttcattatgtagcaactgtgcatcttcatgtcacaaacttgcaagaaatagaatttctttattatcttataaattggtttgtctcacttgtcccacttctgcctgatgggagaaacttgatatacagttaatgccaggaaaactcagtcgattaagagtttttttcaggtaagtcttaatattcctgtagatgaatggataaacaaactggcacatccagacgatgggctattmttcagcactaaaaagaaatgagctttcaagctacagaggaatatagagtttgctctacatattgttaactaaagaagccaaactgaaaaggttacatactatatagttccaactgtacgacattctgggaaaggcaaaactgtagagacagtaaaaacattagtggtggccaagggtttgggggaaggagggatgaatagatggagcccacatgatttttagcacagtaaaaatactgtatgatactacaatggtagatgcatgtcattatacggttgcccaaacccatagactatacaa

SEQ ID NO: 188356 - DNA, 601 bp, Human
tccaggctgggtgacagaatgaaaccctgtcccaaaagaaaaaaaaaaaaaaaaaggagaagaagaatgtaaagggtatgggaaagtaatatgttagttgataccttacaataaatttgccacatttacaaccttaggagatcgtattctcagccctaggttgaaggtgaggaaatgtgaggcagggagttggaagagccttcacttgcccagggtcgtaagtgataggacagggatttggacacaggttggtctgacttcactgtgccatactgctcataagaagagaacatggaggaasgatcactttctaagggatacccaacagtgtgaaaagacccatttatagtatttctgaatcctggaaaggctctccctattctatagagaaattttccaagacctcaggattccagtactatccatgggaacacaggagtccttgacaggaaacatttattttccagtttttccagtttattaaactgcaaaataacagccacccagttaaggaaggaaagcatgttgaacatctctttgccaggcacgggagataaagctcctgctgtgttctgggttttacagacataaaggaaatgaa

SEQ ID NO: 188357 - DNA, 601 bp, Human
aagggatacccaacagtgtgaaaagacccatttatagtatttctgaatcctggaaaggctctccctattctatagagaaattttccaagacctcaggattccagtactatccatgggaacacaggagtccttgacaggaaacatttattttccagtttttccagtttattaaactgcaaaataacagccacccagttaaggaaggaaagcatgttgaacatctctttgccaggcacgggagataaagctcctgctgtgttctgggttttacagacataaaggaaatgaagcatagtccccrtgtctgtaacctttcatggggagaaacacaagggcagacaattttcattcatccccactcttgagattttgaaagaggcatgtgcaagggcagccagaaccacaaggaaggaccctggcctggtctgagatggtcagtgtgggtttttgaaggacagagtcaagtcctaagaagaaggaattggcctgggaagatgatctagagagtgtgactggggagtgctccaggctgaggggatggaggaacaaagcaaggcagtggtaaaacagccctgttagttcagggatccccaaggcagag

SEQ ID NO: 188358 - DNA, 601 bp, Human
ttcttgagatagacaaagaagcaagcagtgaagaggatcctggggaggaggttggacacaatcagacatctatggaatctcaaaaatggaggaggccagtgggatcagtaatgtcacattctgcagagaagtccttaaaaagaagagtgccatctggattgccagagggaacacattggtggcccaagggaggaatgttttggcagattttatgaggatgaagccaaactgccaccctcgtggccaagatggccttgatcctgtcgcaggaaagtcccttctgtgcttggtagaagaatartacttttttcaccctgttccccacactgttgcattaagcatgctaaatagcatcacccccttcctcatctataggaatattaattttaggctttgtcttgctgtcacaatattttaactaatttttcctaagttcttatcaggtacataatggacattctaattagaaaaaaaccatccgtatgccctaaaccttacctctgagggtatcttcatagtgaagaagtttctattttgccagaaaaaaagcgatacttataaaataaatgttttctcttttactacttagtagaaccaatac

SEQ ID NO: 188359 - DNA, 601 bp, Human
ttggtggcccaagggaggaatgttttggcagattttatgaggatgaagccaaactgccaccctcgtggccaagatggccttgatcctgtcgcaggaaagtcccttctgtgcttggtagaagaatagtacttttttcaccctgttccccacactgttgcattaagcatgctaaatagcatcacccccttcctcatctataggaatattaattttaggctttgtcttgctgtcacaatattttaactaatttttcctaagttcttatcaggtacataatggacattctaattagaaaaaaacsatccgtatgccctaaaccttacctctgagggtatcttcatagtgaagaagtttctattttgccagaaaaaaagcgatacttataaaataaatgttttctcttttactacttagtagaaccaatacataatggaattttagtttcatttcataaaatatttactctgtaagcaaattaaagtgactttttttaaacaaaagaaggttgctgtattcaccattgaatcaaatctttagatttccaaattagtgaactaattctgtgaaataatcatcttattcatagctattcaaatctttc

SEQ ID NO: 188360 - DNA, 601 bp, Human
tctaattagaaaaaaaccatccgtatgccctaaaccttacctctgagggtatcttcatagtgaagaagtttctattttgccagaaaaaaagcgatacttataaaataaatgttttctcttttactacttagtagaaccaatacataatggaattttagtttcatttcataaaatatttactctgtaagcaaattaaagtgactttttttaaacaaaagaaggttgctgtattcaccattgaatcaaatctttagatttccaaattagtgaactaattctgtgaaataatcatcttattcawagctattcaaatctttctggataattcgttctgtttcccaggtatcggcacaatcataggctcataaacagaactccaatgcgttgtttctgtttctctttgtcatgtgatttagggtttatttttgtttgtcaatttaaattctaagaatctagatctcagtgtctccttgaaagaatactttattaagtactacctatttgtaatatgtttcaatgtagactaaccaacccaataatgagtatttggtaaagcaataggaaactttgcagtaactacaacaaatatacgtcatcatac

SEQ ID NO: 188361 - DNA, 601 bp, Human
atactttattaagtactacctatttgtaatatgtttcaatgtagactaaccaacccaataatgagtatttggtaaagcaataggaaactttgcagtaactacaacaaatatacgtcatcatactctttgtggagatgacacgctggaaatttcaggtggtgcttatttttaaatgtatgctctatttaatgtgtccctaagttctcagtctccaaaataaatctaacacgggcagcacccccctcccatccgccacacaaaacatgagctgttacacatcccgagtaatgaagtgtatagycgcttcagctttctcttggcatccgaggctaaggagctaatattctaagaggtgatgtattttaatcctaataagcacctaagaattcattgagtgaaaagttaaggttagcaatcaaccttggcaaactgatgcttataaattataccaatgtgaaattgtgtttgaggtgagaaacaagagtgggtgctgagagggagtaataaaccatccaactgcaaatggcgacatttcatcacaccactgttctcattggacattattcacaagcatacttttgatttatttttctcagtgggt

SEQ ID NO: 188362 - DNA, 601 bp, Human
ccgccacacaaaacatgagctgttacacatcccgagtaatgaagtgtatagtcgcttcagctttctcttggcatccgaggctaaggagctaatattctaagaggtgatgtattttaatcctaataagcacctaagaattcattgagtgaaaagttaaggttagcaatcaaccttggcaaactgatgcttataaattataccaatgtgaaattgtgtttgaggtgagaaacaagagtgggtgctgagagggagtaataaaccatccaactgcaaatggcgacatttcatcacaccactgttstcattggacattattcacaagcatacttttgatttatttttctcagtgggtctgtaaatctctttcttggagtgcaaattgcatgagtagtaagttccatgtgccaggagatggcttggttcatctcttagaccttgactttattaataacagcaacaaaaagaagagaccgatacaagttatagagaacctcaaaatgaaaagcaaatttattctagattctacctttttgttttatgtgtgtttttcttttactaaacaatcttatctggtaatttgttccatcatgatgctttgaga

SEQ ID NO: 188363 - DNA, 601 bp, Human
tgagaaacaagagtgggtgctgagagggagtaataaaccatccaactgcaaatggcgacatttcatcacaccactgttctcattggacattattcacaagcatacttttgatttatttttctcagtgggtctgtaaatctctttcttggagtgcaaattgcatgagtagtaagttccatgtgccaggagatggcttggttcatctcttagaccttgactttattaataacagcaacaaaaagaagagaccgatacaagttatagagaacctcaaaatgaaaagcaaatttattctagattstacctttttgttttatgtgtgtttttcttttactaaacaatcttatctggtaatttgttccatcatgatgctttgagaaacatagaaactggttattgaaaagatcagatgtatacgttgatttttgtaaagatcagatgtccttcccctaagatagggtgacttctactgccattgtgttgtagatcttgtgcctgtcattctttcccttaagctaaatatgctctagtactctctctaagtctaatcttatagtctgttaactagttgacttgtttggtggggtgtgaagtaccaagg

SEQ ID NO: 188364 - DNA, 601 bp, Human
catcatgatgctttgagaaacatagaaactggttattgaaaagatcagatgtatacgttgatttttgtaaagatcagatgtccttcccctaagatagggtgacttctactgccattgtgttgtagatcttgtgcctgtcattctttcccttaagctaaatatgctctagtactctctctaagtctaatcttatagtctgttaactagttgacttgtttggtggggtgtgaagtaccaaggagaccaagtcttggatttaatgatgacaaaagtcaacctatattccacatatgtccttatytctgtagagtccattaggcttcttgtatttgaaggccacagggtatacctttaggccactcagccaagttcttgccatgagtcacaaagcagaaccagatgtaagaccagagggtgaggacttcgagcccagcggggaccacagggatggtctggaccactttcctcaccttactgatggtgaactgaagccaaaagaggtcaagtccctgttcgcagtcatgcagccccttagagttggctctgggtgaccacccttccagtccagcactgtttctgatacagtgcgcatgagcatctc

SEQ ID NO: 188365 - DNA, 601 bp, Human
aatttccaacatagaacatgaaaactttggctactgcgaattccaaggttttggatggcaaaaatctggcaatgactccaaaggagggagagaggagagagcagcttgttcaatggaataacctcattttaaggctggagtgccaagctaatttgttaaaattactatactcctttctcaattatccatctcaaggtttatttatgttgtggatttgtgatggtcgccacatctcagccaatcaaagtaggggacagggtcaggtgcgaaatcagtaattctgtataaagtagaattcagraaactgctagtcacttggattaattcagggaagtcctgttcagattattgaaaagatcaaagttatgatttctttttttgaagaagggctatttgattccaactgaatgttagtgtgccagttatttaactcttctgggccttccttataaataaggagtatagacaatgatgaaattaaggtctcttctaggcaggcatcctataagattagaactattactttgaaatacctacagcaactggtaatgagctggcagagtagtcctcaccgctcagcttactttaataaataagcagc

SEQ ID NO: 188366 - DNA, 601 bp, Human
gagagaggagagagcagcttgttcaatggaataacctcattttaaggctggagtgccaagctaatttgttaaaattactatactcctttctcaattatccatctcaaggtttatttatgttgtggatttgtgatggtcgccacatctcagccaatcaaagtaggggacagggtcaggtgcgaaatcagtaattctgtataaagtagaattcagaaaactgctagtcacttggattaattcagggaagtcctgttcagattattgaaaagatcaaagttatgatttctttttttgaagaagkgctatttgattccaactgaatgttagtgtgccagttatttaactcttctgggccttccttataaataaggagtatagacaatgatgaaattaaggtctcttctaggcaggcatcctataagattagaactattactttgaaatacctacagcaactggtaatgagctggcagagtagtcctcaccgctcagcttactttaataaataagcagccatgatttatagttgacaagagcaccagccaaaatctattctccttgacttatagttacactgattataaaaaaaaaaaaaaagata

SEQ ID NO: 188367 - DNA, 601 bp, Human
tgatcgcccttctctgccagccctttgtaacttatgaataccgctatatttcattgatttcaagatgcaccatttttttttcacatttaacttgcgaaatcaggtcgggcctaacaattgctagtgtattgtttaattggccatgcttttcctctcttagcagttacataaatgaacgctgcattttactatcactggcatattagattggatgaaatatggtaattaatttttaccaggtactacagtaatcaatataattgcattttcccctcttgaaatcagatctctgagcataggmgcacatggtccccctttcagtatcccaaggtaagcacactttttgacatgcaaagttggtgccctccaatgaatataaaatgctaaatgagaggaaaatgtgcaggaaacaataagggatttgttccagctggatctgacacactaaattggagcattataagagatggaaatgtctagagtgggatgagtgacccgtttagtagtaagcccaaatgtcaagctaaggaattctgatctctcaaggattatcccacactgtaaattgcaggcaaagccatcgggtaggaaattaaagcag

SEQ ID NO: 188368 - DNA, 601 bp, Human
gaacgctgcattttactatcactggcatattagattggatgaaatatggtaattaatttttaccaggtactacagtaatcaatataattgcattttcccctcttgaaatcagatctctgagcataggagcacatggtccccctttcagtatcccaaggtaagcacactttttgacatgcaaagttggtgccctccaatgaatataaaatgctaaatgagaggaaaatgtgcaggaaacaataagggatttgttccagctggatctgacacactaaattggagcattataagagatggaaaygtctagagtgggatgagtgacccgtttagtagtaagcccaaatgtcaagctaaggaattctgatctctcaaggattatcccacactgtaaattgcaggcaaagccatcgggtaggaaattaaagcagaggttaaagtaacttttttttttttaaactctcacttaaaacttacatatttttaaaaattacctcctcttctcattagccatctggccatgcaaactggctttcacactcctttctttctttctttcctttgcttttttctttattattcagtagaggtgctggtttataca

SEQ ID NO: 188369 - DNA, 601 bp, Human
ccaaggtaagcacactttttgacatgcaaagttggtgccctccaatgaatataaaatgctaaatgagaggaaaatgtgcaggaaacaataagggatttgttccagctggatctgacacactaaattggagcattataagagatggaaatgtctagagtgggatgagtgacccgtttagtagtaagcccaaatgtcaagctaaggaattctgatctctcaaggattatcccacactgtaaattgcaggcaaagccatcgggtaggaaattaaagcagaggttaaagtaacttttttttttttaaactctcacttaaaacttacatatttttaaaaattacctcctcttctcattagccatctggccatgcaaactggctttcacactcctttctttctttctttcctttgcttttttctttattattcagtagaggtgctggtttatacatagtgattgtcaggacagagttttcaggcagctctatgactattgggaccagtcgccaaagtccttcatttaaatgaccaatttcacattcagtctggacttcaatggggatgaagattttagaacccgaagacacatgggtaatgctggaa

SEQ ID NO: 188370 - DNA, 601 bp, Human
cacctgtcacaagataggaatgtgttggttgatactccctgtcttcctttgaaatcataccatcgaaatgaaagttgtccctagttttaataacctcctgacaagaggattccactgtttctctgctatcccatttcaatatttaacaactttctaaaagtctgagcatctcttgcttcagattgtcaatttttctgttattgttaggaaacagagggtcattctcttacgtaatactctccttatgattgtggtcggggaagagaatggtgccccacaggaatcttagacctcctgttcyatctccatcctttcgatatacaaagggcagcagttctcaaagtgtggtccatggaccagcagcatcagcatctcctgggacctcgttgttttttgtttgtttgtttttgttttgtttgtttgagacagatttttgctcttgttgcccaggctggagtgcagtgacgcactctctgcttattggaacctccaccttccagtttcaagtgattctcctgcctcagcctccagagtagcacaggccaccacacccggctgatttttgcatttttagtagagatggggtttcaccatgttggcc

SEQ ID NO: 188371 - DNA, 601 bp, Human
taggaatgtgttggttgatactccctgtcttcctttgaaatcataccatcgaaatgaaagttgtccctagttttaataacctcctgacaagaggattccactgtttctctgctatcccatttcaatatttaacaactttctaaaagtctgagcatctcttgcttcagattgtcaatttttctgttattgttaggaaacagagggtcattctcttacgtaatactctccttatgattgtggtcggggaagagaatggtgccccacaggaatcttagacctcctgttccatctccatcctttygatatacaaagggcagcagttctcaaagtgtggtccatggaccagcagcatcagcatctcctgggacctcgttgttttttgtttgtttgtttttgttttgtttgtttgagacagatttttgctcttgttgcccaggctggagtgcagtgacgcactctctgcttattggaacctccaccttccagtttcaagtgattctcctgcctcagcctccagagtagcacaggccaccacacccggctgatttttgcatttttagtagagatggggtttcaccatgttggccagactggtctcgaa

SEQ ID NO: 188372 - DNA, 601 bp, Human
gaatcttagacctcctgttccatctccatcctttcgatatacaaagggcagcagttctcaaagtgtggtccatggaccagcagcatcagcatctcctgggacctcgttgttttttgtttgtttgtttttgttttgtttgtttgagacagatttttgctcttgttgcccaggctggagtgcagtgacgcactctctgcttattggaacctccaccttccagtttcaagtgattctcctgcctcagcctccagagtagcacaggccaccacacccggctgatttttgcatttttagtagagayggggtttcaccatgttggccagactggtctcgaactcctgacctagtgatccgcccaccttggcctcccaaagtgctgggatcacaggcctgagcccacgcgcccggccgggaccttgtttaacatgcacattttggggctccatcccagacctaccaattcagaaactccaggagcgggtcccagcaatttgtgtttctactggccctccaggtggttctaatgcatgctaagtttgaaaacccttgttatgttggaggttagagtcagtcagaaagaagacagagcaattcaaactac

SEQ ID NO: 188373 - DNA, 601 bp, Human
cgatatacaaagggcagcagttctcaaagtgtggtccatggaccagcagcatcagcatctcctgggacctcgttgttttttgtttgtttgtttttgttttgtttgtttgagacagatttttgctcttgttgcccaggctggagtgcagtgacgcactctctgcttattggaacctccaccttccagtttcaagtgattctcctgcctcagcctccagagtagcacaggccaccacacccggctgatttttgcatttttagtagagatggggtttcaccatgttggccagactggtctcgawctcctgacctagtgatccgcccaccttggcctcccaaagtgctgggatcacaggcctgagcccacgcgcccggccgggaccttgtttaacatgcacattttggggctccatcccagacctaccaattcagaaactccaggagcgggtcccagcaatttgtgtttctactggccctccaggtggttctaatgcatgctaagtttgaaaacccttgttatgttggaggttagagtcagtcagaaagaagacagagcaattcaaactacccaaagaggaatggacagccttcaccttccatta

SEQ ID NO: 188374 - DNA, 601 bp, Human
agccttcaccttccattacacttcaggtacactttgaagacaaccaaagaatgcagacattggcctgcaaatgcctgtgcctgcaattgattgcagttctttttgtattactaacgggaagtctttactttttttttttttttttttttttttgagacggagtcttgctctgttgcccaggctggagtgcagtggcacgatctcagctcactgcaatctccacttcgcgggttcacgccattctcctgcctcagcctcccaagtagctgggactacaggcacccgccaccacacccggctmattttttgtgtttttagtagagatggggtttcaccgtgttagccaggatggtcttgatttcctgaccttgtgatctgcccacctcggcctcccaaagtgctgggattacaggcgtgagccaccgcgcccggccttaaatgttaaaaggaaagaaaatatgcatataaagagattgcacttaaaattagtcagcttgtactttggttggtagaaaacaaacttctgcaaaatctgaagatttactgataggtggatgaggaagtatttctgaaatgtgttaaccactcatttcatttacca

SEQ ID NO: 188375 - DNA, 601 bp, Human
acactttgaagacaaccaaagaatgcagacattggcctgcaaatgcctgtgcctgcaattgattgcagttctttttgtattactaacgggaagtctttactttttttttttttttttttttttttgagacggagtcttgctctgttgcccaggctggagtgcagtggcacgatctcagctcactgcaatctccacttcgcgggttcacgccattctcctgcctcagcctcccaagtagctgggactacaggcacccgccaccacacccggctaattttttgtgtttttagtagagatgggktttcaccgtgttagccaggatggtcttgatttcctgaccttgtgatctgcccacctcggcctcccaaagtgctgggattacaggcgtgagccaccgcgcccggccttaaatgttaaaaggaaagaaaatatgcatataaagagattgcacttaaaattagtcagcttgtactttggttggtagaaaacaaacttctgcaaaatctgaagatttactgataggtggatgaggaagtatttctgaaatgtgttaaccactcatttcatttaccagaaactgctcagagcctcttgggggggc

SEQ ID NO: 188376 - DNA, 601 bp, Human
gcagaaggattgcttgagcccaggaggtggaggctgcattgagctatgatagtggaactgcactccagcctgggcaacagaacaagaccctgtctctaaaaaaaaaaaaaaaaaaaaaaaaattggtgaacattcacctactctgatcagaggcatccgcttcccgtgagcacttctgtgccttgaggatcctgagcacatgtgatcataaggaaaatttagggctaatttttaaaaacataggggtttggtgagggctccatttcttccaatgggcgtatagtaccccccacccccccccaaaaaaaaaacgctttttaaacatgttgactaaaaaatgtaaaagtgataacttcctttaaaaactttgggctggagtttatttaagtggaactttctggtagctttttgcaacctgtaataaactcattggaatgagtgggaaatagatatcatgtgtttcctgagccttccttggatccgtggccaggaaaaaaagctgctgttcaaggggttaatggtgtccaaaccttatttatatttgtgtgattagggatgtgcaaaatgtgcctcttgcactcaatccaggtttgtggaagat

SEQ ID NO: 188377 - DNA, 601 bp, Human
gacagcaaaattaagggaaactgagtaagattattaaaatagatcatattaatgccaaaatctcttgtacaaagagaccacttattcatatatttattcactgagcaaatattcattgttacctattatgcacagctagagaatgttagctcaaagttttcaaaccatttttttaaaacaaagatgtttatatatcctctacagattcctaaagttggatcttattttcttggttaattgtatgtattgatggggaaaattttttaaagtcatattcaaatagatttctttgattcgctgragaataagaattggacatttgctccaggccaattgttcatcttatcgataaatacaaaatgatgtcactcaagttgtgggataaccccccaacccaccctcaaagtttaagaaaacagctacgtagatagcattatggaattcttaaagctccgaggggtatgagaagacatcagttcaatatcttgaatttgcaaaagagctcactgaggcccagtaatcttagctcaagtgactttcccaaggctccagaggcagctggtggcagagccaatcccggcagccatggtcggtcttttct

SEQ ID NO: 188378 - DNA, 601 bp, Human
tactatccattccagttcttaggaacattggcctagacacatttgaaattcagtagactttgggcaactgaaatttacaagattaaactattacaaactagaagaaaataaaggtgatggttttaactggtctctcaatggagaaaagctttctggctataagtaataggagactgtataatgtacatgtacacatgtagatacatttcttacacatacagtatatgtaaagaaatacccagatattagatgacataaaattttcagacacatgtcaaaatataaacaaaattaaacatayacacattaaccctctggtatatttgttgcaaatatgatagacaataaatatggcaaagacctattcttatataaaaagcccatataaatcaagaagaaaaatatcaaagttgaatgtaaaatatgtagaacacatgaaaaagaaactgagaaagaactataagtgcctgtggtgtattttcaacagctctgtgaatttcattattatgtttctgaaagtgccgtggtgacctcacccacatgattgacatggtgtcccatttgtgaggacacacaccaggatctcccccaggtctgggct

SEQ ID NO: 188379 - DNA, 601 bp, Human
tttcttacacatacagtatatgtaaagaaatacccagatattagatgacataaaattttcagacacatgtcaaaatataaacaaaattaaacatatacacattaaccctctggtatatttgttgcaaatatgatagacaataaatatggcaaagacctattcttatataaaaagcccatataaatcaagaagaaaaatatcaaagttgaatgtaaaatatgtagaacacatgaaaaagaaactgagaaagaactataagtgcctgtggtgtattttcaacagctctgtgaatttcattatwatgtttctgaaagtgccgtggtgacctcacccacatgattgacatggtgtcccatttgtgaggacacacaccaggatctcccccaggtctgggcttttcctgggctacctttctctgagttctgtaactggccacgtatctgtgttttcagtgatttctacaaaggtgaggaaaaaaaaaacatgctgggtcaggtgtgatggcttctgcctgtaattccagcactggaggctgaggcaggtattcaagatcagcctgagcaacatggcaaagccctgtctctacaaaaaaaaaaaaaaa

SEQ ID NO: 188380 - DNA, 601 bp, Human
tatgtaaagaaatacccagatattagatgacataaaattttcagacacatgtcaaaatataaacaaaattaaacatatacacattaaccctctggtatatttgttgcaaatatgatagacaataaatatggcaaagacctattcttatataaaaagcccatataaatcaagaagaaaaatatcaaagttgaatgtaaaatatgtagaacacatgaaaaagaaactgagaaagaactataagtgcctgtggtgtattttcaacagctctgtgaatttcattattatgtttctgaaagtgccrtggtgacctcacccacatgattgacatggtgtcccatttgtgaggacacacaccaggatctcccccaggtctgggcttttcctgggctacctttctctgagttctgtaactggccacgtatctgtgttttcagtgatttctacaaaggtgaggaaaaaaaaaacatgctgggtcaggtgtgatggcttctgcctgtaattccagcactggaggctgaggcaggtattcaagatcagcctgagcaacatggcaaagccctgtctctacaaaaaaaaaaaaaaaaaaaaaaatatatatata

SEQ ID NO: 188381 - DNA, 601 bp, Human
aacatatacacattaaccctctggtatatttgttgcaaatatgatagacaataaatatggcaaagacctattcttatataaaaagcccatataaatcaagaagaaaaatatcaaagttgaatgtaaaatatgtagaacacatgaaaaagaaactgagaaagaactataagtgcctgtggtgtattttcaacagctctgtgaatttcattattatgtttctgaaagtgccgtggtgacctcacccacatgattgacatggtgtcccatttgtgaggacacacaccaggatctcccccaggtmtgggcttttcctgggctacctttctctgagttctgtaactggccacgtatctgtgttttcagtgatttctacaaaggtgaggaaaaaaaaaacatgctgggtcaggtgtgatggcttctgcctgtaattccagcactggaggctgaggcaggtattcaagatcagcctgagcaacatggcaaagccctgtctctacaaaaaaaaaaaaaaaaaaaaaaatatatatatatatatatatatatatatatatatatatatatataaaattagtgggcatggtagtagataagggatcttcat

SEQ ID NO: 188382 - DNA, 601 bp, Human
aaatcaagaagaaaaatatcaaagttgaatgtaaaatatgtagaacacatgaaaaagaaactgagaaagaactataagtgcctgtggtgtattttcaacagctctgtgaatttcattattatgtttctgaaagtgccgtggtgacctcacccacatgattgacatggtgtcccatttgtgaggacacacaccaggatctcccccaggtctgggcttttcctgggctacctttctctgagttctgtaactggccacgtatctgtgttttcagtgatttctacaaaggtgaggaaaaaaaaaacatgctgggtcaggtgtgatggcttctgcctgtaattccagcactggaggctgaggcaggtattcaagatcagcctgagcaacatggcaaagccctgtctctacaaaaaaaaaaaaaaaaaaaaaaatatatatatatatatatatatatatatatatatatatatatataaaattagtgggcatggtagtagataagggatcttcatgacacataatttgtatatctctgattgtgttttctctctttagtttctcatttatttttatgatgatatattatttgatttttataaaacac

SEQ ID NO: 188383 - DNA, 601 bp, Human
atctcccttctgattgtactcaaagtcaactgattagtaaccttaattatatctgcagaatccctattgccacgtaacttaatcaggacatgacatctcatcatgtttatactcctgggaattagggcaagaaatcttaggagtccattttagaaatttgcttaaaacagccagatgtcaaaaactcttagcttctcttcattcataaggttgtatttcttccactccccgatttctgtcttcctgttgtttgcagacttttgctgttctttagtttgagtgttttttttcttctttcacrtacagtgtacaatatccttttaaatcttatcctttgttacagtctctgaattcttcactaataactgtaggaagtatctctctctacctttctcttcctctcattctcactcttcaagccattggcaggagacatgtaatgatgtgagggtcaggaggccaatacaccagttcctgttctgtccctacattaagtatgtagcttgatcttagtgtcttggtctcctcaatcagtaataactaataattatctctatttaaatgaaaacacatggacacaaggaggggaacatcacatacc

SEQ ID NO: 188384 - DNA, 601 bp, Human
tcccctccgtaatccacagaacagatatcctccctgttttaaaggtaagcagcttgggggtcaaaaaaactcttcaaggtcatgctcattgataagtggtagagctggaatttaaacccaggtctgtgtgaccacaaatgccatgtattttccactgatttgactttagatttgaagcagaagtaaaattgggaaagtatcagtacattcagccatggcatcaccagtaggggagatgaagttaaagcaaaatttgagagaatcccttctggtggaagggctctcagttaaagccccatcmataattgctttctgttcatgttgacctttattttagactaatggtttgtttattaattaaactgtgaaaactagttttacttgattaaagtgcacagcagagtatactttgttttggtagtgattgttttttcttctattttttaaccctttaatgtcagttttcccttggagggataatatattagattaaaaaaaaacactatgacattaggggaaaatagtatagaatgctacgtaggcagaagttattactctactgtttttcatatggcttattagctggtcgttcttttttatt

SEQ ID NO: 188385 - DNA, 601 bp, Human
tcgttcttttttattgtggcaatatttcagttactaagatcagatccttcagttaaccagggttgtctgttgttctgaactctacttggaaaagaaagagatcaataaactcagaaacaaaggcaaacaaagatacacgtcctcaccttctcatcaccagtccactcgagagaaaccagctttcaaaacattcagtctattttttcaataccttgctttttaactttacaatttgtaacatgcttttaagtgtgttaatgagctcctttgattatcatgtttttttaatgtgagaaaaaayaggcatatgctgttcttcccaggtcttctggtgttcaaagttctatcaactaaacaacactggacttcttatcttttcagtggatgcttatgtggaggtggtgcaggatgctcaattattaaaaaatgatgtgattatatattaaggtcaaaaactgcctgatgcacatatacaccatggaatactatgcaaccataaaaaaggatgagttcatgtcctttgtagggacatggatgaggctagaaaccatcattctgagaaactatcacaaggacagaaaaccaaacaccgcatgttctc

SEQ ID NO: 188386 - DNA, 601 bp, Human
cagtctattttttcaataccttgctttttaactttacaatttgtaacatgcttttaagtgtgttaatgagctcctttgattatcatgtttttttaatgtgagaaaaaataggcatatgctgttcttcccaggtcttctggtgttcaaagttctatcaactaaacaacactggacttcttatcttttcagtggatgcttatgtggaggtggtgcaggatgctcaattattaaaaaatgatgtgattatatattaaggtcaaaaactgcctgatgcacatatacaccatggaatactatgcarccataaaaaaggatgagttcatgtcctttgtagggacatggatgaggctagaaaccatcattctgagaaactatcacaaggacagaaaaccaaacaccgcatgttctcactcataggtgggaattgaacaatgagaacacttggacacagggcggggaacatcacacacgggggcctgtcgtggcgtggggggtggggggagggatagcattaggagatatacctaatgtaaatgatgagttaatgggtgcagcacaccaacatggcacatgtatacatatgtaacaaacctgcacattg

SEQ ID NO: 188387 - DNA, 601 bp, Human
caattattaaaaaatgatgtgattatatattaaggtcaaaaactgcctgatgcacatatacaccatggaatactatgcaaccataaaaaaggatgagttcatgtcctttgtagggacatggatgaggctagaaaccatcattctgagaaactatcacaaggacagaaaaccaaacaccgcatgttctcactcataggtgggaattgaacaatgagaacacttggacacagggcggggaacatcacacacgggggcctgtcgtggcgtggggggtggggggagggatagcattaggagatayacctaatgtaaatgatgagttaatgggtgcagcacaccaacatggcacatgtatacatatgtaacaaacctgcacattgtgcacatgtaccctagaacttaaagtataatttaaaaaaaaaactgcctgatgttttaaagctgaattgaaagtgtatttttaaatttagatttggccttttgctaaccaagatattagattatctagaacatctccagtaatgatagaaatgtagtgttgcgaagggctttgggaatcatcttgtacaaatgcctcacattgcaaagtgagaaaactgag

SEQ ID NO: 188388 - DNA, 601 bp, Human
aggtcacacgcctcatgcctaggtcagaggtacatcacttttagacacgttgatactatcaagagaaaggaaaagaccatcaggatctggggaagggagatctttttgagccaatgattgcattttataaacacgtgaaattggcaagacattctttccagatttcacagagggatatcccatgtccaaccagggtaagacatgaggacatgagtaattagaaggagaaacattgttcataatgacaaggtggaatgtgaaaattggctggagcagaaagggggaaaaagacaagctgcartgtgagatttaggcacacagacaggcgtgtggtgtctttgtgtgtgagtacatatgtgagtgtgtgactgttcacgcgtgcacatgtgacctctagcctaccagatcatgtgaggctttattgaagagatgttctgtgacagtagggtgaccaatttgtcctagtcttaccagtctgtcccagttttagcagctggagaggatgatcggttgaaattcaaacctgagtatactgggtataattgcatatatacttcattgtctccacaatgagtttgtgtaacttgtaggttacacaaat

SEQ ID NO: 188389 - DNA, 601 bp, Human
gtaggttacacaaattgctggctgaagttcatccaggtcaatttatgtgctaatgttttagggattgcatggctgataacagtatttttttttactatcagatccagaaaacaattgaatttgaatttggcaaacggagataaacagggagaaggagaagtaaaaaagggatgtaaggggagagaaaggaagaaagggaaggggaaaaggcctctaagcctcactgggaaggtcctggtaatgtcactgaaccaacatgagcccaaccacaggaaccaagaatctgctctggaaatcctgyttagttgtatttaagtttttttccctccagttaccattttcttccaaaactcggcatgtaagtgaagatggtctttaaatcccagatgttgtttttccatcttccagctggagttgaggtaatattgtgatattcaaacagaaacagaagctgcattttttgggttattttttctagcagcattaccataaattggactgcagtgagtaatcttttaatcagatggaaagaggcattccaaatatgtttctagtcatctgagagtatttaacaacttctttaagaaataaagttaagcgt

SEQ ID NO: 188390 - DNA, 601 bp, Human
acaatagaaattattcatactccatcatccagctaactacaattttgtttcagccttttaaaaagtatgtgtatataccttttaaaatgtgtgtgcatatacaaatgacatcaccccatacatgtgattttgtaagtagatttttaaaggtttgctctcttttgttttgagattgctttgggtattgcagcattcctaatacaggactaagactttcacctcaagatgatagatccccacccaggtgcattggtggtggtttgggaagctgtgaccaaaactccacaaacctcgcaaatcraaagctctgagaaaagtgtttttctggctctcgggacttgctgatgactgcgcattggctctttttgcttcacgtgaccccttctgtccccaccaaagggagttctgcctggggacctttctagcgctccagttgccttatggcctgggagccctcagcatctttctgtctgcctgcctggaggaaattaggtggggacagtgaactagagcctggcccagctgctcattccccgaggcaggtgagcatgccctgggtggaagcctgcagcacatttttctaggagctgagttgctcgtt

SEQ ID NO: 188391 - DNA, 601 bp, Human
taactacaattttgtttcagccttttaaaaagtatgtgtatataccttttaaaatgtgtgtgcatatacaaatgacatcaccccatacatgtgattttgtaagtagatttttaaaggtttgctctcttttgttttgagattgctttgggtattgcagcattcctaatacaggactaagactttcacctcaagatgatagatccccacccaggtgcattggtggtggtttgggaagctgtgaccaaaactccacaaacctcgcaaatcgaaagctctgagaaaagtgtttttctggctctcrggacttgctgatgactgcgcattggctctttttgcttcacgtgaccccttctgtccccaccaaagggagttctgcctggggacctttctagcgctccagttgccttatggcctgggagccctcagcatctttctgtctgcctgcctggaggaaattaggtggggacagtgaactagagcctggcccagctgctcattccccgaggcaggtgagcatgccctgggtggaagcctgcagcacatttttctaggagctgagttgctcgttcttcatctttcccttatcccctagcacgtgtgt

SEQ ID NO: 188392 - DNA, 601 bp, Human
tttcacctcaagatgatagatccccacccaggtgcattggtggtggtttgggaagctgtgaccaaaactccacaaacctcgcaaatcgaaagctctgagaaaagtgtttttctggctctcgggacttgctgatgactgcgcattggctctttttgcttcacgtgaccccttctgtccccaccaaagggagttctgcctggggacctttctagcgctccagttgccttatggcctgggagccctcagcatctttctgtctgcctgcctggaggaaattaggtggggacagtgaactagagcytggcccagctgctcattccccgaggcaggtgagcatgccctgggtggaagcctgcagcacatttttctaggagctgagttgctcgttcttcatctttcccttatcccctagcacgtgtgtcttaggcagcagtcccaacctttttgacaccagggaccagttttgtagaagatcatttttccatggaccaggtggggaggggggtggtttgggatgaaactgttctacctcagatcaccaggcattagatcctcagaaggagcacgcgatctagatcgcttgtgtgcccggttcacaata

SEQ ID NO: 188393 - DNA, 601 bp, Human
tctgcctgcctggaggaaattaggtggggacagtgaactagagcctggcccagctgctcattccccgaggcaggtgagcatgccctgggtggaagcctgcagcacatttttctaggagctgagttgctcgttcttcatctttcccttatcccctagcacgtgtgtcttaggcagcagtcccaacctttttgacaccagggaccagttttgtagaagatcatttttccatggaccaggtggggaggggggtggtttgggatgaaactgttctacctcagatcaccaggcattagatcctcakaaggagcacgcgatctagatcgcttgtgtgcccggttcacaatagggtttgtgctcctatgagaagctagtgccaaggctaatctgacaggaggtggagctcaggcggaaatgctcatcgccagccatgcaccttctgctgtgcggcccaatccctaacagggcacaggccagtgcctcgggtctgcagccctggggttggggacccctcttctatgggacatcattctgcctgttgtgggctgtttctccagtggtccctttcttccagggcaacttcagccttcttgagctgaatatg

SEQ ID NO: 188394 - DNA, 601 bp, Human
ggtggggacagtgaactagagcctggcccagctgctcattccccgaggcaggtgagcatgccctgggtggaagcctgcagcacatttttctaggagctgagttgctcgttcttcatctttcccttatcccctagcacgtgtgtcttaggcagcagtcccaacctttttgacaccagggaccagttttgtagaagatcatttttccatggaccaggtggggaggggggtggtttgggatgaaactgttctacctcagatcaccaggcattagatcctcagaaggagcacgcgatctagatcscttgtgtgcccggttcacaatagggtttgtgctcctatgagaagctagtgccaaggctaatctgacaggaggtggagctcaggcggaaatgctcatcgccagccatgcaccttctgctgtgcggcccaatccctaacagggcacaggccagtgcctcgggtctgcagccctggggttggggacccctcttctatgggacatcattctgcctgttgtgggctgtttctccagtggtccctttcttccagggcaacttcagccttcttgagctgaatatgacaccagccttttaaaagcttt

SEQ ID NO: 188395 - DNA, 601 bp, Human
tggggacagtgaactagagcctggcccagctgctcattccccgaggcaggtgagcatgccctgggtggaagcctgcagcacatttttctaggagctgagttgctcgttcttcatctttcccttatcccctagcacgtgtgtcttaggcagcagtcccaacctttttgacaccagggaccagttttgtagaagatcatttttccatggaccaggtggggaggggggtggtttgggatgaaactgttctacctcagatcaccaggcattagatcctcagaaggagcacgcgatctagatcgcytgtgtgcccggttcacaatagggtttgtgctcctatgagaagctagtgccaaggctaatctgacaggaggtggagctcaggcggaaatgctcatcgccagccatgcaccttctgctgtgcggcccaatccctaacagggcacaggccagtgcctcgggtctgcagccctggggttggggacccctcttctatgggacatcattctgcctgttgtgggctgtttctccagtggtccctttcttccagggcaacttcagccttcttgagctgaatatgacaccagccttttaaaagctttcc

SEQ ID NO: 188396 - DNA, 601 bp, Human
cttatcccctagcacgtgtgtcttaggcagcagtcccaacctttttgacaccagggaccagttttgtagaagatcatttttccatggaccaggtggggaggggggtggtttgggatgaaactgttctacctcagatcaccaggcattagatcctcagaaggagcacgcgatctagatcgcttgtgtgcccggttcacaatagggtttgtgctcctatgagaagctagtgccaaggctaatctgacaggaggtggagctcaggcggaaatgctcatcgccagccatgcaccttctgctgtgyggcccaatccctaacagggcacaggccagtgcctcgggtctgcagccctggggttggggacccctcttctatgggacatcattctgcctgttgtgggctgtttctccagtggtccctttcttccagggcaacttcagccttcttgagctgaatatgacaccagccttttaaaagctttccaccttgttctatccaggtctggcagtttgacccaagaactgtggggattggggccctaaaggactctcctgtccccacccaggggtggcttcacctaggctgagtggcagaactgatgtt

SEQ ID NO: 188397 - DNA, 601 bp, Human
atcatagtgtaatgatgactgtgtgggtttgggatcatgtcccagttctgccctcatcaatcacatgaccttgagtaagttactttcttctttgagagtcagttttctcccaaactgcagtgggtatagtaatggtgactaccatgtgtggtgattataaagatgcagtaagatcgtgcacgtatgccactttgcaaaccatttggcttactgtcaggagtcaatatattcattcttaagcaagacattctccactgtctaagactattcaacacaaggcacactgaaaaggtctatacaragggactttggctgttcggaatgtgaaggggaaagttgcagggaatgagatttaacctaaaatagggcttacggttatgaattttaactatccacattccctctacccagtgaaaccatcaactgactgcacgttgccatggactgcaggagggacttttttttttttgagacagagttttggtcttgttgcccaggctagagtgcaatgacacgatctcggctgactgcaacctccgcctcccaggttcaagcaattctcctgcctcagcctcccgagtagctggggttacagtcatgc

SEQ ID NO: 188398 - DNA, 601 bp, Human
ctgtgtgggtttgggatcatgtcccagttctgccctcatcaatcacatgaccttgagtaagttactttcttctttgagagtcagttttctcccaaactgcagtgggtatagtaatggtgactaccatgtgtggtgattataaagatgcagtaagatcgtgcacgtatgccactttgcaaaccatttggcttactgtcaggagtcaatatattcattcttaagcaagacattctccactgtctaagactattcaacacaaggcacactgaaaaggtctatacagagggactttggctgttcrgaatgtgaaggggaaagttgcagggaatgagatttaacctaaaatagggcttacggttatgaattttaactatccacattccctctacccagtgaaaccatcaactgactgcacgttgccatggactgcaggagggacttttttttttttgagacagagttttggtcttgttgcccaggctagagtgcaatgacacgatctcggctgactgcaacctccgcctcccaggttcaagcaattctcctgcctcagcctcccgagtagctggggttacagtcatgcgccagcatgcccagctaa

SEQ ID NO: 188399 - DNA, 601 bp, Human
taccatgtgtggtgattataaagatgcagtaagatcgtgcacgtatgccactttgcaaaccatttggcttactgtcaggagtcaatatattcattcttaagcaagacattctccactgtctaagactattcaacacaaggcacactgaaaaggtctatacagagggactttggctgttcggaatgtgaaggggaaagttgcagggaatgagatttaacctaaaatagggcttacggttatgaattttaactatccacattccctctacccagtgaaaccatcaactgactgcacgttgccrtggactgcaggagggacttttttttttttgagacagagttttggtcttgttgcccaggctagagtgcaatgacacgatctcggctgactgcaacctccgcctcccaggttcaagcaattctcctgcctcagcctcccgagtagctggggttacagtcatgcgccagcatgcccagctaattttgtatttttagtagagatggagtttcaccatgtcggtcaggctggtctcgaactcctgacctcatgtgatctgcccgccttggcctcccaaagtgttgggattacaggcgtgagccac

SEQ ID NO: 188400 - DNA, 601 bp, Human
gtgctatcgaaacccagatgctctcctttttctcactaccttttagattctccatcctaattgttgggaacagcagtacaaaatgagggaaaatgatacaagtgaccaaaagggtgatgagactttcaaaaacctgagttccagaaggcaccagcgtcagcaattcagagtgttttggatcttaagccatagcaactagtggaaaccttgtggaaacctcagcaggaccccccatgctacagtaggattggtgctggttgtgtgtgtgtgtgtgtgtgtgtgtgtgtgtgtgtgtgtgtggacacactggtaaatagggctcttttatttctagcactggtctattccgaagtttccgaatatagaattacatattacagcagggctgcttagcattcttgtaacattctgaaccccaagattttctgtgttatattctcccagatccctcactttctttttccatggaaaatgttctgagttgggggattgcagttaccaccacgacacgtcccaaacatttcctgagcatctcctgcagatgatgatgaggctgaccgaattgtggactctgctttgttccaaggcagtggacaaacaa

SEQ ID NO: 188401 - DNA, 601 bp, Human
cattcttgtaacattctgaaccccaagattttctgtgttatattctcccagatccctcactttctttttccatggaaaatgttctgagttgggggattgcagttaccaccacgacacgtcccaaacatttcctgagcatctcctgcagatgatgatgaggctgaccgaattgtggactctgctttgttccaaggcagtggacaaacaaattacaccttccacttacagaatattgtactgatacttcttgaaatgcttgcacgtatattacttcattttagcattggacagctctttgagrcagatgagtcgttattacctccctttagccaatgaagacaataaatttgagaaggttactcaaagaattattgactatcagctatgtgacatatgggatattaaaaggcaccacacgaacttcttgcactcatgaaacgtgcattctagtggaagaggtaacaataaattaataaattcaatgtaatgccagatagtgaccaatgctatggagacatgtattttaaaaagcaggcattttaagaagatggaatatgaccagacacgctgtgttaggtgggcaggtctacctaacacagaa

SEQ ID NO: 188402 - DNA, 601 bp, Human
cattctgaaccccaagattttctgtgttatattctcccagatccctcactttctttttccatggaaaatgttctgagttgggggattgcagttaccaccacgacacgtcccaaacatttcctgagcatctcctgcagatgatgatgaggctgaccgaattgtggactctgctttgttccaaggcagtggacaaacaaattacaccttccacttacagaatattgtactgatacttcttgaaatgcttgcacgtatattacttcattttagcattggacagctctttgagacagatgagtcrttattacctccctttagccaatgaagacaataaatttgagaaggttactcaaagaattattgactatcagctatgtgacatatgggatattaaaaggcaccacacgaacttcttgcactcatgaaacgtgcattctagtggaagaggtaacaataaattaataaattcaatgtaatgccagatagtgaccaatgctatggagacatgtattttaaaaagcaggcattttaagaagatggaatatgaccagacacgctgtgttaggtgggcaggtctacctaacacagaaggtctctctga

SEQ ID NO: 188403 - DNA, 601 bp, Human
aagctgtgtggctgtctggggtaagagcatctgcactgaggaaatagcatgtgcaaaggtcctgtggcaggagactggctggggccttcagcgtttccctgctgagaagctgcatcagtagaatgaagctaggtcagagagcaagccagggccctacgtgggttaggctttgtgcaccaccctaatgattgtgaaaaataccctgaaaaggtttttgctctgaggaggaggacttttgagggttacctactgggaatgatatcatctggtttatattttaaaaggatccttctggccactstgtagagaataggctggaggggcaaagtagaacgaaaaaggcatgttaggtggctgttgcagtggtttagataacagatggtgatggtttagtccacagtgttagtggtggaggtggtgagcagattgggtactgatagattttgaagacagggcaggcagggtttgctggtgtcatggaggcaggtgtccaagaaaggcaggagtcagggggaccctgagctcagaagaattcaagaagtcatagtcatgttgtggttggctgaagatagatctagactttctgactggcccagatctc

SEQ ID NO: 188404 - DNA, 601 bp, Human
ctggggtaagagcatctgcactgaggaaatagcatgtgcaaaggtcctgtggcaggagactggctggggccttcagcgtttccctgctgagaagctgcatcagtagaatgaagctaggtcagagagcaagccagggccctacgtgggttaggctttgtgcaccaccctaatgattgtgaaaaataccctgaaaaggtttttgctctgaggaggaggacttttgagggttacctactgggaatgatatcatctggtttatattttaaaaggatccttctggccactgtgtagagaataggcyggaggggcaaagtagaacgaaaaaggcatgttaggtggctgttgcagtggtttagataacagatggtgatggtttagtccacagtgttagtggtggaggtggtgagcagattgggtactgatagattttgaagacagggcaggcagggtttgctggtgtcatggaggcaggtgtccaagaaaggcaggagtcagggggaccctgagctcagaagaattcaagaagtcatagtcatgttgtggttggctgaagatagatctagactttctgactggcccagatctcccggcgatctttcca

SEQ ID NO: 188405 - DNA, 601 bp, Human
ctgcatcagtagaatgaagctaggtcagagagcaagccagggccctacgtgggttaggctttgtgcaccaccctaatgattgtgaaaaataccctgaaaaggtttttgctctgaggaggaggacttttgagggttacctactgggaatgatatcatctggtttatattttaaaaggatccttctggccactgtgtagagaataggctggaggggcaaagtagaacgaaaaaggcatgttaggtggctgttgcagtggtttagataacagatggtgatggtttagtccacagtgttagtggyggaggtggtgagcagattgggtactgatagattttgaagacagggcaggcagggtttgctggtgtcatggaggcaggtgtccaagaaaggcaggagtcagggggaccctgagctcagaagaattcaagaagtcatagtcatgttgtggttggctgaagatagatctagactttctgactggcccagatctcccggcgatctttccagggccactttgagaaaaggcagtgagtagcaggggtctccgtccggcttggcacgttctccttgaggccattgtgagtcctctaagaagggact

SEQ ID NO: 188406 - DNA, 601 bp, Human
gtcagagagcaagccagggccctacgtgggttaggctttgtgcaccaccctaatgattgtgaaaaataccctgaaaaggtttttgctctgaggaggaggacttttgagggttacctactgggaatgatatcatctggtttatattttaaaaggatccttctggccactgtgtagagaataggctggaggggcaaagtagaacgaaaaaggcatgttaggtggctgttgcagtggtttagataacagatggtgatggtttagtccacagtgttagtggtggaggtggtgagcagattgggtwctgatagattttgaagacagggcaggcagggtttgctggtgtcatggaggcaggtgtccaagaaaggcaggagtcagggggaccctgagctcagaagaattcaagaagtcatagtcatgttgtggttggctgaagatagatctagactttctgactggcccagatctcccggcgatctttccagggccactttgagaaaaggcagtgagtagcaggggtctccgtccggcttggcacgttctccttgaggccattgtgagtcctctaagaagggactctgtctctgtcaacccacctttg

SEQ ID NO: 188407 - DNA, 601 bp, Human
ccttctggccactgtgtagagaataggctggaggggcaaagtagaacgaaaaaggcatgttaggtggctgttgcagtggtttagataacagatggtgatggtttagtccacagtgttagtggtggaggtggtgagcagattgggtactgatagattttgaagacagggcaggcagggtttgctggtgtcatggaggcaggtgtccaagaaaggcaggagtcagggggaccctgagctcagaagaattcaagaagtcatagtcatgttgtggttggctgaagatagatctagactttctgaytggcccagatctcccggcgatctttccagggccactttgagaaaaggcagtgagtagcaggggtctccgtccggcttggcacgttctccttgaggccattgtgagtcctctaagaagggactctgtctctgtcaacccacctttgaccacagacctttactgatcctttctgattgataaacaatagagggaggaggttgtgtgatcttttagtttatctcaaggatatcaaaggggaggggaagccctaactgaatatctagctaaataggagataccattcagtctatttgtagtgta

SEQ ID NO: 188408 - DNA, 601 bp, Human
tttactgatcctttctgattgataaacaatagagggaggaggttgtgtgatcttttagtttatctcaaggatatcaaaggggaggggaagccctaactgaatatctagctaaataggagataccattcagtctatttgtagtgtattttaaagcctgtttcatgtgcaaatgtgaactacacagaggtaatctgataatcccaaaagggtaatctgataattccaaaagggtaatctgataatcccaaaagcttattaacataccttgtagataatagatatccagttagtatttgttgcrtttggtgatttgtggttgaatattgagtgttggtattttctagaaccttacattcaattctcttccctatatttgtggttagagtcacacttcactttcagatggaatgagtgtcagtgtttccagtattttccagatgaggaaactgagatgggaaaaagggaaaaggtaggcgtttaacaaaggcatttcataccactggcttattgtcgatgaaacaggcagaagaatcttcctgctgtatcccagacattcactatcgggattcacaccctgttgtatcattgaaaaacgcgcaga

SEQ ID NO: 188409 - DNA, 601 bp, Human
gtagtgtattttaaagcctgtttcatgtgcaaatgtgaactacacagaggtaatctgataatcccaaaagggtaatctgataattccaaaagggtaatctgataatcccaaaagcttattaacataccttgtagataatagatatccagttagtatttgttgcatttggtgatttgtggttgaatattgagtgttggtattttctagaaccttacattcaattctcttccctatatttgtggttagagtcacacttcactttcagatggaatgagtgtcagtgtttccagtattttccagrtgaggaaactgagatgggaaaaagggaaaaggtaggcgtttaacaaaggcatttcataccactggcttattgtcgatgaaacaggcagaagaatcttcctgctgtatcccagacattcactatcgggattcacaccctgttgtatcattgaaaaacgcgcagacttcagctggatgaggtgctcatgcctgcaatcccagcactttgagaggccgaggccagagggttgcttgaggccaggagttcgagaccagtctcggcaacattgtgagaccccatttctacaaaaaatattttgaa

SEQ ID NO: 188410 - DNA, 601 bp, Human
ttgttgcatttggtgatttgtggttgaatattgagtgttggtattttctagaaccttacattcaattctcttccctatatttgtggttagagtcacacttcactttcagatggaatgagtgtcagtgtttccagtattttccagatgaggaaactgagatgggaaaaagggaaaaggtaggcgtttaacaaaggcatttcataccactggcttattgtcgatgaaacaggcagaagaatcttcctgctgtatcccagacattcactatcgggattcacaccctgttgtatcattgaaaaaygcgcagacttcagctggatgaggtgctcatgcctgcaatcccagcactttgagaggccgaggccagagggttgcttgaggccaggagttcgagaccagtctcggcaacattgtgagaccccatttctacaaaaaatattttgaaaactagctgggtatggtggcacacacctctagttccaggagttcaagcttacgtgagctgtaatcacatcactgtgctccagtctgctcaacagagcaagaccctatctctaaaagaaaagaaaaagagaaaggaaagaaacaatgaatgaaaatg

SEQ ID NO: 188411 - DNA, 601 bp, Human
atcactgtgctccagtctgctcaacagagcaagaccctatctctaaaagaaaagaaaaagagaaaggaaagaaacaatgaatgaaaatgtgtagactttaattcacactgaccttctaagtttttcttaggcctttattgacattgttatgtcacaacaaaatctggccatctctgagaacttataaaactttagtggttttaggccaggcgtggtggatcacacctgtcatcccagcactttgggaggctgaggcgggcggatcacctgaggtcaggaattcgagaccagcctgaccaayatggtgaaaccccatctctactaaaaatacaaaattagccaggcatggtggcgcatgcctgtaatcactgctactcgggaggctgaggcaggagagccacttgaacccgggaggcagagattgcagtgagtcgagattgtgtcattgcgctccagcctgggcaacaagagtgaaagtccatctcgaaaaaaaaaaaacaaaaaccaaaaaaaaaactttagtgtttttcagagacatagtgtttccccaagttgtcatttgaagtacacaccccttcttccaaccacatgggcgtcagca

SEQ ID NO: 188412 - DNA, 601 bp, Human
tcacactgaccttctaagtttttcttaggcctttattgacattgttatgtcacaacaaaatctggccatctctgagaacttataaaactttagtggttttaggccaggcgtggtggatcacacctgtcatcccagcactttgggaggctgaggcgggcggatcacctgaggtcaggaattcgagaccagcctgaccaatatggtgaaaccccatctctactaaaaatacaaaattagccaggcatggtggcgcatgcctgtaatcactgctactcgggaggctgaggcaggagagccactkgaacccgggaggcagagattgcagtgagtcgagattgtgtcattgcgctccagcctgggcaacaagagtgaaagtccatctcgaaaaaaaaaaaacaaaaaccaaaaaaaaaactttagtgtttttcagagacatagtgtttccccaagttgtcatttgaagtacacaccccttcttccaaccacatgggcgtcagcaactccactgtgatcaaaaggcagcctgtctgacagaatattccccagtcttcttccctatcggcattttgaggcagggacacactacagcaaaatcagtcca

SEQ ID NO: 188413 - DNA, 601 bp, Human
tgacattgttatgtcacaacaaaatctggccatctctgagaacttataaaactttagtggttttaggccaggcgtggtggatcacacctgtcatcccagcactttgggaggctgaggcgggcggatcacctgaggtcaggaattcgagaccagcctgaccaatatggtgaaaccccatctctactaaaaatacaaaattagccaggcatggtggcgcatgcctgtaatcactgctactcgggaggctgaggcaggagagccacttgaacccgggaggcagagattgcagtgagtcgagatygtgtcattgcgctccagcctgggcaacaagagtgaaagtccatctcgaaaaaaaaaaaacaaaaaccaaaaaaaaaactttagtgtttttcagagacatagtgtttccccaagttgtcatttgaagtacacaccccttcttccaaccacatgggcgtcagcaactccactgtgatcaaaaggcagcctgtctgacagaatattccccagtcttcttccctatcggcattttgaggcagggacacactacagcaaaatcagtccagacccttatataaaataactcttccgtccaccacag

SEQ ID NO: 188414 - DNA, 601 bp, Human
ttgcagtgagtcgagattgtgtcattgcgctccagcctgggcaacaagagtgaaagtccatctcgaaaaaaaaaaaacaaaaaccaaaaaaaaaactttagtgtttttcagagacatagtgtttccccaagttgtcatttgaagtacacaccccttcttccaaccacatgggcgtcagcaactccactgtgatcaaaaggcagcctgtctgacagaatattccccagtcttcttccctatcggcattttgaggcagggacacactacagcaaaatcagtccagacccttatataaaataastcttccgtccaccacagtggccaatatttccttttcctaccttggccctgcctgatcacacacaccagctctgcagccagaggacccctcatgggtgaagtgggctccgggtaccctgtgagttgagaccacggtcccccaggagcatgcagtggtgcctgagggtggttggcagtggtgatggctgtgttatgtgtccttctctctctgtctgcgagtctggttgggtggactttgtccttggttcaaaaagctctcagggatcagctccctgttctcttactcacaggtcgcttctag

SEQ ID NO: 188415 - DNA, 601 bp, Human
cttctgctgtaggattcacgttcactttctcctgttctgactgtcctctgtggcatacacctttgatgtattgatctcccaggtggcttcctaatcctcagggtgctgcagaggtcagaggggcagtgtgaccacacacctggaggggcctggggaagtgccttttgtcagcccaggtttgaatgacctgcaggctaattatgttacttacgacttatgttgcactgggctccttaatgccaacctctgggcgtttgaaggttataaaaagagaaaaatcaaaactcagaccatcagttgygctgattactaattgctttggtgggagattttgtgggaaagacactaatagtcaaaggtggtttgaacaatcacctgtgacttaacctcattccgacttttcttttgactacttattgccagcaccagacaggaagagcaaaaggcagagcaaagcgtctgctgcaggtgaatcaagatgtagcatgatcttgtcccaaatatgcatagccacacagtcacctctcatgggagcacagtcctgtgtgtttgcctatccacgctgcatggctgattcctttcttgatatatgcttcctgtc

SEQ ID NO: 188416 - DNA, 601 bp, Human
gcactgggctccttaatgccaacctctgggcgtttgaaggttataaaaagagaaaaatcaaaactcagaccatcagttgcgctgattactaattgctttggtgggagattttgtgggaaagacactaatagtcaaaggtggtttgaacaatcacctgtgacttaacctcattccgacttttcttttgactacttattgccagcaccagacaggaagagcaaaaggcagagcaaagcgtctgctgcaggtgaatcaagatgtagcatgatcttgtcccaaatatgcatagccacacagtcayctctcatgggagcacagtcctgtgtgtttgcctatccacgctgcatggctgattcctttcttgatatatgcttcctgtcttttgtagggggaggtgctctttggcatctccagacagacccctctccactcctctcctatctcttgtcttcttttgcactatgagccatgatgttttagaatttccatgcctcgttgaggctggaatttggtacagatccaccacaacccagcatcaacctggaaaccaatgcagctctccttggaggcttgctgcccgtatctacagctttcttcactt

SEQ ID NO: 188417 - DNA, 601 bp, Human
ggctccttaatgccaacctctgggcgtttgaaggttataaaaagagaaaaatcaaaactcagaccatcagttgcgctgattactaattgctttggtgggagattttgtgggaaagacactaatagtcaaaggtggtttgaacaatcacctgtgacttaacctcattccgacttttcttttgactacttattgccagcaccagacaggaagagcaaaaggcagagcaaagcgtctgctgcaggtgaatcaagatgtagcatgatcttgtcccaaatatgcatagccacacagtcacctctcrtgggagcacagtcctgtgtgtttgcctatccacgctgcatggctgattcctttcttgatatatgcttcctgtcttttgtagggggaggtgctctttggcatctccagacagacccctctccactcctctcctatctcttgtcttcttttgcactatgagccatgatgttttagaatttccatgcctcgttgaggctggaatttggtacagatccaccacaacccagcatcaacctggaaaccaatgcagctctccttggaggcttgctgcccgtatctacagctttcttcactttttccc

SEQ ID NO: 188418 - DNA, 601 bp, Human
ccatgcctcgttgaggctggaatttggtacagatccaccacaacccagcatcaacctggaaaccaatgcagctctccttggaggcttgctgcccgtatctacagctttcttcactttttccccaacctgcggaaaggcctttttgttgatctcatcaatctgtgatttgagatcttgaaagaaccaagatcttgtgacttggcagggggagccacccgccatgtagccccaccctgtgccctccctgaccccgtcgccccctgtgcggacctgctgcgcttcaggggaaaacagcacgttwagtgagcagtttagcttggactgaatccggaggcaaatcaagtaactttatactgagatactctctccattgtgttctcaggaagatgaagtgaatcaccagagcaaagaatgtgctctctggtgctacaccaataataaagtacaatgttttgaattagaggagggagagagagtaactgagaaacctttggctggtcactttattgttccttgtggctcccccttcccttccctcagatatatacttggataagaatttccttctccagcccagtatttcctaaactcaatcctgcag

SEQ ID NO: 188419 - DNA, 601 bp, Human
acttggcagggggagccacccgccatgtagccccaccctgtgccctccctgaccccgtcgccccctgtgcggacctgctgcgcttcaggggaaaacagcacgttaagtgagcagtttagcttggactgaatccggaggcaaatcaagtaactttatactgagatactctctccattgtgttctcaggaagatgaagtgaatcaccagagcaaagaatgtgctctctggtgctacaccaataataaagtacaatgttttgaattagaggagggagagagagtaactgagaaacctttggctsgtcactttattgttccttgtggctcccccttcccttccctcagatatatacttggataagaatttccttctccagcccagtatttcctaaactcaatcctgcagtaaaatgacaaggccgtgttagacatggaaattattgcagagcaacaaatccaagattgttatttcaccaaaggccccaggaagtggagatgaagaactgtgagagcataagcctccagctcaacccaaatgtgtttttcttgccccacttgttaattagtaaatcaaaaccaaatgaaaaatgcaaataagtgca

SEQ ID NO: 188420 - DNA, 601 bp, Human
tgcggacctgctgcgcttcaggggaaaacagcacgttaagtgagcagtttagcttggactgaatccggaggcaaatcaagtaactttatactgagatactctctccattgtgttctcaggaagatgaagtgaatcaccagagcaaagaatgtgctctctggtgctacaccaataataaagtacaatgttttgaattagaggagggagagagagtaactgagaaacctttggctggtcactttattgttccttgtggctcccccttcccttccctcagatatatacttggataagaatttcsttctccagcccagtatttcctaaactcaatcctgcagtaaaatgacaaggccgtgttagacatggaaattattgcagagcaacaaatccaagattgttatttcaccaaaggccccaggaagtggagatgaagaactgtgagagcataagcctccagctcaacccaaatgtgtttttcttgccccacttgttaattagtaaatcaaaaccaaatgaaaaatgcaaataagtgcatgccacaaatctgtcatacttgaatgtttcccactttatttctgtctttctgactttatcctgtcca

SEQ ID NO: 188421 - DNA, 601 bp, Human
gacaaggccgtgttagacatggaaattattgcagagcaacaaatccaagattgttatttcaccaaaggccccaggaagtggagatgaagaactgtgagagcataagcctccagctcaacccaaatgtgtttttcttgccccacttgttaattagtaaatcaaaaccaaatgaaaaatgcaaataagtgcatgccacaaatctgtcatacttgaatgtttcccactttatttctgtctttctgactttatcctgtccatcattctcgtcatctgtgagtaaaagcacccaaaagcaccttgrtagattggcgtcaatttgggtcttatacataaaactgcctgacaaatgacagcgttcaggtagggattatttagttaacacagaagttatgtgatttatattttttaagaacagaaagatgggagtgataaggcactatttttcccactcttttttaagtttcttacaggtgttttctgtttttgttttgttttgtttctaaatcatacattcaaatgcttgagcctggtgaattttttgttagcttgcttgtttttggtcatttaggaagcattgcctattcagatagacatttacaat

SEQ ID NO: 188422 - DNA, 601 bp, Human
aatcaaaaccaaatgaaaaatgcaaataagtgcatgccacaaatctgtcatacttgaatgtttcccactttatttctgtctttctgactttatcctgtccatcattctcgtcatctgtgagtaaaagcacccaaaagcaccttggtagattggcgtcaatttgggtcttatacataaaactgcctgacaaatgacagcgttcaggtagggattatttagttaacacagaagttatgtgatttatattttttaagaacagaaagatgggagtgataaggcactatttttcccactctttttwaagtttcttacaggtgttttctgtttttgttttgttttgtttctaaatcatacattcaaatgcttgagcctggtgaattttttgttagcttgcttgtttttggtcatttaggaagcattgcctattcagatagacatttacaatcaaatagggctgaacacaccagcacagctgttgctcagaagggaccaggagggctggttgccccagaaaaggaaagatattctccaagaacagtcctgggagaagcattttgttgtgtttttgcaaggacgtggggatccaagttttgtctattaa

SEQ ID NO: 188423 - DNA, 601 bp, Human
tttcggtgttgttgaggtgaagagggacagccatgtgcagatgcccccgattagggacatgttctgaccacggctgcccagggctcaggccagcctgggcccatcacgcggaccagaggttggacggaaccatgagaaaagactctccccgtgtcccagggcttggcacagtggtgctgtgccgcgaataataggtcatctgatgcggtataatttaataggaatatgaatccccagtaacccggggaaccaaagcaaggaattggcctctcagttacttttaactttcaaaacttgaacrtttccttaaaccaaatagccccatcgtcatggtcagaagtccactgtggagaaaggcaggatttagtgtttatttaagctgccaccccatgagagaaactgttgcccagtggagtttgactctcaatttttcaaggaatgattttccattttgtggattttttatgtatgtcttctctctctctctgtctttccttccttccttccctacctccctccagaaatgttgatgggagcaggaaaatttattggccaggtaagggtgtatatgaagaaaaaccttgatggtagggatcctgat

SEQ ID NO: 188424 - DNA, 601 bp, Human
aggcaggaggattgcttgggcccaggaggtcgaggctgcagtgatctgtgattgcaccactgcactccagcctcggcaacagagggagacactgtctcaaataaaaatgcaccatctggtgccatgtagcactgttgggcgtctgcagagcattttggtcacagggtcttctttgcctcccgcctcttcatatgtagatgttactacgccacaagcagagggaggttggtcaccaaatccggaaacatgggcaaacccacaataaatgggttattgatactacattccagtatacagtaaratactcttgtctttgtttccagattttatggccactctgtagaagcttcaagggactgaaaataagtcatttgatgcagctaaaaagagacattgctgccttttgatctcacatcttcagcctgacggtcctgtgttctcttcatatcagactcctgactttcagaaaagagccaatcaccatttgactagggctcatcacttttcaactttttcaggatttcttttggcaagagcaccccccctctctctcatgtgagctcactctctcctctctctcatatccgtgctcctcttccta

SEQ ID NO: 188425 - DNA, 601 bp, Human
aacatgggcaaacccacaataaatgggttattgatactacattccagtatacagtaagatactcttgtctttgtttccagattttatggccactctgtagaagcttcaagggactgaaaataagtcatttgatgcagctaaaaagagacattgctgccttttgatctcacatcttcagcctgacggtcctgtgttctcttcatatcagactcctgactttcagaaaagagccaatcaccatttgactagggctcatcacttttcaactttttcaggatttcttttggcaagagcacccccyctctctctcatgtgagctcactctctcctctctctcatatccgtgctcctcttcctacagtgctgacctctgaggtatccttttttcttttgactctcatcagtctacaacctctgtctatttctccttctcttagtctctctgtgactcccctggattaaaccttgtttctgctcagactcagcaaatattcattgtgagcctactatgtgccaggtgctgtgctgggcttatcactcagtattcactgatttccccagcctctttctgctcagaggtcctacatagccttggggtgag

SEQ ID NO: 188426 - DNA, 601 bp, Human
ttgatactacattccagtatacagtaagatactcttgtctttgtttccagattttatggccactctgtagaagcttcaagggactgaaaataagtcatttgatgcagctaaaaagagacattgctgccttttgatctcacatcttcagcctgacggtcctgtgttctcttcatatcagactcctgactttcagaaaagagccaatcaccatttgactagggctcatcacttttcaactttttcaggatttcttttggcaagagcaccccccctctctctcatgtgagctcactctctcctstctctcatatccgtgctcctcttcctacagtgctgacctctgaggtatccttttttcttttgactctcatcagtctacaacctctgtctatttctccttctcttagtctctctgtgactcccctggattaaaccttgtttctgctcagactcagcaaatattcattgtgagcctactatgtgccaggtgctgtgctgggcttatcactcagtattcactgatttccccagcctctttctgctcagaggtcctacatagccttggggtgagggtgtttagctaatccccttgtgtttgggg

SEQ ID NO: 188427 - DNA, 601 bp, Human
tttcttttgactctcatcagtctacaacctctgtctatttctccttctcttagtctctctgtgactcccctggattaaaccttgtttctgctcagactcagcaaatattcattgtgagcctactatgtgccaggtgctgtgctgggcttatcactcagtattcactgatttccccagcctctttctgctcagaggtcctacatagccttggggtgagggtgtttagctaatccccttgtgtttggggtgggccgtaaatgagctctgatggaccatcctcagcccctccagaatgacctckgaggaatcaatggctgagaaggagagatggagagtgtattagtccattttcaaattgctgtgaagaaatacccaaggctggataatttacaaagaaaaagaggtttaatggactcacagttccacatgactggggaggtctcacaatcatgatggaagacagaggtacaccttatatggcggcaatcaagaaagagcatgtgcaggggaaatgccctttatgaaatcatcagatctcatgagacttattcactatcacaagaacagcacgggaaaacccacccccacgattcaactgtct

SEQ ID NO: 188428 - DNA, 601 bp, Human
attcactgatttccccagcctctttctgctcagaggtcctacatagccttggggtgagggtgtttagctaatccccttgtgtttggggtgggccgtaaatgagctctgatggaccatcctcagcccctccagaatgacctctgaggaatcaatggctgagaaggagagatggagagtgtattagtccattttcaaattgctgtgaagaaatacccaaggctggataatttacaaagaaaaagaggtttaatggactcacagttccacatgactggggaggtctcacaatcatgatggaagrcagaggtacaccttatatggcggcaatcaagaaagagcatgtgcaggggaaatgccctttatgaaatcatcagatctcatgagacttattcactatcacaagaacagcacgggaaaacccacccccacgattcaactgtctcccaccaggtacctcccacaacacatggggattatgggagctacagttcaagatgagatttgggtggggacacagccaaaccttatcaaagaggaagagcaaaagagaatggaagaggtatatgccccaaagaactgaaaacacgtactcacatacaag

SEQ ID NO: 188429 - DNA, 601 bp, Human
cagaatgacctctgaggaatcaatggctgagaaggagagatggagagtgtattagtccattttcaaattgctgtgaagaaatacccaaggctggataatttacaaagaaaaagaggtttaatggactcacagttccacatgactggggaggtctcacaatcatgatggaagacagaggtacaccttatatggcggcaatcaagaaagagcatgtgcaggggaaatgccctttatgaaatcatcagatctcatgagacttattcactatcacaagaacagcacgggaaaacccacccccackattcaactgtctcccaccaggtacctcccacaacacatggggattatgggagctacagttcaagatgagatttgggtggggacacagccaaaccttatcaaagaggaagagcaaaagagaatggaagaggtatatgccccaaagaactgaaaacacgtactcacatacaagtacatgcatgttcatagaagcactattcacaatagccaaaaggtggaaagagtccaaatgtccatcgatggatgaatggataaacaaaatgtggcatgtatccatacaatggaatgtcattcagccata

SEQ ID NO: 188430 - DNA, 601 bp, Human
taatttacaaagaaaaagaggtttaatggactcacagttccacatgactggggaggtctcacaatcatgatggaagacagaggtacaccttatatggcggcaatcaagaaagagcatgtgcaggggaaatgccctttatgaaatcatcagatctcatgagacttattcactatcacaagaacagcacgggaaaacccacccccacgattcaactgtctcccaccaggtacctcccacaacacatggggattatgggagctacagttcaagatgagatttgggtggggacacagccaaaccwtatcaaagaggaagagcaaaagagaatggaagaggtatatgccccaaagaactgaaaacacgtactcacatacaagtacatgcatgttcatagaagcactattcacaatagccaaaaggtggaaagagtccaaatgtccatcgatggatgaatggataaacaaaatgtggcatgtatccatacaatggaatgtcattcagccataaataaggatggagtgcagacacacgctacaacatggatgcaccttgaaaacatgatgctaaatgaagccagtcacaaaggatcacatgttgtgtg

SEQ ID NO: 188431 - DNA, 601 bp, Human
gtctcacaatcatgatggaagacagaggtacaccttatatggcggcaatcaagaaagagcatgtgcaggggaaatgccctttatgaaatcatcagatctcatgagacttattcactatcacaagaacagcacgggaaaacccacccccacgattcaactgtctcccaccaggtacctcccacaacacatggggattatgggagctacagttcaagatgagatttgggtggggacacagccaaaccttatcaaagaggaagagcaaaagagaatggaagaggtatatgccccaaagaactgwaaacacgtactcacatacaagtacatgcatgttcatagaagcactattcacaatagccaaaaggtggaaagagtccaaatgtccatcgatggatgaatggataaacaaaatgtggcatgtatccatacaatggaatgtcattcagccataaataaggatggagtgcagacacacgctacaacatggatgcaccttgaaaacatgatgctaaatgaagccagtcacaaaggatcacatgttgtgtgattgttttcatgtgaaatatccaaaataggcagatccagaagaggcagaacacag

SEQ ID NO: 188432 - DNA, 601 bp, Human
aattttatgttatgtaaattttacctcaattgaaaagaatgaaagataaaggaaggaatgtgttaggggtctattgctttgaattaaggatgcaatttagaaatctggcctgactttcctatgcatggtgaccttgtgatgtggcttgagtataattgaagtaatttgagtagattaatttccttccttggcttcttaaaatttaacgtgcttgaagtttgcatcctgaatttagaatgcaaagcagtatgtggatgagtattctgggccaatagtgctgctgcttaaaacaacaaacccrgacagatgtgttcagcaggttctccagcttagctgtttgcatcttggagaactgttcctgggtcctggggaaagaccactgggggtggggtcagaagcctgagttctgttctgcctccttatgcccatggaggatactgcagagctcaggaaagagcacgaagcaggacccagccctggctcacacgtgcattcaacacacattcttgggcaccatgtactaagccttctatgggatatatgaaggtgaacatgacatggaccctgcctttgagaggcttgcagcccagcaggttaaggt

SEQ ID NO: 188433 - DNA, 601 bp, Human
aaggatgcaatttagaaatctggcctgactttcctatgcatggtgaccttgtgatgtggcttgagtataattgaagtaatttgagtagattaatttccttccttggcttcttaaaatttaacgtgcttgaagtttgcatcctgaatttagaatgcaaagcagtatgtggatgagtattctgggccaatagtgctgctgcttaaaacaacaaacccagacagatgtgttcagcaggttctccagcttagctgtttgcatcttggagaactgttcctgggtcctggggaaagaccactggggstggggtcagaagcctgagttctgttctgcctccttatgcccatggaggatactgcagagctcaggaaagagcacgaagcaggacccagccctggctcacacgtgcattcaacacacattcttgggcaccatgtactaagccttctatgggatatatgaaggtgaacatgacatggaccctgcctttgagaggcttgcagcccagcaggttaaggtagacacgcaaacagctgatcgttttggtataaggtaggggtttgatgctgaagatcttcatgggaccttatagaggtctagagtt

SEQ ID NO: 188434 - DNA, 601 bp, Human
tcagcaggttctccagcttagctgtttgcatcttggagaactgttcctgggtcctggggaaagaccactgggggtggggtcagaagcctgagttctgttctgcctccttatgcccatggaggatactgcagagctcaggaaagagcacgaagcaggacccagccctggctcacacgtgcattcaacacacattcttgggcaccatgtactaagccttctatgggatatatgaaggtgaacatgacatggaccctgcctttgagaggcttgcagcccagcaggttaaggtagacacgcaaayagctgatcgttttggtataaggtaggggtttgatgctgaagatcttcatgggaccttatagaggtctagagttgagggtactaaaactacctgggggtgaggtttggtggaagaaggcaactaaggaaagcttcctggattcaatcttaaaggaagatttaaaatattgctgaattactgcaataaaccgaatgtttgtttccacgcccctgcaaattcatatcttgaaacctaacccccaaggtgatggtattaggaggtggggcctttgggaggtgattaagccctcatgaatgagat

SEQ ID NO: 188435 - DNA, 601 bp, Human
acacattcttgggcaccatgtactaagccttctatgggatatatgaaggtgaacatgacatggaccctgcctttgagaggcttgcagcccagcaggttaaggtagacacgcaaacagctgatcgttttggtataaggtaggggtttgatgctgaagatcttcatgggaccttatagaggtctagagttgagggtactaaaactacctgggggtgaggtttggtggaagaaggcaactaaggaaagcttcctggattcaatcttaaaggaagatttaaaatattgctgaattactgcaataraccgaatgtttgtttccacgcccctgcaaattcatatcttgaaacctaacccccaaggtgatggtattaggaggtggggcctttgggaggtgattaagccctcatgaatgagattagtgcccttattaaagagaccccagagagctgcctcactgcttccaccatgtgagggcacagcgagaagacagccatctatgaaccagggaagaggccctcatcagcaccttggtcttagacttccagcccctagaactgtgagaaatacatttgtgttgtttgtgagccacctagtctatattt

SEQ ID NO: 188436 - DNA, 601 bp, Human
caatttaagaccttcaaaggtagagtttaaggtggaaaagggtgagggacgagggtgggaggtggctgtggggtacaggctgaagggctcttggcaggcctgttacaagtcagacttgtggccctggtactagctgcagtgtggagagagtggatggacatggggcaaaatgcgaggcagtgggactgaggctctgcatgagggcagtggtagtgaagggagtgggacccactgggtttgagacacttctagaatgatgctgtccagtagaactctctgagatgatggaagcatccaacgrtgtgctctccaatacaggagccaccagacacttgtgactcttgaacactttcaacgtgactgatgtgacaggaaccaaattttacattttaatttatttaaatttaaatagctccccgtgcctgtagcttctatattggacagtatagttctagaaagtaaaagcaacaagagttgatgattaattgggcaatttagggtggcagggtagacagagctagagacagaggggcaggttaattgtagaggggggaaagatgagtaccactgtgtgcatgttggctccaagtgcgagagacat

SEQ ID NO: 188437 - DNA, 601 bp, Human
ccctggtactagctgcagtgtggagagagtggatggacatggggcaaaatgcgaggcagtgggactgaggctctgcatgagggcagtggtagtgaagggagtgggacccactgggtttgagacacttctagaatgatgctgtccagtagaactctctgagatgatggaagcatccaacggtgtgctctccaatacaggagccaccagacacttgtgactcttgaacactttcaacgtgactgatgtgacaggaaccaaattttacattttaatttatttaaatttaaatagctccccgtgsctgtagcttctatattggacagtatagttctagaaagtaaaagcaacaagagttgatgattaattgggcaatttagggtggcagggtagacagagctagagacagaggggcaggttaattgtagaggggggaaagatgagtaccactgtgtgcatgttggctccaagtgcgagagacatctgggggaagaagtatgcccagcagtaagaaacgcaagcctctttggagaacgctgggctggagatagaaatttgagagctttcactgttaactatgataggtgagatcataaaactgagt

SEQ ID NO: 188438 - DNA, 601 bp, Human
tagacagagctagagacagaggggcaggttaattgtagaggggggaaagatgagtaccactgtgtgcatgttggctccaagtgcgagagacatctgggggaagaagtatgcccagcagtaagaaacgcaagcctctttggagaacgctgggctggagatagaaatttgagagctttcactgttaactatgataggtgagatcataaaactgagtagcacagggaagccacttcactgcttttggcctcagattcctgttgatttgatggtggtcataatatttgctctgcctaccttctgrgactgttctgaaaaattcagatgggattacgtgcatgaaaatgctttgtaaactcttcagacattaggcagagtttataacgtctttaggagtgagaggaatgtgtcccacatgttattttccaaacatgaaagataaagacttcaaattctggaagtattgcagagtagatcatctgcagggcctcctgctaaaaaacgacaagatccaggataaacaaaagcaaacttgcctaaagtatgagtgtcacgggctcagggacagctttcaggactcccctgtgggagtttccatgagcaa

SEQ ID NO: 188439 - DNA, 601 bp, Human
gcgagagacatctgggggaagaagtatgcccagcagtaagaaacgcaagcctctttggagaacgctgggctggagatagaaatttgagagctttcactgttaactatgataggtgagatcataaaactgagtagcacagggaagccacttcactgcttttggcctcagattcctgttgatttgatggtggtcataatatttgctctgcctaccttctgggactgttctgaaaaattcagatgggattacgtgcatgaaaatgctttgtaaactcttcagacattaggcagagtttataacrtctttaggagtgagaggaatgtgtcccacatgttattttccaaacatgaaagataaagacttcaaattctggaagtattgcagagtagatcatctgcagggcctcctgctaaaaaacgacaagatccaggataaacaaaagcaaacttgcctaaagtatgagtgtcacgggctcagggacagctttcaggactcccctgtgggagtttccatgagcaaacaaacataaaagttgggtttctgtgaatgcaaagaccaacactagcgctgatcctgagaccagcttggggtctgggacagg

SEQ ID NO: 188440 - DNA, 601 bp, Human
ggcctcctgctaaaaaacgacaagatccaggataaacaaaagcaaacttgcctaaagtatgagtgtcacgggctcagggacagctttcaggactcccctgtgggagtttccatgagcaaacaaacataaaagttgggtttctgtgaatgcaaagaccaacactagcgctgatcctgagaccagcttggggtctgggacagggtagtggggagctgtccctgaggttcccacattaagccgggactgtcaaagggagagaaagtggttctggctggtggtgttcctcacaagaacaaatgctttttttttttttttttttaggaaaaaaaaagtaacccaatttaaatattcaggatgaatttcaattaaaaactaccaaaaaatcaaaaatcttcaaacacacaaggaaatacaccaccaaaatgtgtatcatcagagtgacgggagagtaatttcagtcccccaagaatttcacatattggagaacaggcaccaagttagaaaatgcaagacaataatatagaaatacagaaagaatgatagtataataaataatagtaaatatatgacaatttaccattgaaaatgacagcacaaacca

SEQ ID NO: 188441 - DNA, 601 bp, Human
gacaagatccaggataaacaaaagcaaacttgcctaaagtatgagtgtcacgggctcagggacagctttcaggactcccctgtgggagtttccatgagcaaacaaacataaaagttgggtttctgtgaatgcaaagaccaacactagcgctgatcctgagaccagcttggggtctgggacagggtagtggggagctgtccctgaggttcccacattaagccgggactgtcaaagggagagaaagtggttctggctggtggtgttcctcacaagaacaaatgcttttttttttttttttttwaggaaaaaaaaagtaacccaatttaaatattcaggatgaatttcaattaaaaactaccaaaaaatcaaaaatcttcaaacacacaaggaaatacaccaccaaaatgtgtatcatcagagtgacgggagagtaatttcagtcccccaagaatttcacatattggagaacaggcaccaagttagaaaatgcaagacaataatatagaaatacagaaagaatgatagtataataaataatagtaaatatatgacaatttaccattgaaaatgacagcacaaaccaaacaaaaagggagcaatt

SEQ ID NO: 188442 - DNA, 601 bp, Human
caagatccaggataaacaaaagcaaacttgcctaaagtatgagtgtcacgggctcagggacagctttcaggactcccctgtgggagtttccatgagcaaacaaacataaaagttgggtttctgtgaatgcaaagaccaacactagcgctgatcctgagaccagcttggggtctgggacagggtagtggggagctgtccctgaggttcccacattaagccgggactgtcaaagggagagaaagtggttctggctggtggtgttcctcacaagaacaaatgctttttttttttttttttttargaaaaaaaaagtaacccaatttaaatattcaggatgaatttcaattaaaaactaccaaaaaatcaaaaatcttcaaacacacaaggaaatacaccaccaaaatgtgtatcatcagagtgacgggagagtaatttcagtcccccaagaatttcacatattggagaacaggcaccaagttagaaaatgcaagacaataatatagaaatacagaaagaatgatagtataataaataatagtaaatatatgacaatttaccattgaaaatgacagcacaaaccaaacaaaaagggagcaatttg

SEQ ID NO: 188443 - DNA, 601 bp, Human
aagatccaggataaacaaaagcaaacttgcctaaagtatgagtgtcacgggctcagggacagctttcaggactcccctgtgggagtttccatgagcaaacaaacataaaagttgggtttctgtgaatgcaaagaccaacactagcgctgatcctgagaccagcttggggtctgggacagggtagtggggagctgtccctgaggttcccacattaagccgggactgtcaaagggagagaaagtggttctggctggtggtgttcctcacaagaacaaatgctttttttttttttttttttagraaaaaaaaagtaacccaatttaaatattcaggatgaatttcaattaaaaactaccaaaaaatcaaaaatcttcaaacacacaaggaaatacaccaccaaaatgtgtatcatcagagtgacgggagagtaatttcagtcccccaagaatttcacatattggagaacaggcaccaagttagaaaatgcaagacaataatatagaaatacagaaagaatgatagtataataaataatagtaaatatatgacaatttaccattgaaaatgacagcacaaaccaaacaaaaagggagcaatttga

SEQ ID NO: 188444 - DNA, 601 bp, Human
gataaacaaaagcaaacttgcctaaagtatgagtgtcacgggctcagggacagctttcaggactcccctgtgggagtttccatgagcaaacaaacataaaagttgggtttctgtgaatgcaaagaccaacactagcgctgatcctgagaccagcttggggtctgggacagggtagtggggagctgtccctgaggttcccacattaagccgggactgtcaaagggagagaaagtggttctggctggtggtgttcctcacaagaacaaatgctttttttttttttttttttaggaaaaaaaaagtaacccaatttaaatattcaggatgaatttcaattaaaaactaccaaaaaatcaaaaatcttcaaacacacaaggaaatacaccaccaaaatgtgtatcatcagagtgacgggagagtaatttcagtcccccaagaatttcacatattggagaacaggcaccaagttagaaaatgcaagacaataatatagaaatacagaaagaatgatagtataataaataatagtaaatatatgacaatttaccattgaaaatgacagcacaaaccaaacaaaaagggagcaatttgaatttttttt

SEQ ID NO: 188445 - DNA, 601 bp, Human
ttttttttttttttttaggaaaaaaaaagtaacccaatttaaatattcaggatgaatttcaattaaaaactaccaaaaaatcaaaaatcttcaaacacacaaggaaatacaccaccaaaatgtgtatcatcagagtgacgggagagtaatttcagtcccccaagaatttcacatattggagaacaggcaccaagttagaaaatgcaagacaataatatagaaatacagaaagaatgatagtataataaataatagtaaatatatgacaatttaccattgaaaatgacagcacaaaccaaasaaaaagggagcaatttgaatttttttttttttaaatcattgaggtggaaaaactagggtgtggtgacatgcacctggtgacatgtagtcctagctacttgggaggctgaggtaggatcacttgagcccaggagttcgagaccagcctgggcaaaatagcgaggtgccaacccaaaaaaaataagaacaaataaacaaaactcactaatagattatttaaactgcacattaaacagtgaaggagagaactggtaaatgtgtaaatagaagatattacctaaatctagtccagagatcggga

SEQ ID NO: 188446 - DNA, 601 bp, Human
tattggagaacaggcaccaagttagaaaatgcaagacaataatatagaaatacagaaagaatgatagtataataaataatagtaaatatatgacaatttaccattgaaaatgacagcacaaaccaaacaaaaagggagcaatttgaatttttttttttttaaatcattgaggtggaaaaactagggtgtggtgacatgcacctggtgacatgtagtcctagctacttgggaggctgaggtaggatcacttgagcccaggagttcgagaccagcctgggcaaaatagcgaggtgccaacccmaaaaaaataagaacaaataaacaaaactcactaatagattatttaaactgcacattaaacagtgaaggagagaactggtaaatgtgtaaatagaagatattacctaaatctagtccagagatcgggagataaatggtgtaaaatcagtagctaagagatgtggacattagaaagtctaatatatacctaattgtcatttttgaaggaaactctaaaacaaatggcagagaggccataattgatgagtgactggctgagaattttccaggactgatgggagctaggaacccacagacagat

SEQ ID NO: 188447 - DNA, 601 bp, Human
aatgtgtaaatagaagatattacctaaatctagtccagagatcgggagataaatggtgtaaaatcagtagctaagagatgtggacattagaaagtctaatatatacctaattgtcatttttgaaggaaactctaaaacaaatggcagagaggccataattgatgagtgactggctgagaattttccaggactgatgggagctaggaacccacagacagatgaactacgacggcatctgagccgggcagaatgaataaaaagaaacacacaagtaggcacaaaacactgtagcaaatgcagygtaccagaagacaatggcattgtcaatgggaccacagaacccagatcacccgggaaggaatgctttgtttgtttgtttgtttttgagacggagtcttgctctgtcacccaggctggagtgcagtggcaccatctcggctcactgccagctccgcctcccgggttcacgccattctcctgcctcagcctcccgagtagctgggactacagacacccgccaccaggcccggctaattttttgtatttttagtagagatggggttagccaggatggtctcgatctcctgaccttgtgatccgc

SEQ ID NO: 188448 - DNA, 601 bp, Human
cttgctctgtcacccaggctggagtgcagtggcaccatctcggctcactgccagctccgcctcccgggttcacgccattctcctgcctcagcctcccgagtagctgggactacagacacccgccaccaggcccggctaattttttgtatttttagtagagatggggttagccaggatggtctcgatctcctgaccttgtgatccgcccaaagtgctgagattagaggcgtgagccaccgtgcccggccaggaatgctgagtctgaaggaatgaatacaggctgagagttgttcttagtcamgtggaggatattgtgcctgttgttcctctgcagtggaaatcaggtgtgggaggatcttttgttctctctttaagctggcctatctgtgttttgactggagatgtagcagtttttctcaagtgtgaaaaaaggcatgttgtgtagattgatttttactaaatgtggtctgattgcttctttaaggcagcccttgtaagggggcaaaaatgcggttatttgacattaatggaactctatcaaggctgtgatcattcatttgaaatctttcttcccaacgcatgtttattgactgaagtgcct

SEQ ID NO: 188449 - DNA, 601 bp, Human
tctcgatctcctgaccttgtgatccgcccaaagtgctgagattagaggcgtgagccaccgtgcccggccaggaatgctgagtctgaaggaatgaatacaggctgagagttgttcttagtcaagtggaggatattgtgcctgttgttcctctgcagtggaaatcaggtgtgggaggatcttttgttctctctttaagctggcctatctgtgttttgactggagatgtagcagtttttctcaagtgtgaaaaaaggcatgttgtgtagattgatttttactaaatgtggtctgattgcttctytaaggcagcccttgtaagggggcaaaaatgcggttatttgacattaatggaactctatcaaggctgtgatcattcatttgaaatctttcttcccaacgcatgtttattgactgaagtgcctgagtgtgctctcatagaagccaaggtccactactaatttccataatgagacatgtatagtggtagctactgagcatctccccaatttttttttttctttttttgagatggagtcttgctctgtcacccaggctggagtgcagtggcgtgatctcggctccctgcaacctctgcctcccg

SEQ ID NO: 188450 - DNA, 601 bp, Human
ccctgcaacctctgcctcccgggttcaagctattctcctgcctcagcctcgcgagtagccgggactacaggcatgtgccaccaagcccttctgactaacttttgtatttttaatagaggcaaggtttccccgtgttggccaggccggtctcaaactcctgacctcaggtgatctgcccacggcctcccaaagtgctggaattacccgtgtgagccactgcgcccggcctatctccccagtttaaagtgaaattaatacctatatttgggtatgaaaatggttttaacatgattttttttttaaaaaaaaatgactattaaccctttgtgctaataatatgtaggtgcctagtgtcctaaagctctttacgatacatgtactggatatcttcttaaaaagtcatttggaataaaagggtagccccagagagttttattgtggcaacggaggatttctggatctggatttgggtggtggtaacatggatctatacatgtgataaggggtcatagaataatacacatacgtactcaaacagtgcttgtgaaaactggtgaaatcagagtgggtgtggtctagtaaatgtattgagccaatgtca

SEQ ID NO: 188451 - DNA, 601 bp, Human
ctggttttgatcttgtacttcagttatgtaaaatgttactatggggggaagctgggtgaagggtgcatggggcttctctactgttttttcaactacttgtgggactttaattatttacaacacaaaataaagtttaaaaatgtcatttggagcatggcaaccagaaaaaatagattattcttgatatttgtgattcttatagaatatgaatacaaatacttagaaatatttgatgaaccctggagggtaaagtcttttgtttcaccttggtcaaaagtgaattggaaagtttagctcagtstttgtattacaattcaaggttatatgcttgcaacatgaaagtcaaaaggccgctgtcgttacaacccttggaagtccagccagaaatgtccttgttgcctaaaattaaataagcttgtgccatagaatgaaaaattgcttacattagtcaatggaatgaccatgtttcaaaaaaaatttcaagtttggtgtgtaactgtaaatggaaacgtgaaatatttggaaaatgtaggatttattgggaattattgtaattgccttaactaatctagactaaattaaccagagagtaagtccagtt

SEQ ID NO: 188452 - DNA, 601 bp, Human
ttaaaatatctttattagcatcaaacaaagcagtagtgagaaaaaaagaaaaatctttagtaagatcaaggaaaagtgaacgtacaaattcggatgaaaaaggagaaacaaccatagatagagcagagatgaaataatgagaggattctatgaaaaatgttatggtaatagttcgctgcaacctggatggggttggagaccattattctaagtgaagtgactcaggaatggaaaaccaaatattgtatgttctcacttataagtgggagctaagctatgaggatgcaaagtcaaagaatgwcacaatggactttgaggactcgggggaagactgaggggggcttaggcataaaagaccacatattgggttcagtgtacactgcttgggcgatgggtgcaccaaaatctccgaacccaccactaaaaaacttacccatataaccaaacacgacttgttcccccaaaagtattgaaataaaataaaataaaatttaaaacaaattatggcaataaacttgaaaaattaaaaatggacagacctctagaaaacagacttaaaaagaaataggttcaatatttctatgtttaaaggaaaatgagt

SEQ ID NO: 188453 - DNA, 601 bp, Human
gtgagaaaaaaagaaaaatctttagtaagatcaaggaaaagtgaacgtacaaattcggatgaaaaaggagaaacaaccatagatagagcagagatgaaataatgagaggattctatgaaaaatgttatggtaatagttcgctgcaacctggatggggttggagaccattattctaagtgaagtgactcaggaatggaaaaccaaatattgtatgttctcacttataagtgggagctaagctatgaggatgcaaagtcaaagaatgacacaatggactttgaggactcgggggaagactgasgggggcttaggcataaaagaccacatattgggttcagtgtacactgcttgggcgatgggtgcaccaaaatctccgaacccaccactaaaaaacttacccatataaccaaacacgacttgttcccccaaaagtattgaaataaaataaaataaaatttaaaacaaattatggcaataaacttgaaaaattaaaaatggacagacctctagaaaacagacttaaaaagaaataggttcaatatttctatgtttaaaggaaaatgagtaatttaaaatgtcccccaaaagaaaacaccagaat

SEQ ID NO: 188454 - DNA, 601 bp, Human
gacagacctctagaaaacagacttaaaaagaaataggttcaatatttctatgtttaaaggaaaatgagtaatttaaaatgtcccccaaaagaaaacaccagaatcaaatgactctacagataagtctgccagattttcaggaagtatattacttcttgaaaagaaggagctgaaaggctccccagcttattccaagagaaagtgcagtagttcccccttatccacggtttccgtatccacagtttcggtttccacagtttgctcttgaggtctgaaaacagttgagtatagtatagtaagwtattttgaaaaagagagagagaccatcttcatataacttttattatagtatattgttgtatttgttttattatcattaatcttactatgcctaatttataaatttaaatttattttcctaggtatgcacgtataggaagaaacatagtgcatatagggttggcactattcacggtttcaggcatccattggggcccttggaaggtatccccctcggataagaggggaaaattgtataacttgaaaccacacaatgccataggaaatgagaacatcgccagtctcacttacgaactcacac

SEQ ID NO: 188455 - DNA, 601 bp, Human
cacagtttcggtttccacagtttgctcttgaggtctgaaaacagttgagtatagtatagtaagatattttgaaaaagagagagagaccatcttcatataacttttattatagtatattgttgtatttgttttattatcattaatcttactatgcctaatttataaatttaaatttattttcctaggtatgcacgtataggaagaaacatagtgcatatagggttggcactattcacggtttcaggcatccattggggcccttggaaggtatccccctcggataagaggggaaaattgtatracttgaaaccacacaatgccataggaaatgagaacatcgccagtctcacttacgaactcacacataaaaattccaaatagtaaatatatgaaagcaaccctctaaactttctcattaggtccaatgctttgcaatgtgtctcttcttttcctattatttaatcttaatagtaccgaactggactccaacatcagactgaaagtcagagtccttgccgctctcctgattttaaaggcagtgatgtgaatgtatcaccattaagaatgtccttagctggctgggcgcggtggctcacgcctg

SEQ ID NO: 188456 - DNA, 601 bp, Human
tcaaaaaaaaaaaaaaaaaaaaagactgtccttagctgtagggatctttttaatatacactcattatcaggttaatggagttctttctatgcctggtttgctagtttaaaagagacttaagaggtagaataatcaagtgtcatgagtgaacactggctcctgatttcaacacacaaaatttagacagttttttagatatttgaggaaatctgatcactttaacaattttattattattttacagagacagggtctcactctgttgcccaggctggagcgcagtggtgtaatcatagctcaytgcagcctcacactcctgggctcaagcagtcctcctgccttggcctcccaaggggccgggactacaggcaatgccactgcacctggctgctttaacagtttttaagtgtacggttcagtggcattaaggacattcacattgattgtgccactatcaccacttcctctccagaactttttcttcttcccaagctgactatttgggtacttactaaacctgaacttcccattcccctctcccatagcccctggtataccattctcctttctatctctatggatttgactaggcttgctacct

SEQ ID NO: 188457 - DNA, 601 bp, Human
gggttgcttccagcttttggctattgtgaataatgctgccatgaacatgagtgtacaaatatccgttcaaggccctgcttttaatgcttttgcatatatatccagaaagataattgctggatcaatgctaattttatgtttgtttgaggaattgccacactatttgctacagtgctgcaccattttgcattcccatcagcaaagcacaagggttctagtttctctaaatctttatcaacacttgtcagaaaatgcccatacttttaatacatctctatgaagtagggctgaagaaggagargagttactggtcaccattgcctgcacagcggccatgcccacctatgatacatgagccattcacccgctgacaggcagacgaccctccacacaggctgccttgctcttaaccataaccaggcctacgttttccatgtgagcctgcctgtacaacttcatcatgtctctaaaaaggaaaggaaaggaggagaaccgaacagtgtatgatttagtgatacacacatgcagtagaattgttaggttttaaagggcaggggagtgataaacattattcctgatgtgaggtacctttggagagaag

SEQ ID NO: 188458 - DNA, 601 bp, Human
ataatgctgccatgaacatgagtgtacaaatatccgttcaaggccctgcttttaatgcttttgcatatatatccagaaagataattgctggatcaatgctaattttatgtttgtttgaggaattgccacactatttgctacagtgctgcaccattttgcattcccatcagcaaagcacaagggttctagtttctctaaatctttatcaacacttgtcagaaaatgcccatacttttaatacatctctatgaagtagggctgaagaaggagaggagttactggtcaccattgcctgcacagyggccatgcccacctatgatacatgagccattcacccgctgacaggcagacgaccctccacacaggctgccttgctcttaaccataaccaggcctacgttttccatgtgagcctgcctgtacaacttcatcatgtctctaaaaaggaaaggaaaggaggagaaccgaacagtgtatgatttagtgatacacacatgcagtagaattgttaggttttaaagggcaggggagtgataaacattattcctgatgtgaggtacctttggagagaagcagttgaagaggatcaggaaagaatacaa

SEQ ID NO: 188459 - DNA, 601 bp, Human
gtgtacaaatatccgttcaaggccctgcttttaatgcttttgcatatatatccagaaagataattgctggatcaatgctaattttatgtttgtttgaggaattgccacactatttgctacagtgctgcaccattttgcattcccatcagcaaagcacaagggttctagtttctctaaatctttatcaacacttgtcagaaaatgcccatacttttaatacatctctatgaagtagggctgaagaaggagaggagttactggtcaccattgcctgcacagcggccatgcccacctatgatayatgagccattcacccgctgacaggcagacgaccctccacacaggctgccttgctcttaaccataaccaggcctacgttttccatgtgagcctgcctgtacaacttcatcatgtctctaaaaaggaaaggaaaggaggagaaccgaacagtgtatgatttagtgatacacacatgcagtagaattgttaggttttaaagggcaggggagtgataaacattattcctgatgtgaggtacctttggagagaagcagttgaagaggatcaggaaagaatacaacagtctcagtcactttctggt

SEQ ID NO: 188460 - DNA, 601 bp, Human
acacaggctgccttgctcttaaccataaccaggcctacgttttccatgtgagcctgcctgtacaacttcatcatgtctctaaaaaggaaaggaaaggaggagaaccgaacagtgtatgatttagtgatacacacatgcagtagaattgttaggttttaaagggcaggggagtgataaacattattcctgatgtgaggtacctttggagagaagcagttgaagaggatcaggaaagaatacaacagtctcagtcactttctggttttcaggttgggtgatggtttccttggtgctttactaktatgcttcattacctccgtaaattgcatacatccttttgtatgtataattacataatttacattttaaatcttaaaccagtgacttttattccttaaggcttttgttcctatgtgttggccaaaggtctaggacaggtgagaaatttccactgggatggtctgaggcagaaaggagagaaggaagtgagttttataaagcttcgtttgttcagtatgtcttccctattttatttagtattaaaaagacttttagaaatgcagtggtagagttagagcatgcagtttgttgttttgttttt

SEQ ID NO: 188461 - DNA, 601 bp, Human
aagggcaggggagtgataaacattattcctgatgtgaggtacctttggagagaagcagttgaagaggatcaggaaagaatacaacagtctcagtcactttctggttttcaggttgggtgatggtttccttggtgctttactattatgcttcattacctccgtaaattgcatacatccttttgtatgtataattacataatttacattttaaatcttaaaccagtgacttttattccttaaggcttttgttcctatgtgttggccaaaggtctaggacaggtgagaaatttccactgggatrgtctgaggcagaaaggagagaaggaagtgagttttataaagcttcgtttgttcagtatgtcttccctattttatttagtattaaaaagacttttagaaatgcagtggtagagttagagcatgcagtttgttgttttgtttttattgtccttaacaatggcaagcagaagaagcagatagccttgtgtaaggtcattatcatttcaaaaactgtcttgactggtccttgaaatttaaaaattctaggaattattgcctcagagaacacagcgccgcattcaggagccagccaccaaggctg

SEQ ID NO: 188462 - DNA, 601 bp, Human
tatttcttatatccctatgagacattagcaaacaaactgtgtacattcaatcgcaggcaaaagagtggggggaacggaggagttctgagcaaacttcagtgatcagtggctgaggtatgatgaggagagtgaggaaggtggtacagctttgaggtaaaaggcacaggagcagcttagaagaccagacggtaatgggatgggcgtgagagtttaaaaggttgtgggtggcaatcagaggctcgtggatgacactaaggaagccgtgcatcttttctaagaaggataaaggaaaagaaagttsagagtacttcatgatattgttgttttggtagaggaaaaattggaaaatccacatatgaggcaatgggttctattttacattgtaataaaaggaatgctttgaactgtgcttctgttttctcatttttagattttttatctcctcacatcttcaaatctgtgagcatttgccaagattcttccttagtcgtacatatgggctcccagcattgcacaacacttatccttaaaagttacatgcaatttatccccttcctggcatggtcagacttcccttttctctcctccctcctcttttcct

SEQ ID NO: 188463 - DNA, 601 bp, Human
aacttcagtgatcagtggctgaggtatgatgaggagagtgaggaaggtggtacagctttgaggtaaaaggcacaggagcagcttagaagaccagacggtaatgggatgggcgtgagagtttaaaaggttgtgggtggcaatcagaggctcgtggatgacactaaggaagccgtgcatcttttctaagaaggataaaggaaaagaaagttcagagtacttcatgatattgttgttttggtagaggaaaaattggaaaatccacatatgaggcaatgggttctattttacattgtaataaaakgaatgctttgaactgtgcttctgttttctcatttttagattttttatctcctcacatcttcaaatctgtgagcatttgccaagattcttccttagtcgtacatatgggctcccagcattgcacaacacttatccttaaaagttacatgcaatttatccccttcctggcatggtcagacttcccttttctctcctccctcctcttttcctcccatccccctttcccttgttgtgttagttgcctattaccgtgtgacaaatcccccaaaacatagtggtttaaaacaacaacgagttacca

SEQ ID NO: 188464 - DNA, 601 bp, Human
gaaggataaaggaaaagaaagttcagagtacttcatgatattgttgttttggtagaggaaaaattggaaaatccacatatgaggcaatgggttctattttacattgtaataaaaggaatgctttgaactgtgcttctgttttctcatttttagattttttatctcctcacatcttcaaatctgtgagcatttgccaagattcttccttagtcgtacatatgggctcccagcattgcacaacacttatccttaaaagttacatgcaatttatccccttcctggcatggtcagacttcccttytctctcctccctcctcttttcctcccatccccctttcccttgttgtgttagttgcctattaccgtgtgacaaatcccccaaaacatagtggtttaaaacaacaacgagttaccatctctcacagtcttgtggaatgaccaggttcaactaggtggttctttcaaggcctcttgtgcagctgcaaccaggtggtggctggggctgagtcatgcaaaggacatccaagatggcatcttcataacacttctggtgcctcagctgaggtgcttggggacaggctggacagtttgtgtgttctgt

SEQ ID NO: 188465 - DNA, 601 bp, Human
cctcttgtgcagctgcaaccaggtggtggctggggctgagtcatgcaaaggacatccaagatggcatcttcataacacttctggtgcctcagctgaggtgcttggggacaggctggacagtttgtgtgttctgtctctctcttctcccacccacccccatctctgttctcctctcccacccctctgtgtagcttctctacatggctagcttgggcttcctcacaacatggaagtttcagggtagtcacacttcttagatgacagctgtctttcctcagacaagcattccaagaagtctaartggaaggaagttcaaagcttatgacccagccttggaagtcactcagcaccactgttgaagactttcgttctgttggtccaaaacaggtcatacagccagccacagagccagctcagagccacccgaagggagcagaccacccacgggcatagatgctgggagatgtggtttattgggaatggcatacctctcagaagaccagctaccacatttctcctttgttaaaaatgtctgtttctctgctccttataactgaaatatcttaaagttactgtcttatgtcttatttcttatattttt

SEQ ID NO: 188466 - DNA, 601 bp, Human
ttttagaaagtctctttggaaaatcagatttgattcactttttaaccaacgatgataacatatcaaacttaaaaggcagatcggttttagggaaaagtgatacaccgtcctgtgtgggtgtccttgagtgaacttcccaacaatattgcttttcatgcgtagccactaattagaaaacctgctctcttgttggggctaaactgtggtttacttttctggttggacttcttcttgcttatattcaagcttttacagaagccaaagcttattcttttttaaccctcaaaataaaaaaaaaaaagaactcgaatctaaaaaatgtgttgtgtaattacatggcagtttcagaaattctttttaaaaaatcttgtacctatagatggcttaacttagcttctgcaaatgccattgaggacttagattcttctggggagttagctcttttttttcttttcttttctttcttttttttttttttaagaagctaaatctccaaagcttttctctggtaattatgaaaaacaacatgtgtaagagaaagtgggaagttggaggtggctaataatttgatattttttctacccacaaaccttgggaaaac

SEQ ID NO: 188467 - DNA, 601 bp, Human
aggcaaaatgtgaagaccctttacacttcaggcccaggcaaaatgctttgcccaccccccttccccacccgcagccatccccaccaatgttcagctcagggctgcccttggttatgtcaactgctgatggtgacacgtgaaccagcctgaggagggaagagtagccgggaggagagggggccaggaggacataacggggccaggatgggcggacgggttcttcttcattgcttcattaattctcacacctttttctgtgaagtcatactcttcccatttttgcagatgagaaaactttaaygcaagagttttcataacttgctctcatgcaaattcattcaaataagtatataagcagaagtatttaaactaaataaaatctaagaattttgcttcatcttgggtaacatgaaggattttcatctcctcctcatgggccagccagtggtctgttcactacccgatccccgtagtaagccgtgggtaattggtaatccacctatgaagtcaaacggggaaactggtgaggtaagcccgtggcacttagtcaagtaacaatagttgtcactctctcttgtttaatcttatagtggagtacgac

SEQ ID NO: 188468 - DNA, 601 bp, Human
ccaaaggtggggctggcccctgtttcccaccttttgtcatgacaataaccccagctatgtctgtgcagggtgacctggagttcaggggcagcatgtgagtacgatgaggtgggtgttgtaaatgggagtgtttagctggtgagatcttttgctatttgattttccaaatagctatcttttcctaagaaagctagtgaatgtatttattataagcatcttttgtgatcagataactccataatttattagggttaaaatgttcccactattgattagtcctcattttgaatgataggtgagrgtggctaaaataaattcatacattaaaagtatatgatgcttgtaagtgataataattccagtgaatacaaggcagtgtatttgtgcacataagatacacatacacacatgtatctttgagtaagcttgtgtgtgatgtattttttttttttatcacttggatacaagggagcagtagactttttccatgtctgtattactctcgtttcctaaaacaaggccagaccattttacaaaagaactgcagtgaagcatgtgcatggagctgcctagcaatacagaaaaacttccatggaacaat

SEQ ID NO: 188469 - DNA, 601 bp, Human
ggaagggctgagggatgaagttttatagtcgttagtacagaagaagccaatacacagaagccaatgacctcgaattttgcttagtatttaggggtcagtttagtaagtcagtgagaatcaaggcctttatgcatagtagaatagtgttaccgtgtagctcttagtgtgtacaaggtggaaattaagcaggtgatatgacggtctggcaattatatggcagctacaaggataaaaatgaagggaagtgaacatatgggggagggaactccatgcttccagactccgtaagggatttgtcagmtttggttttataaaccaagtccaggttcccacttttggtcttgtgagtctattgatttcccaagaatttccaaaggcttaagaatgactttggtttttcctgaatgtattgatctgtgtgtgggtctgtcacaaatacacacacctgaactcataagcaacattaatttgtccgtgaaaggttcatttttgttttgaaagcaccgccagcatccagcccttgtgcatatttaggtctgtaatggggaaacacagaaggaggaaggacagatgccatgctttgggacatttcatggtatga

SEQ ID NO: 188470 - DNA, 601 bp, Human
tctttttggctcagaaatatattgggaatatatgtttttctccgtcctgcaggaaaacctttacagtgaaaaccctaggctgggagttaagtgactggcatttaaaaaaattgttatttgttttaaaaaagagagagagaaagttagcagaacatttgtaaggtttatactgaactccagccaaaaaagaacagctgccctgtgcttaggatggtggtgtcatacttcctcgaggccagcagtgagtttggaaaataaaatcctgaatggtcccaacctttgatgactctctatcaaagcrgagagttgtagtttctttgccttctaggatgggagcatttggcacctgcatgtgtttcgttgttgtgcataggaaaggggaaattctgggagaactgggagagtttcatgcttttgaagggctccagtttggccaggaagagattttcttttcttatctgtgggccaggagcccaggcctcctgccgcctcctagcgttcttccagaggcctccagattcagctgcaggactcctttcgggggaaggtttgatctccccatctgtaccatcttggggtgtcttggctgaaaacaattctc

SEQ ID NO: 188471 - DNA, 601 bp, Human
actagttggctggtcctatgattattgacctctttctttgctgtaatacctgctgttttcagtgcattggcttttctgggcagtgggcaagaagaacccatcaggctgcaacaatagtctgcatcattaagcttgagtaacacatgatgcctttgcgctttatttatttttagaagtttacttcatggtattgcatggtgtttaaaagatgactttggtattaaaatttggtgttataaatcattgtgtccttgtgatgatgcaggtaaaaaaaattgcattcatatagtagttacagttyggaaaaggccttctcttatattttctcattagggttttaccatgaccttatcagatagacagggcaggcatgttatccttgagagaacaaagtatggcacatacgaattttgccaagaccaaataattcctaaactattgtctgctatgcttcctaaaagtcacttcaattatgtgggtacagtctcaagataaagacgaagtaccggaaagaggtaagcaacctccttatgacacatcctcacacctccatgtccttaggtttgaagcagacaccccaagaatgcttctgtttgaatgg

SEQ ID NO: 188472 - DNA, 601 bp, Human
aaaagatgactttggtattaaaatttggtgttataaatcattgtgtccttgtgatgatgcaggtaaaaaaaattgcattcatatagtagttacagtttggaaaaggccttctcttatattttctcattagggttttaccatgaccttatcagatagacagggcaggcatgttatccttgagagaacaaagtatggcacatacgaattttgccaagaccaaataattcctaaactattgtctgctatgcttcctaaaagtcacttcaattatgtgggtacagtctcaagataaagacgaagwaccggaaagaggtaagcaacctccttatgacacatcctcacacctccatgtccttaggtttgaagcagacaccccaagaatgcttctgtttgaatggcaaatgttttcataggtagtgaagatctgtgtctgttagaattcagactctggtactttgatgtctaaggccttcctacagaaaacctttgcaaaactttgttgatctcttgaccaaccactgatctattaacagtttttctagaggaggggaatagaagggaagaaagattggaataaatttacacaaaagtattatatatt

SEQ ID NO: 188473 - DNA, 601 bp, Human
taccatctttactatttttaagtgtgtagttcagtggtaataaacatatattcttttcttcccccttcatccctccctccttactaaaacaggaagatttcctcaggcaagcacaggaggctgctgttggagtctccaggaacaatcccagactgaactattgctttaatttttgacagaattcacaaaatcttacctattttacagacagaatataattgtcccaggagagaaaagggtaaaaacacattttccagaatttttagtttgatactgcactctgaaccattcacagagatcrggaacacaggaataagcagagttcagatttgcacgtttgagtcatggtatgagtacccgagacgatgtgagatgtagaagttttgagctcagcagaatgagctaaactacagtaggagattgttgagaccacagggcgaaccactgaagtaggtcacatagaccagatgtgtaagaatagaaaacctaattgaccctgtaccatttattgaaaatactatctttttctcatgtgctttagtggcaactttctcataaattaggtgactatatatgtgtgagtccattttttggatcttct

SEQ ID NO: 188474 - DNA, 601 bp, Human
gaattcacaaaatcttacctattttacagacagaatataattgtcccaggagagaaaagggtaaaaacacattttccagaatttttagtttgatactgcactctgaaccattcacagagatcgggaacacaggaataagcagagttcagatttgcacgtttgagtcatggtatgagtacccgagacgatgtgagatgtagaagttttgagctcagcagaatgagctaaactacagtaggagattgttgagaccacagggcgaaccactgaagtaggtcacatagaccagatgtgtaagaayagaaaacctaattgaccctgtaccatttattgaaaatactatctttttctcatgtgctttagtggcaactttctcataaattaggtgactatatatgtgtgagtccattttttggatcttctgttccctgggttaatttttctcttcttgcaccaatactccactgtcttaattccttcagttttataataaggcttgatatctgatgtgtaacctcaaaattgttcttgagactttcttggctattaatggcccttcacattcccatgtaaattttaaaatcagtttgtttccacaaaa

SEQ ID NO: 188475 - DNA, 601 bp, Human
agttttataataaggcttgatatctgatgtgtaacctcaaaattgttcttgagactttcttggctattaatggcccttcacattcccatgtaaattttaaaatcagtttgtttccacaaaaaataaaaacaaacttgctgggcttctgattggaattgcactaaatctagagatcaatttgggaaggatttacatctcatcgataatgaggatttcagttcaagaaagtggtatttacttaggccttctttaataactctcagtaatatagttttttgtatgtcttgaacatttttattakattaattttaggtattgaagtttctgatgctgttgtaaatggtattaatagttttttaaaaattcagtgccaaattggtttttgctcacatatagcataccattgattttaatttgtatccagcaaccttgcaaatttacatgttaattcgaatagtttttctgcatggccttttggaatttctgtgaatataatctataaatactagttttattttttccttttcaattctattttttatttctctttttcttgctttattgtgctggctgggacgtccagtacaatgttgaaattgtt

SEQ ID NO: 188476 - DNA, 601 bp, Human
tctgctttgcttttgagcctctaaacagtttctttctacttgttttctcaactcctcgtcccatataaacacagcttaatatctggtaaatacctcaagtggaaatgttggagttcaaggaggccaggacttgaagagccagagtcctagaggaaagggactacacagaagtgacccaggcttctatgagatcacttttatgagctcatttccatgcagccccctttttttctgggactttagctcttctcacgcactagctgccttgaattttgattttctccccagctggtgatactgygtaaagctctaggccgctaccaattgctgcttggtgtctgtgcctcgtactagaaattatcaaatgccctgaaaggaaaaggcagcagcaaacacaaggctcaccttaatgcatttcctttctccctgaggtcttgacccatctagtgttgccttgcttggttgctctaagagaacttcaaacaagtgtgttttttagttaattcagtattttttttagtgggaatgttagtttgatacatcatgaccagaagcttaagtctttgaagtatagtgtgttttatcattttcatttggaaat

SEQ ID NO: 188477 - DNA, 601 bp, Human
tggtggcgtgcacctgtaatctcagctactcaggaggctgaggcaggagaatcacttgaacccaggaggcggaggttgcagtgagccaagatgacgcactccagcctgggtgacagagcaagactctctctcaaaaataaataaacagacaaactaactaaataaaaataacaggtgacaaactccgcacttgatcactagtgaagattagagtataccccagtgtatggaagcattgttgtgtttatgtggccaaagagagcagactgggtagccgtcagtttgtataaagtttccatcytctttccccctcttaccctgccttggacatatagaaccaagacttctaataacactgatactttggactcgatctcacctgcagttctgtttattagcctaattcgatgacaccctgagggtcatgcccatccataagacacactgacttgtggagcagcctacatttggtttgcactgttttagggagaggagcaagaaatcttgagagcagatagctttcaactctaagttcacaaaacaggcacaggtagtcctgctcatatttcatggagaggtagtctggctttaggtccttggc

SEQ ID NO: 188478 - DNA, 601 bp, Human
ttggctcacaaagtatggttcttagaccagcagcatcagcatcacgtgggaacctgttagaaatgcagattctcaggcccctccccaagcttactgagtcagaagccctaggggtgaggggcagcaatccatgtgttaagcccccgcaggggattctgatgcaggctacacttgagaaccactgataaaagagcacgtacaacacatgagccaaactgcctgggttcaaattccagctctgcccttgctggctgtgtgaccatgtgcaagccacttaatctcaatctctctctctctctccttttttttttttttttttttttttttgagatgagttgtgctctgtcgctcaggctggggtgcagtggcacaatctcagctcactgcaacctgcacctcccaggctcaagagatcctcccacctcagcccatgcccagctaaattttttattttttgtagaggcagggttttgccatgttgcccagtctggtctcgaacccctgggctcaagtgatctacctgcctcagcctcccacggtgctgggattacaggtgtgagccaccatgccctgcccacttaatctctttgtgcctcagttt

SEQ ID NO: 188479 - DNA, 601 bp, Human
tgagtggctttctgattcatcaactctaaagccagggtgaatttttgaaattttccagaaatatcttactagcatattaatttgttaagaacctcatttgcccaggatgaccacaatgtgaggaatatcacgctctgaggttggaataacattgagaagagtaacactgttacatccttgaagattggaagcgtattcatcatgcaaatgtagggtctgagttagttgagaacaaaatagtcaataactgcattaaaaattatcttcccttgtttcaagattttctttcgtggtttgccamcttgagagtatgtcacctcaataggaaggtccaagtaatctaggcatggtgatgattttggccagtctctaggattctttatcagtgacacacattttaggtgagaacatctcttctgaactctgccaaagtgagatttagaagggaaagcttatttttcacgtggcaaaatcagatgcatcttcttcgaggctacacttttacagtccgcagactaggaaggccatgtatccctgaggaaacattagtacatgtgggtcagaccagaaccgttttagtgatttgtcatcaacagcatct

SEQ ID NO: 188480 - DNA, 601 bp, Human
gctgtcctgaggaataaaggctgttgacacagtcaatattcgctgttcctctgtcccacttggcccaatcatcttaagtccatgctctgcctcacttcccttccagaggccccgagcatcctagatctaaacattgaagtccaagccttcctcgctgccataggaccacatagagttttcatctttcaaggctcggccactagactgcacttgttgacctcacaagcttcttaagcagtgagaacagtcagtgttctcattgtacgattacaaaagtgtgccacagaacaacgcaaattcrtggggccccagagtgactcggtagcagagtcgggatggaaactgggctctccacatccacgaatctgcactgaccccgtaggtgcaattgcttcatgtcatgatgggtaatcctcatcttccgcctttgccccaagtttaacttttgattcatgttctccctctttaattcattccttctctttctgctcttctctgttttcctcctcctccttggatgatgtgcgtctgcctcattccccacattctcttggacgaggctgccattttctttatcacagaccctgatctttaaaaataa

SEQ ID NO: 188481 - DNA, 601 bp, Human
cagtcagtgttctcattgtacgattacaaaagtgtgccacagaacaacgcaaattcatggggccccagagtgactcggtagcagagtcgggatggaaactgggctctccacatccacgaatctgcactgaccccgtaggtgcaattgcttcatgtcatgatgggtaatcctcatcttccgcctttgccccaagtttaacttttgattcatgttctccctctttaattcattccttctctttctgctcttctctgttttcctcctcctccttggatgatgtgcgtctgcctcattccccacrttctcttggacgaggctgccattttctttatcacagaccctgatctttaaaaataaaagctcattctgccagctgtgctaccctcacgctttgaactgtatttctctgtatccttattataagtctttaaaatgtaggtgcctaatctagtcatcagaggtaactcggcatgtgctcacgggccccgccttgagggcagccttacccccgagattcccactgggtcttggtgctagagagtgccagccacattctgcccgtgacaccgatgtgtgccgtgcttcctctgggaccggggct

SEQ ID NO: 188482 - DNA, 601 bp, Human
ggccagaatgtggcctcccgcagactctgttaagcagctgagtaaatgacttttaactgtgcctactgtttatacttgggaaagacgacaatagagttcccttctcactttaagtggccatggaggcaggagaaactgttcactcctcctctgagaaatctaaccatttgaacttgatgtttcactggcctcgtaagtatttgatggattaaagatgaagttcattcattcatcacaggtcgtctttggtaatcatctcaatgagacagtatgttattatggaaagctctttgaatccaaractaggtcctgttttttcacttgctagcttgagatcttgaccacatatgacggtagccttgtgtctgagtctcaggttccccagctgtaaggtggagaccgtgacactctgcctggcttttaggattggtgtaaggaccaaacaaagagaagtagatgaaagcactttgtaacttatgtaaatgtatgcttatcttaaacttagtatttaattttagtcgtttttctatctctgtaagatattgcagcaaaatatttccaataccaggagctttgagtctttccatggccaaaatatagc

SEQ ID NO: 188483 - DNA, 601 bp, Human
aacttagtatttaattttagtcgtttttctatctctgtaagatattgcagcaaaatatttccaataccaggagctttgagtctttccatggccaaaatatagccctccctgtcatgggaatcccaggccatctcattctagtggccatgggatggatacgcagattcagattgtccctaaagatgaccatctcctggcactgacctatcataaaatgcaggtgagcagaaggagaccctcacaccgtcatcccacagccccttgattatgttagttcaaaactgtgaaaaagtcagtcttycctgaagggcctaatggaaggaatggattctctgactttgcctcaaagaaccccagctgtagctcaccactgtgctgggatgaactttaaaatcactcagcatccaccctcggctacacagtccatatggggaaggactgggtactcactgcagaccattcagaggccttaattaaaatagtagatgattacttaggcatgcgatgtggcttcttgtttctccttatttcataggaacaaacgagaagattttcagtcccaatttcaaaacaagaaaaaatgagcaaagcccagtttata

SEQ ID NO: 188484 - DNA, 601 bp, Human
tggcagggtgcagtggctcatgcctataatcctcacactatgggaggctgaggcgggcggattacttgaggttgggagttcgagaccagcctggccaacgtggtgaaaccccatccctactaaaaatacaaaaaattagctgggtgtggtggcatgtgcctgtaatcccagctacttgggaggctgaagcaggagaatcacttgaacccaggaggtggaggttgcagtgagccaagattaagattatgcctgagtgacagagcgagactccatcgaaaaaaaaaaaaaaaagttctccccrgtgtgtttttaggaagtggcatggaagtccacccatggaagcccagaggaagggagagtggatgttccctccccacagccagtcccgtagctagttaggattgaatggaaacccagacacttctgactctaatgccagtgcttgcaaattctggggtcctttggctatttaaatagcttgagaatcaaccataaaggtgaagattggcagtgggatttgcagccagagaacttgtttccctggttgctaccctgtgattttggacacatttaatctgtttcagcttccatttactcatct

SEQ ID NO: 188485 - DNA, 601 bp, Human
gcatggaagtccacccatggaagcccagaggaagggagagtggatgttccctccccacagccagtcccgtagctagttaggattgaatggaaacccagacacttctgactctaatgccagtgcttgcaaattctggggtcctttggctatttaaatagcttgagaatcaaccataaaggtgaagattggcagtgggatttgcagccagagaacttgtttccctggttgctaccctgtgattttggacacatttaatctgtttcagcttccatttactcatctgtaagatggggatgatgartgccttgcagatttgctggaattaaatgaaaagcatcaaaatctggctcataatagcactcaaagattatttatatgccattgtaggaagtaggttctcagggcatatgttgggatccctggaaaacaagtaaaataattctggaagatgcattaattcttccaggtaattgtacagaaatgtcatttttggtggccaaacatgttgggaagagttaatgcaacttcccaaagtacctatttcttctttgggaagcagtgtctccattttgtgttccgacttaaatcaaccatctatttt

SEQ ID NO: 188486 - DNA, 601 bp, Human
ctccctggatggctttcacttgcccttgcttctctgcagctggctgctctaaatgaaggctggatgttggttggctctgttatacttctccaggggcttggatagcctctgcatggtatcatttattgtttttacacatgtttgactagtcctggtcctagccgtctttgccccattggggattttaaccaatctaccaattctttttcagcctccatttcttaccagcctgctgctcttgcaacacctgtcctcaggttctatagctccagtttggtggtctccttctacttgttatcaytcactctcttttatggtagctctcacttggggttcactattttatcttctgggggactgtgataccacttggccaatccatgacaaggtccatgaacaaatggccttgaagttccattgggtgattctaaattttcatttggctaattttccggatctttccaagacctcttttgagagggtgtagctaaagcaatttcaggtcagctggtaagtctgaagtctgctctgctgctgctgctgtgaggcagaattggtctttgttttgatagatgagtttggaaacattatctgcacttta

SEQ ID NO: 188487 - DNA, 601 bp, Human
tggccttgaagttccattgggtgattctaaattttcatttggctaattttccggatctttccaagacctcttttgagagggtgtagctaaagcaatttcaggtcagctggtaagtctgaagtctgctctgctgctgctgctgtgaggcagaattggtctttgttttgatagatgagtttggaaacattatctgcactttaatgatccatgtgaaattggagtagtctctttcagtcttgatgtttatgttgtcactacccagctctgccaaccatctatgacccagcagcctcttgagacmctgtctgtcctttggaatgagtctgccattgtatcaatgccacctattagcatttcttttttgtttgtttgtttttaagacagtttcactcttgttggccagactggagtgcaatggtgccatctcagctcactgcaacctcctcctcccgggttcaagcgattctcctgcctcagcctcccaagtagctgggatcacaggcatgcaccactactcctggataattttgtatttttttagtagagacggagtttcaccatgttggtcaggctggtctcaaactcctgacctcaagtgatc

SEQ ID NO: 188488 - DNA, 601 bp, Human
atttcttttttgtttgtttgtttttaagacagtttcactcttgttggccagactggagtgcaatggtgccatctcagctcactgcaacctcctcctcccgggttcaagcgattctcctgcctcagcctcccaagtagctgggatcacaggcatgcaccactactcctggataattttgtatttttttagtagagacggagtttcaccatgttggtcaggctggtctcaaactcctgacctcaagtgatccacttgcctcggcctcccaaagtgttgggattacaggtatgagccaccacayctggccagcattttgtagagtaagttctccttccctccttttcccacccccaaacatgtatctttaaggaccttgggggaaattgtggctctagtacattcagggatactcctgaccttcttcttgatagtttatattttctgtcctttaagcttcccggttgggactattcaataggctttcagcgtaaattaaccaggagtcatctcttgcaaaacagctgtttgagtagtttattataactgtgcaatcttgtgctatacatttcaaggaaatccagtccagactgggggtctcatt

SEQ ID NO: 188489 - DNA, 601 bp, Human
aggtcaagactgtgaactagcagtttctagttctccaggaaagttgggaattgtgatttgtcattgtgatcttaaacttttagggcctgcagcttggcttgcagatgtcttaagtagagtttggttcagggcttcctatatgaaatcaaaccttaattctccatagacatggaggacagtcatggcaaatagtgatctaaaagttagaatcaccaaaaaaaagttagaatcaaaagcttcacttctatcatgcacaactcttgttcgaggataatggctatcaaagagtggaacagactgkaaagttcccttctacctcctcccaaggttcactccttgcaaatgtgcaaatggcaacaattctaaaaggcaataagaagaagcttatgcaggtaccgtgagatgcctaagtcattcccgatcattgccaaccctgggagggcactggggccaggagactcagtctaggaagtggcagagagtatagaaggtgcttagagcacagagggtcttagagctaagtttttaaaggaaatctttgtctatttgtaggacagttccatattcttttagaatcaagacaaaggctgaaaagagacca

SEQ ID NO: 188490 - DNA, 601 bp, Human
tttggttcagggcttcctatatgaaatcaaaccttaattctccatagacatggaggacagtcatggcaaatagtgatctaaaagttagaatcaccaaaaaaaagttagaatcaaaagcttcacttctatcatgcacaactcttgttcgaggataatggctatcaaagagtggaacagactgtaaagttcccttctacctcctcccaaggttcactccttgcaaatgtgcaaatggcaacaattctaaaaggcaataagaagaagcttatgcaggtaccgtgagatgcctaagtcattcccratcattgccaaccctgggagggcactggggccaggagactcagtctaggaagtggcagagagtatagaaggtgcttagagcacagagggtcttagagctaagtttttaaaggaaatctttgtctatttgtaggacagttccatattcttttagaatcaagacaaaggctgaaaagagaccaaagtcccacccagattaaatggggccttatgagatcctgaaatctcctggagcaaccaaaaaatagggcctcactgttgcttctcaatgttgaccatccaaattataaacaaaatctag

SEQ ID NO: 188491 - DNA, 601 bp, Human
atgcacaactcttgttcgaggataatggctatcaaagagtggaacagactgtaaagttcccttctacctcctcccaaggttcactccttgcaaatgtgcaaatggcaacaattctaaaaggcaataagaagaagcttatgcaggtaccgtgagatgcctaagtcattcccgatcattgccaaccctgggagggcactggggccaggagactcagtctaggaagtggcagagagtatagaaggtgcttagagcacagagggtcttagagctaagtttttaaaggaaatctttgtctatttgyaggacagttccatattcttttagaatcaagacaaaggctgaaaagagaccaaagtcccacccagattaaatggggccttatgagatcctgaaatctcctggagcaaccaaaaaatagggcctcactgttgcttctcaatgttgaccatccaaattataaacaaaatctagactctgatcaaactgtccacccccaccccagccctatcaactgttaggagattattgacaccagaaatcaaaaccccagtgtggtccctggcctcccgtagtgtcggtgacacaaggagctggcacctgc

SEQ ID NO: 188492 - DNA, 601 bp, Human
cctcctctactgaagttgcaaagcacagcaggcagggtcactgggacccaggctggctctggctgccgtgactcaggcgcaccccccctgggagcccacaggcttgctgcagcgccctagccccgtcatactcacagcagcagctgcgtggtggccctccagccccgcggtgcagcctccccgcacaatgcctgcctgagagtcaggatggtggctgcgcccttcccttctcctctgggtctcatacctatgggcctctcctggcctccagtgccagggaagcctgcctgtcactggcccrtcatggcatatagggattgagcttcagagctaaccaacagtgggctcctttgcacttcgctgtgtgcgtggctcttcaggagggccagataaaaaggatgctggatggaattaacccagatgttatgcttagtgtggggtatgacccctgcattgggggtataggcaatgtatacagtgcatgtgccgctgcctggggacatggcttctgtgaggaagtcccagcccagctagccgccttctgttggggccaagggtgccctgtcctcactgcactggatgagagagctattctgcagtt

SEQ ID NO: 188493 - DNA, 601 bp, Human
gcagagcctgtgtggaacgtgcacctgcaacaggaggagcaagggcaggaagatgctagaggacagagaaaggggatcagccagaggcgtgtgtgctgggagctgcagcatgtacccctgatggcccccaggaagggagctatggcccctccaccaccaccctcagaacaggactctcagatgtgaaagctcagttgtgtctcaaggacaagaagactccatcactgtgtcctccctcccatccgctggactccagaaaaatgcacctccatatggctcctttcaagttagcccccaaccmctcccaggtgtactggcccccaggtaacatggaggaatgacagataatgaaagacacacctggggcttgggagagggatttcagagccatggctggacctgatgctttattccgaggtgaattctggattggaacaccccggtctcttatggtagaaaatggcaggcacttccacatggtcccgccatcgggaatggatgggacacttctacctgtttctctaccactgattgcatcgtgcagaaggcctaaatgagatgcaagcctccctttggcaaagtattggaaaaatgaaggcaa

SEQ ID NO: 188494 - DNA, 601 bp, Human
ccctcccatccgctggactccagaaaaatgcacctccatatggctcctttcaagttagcccccaacccctcccaggtgtactggcccccaggtaacatggaggaatgacagataatgaaagacacacctggggcttgggagagggatttcagagccatggctggacctgatgctttattccgaggtgaattctggattggaacaccccggtctcttatggtagaaaatggcaggcacttccacatggtcccgccatcgggaatggatgggacacttctacctgtttctctaccactgattkcatcgtgcagaaggcctaaatgagatgcaagcctccctttggcaaagtattggaaaaatgaaggcaacgtattggaaacataaaggcttcataaagacacgctttgggcaccacagctgggacctctctgcccaactctgttctccttctgagggggatggtgcctgtctctgccaccttcttttccactacagatcatggagagtcttgctgaagaaccttccttaggggaaacaggcatgtctgtcttggatcttttttttaaaaaacaacaacaacaacaaaaaaaaacgggtctca

SEQ ID NO: 188495 - DNA, 601 bp, Human
ggatgggacacttctacctgtttctctaccactgattgcatcgtgcagaaggcctaaatgagatgcaagcctccctttggcaaagtattggaaaaatgaaggcaacgtattggaaacataaaggcttcataaagacacgctttgggcaccacagctgggacctctctgcccaactctgttctccttctgagggggatggtgcctgtctctgccaccttcttttccactacagatcatggagagtcttgctgaagaaccttccttaggggaaacaggcatgtctgtcttggatctttttttwaaaaaacaacaacaacaacaaaaaaaaacgggtctcactctgttgccagactggagtgcagtggcacaatctcagctcactgcaacctctgcctcccgggttcaagcaattctcctgcctcggcctcccgagtagctgggactacaggcatgtgccatcatgcccctctaattttttgtatttttagtagagacagggtttcaccatgttggtcaggctggtctcaaactcctgacctcaaacaatccacctgcctcagcctcccaaagtgctgggattacaggcgtgagccaccgcgcc

SEQ ID NO: 188496 - DNA, 601 bp, Human
tccttctgagggggatggtgcctgtctctgccaccttcttttccactacagatcatggagagtcttgctgaagaaccttccttaggggaaacaggcatgtctgtcttggatcttttttttaaaaaacaacaacaacaacaaaaaaaaacgggtctcactctgttgccagactggagtgcagtggcacaatctcagctcactgcaacctctgcctcccgggttcaagcaattctcctgcctcggcctcccgagtagctgggactacaggcatgtgccatcatgcccctctaattttttgtakttttagtagagacagggtttcaccatgttggtcaggctggtctcaaactcctgacctcaaacaatccacctgcctcagcctcccaaagtgctgggattacaggcgtgagccaccgcgcccggcctgtcttggatctttagagttcatctccatccccgaagggagttgtagaagcttcctgtatcatgggccccacttgcctgtcccacactgtgagaggaaacccatttacatctcatgtccaaagccatttttttcctacaaatagttttgtgtgtgtgtgtgtgtattgaggggtta

SEQ ID NO: 188497 - DNA, 601 bp, Human
gtgtgtgtgtgtattgaggggttataaaggaaagcagaatattttatcatggtttttgcttcagtggctttaggacaaattagaactcaactctggtgctagaaaagaaaaatctccacttaaaacccatgttcaaatatctgtaatgttcatttggagaagagaggaaggatttgggctttttaatactaattgtacctgaaggtttccctgcggaagcagtttattaaatgggactgaaagccgcgctgctaaaggcaattaacatctgatacattctcaaagctcagaaatctttggygagaggaatgtttctgcctgtgtaagagcaggccagggagttaccttctgcttatggaaggaattcgtcctgggggggcttttatgattgttggattttgtcatctgtgtcacctgatcactcaacagttttttgcccaaacccacctatggctgggccctgcttgtccaagttgccctggatgagcacctggggccttgtcttgagggggaaaattgcctctgggcggctggtgcccctgcccttgagggggaccagatttcactgtgtattcaactttgaaaaagccagagcccttga

SEQ ID NO: 188498 - DNA, 601 bp, Human
gcagcagttccaattctggtgtcacaggcgcatgtggacagccaggggcctgatctcagtggctctgactcatgggtctgggattgagctgagaaccccgcactttagagaaactccctgatgatccccagtattcggcacaggccacctacaagtcacacactgagagcttctgtcctggcggcgggggtggtgggggaggctcctctgtcttgggtcagcttctctggtttttggtttgtcgcctctctctagctgtctcacttcctttctctgccctgcccttgactggtgaatccaytggggcaaagctgtgttacctctctttgtcccactggagtgaccatgttcctgttgaattgtcaccacatacatttccactggccctcttcagcccattcatcaaaaccaataccaagggcagtgggagtgaggggaaagttttttctgtaatctgtaatctgtcaatctgtttaaaaaaaaaaaaaaaagtgtgtcagtataattccatgcagaacccagggtactgaccctgagtggcagacacaagtattccaaggagcatcaaccttcataaatatttatacgttctttgccagca

SEQ ID NO: 188499 - DNA, 601 bp, Human
ctgatgatccccagtattcggcacaggccacctacaagtcacacactgagagcttctgtcctggcggcgggggtggtgggggaggctcctctgtcttgggtcagcttctctggtttttggtttgtcgcctctctctagctgtctcacttcctttctctgccctgcccttgactggtgaatccactggggcaaagctgtgttacctctctttgtcccactggagtgaccatgttcctgttgaattgtcaccacatacatttccactggccctcttcagcccattcatcaaaaccaataccargggcagtgggagtgaggggaaagttttttctgtaatctgtaatctgtcaatctgtttaaaaaaaaaaaaaaaagtgtgtcagtataattccatgcagaacccagggtactgaccctgagtggcagacacaagtattccaaggagcatcaaccttcataaatatttatacgttctttgccagcacttaacatggaattataaggaaatttaagcatggcctgagagtatctgtaggaagaaaaacaggagagttgaattcctccttttcctctctctggccctgatccttacttaatgaca

SEQ ID NO: 188500 - DNA, 601 bp, Human
tggtgggggaggctcctctgtcttgggtcagcttctctggtttttggtttgtcgcctctctctagctgtctcacttcctttctctgccctgcccttgactggtgaatccactggggcaaagctgtgttacctctctttgtcccactggagtgaccatgttcctgttgaattgtcaccacatacatttccactggccctcttcagcccattcatcaaaaccaataccaagggcagtgggagtgaggggaaagttttttctgtaatctgtaatctgtcaatctgtttaaaaaaaaaaaaaaaagtgtgtcagtataattccatgcagaacccagggtactgaccctgagtggcagacacaagtattccaaggagcatcaaccttcataaatatttatacgttctttgccagcacttaacatggaattataaggaaatttaagcatggcctgagagtatctgtaggaagaaaaacaggagagttgaattcctccttttcctctctctggccctgatccttacttaatgacaaaaatgccagtgtctggcgctaaaagaaatagctgttcttccagagaaggttctctttgttgagcattgagag

SEQ ID NO: 188501 - DNA, 601 bp, Human
gctcctctgtcttgggtcagcttctctggtttttggtttgtcgcctctctctagctgtctcacttcctttctctgccctgcccttgactggtgaatccactggggcaaagctgtgttacctctctttgtcccactggagtgaccatgttcctgttgaattgtcaccacatacatttccactggccctcttcagcccattcatcaaaaccaataccaagggcagtgggagtgaggggaaagttttttctgtaatctgtaatctgtcaatctgtttaaaaaaaaaaaaaaaagtgtgtcagtrtaattccatgcagaacccagggtactgaccctgagtggcagacacaagtattccaaggagcatcaaccttcataaatatttatacgttctttgccagcacttaacatggaattataaggaaatttaagcatggcctgagagtatctgtaggaagaaaaacaggagagttgaattcctccttttcctctctctggccctgatccttacttaatgacaaaaatgccagtgtctggcgctaaaagaaatagctgttcttccagagaaggttctctttgttgagcattgagagagtcaaatcaa

SEQ ID NO: 188502 - DNA, 601 bp, Human
ggttccatccagcagaaaaagaaactggaaatccagacatgaagtggtggtctctgcctgtgttctgccagcaattcttcaacaccaattaagtgtcttgcaattcaatccaattctttttttttctttttttttttttttttgagacagggtcttgctttctcgcccaggctggagtatggtggcataatcagggctcattgcagcttcaatctccagggatcaagcagtcctcccaccttagcctcccaaatagccgagaccacaggcacacaccactatgtccagctaattttatatyttgtagagacagggtctgtgttgcccaggctgatctcaaactcatgggttcaaacagtcttcccaccttagcctccaatagtgctgggattacaggcatgaggcgccacatctggcctcagttcaattctgatgccacctggagttagcacaggcccaagtgaaagggcaaggtccccaaggagactgctgtcatttcagacaccaggcacaagtgaggtccacagggcagccatgcttctgtctgtcttgcctacaaatttgggagttcacattaccgcccttcatgtttgataatttg

SEQ ID NO: 188503 - DNA, 601 bp, Human
ccatccagcagaaaaagaaactggaaatccagacatgaagtggtggtctctgcctgtgttctgccagcaattcttcaacaccaattaagtgtcttgcaattcaatccaattctttttttttctttttttttttttttttgagacagggtcttgctttctcgcccaggctggagtatggtggcataatcagggctcattgcagcttcaatctccagggatcaagcagtcctcccaccttagcctcccaaatagccgagaccacaggcacacaccactatgtccagctaattttatatcttgyagagacagggtctgtgttgcccaggctgatctcaaactcatgggttcaaacagtcttcccaccttagcctccaatagtgctgggattacaggcatgaggcgccacatctggcctcagttcaattctgatgccacctggagttagcacaggcccaagtgaaagggcaaggtccccaaggagactgctgtcatttcagacaccaggcacaagtgaggtccacagggcagccatgcttctgtctgtcttgcctacaaatttgggagttcacattaccgcccttcatgtttgataatttgctgg

SEQ ID NO: 188504 - DNA, 601 bp, Human
aatctagggcctcaggagcataacaaagacactcaggaaaatccaagggttgtcaaagcttggtgccaggaactggggacaaagaccagagatatatttattattttcacactgcccatgtctgcttgacctgggaaagaaagttgtttgtagaaatctttgctttttacatgaccaaatgatgccaagatggtcttcatggagattttggtccctagcacgagacggtattttggaggaagcttacttcacaagcagaatgaggttggatggggaaaatcccaggctaagactgtaagtwgtgtgatcatgcagtttatcatctaatctaacccaggacacctttaggagcgcagggcgttaggaccttggggtcttcaggagactcccctgctgcacccagctggcaggagaggaaagagtgagtggaaggctgatggggtagggggcaggtggttaggagggccaggcctggcagcaccacacatcccttcttccccacattcatgggcagaatccaggcacatggccacagctaactgcagtgggaaatgtcatctggctgtgtgctcaggaggttgatagaggatgtgggttgcta

SEQ ID NO: 188505 - DNA, 601 bp, Human
gtacacccagctactcggaaggctgaggtgggagcatcacttgagcccaggagttggaggctgcagtgagccatgatcacaccactgcactccagcctgggcaatggagtgagaccctgtctcaaaaatttcttaaaaacccacaaaaacaaaaaaatccagacaagcttgtcaacgctatgtgagatagcacacttgccaccctgtactctctatgccctaactattgaataataatttagctagtccgggtttttactagtcagaattttccagagagacagaatcaataggatatatrgagatatatatatatataggaggagatttattatgggaattgactcaggcaattacggaggccaagaagtcacatgagctgctgtctgcaagctggagaaccaggaaagctggtggtgtaattcagtcttgagtccaaaggcttgagaaccaggtgagccagtggtgtaagtcctagttggaagtcaaagccctgagtactggggagggctgctggtataagtcctgaagtgcaaagccctgggaactgggagctctgatgtcccagggcaagagaagacaatgacccagctcgataaaa

SEQ ID NO: 188506 - DNA, 601 bp, Human
aaggctgaggtgggagcatcacttgagcccaggagttggaggctgcagtgagccatgatcacaccactgcactccagcctgggcaatggagtgagaccctgtctcaaaaatttcttaaaaacccacaaaaacaaaaaaatccagacaagcttgtcaacgctatgtgagatagcacacttgccaccctgtactctctatgccctaactattgaataataatttagctagtccgggtttttactagtcagaattttccagagagacagaatcaataggatatatggagatatatatatatattggaggagatttattatgggaattgactcaggcaattacggaggccaagaagtcacatgagctgctgtctgcaagctggagaaccaggaaagctggtggtgtaattcagtcttgagtccaaaggcttgagaaccaggtgagccagtggtgtaagtcctagttggaagtcaaagccctgagtactggggagggctgctggtataagtcctgaagtgcaaagccctgggaactgggagctctgatgtcccagggcaagagaagacaatgacccagctcgataaaagagaatttgcccttcctc

SEQ ID NO: 188507 - DNA, 601 bp, Human
agaaccaggtgagccagtggtgtaagtcctagttggaagtcaaagccctgagtactggggagggctgctggtataagtcctgaagtgcaaagccctgggaactgggagctctgatgtcccagggcaagagaagacaatgacccagctcgataaaagagaatttgcccttcctctgtctttttgttctctctgggccctgaaccgaggagatgatacctatccgtgttggtgagggcaggtctattttactcagtctactgactcaaatacttatttcttccagaaataccttcacagatayaccccaaaataatgtcttaacagttgccagactcagtagcttacacctataatctcagcactttgggaggccaaggcaggaggcttgcttgaggctaggagttcaagaccagcctcggcaacatagcaagtccccatctctgcattaaaagttagcttgtggtggcccgttcttgtagtcccagctgcttgggaggctgagtgggaggattgcttgagcccaggaggtcaagtctgcagtgagccatgattgtgccactgtgctccagcttgcgtgacagagcaaaaccccattgcagaa

SEQ ID NO: 188508 - DNA, 601 bp, Human
tcctagttggaagtcaaagccctgagtactggggagggctgctggtataagtcctgaagtgcaaagccctgggaactgggagctctgatgtcccagggcaagagaagacaatgacccagctcgataaaagagaatttgcccttcctctgtctttttgttctctctgggccctgaaccgaggagatgatacctatccgtgttggtgagggcaggtctattttactcagtctactgactcaaatacttatttcttccagaaataccttcacagatacaccccaaaataatgtcttaacagttrccagactcagtagcttacacctataatctcagcactttgggaggccaaggcaggaggcttgcttgaggctaggagttcaagaccagcctcggcaacatagcaagtccccatctctgcattaaaagttagcttgtggtggcccgttcttgtagtcccagctgcttgggaggctgagtgggaggattgcttgagcccaggaggtcaagtctgcagtgagccatgattgtgccactgtgctccagcttgcgtgacagagcaaaaccccattgcagaaaaaaaagttttatcagctacttgggc

SEQ ID NO: 188509 - DNA, 601 bp, Human
tatcagctacttgggcattccatagtccaatcaagttgacacaaaattaactatcacagtgctctagattgcatgcagtagaagcagactgtaatgagagagaaaagcgtaccagggaacttacccaatcaacaaaaaggctggagacttaattcaggaaatcaaggctcagatctagtcatggaacaatgtgctttggatccctccaatgtggtcatcaccctagacactggctgccgtactacccattcttgatgtcacctttgagtcactccctcaggttatacactgcagggtggaracatttgattggctttgatgaagtcatgagtccgtacttcagatgctaggggacaaagaggggagctatctgtcgtgggaaatggggctctgagtcccacctatctaggcattcccccacatgcgaagtgttgccaaaagctgggtagcaaaagcagtaaatatccactacagctgggtatggcattctaggtttgatggcatcattttcatattatttaattttttaatgtgtatttttgttaagtttgctatccattttgtgtttcttagtaattttctttttatctctggattactt

SEQ ID NO: 188510 - DNA, 601 bp, Human
gtataactaatctgttaagtaatctgtttaatctgttaattagacaactaatgtttaacctgtttaatctgatctttagttatatctaatctgatttcattgttattttcaatggttatggtttttataaagttctatttgactctttttacatctacctgttcttttttcatgttttttccccataattttgttttaaggtttctagtccttcttttcttccttccattattttaggtattcttccttttttttcctctagtttttgtttttagttttgttattgttttgttttgttttrgtattcttcctttagagcttagttcagatgactcttatccacagtctctggggtcctctgggtcttcccttgcattccagccatcctcttgagagactttgtgtggctgattcatttttgttcaggggttcttttcagtaggaagtttctgtcttatggtgatagttggttgattgtttttactgagagagtccttgtcctgcattgtgaaaatttccctccagggcttctctggggtccttaaagttacaggcagggtggttctgttgggtaacataggcaggtggagaggataaataa

SEQ ID NO: 188511 - DNA, 601 bp, Human
tttttcctctagtttttgtttttagttttgttattgttttgttttgttttggtattcttcctttagagcttagttcagatgactcttatccacagtctctggggtcctctgggtcttcccttgcattccagccatcctcttgagagactttgtgtggctgattcatttttgttcaggggttcttttcagtaggaagtttctgtcttatggtgatagttggttgattgtttttactgagagagtccttgtcctgcattgtgaaaatttccctccagggcttctctggggtccttaaagttamaggcagggtggttctgttgggtaacataggcaggtggagaggataaataaatttagaattataaaccacctaaaaaagttgccccatctcttctcccagtataggccactggcctgagtcactgtctcttttccttaaaaaatcatgaaatctggtggggcatggtggctcacacctgtaatctcagcactctgggaggctgagatgggcagatcacttaaggtcagtagttcgagaccagcctggccaatgtgttgaaaccccatctctactaaaaatacaaaaaattagctgggcatg

SEQ ID NO: 188512 - DNA, 601 bp, Human
tctcatccgaccctgcttgacacatccttaaatccattccagcagaactcctctctcttcctctcactcccactctgaactgtcccttctctgaagggacatttgcctatggcccttgcctgtgtgatatttgcctatggcctttgcccgtagcatccatgttctggtttgtattggagttatttgtgtgtctgttttacaccaccccttcattcactgagttcttggagggaggaaagccatgtctgacttaccgtctattggccgtggtgccaggcagaaggcatgtcacgtaagagtygctccagtgggcctcagtgaattggggcacccccagtgctcttgctggtgattcagttaagccaggctagtggcccctgtgctgcacagggtgggtacatgcacttcagcagagtctcctgaggaacccctggcttagtgttattgcatcagcacacaagagctcaaccctggcagtgaggtgggagtacagccagagagagcattgcccctgcgtggtgtctccctctcccccgttcctgggcctcctggtttggccccactccaccattactcttccttcaggatactcttctggccc

SEQ ID NO: 188513 - DNA, 601 bp, Human
gagtctcctgaggaacccctggcttagtgttattgcatcagcacacaagagctcaaccctggcagtgaggtgggagtacagccagagagagcattgcccctgcgtggtgtctccctctcccccgttcctgggcctcctggtttggccccactccaccattactcttccttcaggatactcttctggcccggcagctgtcttgaaagcccctgtgcagtttcaaaatgctccctgtttggactgcagcaaatcctgcctagtagcgttgtctgatcatgtgaatgtgatgccttcccggtcwggcgcctctggggtgtactgggcaagtcggcccacgcctccataggccttgcatgcagcagggctcacaacacacctctgttgcttaagggtgtccattcaagtcaccctgctcccagtactgaccccagggtagacaaaacggattccgtaagacattcaagccaacagtcaggaacctgatgtagctgttgggtgaccatacttgtatctaggaggctatcctgagcctagcacagagcctggcatgtggtaaactctctatgaaggaattaatgagttgatgggtgcatcttttgat

SEQ ID NO: 188514 - DNA, 601 bp, Human
gaggaacccctggcttagtgttattgcatcagcacacaagagctcaaccctggcagtgaggtgggagtacagccagagagagcattgcccctgcgtggtgtctccctctcccccgttcctgggcctcctggtttggccccactccaccattactcttccttcaggatactcttctggcccggcagctgtcttgaaagcccctgtgcagtttcaaaatgctccctgtttggactgcagcaaatcctgcctagtagcgttgtctgatcatgtgaatgtgatgccttcccggtctggcgcctcyggggtgtactgggcaagtcggcccacgcctccataggccttgcatgcagcagggctcacaacacacctctgttgcttaagggtgtccattcaagtcaccctgctcccagtactgaccccagggtagacaaaacggattccgtaagacattcaagccaacagtcaggaacctgatgtagctgttgggtgaccatacttgtatctaggaggctatcctgagcctagcacagagcctggcatgtggtaaactctctatgaaggaattaatgagttgatgggtgcatcttttgatgggtgcatc

SEQ ID NO: 188515 - DNA, 601 bp, Human; identical to SEQ ID NO: 23058

SEQ ID NO: 188516 - DNA, 601 bp, Human; identical to SEQ ID NO: 23059

SEQ ID NO: 188517 - DNA, 601 bp, Human; identical to SEQ ID NO: 23060

SEQ ID NO: 188518 - DNA, 601 bp, Human
tttctgggccttctctccccttcttgttttttattgcccctctccccccgatcttgtgagttctatgcttgggcctcactcaccctgaatacagacttccaggtgagagcagagcctgcggtcaaatagacagcctgtagaggaaaaggtgagcagaggctcagacacccactcacagagaatgggcagatgggtggacaggctgggaacgggagaagcagatgcaatttattctttcattctaaagaaggccttaagctgggaggagagtaggaatcaggcctgaatttcttaaaaggargcatgggatcttgttttggattttaagaatttgtgagtctgtatccttaaaagcctctgtttgcttaactgagtgatagggaagaaaccttccaggtgcagggagagagattcatagaattactgcaggagaggttttggccaaattctgaaagaggaatttccttcccaaatatggaaaagcatcctataatggcctggaactcagaagaggttctagcacacttcccccggtcgggggaaagagggcatgggtggggctggggagggtgtctcttaggcatctctcctcgcgctgtcc

SEQ ID NO: 188519 - DNA, 601 bp, Human
gcagatggatcacttgaggttaggagctcaagaccagcctggacaacatggtgaaaccctgtctctattaaaaatacaaaaattagccaggcatggtggcgcgcacatgtaatgtcagctactcgggaggctgaggcaggagaatcacttgaacctgggaggtggaggttccagtgagcaagagattgcatcactgcactccagcctgggtgacacagcaagactctgtctcaaacaacaacaacaacaatcaacaaacaaaataaacccaaaaaaactttgactcctctctttataaccrtatccaatatttcacgaaataatgctgactaccttaaaaataaatgcagaattctctcatccttcattccttccctgcaatcaccttggccccatccacattcatctcttatctgagttattgtggtagtttttgtttgtttgttttagtaaagtgaaagcagtttattagagaagtgaagaaacaaaagaatggcactccatagacagagcaacctattgtggtggtttttagtggtccccctcaccaactcttgactccatctattctagtctcactacagcagcaaaagtgatgctt

SEQ ID NO: 188520 - DNA, 601 bp, Human
gtgaccattcctgcacctctttacctgtgccccagcatgctggccttggtgcccacttccttccccttctctccatcaattaggacaaccacagattcatcagcctcaccattgctagagttgtagagaaaggctgcctacctgtcccttggacggggctctggggggcgaagcctggggatgcgctccatctcctgagagatcacatactgggtgaggtcatcgtgccaggacaatcctgtcaggaaagaggacagcgtaagttggttcaggagtctggggatccagtaacggggaccaytggggatcagaactgtaccctctgccctgcagctcatggggtttgtcagagtagagggacaaactcagtgggtgatctgagctgtcttcttcccaccctcaggtacagctattggagccagaccacctgggtttgaatcctgcctttgctactgatgaattatgtaaccttgggcaagttgctgaacctctccaagcctcaattccctcatcaataaaatggggatttatacctcctaggattgttattatcattaaaataacacatatacatatcaaacggttagaatagtgcctgtca

SEQ ID NO: 188521 - DNA, 601 bp, Human
ttcatcctggtatcatcatctgagctccctaaacctcatttactttcctctgctttgcagtctgaatgatgcctttagaggccctaaccacaaaaagatgatggtggctcctgtcatatagaaattcacatagtaatgaaatggaatattgaacaacttcagtccaacagcattctaatttctcccatgatgactacattgatgcttcttttaaagtagccaatgtcaatgtttttcaaaacattcaaaaaatgcccgtttttctggatccctagagatgagctcagctcctcttggtcaygtgagcatgtcagagagtgaccattcctgcacctctttacctgtgccccagcatgctggccttggtgcccacttccttccccttctctccatcaattaggacaaccacagattcatcagcctcaccattgctagagttgtagagaaaggctgcctacctgtcccttggacggggctctggggggcgaagcctggggatgcgctccatctcctgagagatcacatactgggtgaggtcatcgtgccaggacaatcctgtcaggaaagaggacagcgtaagttggttcaggagtctggggat

SEQ ID NO: 188522 - DNA, 601 bp, Human
agaattcagttttctggctccagttctgccatcaacttgatgggagaccttaggcaataacttgcggtctctgggccttggtttcccccaaaatgaggggtgggaggatacagattctaggtcctgaatttgaaatttaggtttggcaagggggcgtgctgccatggggtgattatgagtcaaggaggtgctggggactcactttcttgatatcagctccaacatttacaacccctcctgcgagacaggaaaaacaagagtctggaaaaatggccatggccaaggtctacacaacacaagygggagaaagggccagagaccctgagcctggaacatttgctgtggtcttcatctcagtcagtgaccaagaccctgttactggtctcatcctaagcctggcctcattcctttttgcttcctcctcccaatttactgttttattaactcctccctctaccattggccatctctctcaaagctattctttgttcagttatttctctacccatcaattactggcttcttcttagtactggctatgcccgtttttaggccctcattgtcaccaacccatccttcccgatgcctccttttccctgct

SEQ ID NO: 188523 - DNA, 601 bp, Human
atggtgaaaccccatctctactaaaaatacaaaaaaaaatttagccgggtgtggtggcaggcacctgtaatcccagctacttgggaggctgaggcaggagaatcgcttgaacctggcaggtggaggttgcagtgagccgagatcgagccactgcactccagcctggacagcaagagtgaaactctgtctcagacaaacaaacaaaacatattttgagtataatgtcctttctgtgcaaggtgttcccttggaatttggagactgtgctccagcagactaagggcggctcaactagttctcrggcctttttactacagagggctggtcctgcagggaggggacacctacgccatctgctggtgagaaagagaactgcggggaggggctgcttgggcgaaggccgcctccagccagccgtgcctacggacacgtttcggctccagttctcccctctggtttgcctccagctcttgcggacaacatcagccctctggggacttggactgattctccagttagcgcatacctgtcccactcctgtctgcaagatttggagccctgtctgtgcttccagttcagacttcaccagccctgcagggag

SEQ ID NO: 188524 - DNA, 601 bp, Human
acctgagatcgggagttcgagaccagcctggccaacatggtgaaaccccatctctactaaaaatacaaaaaaaaatttagccgggtgtggtggcaggcacctgtaatcccagctacttgggaggctgaggcaggagaatcgcttgaacctggcaggtggaggttgcagtgagccgagatcgagccactgcactccagcctggacagcaagagtgaaactctgtctcagacaaacaaacaaaacatattttgagtataatgtcctttctgtgcaaggtgttcccttggaatttggagactgygctccagcagactaagggcggctcaactagttctcaggcctttttactacagagggctggtcctgcagggaggggacacctacgccatctgctggtgagaaagagaactgcggggaggggctgcttgggcgaaggccgcctccagccagccgtgcctacggacacgtttcggctccagttctcccctctggtttgcctccagctcttgcggacaacatcagccctctggggacttggactgattctccagttagcgcatacctgtcccactcctgtctgcaagatttggagccctgtctg

SEQ ID NO: 188525 - DNA, 601 bp, Human
aggcgctccttgtcttgctgccgcgcatgctgccgcacacacagagccacagccagagccaccagcagcccagccacacctgccagggccaccagagtgagcagcactgagcgcatgggtgaggtgctgtgcgcagtttggggaaggactgcagctgcctcctccctctgtgggaacaaggctagaatcaagggaggcagtggcatagggaggtttcagagctgctcctcaccccggtcccatgccacaccccctgttaggacatctcctggggcaaagctgggagattaggggtatggtrgtacagccagatgggctcagattctccttctcaatccccatcggatcaactcaaccacagtgcagtgccagaggcccccaccaggagtgtttgcatttaaaaacggacagagaaccctaggaattgaattgtagaacgtgaggcatcagtgttggatgcagaagacaaaggtattttgagtataggccgggcgtggtggctcacacctgtaatctcagcactttggggggccaaaggttggcggatcacctgagatcgggagttcgagaccagcctggccaacatggtgaaaccccatct

SEQ ID NO: 188526 - DNA, 601 bp, Human
aagtcaggatgccggttctttttgatgttgccctccccctgcgcggtggcacaggtgtttggctctgcttggtaggcacagagggcctgccactccttggcaaggcggtcccggttccgcaggtgatcctccatgtatgcctgtgggggcaccacggtctggctctggcccacacagccagcctggcctctctcaccatcccattccttcacccactctgggcccaggccctgtcctgaccagaatcatgtgtcccgtggagatgtccatgttggcttgggccggctcctcgcaccaggasggggtgctgctgtgggagctggggctggcctgggctgcgtcgctgaactgggaggacacactgctcacccgtgaaggctccggtggaccctctgcccggttgaacaaggacttcgtggccatgtgctggcggcacaggtcctgtggaggaagaatcaggtgaggtccaagagtcccctgaaacttttcaacagggccctgggttcaactctgggctcctaggcttgcccttgactgattttcagtggaactcagctcctctggggtatggtcttctgcctggccctgatcctttccaggg

SEQ ID NO: 188527 - DNA, 601 bp, Human
cgttctcccatttgtctgaaatatttctctttcccctgcttggcctctgcccagttccccctccttctccacccctccacctagtctctctcctaatgaaaaagtttgtttctcttttacattagtaacgtatgtaacgggtggtatgtctttctttgctttggccaccaggaaactcagagctaaattaggttcaattaacgtaggtcttaatctcagtctttgggtatccttatcttccctgtctaatatacacttagctgttagcttcttacctcggttttggtggttttatagtttkatctctgtgcctttatcataagtctctatgaacgctttttgactctagacaggacacacacacacacacacacacacacacatgtatgttctgtaaacaggacacacacatgtatatatgtgaatatatgggtatgcatatatgtgtttatatatattcatatatgtatgaatcatgagcagggccaataaaagcctttttaaaaagactgttgagtgctcatttggtgaagaaaacgttacgaaaaggccatcatctactcttcccacatccattgtccccttgctgtggggccctgct

SEQ ID NO: 188528 - DNA, 601 bp, Human
gcgcgtctcctgggtctgcacgttcttcaggtagaagctccgcaccagaaagtcctcgcaccagatgtgctccgacaccaggttcacctgcccggcaggggcccaggcctgagcgccgcgggctgccccagtccccgcgttgcgcgcgctctcctcgcgaccttctcggtctctccaaccaccgcccggcctcccaggccggttcaaattctaagttccagcggtcccaggaaccctggctgcctgtcacttatctactgctcaggaccactagtagcttttccacccagacacagctatygtgagcctctcgaggtcggagtttctcctccctcttcctcgcagggtctaccagagtatcggtgctacacgtgccataaacttggatgaaattctgtagtattcttactggatttttttcgttaaccaccagcaggaccaatgaaaggctttttaaaaaaaccgtcatgtgcttatttggtggggaaaaaattactattcaggctcatctggtgatgagaagcttctgctgtgttcttaaggtttttttgtcttagtggggactcacgttctcccatttgtctgaaatatttctctttcc

SEQ ID NO: 188529 - DNA, 601 bp, Human
gccaactgagtttacataattccagcctaaagcaatcttttagcttatctgtgcagctttaaaacagatccatgcactagttctaccaggattttttaaatatggaaaaaaggaaatagctctgataccctggcactgctttcaagacgcctgtgtctcaggcctcagggaccccagttagaaactgctgtcctgaggttcagaaactatacccatgtccccacccccagctctgctcctctgtccagtacctagagacatcaggccagcttggcaagggacagagaaccaggagaagggygcagtgtgggtgggcccctgcccttggtagtgggcttcccaagtacctgtctggggctaggaaaagcaggggacgctggagggctgacctgtcttggtgtcagtgttggaaaagggtaagtccctcaggtagcccctgtctagtccccacctgctccactgagccccccagaatccagagatcctcccacactcctttcgacagtctttgcctcttccctgtaccccttgctcccagctcggggtggtccccgggccacatgtcctgtctgtccatgcagcagccacacctgccaatgat

SEQ ID NO: 188530 - DNA, 601 bp, Human
taacccatgtaaagagctaagtgctaggtctggcacacaataggtgctcaatacatggtagcaggtggcaactattaatgataatacatcatcatattaagagacacttctgcccaagtccaaggggatagctttctggtgacttcaagggtgtcagtcttgccacatccctgctctggccctctgccattctttatgaccacccaggctgttttcctcccgactcaggctccagtggtccttaccagttgtgacatcaggctgccctgggcatagtgttccctgggccaggggaggacaaccccaacccctcaactcgggacattgtgctactgcttgtctccctggagcagtctcacttcagcacaggcattctgtggctgcgttatattcagacttggggtccccttggacctcagacctttctccactgcccctgaccacaactcagtgaggagcagggggcttctccgtctctcaatggacccatctaacctgcccttgtcctttatgacctttctgctttgggagtcacctgcatactcctgatatccctgcaagccagaaccagggaagaccttcttaggggttgtcagattga

SEQ ID NO: 188531 - DNA, 601 bp, Human
aatctcctctccacccacctgcagtgcacgatgatggggcaggagcggccccggtagcacttgttcaccttcctgcaacaagaaatgggtgtgagggccagtgggcaccagcagagagggaaagggaagctgaaacacatgacgtgggcctctctttcttccttttctccccacctgcccggggcagagagggaagatggttggagaaaggagccagggctggaggcaaagaaccagagctggtgtgggtggcattgggctcgccttgtcacttgcaagctaggtgcccaagctatgcacstggaacaactgatttaacctctttgagcctcagttttcttacctgtaaaatggaggatagtaagaaaaacctccttagggttcttacaatgatcacatgagataacccatgtaaagagctaagtgctaggtctggcacacaataggtgctcaatacatggtagcaggtggcaactattaatgataatacatcatcatattaagagacacttctgcccaagtccaaggggatagctttctggtgacttcaagggtgtcagtcttgccacatccctgctctggccctctgccattctttatg

SEQ ID NO: 188532 - DNA, 601 bp, Human
gacaaccaaagaggagagccatggctcagcccagaagcagaggcagcaggagggaattggatgggcctctctagccttcagccagctttttgtgtatagggggccaatggtcaatattttcaactttgtgggccacatacagtttgtatcacatacttttcttcttttttcttcacccatttaaaactgtgaatgccacgcttaggtcttggccattaaaaacaggtggtgtgctggatttggactatgcctgcagtttgctagcaccaaggggacaggcaggcaatgtgcacaggagacrcacacagggagtgggaccagagagatgaatctcctctccacccacctgcagtgcacgatgatggggcaggagcggccccggtagcacttgttcaccttcctgcaacaagaaatgggtgtgagggccagtgggcaccagcagagagggaaagggaagctgaaacacatgacgtgggcctctctttcttccttttctccccacctgcccggggcagagagggaagatggttggagaaaggagccagggctggaggcaaagaaccagagctggtgtgggtggcattgggctcgccttgtcact

SEQ ID NO: 188533 - DNA, 601 bp, Human
gggaagctccctaccttttgccatgcggttcaggaccatgtcgatgaggatgtaggtgccggtcctccccgcaccatcactgaaacaggagttagtgacaggtttagcttgagatgcagcagaaagggggagggacggaggaggcgaggaggcctggaggcctgggggaggggaggacactgggtgacccgttggggttggcttggagagggacagtgagccgaggatgaaggaaagctcatagcacctgcacgctgggacttgggccttgagaggggagtctgtgacctgtgggtgtcayttgggcaatgggacaaccaaagaggagagccatggctcagcccagaagcagaggcagcaggagggaattggatgggcctctctagccttcagccagctttttgtgtatagggggccaatggtcaatattttcaactttgtgggccacatacagtttgtatcacatacttttcttcttttttcttcacccatttaaaactgtgaatgccacgcttaggtcttggccattaaaaacaggtggtgtgctggatttggactatgcctgcagtttgctagcaccaaggggacaggcaggcaatgt

SEQ ID NO: 188534 - DNA, 601 bp, Human
ggctttcccttcctgactcttctaggaagggctgagcatgcccaagaggtggctggtggggcagtgaggagtgggtacacagagatgctcacacaggcaaagagggacagaggctgggctgcccgccaaggggccccagggtctcactggggcagggccttgaggatggcattcacttcctccgccacggctgtcagggcaaattcaaactggtcctgaggaagggcagtggtaggatggtcatggagagggctgacctgtgctctgccctcaagatggggggcttttggtggggggaggrccctgggcaggtcccctgggaggaagggagccctcctggaggaggcgcagaagcaggtgggaaaggttggcagctgctgctttccctggggtggccaagaagtgggtgctagggaagggtgggagctggggttggggcaggaaggcatggtcaccttagagcggacaaggccaggccgctggtcacggacatgctccagggtggcagcgatgtcaatctccttcactcctggagatggaggtggggatggggctgctcagggggtgtccagaggaggacaggacccagaaaacctgaggc

SEQ ID NO: 188535 - DNA, 601 bp, Human
gccgggtgcagtggctcacacctgtaatctcagcaccttgggaggctgaggtgggcagattacctgaagtcaggagtttgagaccagcctggccaacatggtgaaaccccatctctactaaaaatacaaacattagccgggcatggtggcacatgcctgtaatcccagctactagggaggctgaggtaggagaatcgcttgaaccagggaggtagaggttgtggtgagccaagattacgccattgcactccagtctgggcaacaagagcgaaactctgtctcaaaaaaaaaaaaaaaaaaagaaaaaaagaaaaaagaaatcagcctgtagtctgtgttcaggttagtggtgttgggggagaaaaccaatgtctaataagaaagttttatacagcagaacacagaaatgaggcagggatgaacagctcactgctcactgacagagaccggaaaacccaacactgaccaatgttggagaggatttagggaatgaaccaaaggggttcatacaggatctatcttcctaatgactatcaacaaatatgaatgcacctaccatgttctaggcatggttccaagtactgggattcagtgagatgag

SEQ ID NO: 188536 - DNA, 601 bp, Human
tgaggaagaggaagcaggggaaagtcaggaagtatggctttttaaaggagagtctagggctgggatatagtagcagagccacctggtttcagtccttgtatcccaaagatcttggggcacacgaacctgggccatcccatgggaaatacattagtccttcccattacatgtggctagtgtgagttaatagaggagtgttgtacatctataaaactcagttaataaccttttaaaattagagaatgtgtttcagttactcactttgtatcagaatttgttaggttgccactcaaactggctyaaactataaagcagctttattggctcatagaactgaaaagaccaatagttgagtgtccttcaggtgtatttattctagagattcaggaagtcatcaaagctgcagctttggctgggtgtgatggcacaaacttacagtcccccagctacttgggaggctgaggcagaaggatcccttgagttcaggagtttgagaccagactgagaaacatagcaagaccccacctctaaatttaaaaaatggcagctctgtttttctgcagttcccttggctcagctgtcttgcaggagttggttgact

SEQ ID NO: 188537 - DNA, 601 bp, Human
ccaaagatcttggggcacacgaacctgggccatcccatgggaaatacattagtccttcccattacatgtggctagtgtgagttaatagaggagtgttgtacatctataaaactcagttaataaccttttaaaattagagaatgtgtttcagttactcactttgtatcagaatttgttaggttgccactcaaactggctcaaactataaagcagctttattggctcatagaactgaaaagaccaatagttgagtgtccttcaggtgtatttattctagagattcaggaagtcatcaaagctrcagctttggctgggtgtgatggcacaaacttacagtcccccagctacttgggaggctgaggcagaaggatcccttgagttcaggagtttgagaccagactgagaaacatagcaagaccccacctctaaatttaaaaaatggcagctctgtttttctgcagttcccttggctcagctgtcttgcaggagttggttgactggcttggcctgggttaattgcctatccatgagcccacgatagtggccaggtggagatagacataccctaattagcttacctctgtggaggttcaccctcaag

SEQ ID NO: 188538 - DNA, 601 bp, Human
accttttaaaattagagaatgtgtttcagttactcactttgtatcagaatttgttaggttgccactcaaactggctcaaactataaagcagctttattggctcatagaactgaaaagaccaatagttgagtgtccttcaggtgtatttattctagagattcaggaagtcatcaaagctgcagctttggctgggtgtgatggcacaaacttacagtcccccagctacttgggaggctgaggcagaaggatcccttgagttcaggagtttgagaccagactgagaaacatagcaagaccccayctctaaatttaaaaaatggcagctctgtttttctgcagttcccttggctcagctgtcttgcaggagttggttgactggcttggcctgggttaattgcctatccatgagcccacgatagtggccaggtggagatagacataccctaattagcttacctctgtggaggttcaccctcaagctgggattagggtccctcccacccaaaccaggtgtctgccacacaaaggggaggacggcaatggatgtaggaacagccaaccacaatgtcccttgtgccctcagttgtcaaaaactgcatta

SEQ ID NO: 188539 - DNA, 601 bp, Human
tttttttttctttttttgagacagtgtctcactctgtcacccaggctggagtgcagtggtgcgatcatggctcactgcagctttgacctcctgggctccagctgtcctctcacatcagcctcccaagtagttaggaccacaggcatgcaccaccactcctggccaatttttctatttttggtagaaagaggtttcgccatgcccaggctggtcttgaactcctgagctcaagcaattcacccactttggcctcccaaagtactgggattataggcataaattactgtacctggccatcatrtatcttgtttcttatcatcacttgtttatatggcttagagattgggctgtgaagctgtgagggctgggcctatgtctttcctacctctttcccccaagtgccaggcacggtcttaggcataggggaggtgccatgagtggtactgagcagtggatacatctgatggtaaacttatatgtgacactcttcttcccagctccctgatctgggttgtttgacataatatagagtgaagaaaagacaatgagggaggtgggcagattgaacaagcctgacccttcagttctcagtgtttgaggt

SEQ ID NO: 188540 - DNA, 601 bp, Human
agtgtttttcagggccatctggtagacatctataaagttgtccttgaggatgtagcagaacagggaacatggcccaaaagcctcagagatgggaatatgaaactaagtattaaggtgaaatatgtgtgagttatgccaatttagcaattacattgccagaatgaatcatagcaatttagcatttgcccttacagataaactgctgtaggcaaagagacatgcaagaatattcaaggcagccttatttgtagtcaggaaaattagaatgatttaaatgtcccatagtagggggctaattaaattatggtacatccatatgatgaaatttcatgcagccattaaaaaggttagggacagatctattaatatttattgcttgctaagagatggaaagaacgtgttgaaaaagaaaaactttagctgaattaagtttaacagagtttaaatgagcaaagaacaattcacaaatcagacagcgtcccgagccagagtaggctcagagactccagtgcagccatgtggtggaagaagatgtatgaacagaaaaaggaaagtgacatacaaaaaatggaagtgaggtacagaaacagccggattgatt

SEQ ID NO: 188541 - DNA, 601 bp, Human
atgcagccattaaaaaggttagggacagatctattaatatttattgcttgctaagagatggaaagaacgtgttgaaaaagaaaaactttagctgaattaagtttaacagagtttaaatgagcaaagaacaattcacaaatcagacagcgtcccgagccagagtaggctcagagactccagtgcagccatgtggtggaagaagatgtatgaacagaaaaaggaaagtgacatacaaaaaatggaagtgaggtacagaaacagccggattgattacagcttggcattagcctaatttgaacayggtttgaacagttggccacctctgattggccaaaacttggtgattggcacaagagtaggctacagtctgtatacaactccatttacgttatagtttgtaatgtgctgagaaacctttaggccaaacttaatatataaggaggcagctttaggctaaacttgaacttgatttaacaattccccactttcggttatttcagttttagaggatgaccaagactttactcattgatgtcattatcaccattgtaaatgtatttatttggtcttggaacccactgggaaatagcagagcagtggg

SEQ ID NO: 188542 - DNA, 601 bp, Human
tgattacagcttggcattagcctaatttgaacacggtttgaacagttggccacctctgattggccaaaacttggtgattggcacaagagtaggctacagtctgtatacaactccatttacgttatagtttgtaatgtgctgagaaacctttaggccaaacttaatatataaggaggcagctttaggctaaacttgaacttgatttaacaattccccactttcggttatttcagttttagaggatgaccaagactttactcattgatgtcattatcaccattgtaaatgtatttatttggtmttggaacccactgggaaatagcagagcagtgggttttgtaaggtgggaacaaggacttcaggttatttttttgtgaaggttagagtagagggtacctccttatggtgggatgtcctgtttacagaagaaaaacaaaacttagtctgttctaggatctatttgtttccttaaagtcttagtttgattatgtcacatttagcataaatgactctattttggtttggtgtggtctgttggaggctagtgcatgagcttagtcgaaaacaatggcctcccataatttgtttccaatttctcctc

SEQ ID NO: 188543 - DNA, 601 bp, Human
ggaggcagctttaggctaaacttgaacttgatttaacaattccccactttcggttatttcagttttagaggatgaccaagactttactcattgatgtcattatcaccattgtaaatgtatttatttggtcttggaacccactgggaaatagcagagcagtgggttttgtaaggtgggaacaaggacttcaggttatttttttgtgaaggttagagtagagggtacctccttatggtgggatgtcctgtttacagaagaaaaacaaaacttagtctgttctaggatctatttgtttccttawagtcttagtttgattatgtcacatttagcataaatgactctattttggtttggtgtggtctgttggaggctagtgcatgagcttagtcgaaaacaatggcctcccataatttgtttccaatttctcctcttttggtcagtttcttacttaggtaagagtatgagcaaaacttagggccttagcactgctctcagttacctcattttgtgtttctggtctcagcacatcattcataggttatggtgcctctcatggtcacatatatcttttagctcttttcattccagttgaagagagacc

SEQ ID NO: 188544 - DNA, 601 bp, Human
gtcctcagtcagtgaaccatgaaaagctttcttttcctggtgaaaatacacggtggcatgatgagctactgttacaacatcagtcctcttgtgtgggaaagcttttatacaaccagacgacctgcattgaaaaatgacaatagaatgaaatccctctataaatgtttaaatgtcccatcagctagcgaaatgtacctgaaatttttattgtcttcccaggaatatgggtttgacaaaccaaatattggtcataaactattttagcaatgtagaagtcactacacacacacacacacacacctttaatttggatcattttatgtttttcatgatgagttatggaatgcagaacttttaataaaaaaaagctttaaggactcaggaaggacaaggtggctgtcctggttctctgtgagtccatgcttaacattggacttacatcctcttggataccagttgtttctccaatttaggtgcatagcactaataattgataagttatcataggtaatttgacttagaacatggagttcattcaaactgtatatctaaacaatttcagtactggatgatttagcatgaacatctggcaaggtgtttt

SEQ ID NO: 188545 - DNA, 601 bp, Human
tttctaatttgacaatgcttcccatgtaacttagcatgtcaaataattctgtttacctctcttttggatgcttcagggaacctctgtagcatcccaaagttaaaggtcaaaaaagacttaattttgaagctgaaatctgatttttgggaagcctgacaaatatgtcaaaggtttaaaacacttgaccaaaatagaatcacaggtcaccataaaacaatagtcattcatttaaccaaagtgataattaaaagattctttttatttgtttgtttgttttttgagacaaagtctcactctgtcrcccaggctggagtgtgatggcaccatctcggctcactgcaacctccgcttcctgggttcaagtgattctcctggctcagcctcccgagtagctgggactacaggcatgcaccaccatgcccagctaatttttgtatttttagtagagatggggtttcatcatgttggccaggctggtcttaaactcctgacctcaggtgatccacccaccttggcctcccaaagtgctgggattagaggcatgaaccatcccacctggcctaaaagatacttaaaaacaaaaaacctgtactctttgata

SEQ ID NO: 188546 - DNA, 601 bp, Human
ttgtattagtatattatcatattaaaactaattttaataaaacttcataaatacatttatcaaatttgtcatcttttaaaccacacatttccataaaccttttgtttcacattttccccaagtttctctttctttttttttttttttgagacatattctcactttttcacccaggctggagtgcagttgcaccatctcggcccactgcaacctccgcccccaggttcaagcaattctcatgcctcagactcccaagtagctgggattataggtatgcgccaccatgcttggctaatttttygtattttagtagagacagagttttgccatgttggccaggctgttgtaggactttcttcttagttcaattaaaaatggggtccttgtcacacaaccaggaaagattaggctcgcggacacatagaagggtgagaaaaatggaatttattgggtgaaaaggaaaaaaattcagtaaagctagagaggtgcctgttaacaggcccccatctcacagattgaatccccaggttaccaccctggtacgggagaggacaagctcctccctctgcaaacgggtaaacctcccgaggctccaccccag

SEQ ID NO: 188547 - DNA, 601 bp, Human
agggcctagagaataggaattatccactctcacctatgtctctattcccactagtgtcagtagccttggagttccctagacctcatttatgccatggatactagcatgactttatccatgaaatgagaggcttggcttaatcagcagaaattagccatgctcacctgtgctgtgccttttaacctctgttatcatctgcctctggatcctgtagatccagttttctttcctagggctttgacccgaagcttggaattgagtttgggacaaaattgtgtctcagggggtgttgcatggactycttatcataagccaaatgctaaggtgaaactgtggaatcgagtcctcctgcaacaagggagagaaagggatgtcttgtgacacacccagataactggtggctatggttatgcttgctaagacttgggtgcatggtgcttggttttggttagctcccttggtcttcctttcccaaaaaggaaacctccaagtgatgggcatcctacttattcctgtcacctgacaggatttgcaggataattgctcagaaccagaatattgacccagatttttacattatccatctgagctgcagccaaag

SEQ ID NO: 188548 - DNA, 601 bp, Human
gggggtgttgcatggacttcttatcataagccaaatgctaaggtgaaactgtggaatcgagtcctcctgcaacaagggagagaaagggatgtcttgtgacacacccagataactggtggctatggttatgcttgctaagacttgggtgcatggtgcttggttttggttagctcccttggtcttcctttcccaaaaaggaaacctccaagtgatgggcatcctacttattcctgtcacctgacaggatttgcaggataattgctcagaaccagaatattgacccagatttttacattatccrtctgagctgcagccaaagattgctggttggttcacaggagcaggcagggttagtctaaaatgtaggcaaaaacttaagaacaatgaatgagtttagaatttaattacaaatgtataagttttgaaacataatttctctctctccagtcctcatttttgttaaaaaaaatcataataggactgagttgtttgcaaagtagactttagtcttatacttggcctgattatttgcataaagtacagcaagaataattatttctacataggccttttagattggctttgatggaactctgttcca

SEQ ID NO: 188549 - DNA, 601 bp, Human
agccaaatgctaaggtgaaactgtggaatcgagtcctcctgcaacaagggagagaaagggatgtcttgtgacacacccagataactggtggctatggttatgcttgctaagacttgggtgcatggtgcttggttttggttagctcccttggtcttcctttcccaaaaaggaaacctccaagtgatgggcatcctacttattcctgtcacctgacaggatttgcaggataattgctcagaaccagaatattgacccagatttttacattatccatctgagctgcagccaaagattgctggtyggttcacaggagcaggcagggttagtctaaaatgtaggcaaaaacttaagaacaatgaatgagtttagaatttaattacaaatgtataagttttgaaacataatttctctctctccagtcctcatttttgttaaaaaaaatcataataggactgagttgtttgcaaagtagactttagtcttatacttggcctgattatttgcataaagtacagcaagaataattatttctacataggccttttagattggctttgatggaactctgttccaaaaggaagctcagataagaccttttaaa

SEQ ID NO: 188550 - DNA, 601 bp, Human
ctgtggaatcgagtcctcctgcaacaagggagagaaagggatgtcttgtgacacacccagataactggtggctatggttatgcttgctaagacttgggtgcatggtgcttggttttggttagctcccttggtcttcctttcccaaaaaggaaacctccaagtgatgggcatcctacttattcctgtcacctgacaggatttgcaggataattgctcagaaccagaatattgacccagatttttacattatccatctgagctgcagccaaagattgctggttggttcacaggagcaggcagkgttagtctaaaatgtaggcaaaaacttaagaacaatgaatgagtttagaatttaattacaaatgtataagttttgaaacataatttctctctctccagtcctcatttttgttaaaaaaaatcataataggactgagttgtttgcaaagtagactttagtcttatacttggcctgattatttgcataaagtacagcaagaataattatttctacataggccttttagattggctttgatggaactctgttccaaaaggaagctcagataagaccttttaaagctgagcccagccatgggtt

SEQ ID NO: 188551 - DNA, 601 bp, Human
ggagctcctgggcctgttagaaagtgacattctttactgaccacgggtcaggaaccctgtacagggactgtgtagtcgagggtataaggccagtttcttttccaaaaggggcttttattggcttggcaagtcgagcttgactccttaaagggaagcatacctttctagtcaaagccttggtaaaacaacagtttctccaattgcatcctgttgcaaaagaaaaatggattcttattgcactgatgcaaacaactatattgccataaattaagaatactctgctgggtgcagtggctcacgmctgtaatcccagcactttggggggctgaggcggatggatcacctgaggttaggagttcgagactagcctggccaacatggtgaaacccccgtctctactaaaaatacaaaaattagccaggcgtggtggtacacacctatagttccagctacttgggaagctgaggcaggagaatcacttgaacccgggaggcagaggttgtagtgagccgagatcacaccactgcactccagcctgggcaacagagcaagactctgtctcaaaaacaaacaaacaaacaaaaaaacacaactcacagat

SEQ ID NO: 188552 - DNA, 601 bp, Human
cctgagttctttcagttagctcttgttttgcttgatatttgtgaatatttcagctcttcctttattccaatgtcgcaatatccaaagttatcagaaacctgcatttgagaacacctgtcaaagtcctatagcttactataaaccgtctttcgaaaaggagtaaaacaagaaaacaattgtctgtgaaaaacaaaattcccagggtagttacagttagaaacacagttgacaaagaagtctggttatctctggtttacaataacttaacataacaacctgaattataatttttttttgagayggagttttgctcttgttgcccaggctggagtgcaatggcatgatcttggctcactgcaatctccctctgcctcccagtttcaagcaattctcctgcctcagcctcctgagtagctgggattacaggtgcccaccaccacacctggctaatgttttgtattgttagtagagatggggtttcaccatgttggccaggcaggttttgaactcctgatctcaggtgacccacctaccttgcctcccaaagtgcaaggattacaggcacgagccgttgcgcctggccttaattatgattgatagc

SEQ ID NO: 188553 - DNA, 601 bp, Human
atagcttactataaaccgtctttcgaaaaggagtaaaacaagaaaacaattgtctgtgaaaaacaaaattcccagggtagttacagttagaaacacagttgacaaagaagtctggttatctctggtttacaataacttaacataacaacctgaattataatttttttttgagatggagttttgctcttgttgcccaggctggagtgcaatggcatgatcttggctcactgcaatctccctctgcctcccagtttcaagcaattctcctgcctcagcctcctgagtagctgggattacaggygcccaccaccacacctggctaatgttttgtattgttagtagagatggggtttcaccatgttggccaggcaggttttgaactcctgatctcaggtgacccacctaccttgcctcccaaagtgcaaggattacaggcacgagccgttgcgcctggccttaattatgattgatagcatatactcagacatcagaatttccgagatcccatacaattttggaacatatatcagcattattcaccaaggtataacctaaagaagatcgaacaccattttggcaatctctaaacatgacaaattat

SEQ ID NO: 188554 - DNA, 601 bp, Human
agtcaatatgttcacacacagaattttgcaagattaatttttataatcctttcactacttgtttgaatttttagcttttcttatctaatttaaaacaatcttttaaccctaggcaagaatttacattttcatgccttcttataatctttttttttgagacagagtctcgccctgtcacccaggctggagtgcagtggtgtgatctcggctcactgtaacctctgcctcctggattcaagcaattctcatgcctcagcctcccgagtagctgggattacaggcatgcaccaccacacttggmtaatttttttgtatttctagtagagatggggtttcaccatgttggccaggctagtctcaagctcctgacctcaggtgatccacctgccttggcctcccaaagttctgggattacaggcatgggttaccatgcccagccttcttataatcttttattaaaaatacattttgttgttcttacacaccttgcatataaatctattttcagttgtttcaattacatgttataatggtaactcctggcaattttaactttaatgtaaagcctggtaaattgttttttgtgctaggtgtagccaag

SEQ ID NO: 188555 - DNA, 601 bp, Human
tcatgcctcagcctcccgagtagctgggattacaggcatgcaccaccacacttggctaatttttttgtatttctagtagagatggggtttcaccatgttggccaggctagtctcaagctcctgacctcaggtgatccacctgccttggcctcccaaagttctgggattacaggcatgggttaccatgcccagccttcttataatcttttattaaaaatacattttgttgttcttacacaccttgcatataaatctattttcagttgtttcaattacatgttataatggtaactcctggcamttttaactttaatgtaaagcctggtaaattgttttttgtgctaggtgtagccaaggtttgaatccttccagcataattaagggtgtggttaattccatatgtcccacttaccaattgtgaagtaggcaagtcaaatagttctcaaaacccaaaaggcagtttagaaccttaaaacatttagaaagcctaggccgggtgcagtggctcatgcctgtaatcccagcactttgggaggctgaggcggatggatcacttgagtctaggaattcgagaccagcctgggcaacatggcgaaaccct

SEQ ID NO: 188556 - DNA, 601 bp, Human
gtagctgggattacaggcatgcaccaccacacttggctaatttttttgtatttctagtagagatggggtttcaccatgttggccaggctagtctcaagctcctgacctcaggtgatccacctgccttggcctcccaaagttctgggattacaggcatgggttaccatgcccagccttcttataatcttttattaaaaatacattttgttgttcttacacaccttgcatataaatctattttcagttgtttcaattacatgttataatggtaactcctggcaattttaactttaatgtaaarcctggtaaattgttttttgtgctaggtgtagccaaggtttgaatccttccagcataattaagggtgtggttaattccatatgtcccacttaccaattgtgaagtaggcaagtcaaatagttctcaaaacccaaaaggcagtttagaaccttaaaacatttagaaagcctaggccgggtgcagtggctcatgcctgtaatcccagcactttgggaggctgaggcggatggatcacttgagtctaggaattcgagaccagcctgggcaacatggcgaaaccctgtctctactaaaaacacaa

SEQ ID NO: 188557 - DNA, 601 bp, Human
gggaagcataaacaaactttacctacaccctcctgtaagttcctgttcatctagctgctaccataaacgtcacacggtgatatgtggcaaaattaaccagcaaacaacctcgggatgcggccataccaaagaactgcctcaaactcccctccccaatataaacccctccttctgtaagtttggggctgcttcctctctgactgttaagggggcagccggcaggttaacaaaaacttgcttgcctgactttgagtctatttttcctttctctcgggtaacctcacaccaacctccataatcmtgtgagccaattctgtaaaataaatctttccctatatacatacatcctattgtttcttttttttttctggagaatccttattaatatatccacaaaattacatcagtccactgtccaatctgagagtttcttccaaatccagttaaagtaattttttgaccataaccatgggtatttctcggtgccccaatgacttgtgcccagtgtcggaaaaggctgaacaggttcgacaactgtggttgccatcaagtccccagcacaccttgatcagtgcataaagcctctgatcctccttagaga

SEQ ID NO: 188558 - DNA, 601 bp, Human
cccctccccaatataaacccctccttctgtaagtttggggctgcttcctctctgactgttaagggggcagccggcaggttaacaaaaacttgcttgcctgactttgagtctatttttcctttctctcgggtaacctcacaccaacctccataatcatgtgagccaattctgtaaaataaatctttccctatatacatacatcctattgtttcttttttttttctggagaatccttattaatatatccacaaaattacatcagtccactgtccaatctgagagtttcttccaaatccagttraagtaattttttgaccataaccatgggtatttctcggtgccccaatgacttgtgcccagtgtcggaaaaggctgaacaggttcgacaactgtggttgccatcaagtccccagcacaccttgatcagtgcataaagcctctgatcctccttagagaaggagggacttgggtttctgccctagtcctgttcatcttgacgggggtaagatcttgccaaaacacaaggagacagatgactgcaatgcaagttgtggggtacctccattgctgagaaactcctgctagaccgcagccaaggggt

SEQ ID NO: 188559 - DNA, 601 bp, Human
cctccataatcatgtgagccaattctgtaaaataaatctttccctatatacatacatcctattgtttcttttttttttctggagaatccttattaatatatccacaaaattacatcagtccactgtccaatctgagagtttcttccaaatccagttaaagtaattttttgaccataaccatgggtatttctcggtgccccaatgacttgtgcccagtgtcggaaaaggctgaacaggttcgacaactgtggttgccatcaagtccccagcacaccttgatcagtgcataaagcctctgatyctccttagagaaggagggacttgggtttctgccctagtcctgttcatcttgacgggggtaagatcttgccaaaacacaaggagacagatgactgcaatgcaagttgtggggtacctccattgctgagaaactcctgctagaccgcagccaaggggttttatgttctgcgactcttttctgagggagaataaggcagaaagtccatatctcagaacctgagaggtgatgagaagctgtcttgggacacctctgaggaagatggggaggccagtgaagagtgggaggggcctcccattcttc

SEQ ID NO: 188560 - DNA, 601 bp, Human
gagggacttgggtttctgccctagtcctgttcatcttgacgggggtaagatcttgccaaaacacaaggagacagatgactgcaatgcaagttgtggggtacctccattgctgagaaactcctgctagaccgcagccaaggggttttatgttctgcgactcttttctgagggagaataaggcagaaagtccatatctcagaacctgagaggtgatgagaagctgtcttgggacacctctgaggaagatggggaggccagtgaagagtgggaggggcctcccattcttcggtgttccaggagkatcacagggcaatcagtcttcaaggctcagggaaggctgagtccaagcctttgtttatatggaaggtcttaacggtgctatggcaaagtaacgcagcctggtagaagaaataaagataagacactccaagtcagccagtgttattttgtgtggtggctcacaaaaaaataaaaataaataaacaaataaataaaaacacatgaccatgagacaagcactttcttttcctataaaaattacctttaaaaaaatcacataaatatgagttacgattacatgctaattttgtggctatatacc

SEQ ID NO: 188561 - DNA, 601 bp, Human
tatggaaggtcttaacggtgctatggcaaagtaacgcagcctggtagaagaaataaagataagacactccaagtcagccagtgttattttgtgtggtggctcacaaaaaaataaaaataaataaacaaataaataaaaacacatgaccatgagacaagcactttcttttcctataaaaattacctttaaaaaaatcacataaatatgagttacgattacatgctaattttgtggctatataccacatttaatagaaaatgccatttagaattgaaataacttgcagaagtagtgtatgcayattttagagaaatgagaaaatataaagaaacaaaaagaagaaaatctaaatcttccataatcccaacacccatcacatagcacaatgccttatacccataggttcttaataagcgcttgtgaaatgaatacataaatacacccatatgttgttataagcatatggggaaagcattatctgttttccccatatgtcatctacatatatatgttttttaaaataaaagcataccatatgctctcttttgtaacttgccattttacagaaaagtaaatatgaatatctttttcaataaacaca

SEQ ID NO: 188562 - DNA, 601 bp, Human
cagaaaagttacaaagaaaatagttttgcatgacaaagggcagtccaaaaaacaaaaacagggccacatgtggtggctcacattgtttgtaatatcagcactttgggaggccgaggtgagtggatcacgtgaggtcaggagttcgagaccagcctggccaacatggtgaaaccctgtctctattaaaatacaaaaaaattagccaggcatgatggtgcacacctgtaatcccagctactcaggaggctgaggcaggagaatcgcttcaacctgggaagtggaggttgcagtgagctgacayggtgccactgcactccagcctgagcaacagagtgagactccatctcaaaaaaaaacccaaaaaacaaaaacaattattttttgcaaataagtacatgcagaatatatatcacaaagacataccattttcaactatgatatttgcaaaaacagtctctgcaaatatcatagttgaaagtggtatatcttcatgatacatattctgcatgttcttatttgtaagattggacctattttctgcatagatatactatttatatttctttttttgtaaattccctatttctgtttttatgtctat

SEQ ID NO: 188563 - DNA, 601 bp, Human
aaacagggccacatgtggtggctcacattgtttgtaatatcagcactttgggaggccgaggtgagtggatcacgtgaggtcaggagttcgagaccagcctggccaacatggtgaaaccctgtctctattaaaatacaaaaaaattagccaggcatgatggtgcacacctgtaatcccagctactcaggaggctgaggcaggagaatcgcttcaacctgggaagtggaggttgcagtgagctgacacggtgccactgcactccagcctgagcaacagagtgagactccatctcaaaaaaaaacccaaaaaacaaaaacaattattttttgcaaataagtacatgcagaatatatatcacaaagacataccattttcaactatgatatttgcaaaaacagtctctgcaaatatcatagttgaaagtggtatatcttcatgatacatattctgcatgttcttatttgtaagattggacctattttctgcatagatatactatttatatttctttttttgtaaattccctatttctgtttttatgtctatttttctaacgagtttttgaattgtgtagtcatacatattttcttcttgtattttt

SEQ ID NO: 188564 - DNA, 601 bp, Human
aattagccaggcatgatggtgcacacctgtaatcccagctactcaggaggctgaggcaggagaatcgcttcaacctgggaagtggaggttgcagtgagctgacacggtgccactgcactccagcctgagcaacagagtgagactccatctcaaaaaaaaacccaaaaaacaaaaacaattattttttgcaaataagtacatgcagaatatatatcacaaagacataccattttcaactatgatatttgcaaaaacagtctctgcaaatatcatagttgaaagtggtatatcttcatgatayatattctgcatgttcttatttgtaagattggacctattttctgcatagatatactatttatatttctttttttgtaaattccctatttctgtttttatgtctatttttctaacgagtttttgaattgtgtagtcatacatattttcttcttgtatttttgtagtttcttttaaaatctttatcccacctgggattagtttctgtgtatggtgtgaggtgcacaaggcaggtgcctgaccaaggggtcacatgaggagcaggaatggagcctgcatttgacttgccaggccctgggctttg

SEQ ID NO: 188565 - DNA, 601 bp, Human
cagagtgagactccatctcaaaaaaaaacccaaaaaacaaaaacaattattttttgcaaataagtacatgcagaatatatatcacaaagacataccattttcaactatgatatttgcaaaaacagtctctgcaaatatcatagttgaaagtggtatatcttcatgatacatattctgcatgttcttatttgtaagattggacctattttctgcatagatatactatttatatttctttttttgtaaattccctatttctgtttttatgtctatttttctaacgagtttttgaattgtgtaktcatacatattttcttcttgtatttttgtagtttcttttaaaatctttatcccacctgggattagtttctgtgtatggtgtgaggtgcacaaggcaggtgcctgaccaaggggtcacatgaggagcaggaatggagcctgcatttgacttgccaggccctgggctttggctggggctgcagctgctagcaggcttttttttttttttttttttaattcctatttaaggcactctttaggccagcaatgaccacggatgtgggttctaactatactttctccccaaataatcaactagttg

SEQ ID NO: 188566 - DNA, 601 bp, Human
catgctttttccatctgctaattatttatttacttcctataaggtctttactatttcttgctcattcaaagagctttgattctcaggatgcatgagtttgtgctgctttttggaacgttgttctagcagcttgtcaaaagtgaggaagcactcacatttctgtttactcttccagaaggctgcttactacgagtttgttgctggaagaaaaatagtactccatttcctgtagaaaagagagacagccgatgttttcttcggagggcaaataaataagaataaacccagcctctgctccctyatctaggatctaggaactgatactgttattttctttttttctctctttttaagccattctagtggttaacagtggctttggtttgcatttccttaatgacaaatgatgttgaacatcttttcttgtggttaacagtggctttggtttgcatttccttaatgacaaatgatgttgaacatcttttcttgtgattataggccatttgcatatcttcattggagaaatgtctattcaagttctttgcttatttaattaattaatttatttattttgaggcagagtctcattctgtcactcagg

SEQ ID NO: 188567 - DNA, 601 bp, Human
ttgtgctgctttttggaacgttgttctagcagcttgtcaaaagtgaggaagcactcacatttctgtttactcttccagaaggctgcttactacgagtttgttgctggaagaaaaatagtactccatttcctgtagaaaagagagacagccgatgttttcttcggagggcaaataaataagaataaacccagcctctgctcccttatctaggatctaggaactgatactgttattttctttttttctctctttttaagccattctagtggttaacagtggctttggtttgcatttccttaawgacaaatgatgttgaacatcttttcttgtggttaacagtggctttggtttgcatttccttaatgacaaatgatgttgaacatcttttcttgtgattataggccatttgcatatcttcattggagaaatgtctattcaagttctttgcttatttaattaattaatttatttattttgaggcagagtctcattctgtcactcaggctggagtgcagtggtttgatctcggctcaccgcaacctctgcctcttgggttaaagtgattctcatgcctcagcctcccaagtagctgggactacaa

SEQ ID NO: 188568 - DNA, 601 bp, Human
ttttttttttttttttttttttagatgggagttttactctgttgctcaggctggagcgtattggtgcaatctcagctcactgcagcctccacctcccgggttcaagtgattctcctgcctcagcctcccgagtagctgggactacaagcatgcgccaccacacctgcctaatttttgtatttttagtagagatggggtttcaccatgttggccaggctagtcttgaattcctgacctcaggtaatctgcccacctcggcctcccaaagtgctgggattacaggtgtgagccaccatgcctrgccaaaagtttttaatttttatgaagaactatttatctatttaaaaaaaattcctcatgcatttgttatcaaatctaagaattcattgacatatccagggtcatgaagacttacccttatattttattcagagttttatagttttagctcttctttttagattgttgatccattttgaattaatttttgtatatggagtgaggtaggggtccagcttcattcttttgcatttagttatccagtggtcccagtaccatttgttgaagagactttctttccccattgaatggtctgtgcacc

SEQ ID NO: 188569 - DNA, 601 bp, Human
ctggagcgtattggtgcaatctcagctcactgcagcctccacctcccgggttcaagtgattctcctgcctcagcctcccgagtagctgggactacaagcatgcgccaccacacctgcctaatttttgtatttttagtagagatggggtttcaccatgttggccaggctagtcttgaattcctgacctcaggtaatctgcccacctcggcctcccaaagtgctgggattacaggtgtgagccaccatgcctggccaaaagtttttaatttttatgaagaactatttatctatttaaaaaaaattcctcatgcatttgttatcaaatctaagaattcattgacatatccagggtcatgaagacttacccttatattttattcagagttttatagttttagctcttctttttagattgttgatccattttgaattaatttttgtatatggagtgaggtaggggtccagcttcattcttttgcatttagttatccagtggtcccagtaccatttgttgaagagactttctttccccattgaatggtctgtgcacccttgtcaaaaatcagttgactgtagatgttctagtgtatttctgaattct

SEQ ID NO: 188570 - DNA, 601 bp, Human
tggtgcaatctcagctcactgcagcctccacctcccgggttcaagtgattctcctgcctcagcctcccgagtagctgggactacaagcatgcgccaccacacctgcctaatttttgtatttttagtagagatggggtttcaccatgttggccaggctagtcttgaattcctgacctcaggtaatctgcccacctcggcctcccaaagtgctgggattacaggtgtgagccaccatgcctggccaaaagtttttaatttttatgaagaactatttatctatttaaaaaaaattcctcatgcrtttgttatcaaatctaagaattcattgacatatccagggtcatgaagacttacccttatattttattcagagttttatagttttagctcttctttttagattgttgatccattttgaattaatttttgtatatggagtgaggtaggggtccagcttcattcttttgcatttagttatccagtggtcccagtaccatttgttgaagagactttctttccccattgaatggtctgtgcacccttgtcaaaaatcagttgactgtagatgttctagtgtatttctgaattctcagttgtattc

SEQ ID NO: 188571 - DNA, 601 bp, Human
cacctcggcctcccaaagtgctgggattacaggtgtgagccaccatgcctggccaaaagtttttaatttttatgaagaactatttatctatttaaaaaaaattcctcatgcatttgttatcaaatctaagaattcattgacatatccagggtcatgaagacttacccttatattttattcagagttttatagttttagctcttctttttagattgttgatccattttgaattaatttttgtatatggagtgaggtaggggtccagcttcattcttttgcatttagttatccagtggtcccrgtaccatttgttgaagagactttctttccccattgaatggtctgtgcacccttgtcaaaaatcagttgactgtagatgttctagtgtatttctgaattctcagttgtattccattggtctatatgtctacacttacactagtaacttactgttttgattactgtagctttgcagtaagttttgaaatcagaaaatgggaatgttccaacattgttttcttttttaatattgttttggctatttagggccccttgcagttccatattaattttaggatcaggttttccatttctgcaaaaa

SEQ ID NO: 188572 - DNA, 601 bp, Human
acatatccagggtcatgaagacttacccttatattttattcagagttttatagttttagctcttctttttagattgttgatccattttgaattaatttttgtatatggagtgaggtaggggtccagcttcattcttttgcatttagttatccagtggtcccagtaccatttgttgaagagactttctttccccattgaatggtctgtgcacccttgtcaaaaatcagttgactgtagatgttctagtgtatttctgaattctcagttgtattccattggtctatatgtctacacttacacyagtaacttactgttttgattactgtagctttgcagtaagttttgaaatcagaaaatgggaatgttccaacattgttttcttttttaatattgttttggctatttagggccccttgcagttccatattaattttaggatcaggttttccatttctgcaaaaaggctatggaattttgaaagggaatgcattgaatttgtagtttgccttggggagtactgctgttttaacaatattaagtctcctaatccatgaacatggatgactttccacttatttaggtctttaatttccttcagcag

SEQ ID NO: 188573 - DNA, 601 bp, Human
cagggtcatgaagacttacccttatattttattcagagttttatagttttagctcttctttttagattgttgatccattttgaattaatttttgtatatggagtgaggtaggggtccagcttcattcttttgcatttagttatccagtggtcccagtaccatttgttgaagagactttctttccccattgaatggtctgtgcacccttgtcaaaaatcagttgactgtagatgttctagtgtatttctgaattctcagttgtattccattggtctatatgtctacacttacactagtaacwtactgttttgattactgtagctttgcagtaagttttgaaatcagaaaatgggaatgttccaacattgttttcttttttaatattgttttggctatttagggccccttgcagttccatattaattttaggatcaggttttccatttctgcaaaaaggctatggaattttgaaagggaatgcattgaatttgtagtttgccttggggagtactgctgttttaacaatattaagtctcctaatccatgaacatggatgactttccacttatttaggtctttaatttccttcagcagtgtctag

SEQ ID NO: 188574 - DNA, 601 bp, Human
tagatgttctagtgtatttctgaattctcagttgtattccattggtctatatgtctacacttacactagtaacttactgttttgattactgtagctttgcagtaagttttgaaatcagaaaatgggaatgttccaacattgttttcttttttaatattgttttggctatttagggccccttgcagttccatattaattttaggatcaggttttccatttctgcaaaaaggctatggaattttgaaagggaatgcattgaatttgtagtttgccttggggagtactgctgttttaacaataktaagtctcctaatccatgaacatggatgactttccacttatttaggtctttaatttccttcagcagtgtctagtagttttcagtgttcaaatgtttcacctccttggttaaatgtattcctaggtattttatcttttggatactatcattagtctgtttgggctgccataacaaaataccacagactggatggcttaaacaacaaatttattttctcacagttctgtaggctagaagtgagagatcagggtgccagtggttggtttctgatgagggctgtcttcctggcttgtagttggc

SEQ ID NO: 188575 - DNA, 601 bp, Human
atcagaaaatgggaatgttccaacattgttttcttttttaatattgttttggctatttagggccccttgcagttccatattaattttaggatcaggttttccatttctgcaaaaaggctatggaattttgaaagggaatgcattgaatttgtagtttgccttggggagtactgctgttttaacaatattaagtctcctaatccatgaacatggatgactttccacttatttaggtctttaatttccttcagcagtgtctagtagttttcagtgttcaaatgtttcacctccttggttaaawgtattcctaggtattttatcttttggatactatcattagtctgtttgggctgccataacaaaataccacagactggatggcttaaacaacaaatttattttctcacagttctgtaggctagaagtgagagatcagggtgccagtggttggtttctgatgagggctgtcttcctggcttgtagttggctgccttcttcctgtgccctagagggcaagctctctggtgtctcctattatgaagacactaattctatcagatcagggccccacccttatgaccccatttaaccttagttactt

SEQ ID NO: 188576 - DNA, 601 bp, Human
ctttccacttatttaggtctttaatttccttcagcagtgtctagtagttttcagtgttcaaatgtttcacctccttggttaaatgtattcctaggtattttatcttttggatactatcattagtctgtttgggctgccataacaaaataccacagactggatggcttaaacaacaaatttattttctcacagttctgtaggctagaagtgagagatcagggtgccagtggttggtttctgatgagggctgtcttcctggcttgtagttggctgccttcttcctgtgccctagagggcaagmtctctggtgtctcctattatgaagacactaattctatcagatcagggccccacccttatgaccccatttaaccttagttacttccttagaggccccatcaacaaatgcagcaacacggggtttagggtttcaacataagaatttgaggggagtgcagacattcagtccataacagaggttattgtaaatggaattattttcttaatttcctttcagattgttcttccaggttcttaaaactctagacgagctactgttaacaagtttcctacgtatcctcttccccaccccctttctatg

SEQ ID NO: 188577 - DNA, 601 bp, Human
tagtacacgcttttcaagggcctacgtttgtttccagttagaaggacatagttgttttctcagggatccgtggagtaagtggttcagagcatggcctccagccaggtgtttggagtttgaatcctgactctgctacttaatgataaagtgaccttgagcaacttctttgggcctcagtttcctcatcggcaaaattgtggtaatattaaacctaccccaaacagctgtagtgaggattgaatgagctaatataagtaaaattcttggaacagtgtctggttcatggtcagctctatggaarcacgtgcaattattattgttaatgtcttaaactggaaacaaattaagcctacttttaggacaggtctcctagggaattttttttttttttttttttttttttgagatggagtctcacattgccacccaggctggagtgcagtggcatgatcttggctcactgtaacctcctcctcctcccgggttcaagcgattctcctgcctcagcctcccaagtagctgggattacaggcgcccaccaacatgcccagctaattttttgtatttttagtagagacggcgtttcaccatgttggccagg

SEQ ID NO: 188578 - DNA, 601 bp, Human
attgttaatgtcttaaactggaaacaaattaagcctacttttaggacaggtctcctagggaattttttttttttttttttttttttttgagatggagtctcacattgccacccaggctggagtgcagtggcatgatcttggctcactgtaacctcctcctcctcccgggttcaagcgattctcctgcctcagcctcccaagtagctgggattacaggcgcccaccaacatgcccagctaattttttgtatttttagtagagacggcgtttcaccatgttggccaggttggtctcgaactcytgaccttgtgatttgcccacctcagcctcccaaagtgctgggattacaggcgtgagccactgtgcccggccctcctagggaatttaatagaggaaaatagatgtgtatgtaaagtattttttaaaaagcaacctttaaggaaaaaaacaaaactcactcacaggaaaatgatatggctggggcacttataaatctaaggagtatttacaggaattcagaggctcagcaaggattccctgccttctagaactatctggtcaatgtcaggtgacttactgtttcagaaaacatttctttttg

SEQ ID NO: 188579 - DNA, 601 bp, Human
tgccaaggctgatctcaaactccttagctcaagtgatcctccagccttggcctcccaaagtgctgggattataggggtgagtcaccatgcccggtccagtaatcactttcactagtttcttatgtatccatccagtatttttctatgaaagcaaatacaaatactatatattcttattttagacctcctttcttaggcaaaagatatactttttcacataatctatcttggatatctttctgtattagtacacaaggaatttcttcatccctttttaaggtgacatagtatttcattatgkggatatctcatgctttgtttataaatttgctcgtacttttgtaaatattaacaaatcgtcctccaagtagggatgtgttattttggagtcctaccagcagtatattttccttccaggaaaataggcatattcactgcagtttgcagacgatcagctgttcaaaattagaacacactggcaggtgttcctgggaggtagaaatgggaaacaggtctaaatggatgttaggggtttgtcaagactgtccttccaggaactggcagaatcagccatttgttcaaggtgatgtctgggtatatg

SEQ ID NO: 188580 - DNA, 601 bp, Human
ccatgcccggtccagtaatcactttcactagtttcttatgtatccatccagtatttttctatgaaagcaaatacaaatactatatattcttattttagacctcctttcttaggcaaaagatatactttttcacataatctatcttggatatctttctgtattagtacacaaggaatttcttcatccctttttaaggtgacatagtatttcattatgtggatatctcatgctttgtttataaatttgctcgtacttttgtaaatattaacaaatcgtcctccaagtagggatgtgttattttggagtcctaccagcagtatattttccttccaggaaaataggcatattcactgcagtttgcagacgatcagctgttcaaaattagaacacactggcaggtgttcctgggaggtagaaatgggaaacaggtctaaatggatgttaggggtttgtcaagactgtccttccaggaactggcagaatcagccatttgttcaaggtgatgtctgggtatatgggtgatatattggaggcaattatgttggattggtcctaggagaatccagtttttaacaccaaaactaagatccagtaaagttgg

SEQ ID NO: 188581 - DNA, 601 bp, Human
tgaggtgggcggatcacttgagttcaggggttcgagatcagcttggccaacacggtgaaaccccgtctctactaaaaacacaaaaattagccaggtgtggtggtgggcacctgtaatcccagctacttgggaggctgaggcaggaggatcgtttgaacccaggaggtggaggttgcagtgagccgagatcatgccactgcactccagcctgggcaacagagtgagactccatctcaaaaaagaaaaaaaaaaaaactttttaacttgacatctgccactgagggtaagatttaggttgcakgttttcactgggccaggccacctatgacatgacagctcagatttagaatcggagctaaacattatgtagagccctttgtaatctatttacatttttttctctaaagccagtttcctgaatagatgatatcatatgcatgcatttaaaagctcttttgtgaatctttgagtcagatgactggggaaaaaaagctattctgctaactcatgataagtttggggttctcaaatttttgttttaacatatatatttttaaaatatcattttatgaagcattgtttcctccaagtgattttttaa

SEQ ID NO: 188582 - DNA, 601 bp, Human
ctgggccaggccacctatgacatgacagctcagatttagaatcggagctaaacattatgtagagccctttgtaatctatttacatttttttctctaaagccagtttcctgaatagatgatatcatatgcatgcatttaaaagctcttttgtgaatctttgagtcagatgactggggaaaaaaagctattctgctaactcatgataagtttggggttctcaaatttttgttttaacatatatatttttaaaatatcattttatgaagcattgtttcctccaagtgattttttaacaaccacrtttaagttctgtatatccgattcctactgttgagagagttttacttttggaacaacgtgaagtcccaacaaataggtctattctggttttcatttctttttcagcaacactttcagtttatctttttgcaattttcccttaacataataaaggcagctcctggggtggggtgttgaaggtcattaaagaaaaaatatatattaaaaaaaatttgactgggtgcggtggctcacgcctgtaatcccagcactttgggaggccaaggtgggcggatcatgaggtcaggagatcaagaccatc

SEQ ID NO: 188583 - DNA, 601 bp, Human
aatatgaagtctcttgcccttccacccctattgcatcctccttagcaaccagtactgacagtttgttgtgtattctcccctctttatccaggagcatgcaaatatacatgtggataggtaggattttgtctcctcttaaaattggaccatattgtacttattgctctacagctagccttttaaaaaaatggactcatacccagcttgcttaggaaaggaaataggtttgaggaacagctgggagtgggggcagtccctggacattaatcttgcttatggaaagtatgtttccacccacgtkagcacccttgcctaaccaaggaggaggcctgaccacctaccttgcctaaccagggagggggcctgaccatctaccgcatgactgaggcaagagcctacagcatcagcctcgtgggcctccctgtccctctgacccactgagccaagcagagcatgaaggcttagagcctgagcactccgggaaccctaacttggtcctcctttattcctcagcctctgcagctcccccttatttgacatatggaagattccagagctgtataattccaagataatcagtcaatattcactaagcattcat

SEQ ID NO: 188584 - DNA, 601 bp, Human
attccaagataatcagtcaatattcactaagcattcattatgtaccaggcactgagctaagcacttgaatgatgtgaacgagcctactcagataggcactcttattatccccattttatagaaagggaaactgaggcacacaggagttacccacctagggtccctctgccaggagtggtcagacctgtgatttgaccctagacagtctggttctagatgcccgccatacccacttccactctgctatagcgagattctggtttggggattctaagattctgtcacttgagattttggtgaktctataattctaaattctaggagtatgggatttcccttgactctggatggagggggtggtggacttcagggtgagaagatctcccttaattgaacccccatagaggcttatctttgtgctgttcctctgcgtccctgcagggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtg

SEQ ID NO: 188585 - DNA, 601 bp, Human
tgcagtggcttgatctcagctgactgcaacctctgcctcctgggtgcaagcaattctcctgcctcagcctcccaggtagctgggattacagttgtgcaccaccatgcccagctttttttttctttaaattttagtagagacgggggtttcaccatgttggtcaggctagtctcgaactcctgacctcaaatgatctgcctgcctcggcctctcaaagtactgggattataggcatgagccattgtgtccagccagcaccttctttctttatggttcctatttccagtgctttcatcctgttgggtttctctgtgttgccgtcccctcctccactgaaggtgcgattcttcatcatatcggccctcatcccactgtggattcatgtttagcatggagactgccatgaacctgcatgttttttcctgctaggctagtggcaaattcatttctcccacattttgcatacacccactcatacaccctcccattactggcctctttcctagaaatcgccctcacctgatctcccactctatcttctagacatccaacacgctgacatgggccctgtaccacctctcaaaggaccctgagatccagg

SEQ ID NO: 188586 - DNA, 601 bp, Human
gtgttgccgtcccctcctccactgaaggtgcgattcttcatcatatcggccctcatcccactgtggattcatgtttagcatggagactgccatgaacctgcatgttttttcctgctaggctagtggcaaattcatttctcccacattttgcatacacccactcatacaccctcccattactggcctctttcctagaaatcgccctcacctgatctcccactctatcttctagacatccaacacgctgacatgggccctgtaccacctctcaaaggaccctgagatccaggaggccttgcatgaggaagtggtgggtgtggtgccagccgggcaagtgccccagcacaaggactttgcccacatgccgttgctcaaagctgtgcttaaggagactctgcggtaggacagaatgctgttctggggggcacaggatctctttgtggggagggaatcagaggaggaaatctgaagtgaagacaggtgggctggggctagtgacaaggatgagatgggagaggtaggggagaaggagtggggcactttgtacccccatgaatccagagcagactccagacattcttttccctgcagtctctaccct

SEQ ID NO: 188587 - DNA, 601 bp, Human
ataataatgtagtaatcattagctaacatttattgaacactttctatgtgtcaggcactggtaggcagtttacgtggatggtctcatttgatctgtgcaacaaccctgtgcggtaggtgttgtgatgacagccattttccagatgagaagaggccagctgtgtgaaaggctgagttgctgcctaaacctatagcccgtgtcccctgggtcccctgctgtgcctgctttcccccgccaagtgtcagagtgtcagtctctggacaatcctttgaacgtcctagcctgggaggggagcccatcycagagggagggtgaaatgatctggtctctttttgcagagcacaagcgggagatttacgaccgctatggccgggaagggctgacagggacaggtaggtggagtggtgaggcccaggaatggaggtggggcagggaggagaggggcagggcagattcttgcaatggaggctctctcaggctcctggctgtgccttaggtgaggtcccccggctcagggcaggatgcatgccctaagctctctcctcatcctgcctttccaggaactggcccatctcgggcagaagctggcagtggtgggcct

SEQ ID NO: 188588 - DNA, 601 bp, Human
tcccctgctgtgcctgctttcccccgccaagtgtcagagtgtcagtctctggacaatcctttgaacgtcctagcctgggaggggagcccatcccagagggagggtgaaatgatctggtctctttttgcagagcacaagcgggagatttacgaccgctatggccgggaagggctgacagggacaggtaggtggagtggtgaggcccaggaatggaggtggggcagggaggagaggggcagggcagattcttgcaatggaggctctctcaggctcctggctgtgccttaggtgaggtcccccggctcagggcaggatgcatgccctaagctctctcctcatcctgcctttccaggaactggcccatctcgggcagaagctggcagtggtgggcctggcttcaccttcaccttccgcagccccgaggaggtcttccgggaattctttgggagtggagacccttttgcagagctctttggtgagtggactctggaagcctctgaatggctcaacttccccctccaggcctgtccttccatcagctgggaggccctgaggtggaaggctgagaggggacgggaatgccacggacagaagattttgt

SEQ ID NO: 188589 - DNA, 601 bp, Human
cagtctctggacaatcctttgaacgtcctagcctgggaggggagcccatcccagagggagggtgaaatgatctggtctctttttgcagagcacaagcgggagatttacgaccgctatggccgggaagggctgacagggacaggtaggtggagtggtgaggcccaggaatggaggtggggcagggaggagaggggcagggcagattcttgcaatggaggctctctcaggctcctggctgtgccttaggtgaggtcccccggctcagggcaggatgcatgccctaagctctctcctcatcctrcctttccaggaactggcccatctcgggcagaagctggcagtggtgggcctggcttcaccttcaccttccgcagccccgaggaggtcttccgggaattctttgggagtggagacccttttgcagagctctttggtgagtggactctggaagcctctgaatggctcaacttccccctccaggcctgtccttccatcagctgggaggccctgaggtggaaggctgagaggggacgggaatgccacggacagaagattttgtggagctgggtccagtgagagccgggacagaacctcacgtgtg

SEQ ID NO: 188590 - DNA, 601 bp, Human
aatggctcaacttccccctccaggcctgtccttccatcagctgggaggccctgaggtggaaggctgagaggggacgggaatgccacggacagaagattttgtggagctgggtccagtgagagccgggacagaacctcacgtgtgccagaacccccgtaatccaacagtgacacttcacagactcaccttattaaattacaacaataatacattgttagacttctatagtaacagccatgaaagcaagactcaaagcatcttgtgacaatattgttattattacctataaaacagatagtgktattttttaatgatagatatgtgccaaatattttacatttcgtaagtctctagtgaaccctgacaggtgggcaattttctccccatttgcagatgagaaaactgaggcacagttaatagcccagagtcacataacacatggcagagctggactcctagctgtgtctgcctgtcatcgcgtcatgatgatttgcctgtactgaaagagccatctgtcctccatccctcttccccctccttccttcctttattctttattgtggacagaattaaccagtgagtgttttcgaattcaacatta

SEQ ID NO: 188591 - DNA, 601 bp, Human
gaaggctgagaggggacgggaatgccacggacagaagattttgtggagctgggtccagtgagagccgggacagaacctcacgtgtgccagaacccccgtaatccaacagtgacacttcacagactcaccttattaaattacaacaataatacattgttagacttctatagtaacagccatgaaagcaagactcaaagcatcttgtgacaatattgttattattacctataaaacagatagtggtattttttaatgatagatatgtgccaaatattttacatttcgtaagtctctagtgaaycctgacaggtgggcaattttctccccatttgcagatgagaaaactgaggcacagttaatagcccagagtcacataacacatggcagagctggactcctagctgtgtctgcctgtcatcgcgtcatgatgatttgcctgtactgaaagagccatctgtcctccatccctcttccccctccttccttcctttattctttattgtggacagaattaaccagtgagtgttttcgaattcaacattaaaaaggaatttataaataagcccaactaaaaagcggaaaagaaaaaccctacccagtt

SEQ ID NO: 188592 - DNA, 601 bp, Human
gtctccgtgtcttggtggtagtagtcccccaggcccagctgttttctctttatctctttgtcttgtgtctttatttcttacaatctctgtttcccccttcgaggagaacacccgcaaagcccagtagggctggactctacagtcgtaccttatcagcagtgtgttacccccaggccagatgactaaggaaatctgtaaccacgactttcaggttaacagcatagtgctaagtgaaaaaagaaaaatgttaaaactgcaactgtttccaagcttattcttagacggccatcttccttctttyggaatctttctggtactagtactttttttctctacaagtgtatctcctcacatatgtttagggaaaccagaatcccaaggatgtgagtgttttgacagggtcaaaactgatttggtgctttttaactaaaatctttggttatgggggtttttggttttttgttgttgttggtttaagatcttaagcacagttacattctgggctatagtaacatctagattaccatgtaactatttgcttagacattaaaatattcaggaatgaaagaactcccattcgaacatatgccaatgaaatgtg

SEQ ID NO: 188593 - DNA, 601 bp, Human
tctctttatctctttgtcttgtgtctttatttcttacaatctctgtttcccccttcgaggagaacacccgcaaagcccagtagggctggactctacagtcgtaccttatcagcagtgtgttacccccaggccagatgactaaggaaatctgtaaccacgactttcaggttaacagcatagtgctaagtgaaaaaagaaaaatgttaaaactgcaactgtttccaagcttattcttagacggccatcttccttcttttggaatctttctggtactagtactttttttctctacaagtgtatytcctcacatatgtttagggaaaccagaatcccaaggatgtgagtgttttgacagggtcaaaactgatttggtgctttttaactaaaatctttggttatgggggtttttggttttttgttgttgttggtttaagatcttaagcacagttacattctgggctatagtaacatctagattaccatgtaactatttgcttagacattaaaatattcaggaatgaaagaactcccattcgaacatatgccaatgaaatgtgtggaaagattacatttagttaagtacatttaacttggggcaagt

SEQ ID NO: 188594 - DNA, 601 bp, Human
tctttgtcttgtgtctttatttcttacaatctctgtttcccccttcgaggagaacacccgcaaagcccagtagggctggactctacagtcgtaccttatcagcagtgtgttacccccaggccagatgactaaggaaatctgtaaccacgactttcaggttaacagcatagtgctaagtgaaaaaagaaaaatgttaaaactgcaactgtttccaagcttattcttagacggccatcttccttcttttggaatctttctggtactagtactttttttctctacaagtgtatctcctcacatrtgtttagggaaaccagaatcccaaggatgtgagtgttttgacagggtcaaaactgatttggtgctttttaactaaaatctttggttatgggggtttttggttttttgttgttgttggtttaagatcttaagcacagttacattctgggctatagtaacatctagattaccatgtaactatttgcttagacattaaaatattcaggaatgaaagaactcccattcgaacatatgccaatgaaatgtgtggaaagattacatttagttaagtacatttaacttggggcaagtgcagccagat

SEQ ID NO: 188595 - DNA, 601 bp, Human
tgtttcccccttcgaggagaacacccgcaaagcccagtagggctggactctacagtcgtaccttatcagcagtgtgttacccccaggccagatgactaaggaaatctgtaaccacgactttcaggttaacagcatagtgctaagtgaaaaaagaaaaatgttaaaactgcaactgtttccaagcttattcttagacggccatcttccttcttttggaatctttctggtactagtactttttttctctacaagtgtatctcctcacatatgtttagggaaaccagaatcccaaggatgtgartgttttgacagggtcaaaactgatttggtgctttttaactaaaatctttggttatgggggtttttggttttttgttgttgttggtttaagatcttaagcacagttacattctgggctatagtaacatctagattaccatgtaactatttgcttagacattaaaatattcaggaatgaaagaactcccattcgaacatatgccaatgaaatgtgtggaaagattacatttagttaagtacatttaacttggggcaagtgcagccagatggtcccctctatgagtgtaggagcccgttaagt

SEQ ID NO: 188596 - DNA, 601 bp, Human
ttatcagcagtgtgttacccccaggccagatgactaaggaaatctgtaaccacgactttcaggttaacagcatagtgctaagtgaaaaaagaaaaatgttaaaactgcaactgtttccaagcttattcttagacggccatcttccttcttttggaatctttctggtactagtactttttttctctacaagtgtatctcctcacatatgtttagggaaaccagaatcccaaggatgtgagtgttttgacagggtcaaaactgatttggtgctttttaactaaaatctttggttatgggggtwtttggttttttgttgttgttggtttaagatcttaagcacagttacattctgggctatagtaacatctagattaccatgtaactatttgcttagacattaaaatattcaggaatgaaagaactcccattcgaacatatgccaatgaaatgtgtggaaagattacatttagttaagtacatttaacttggggcaagtgcagccagatggtcccctctatgagtgtaggagcccgttaagtttaatatgatctgaaacaactataggtgagaatttttgcatgagaaatattttattccgacc

SEQ ID NO: 188597 - DNA, 601 bp, Human
atgttggccagactggtctcaaactcctgacctttggcctcccaaagcgctagtattataggcgcaagccattgtgcctggccaaaatttatttttgagaggccggacacagtggctcagttctagcttgttgttgttgttgaggattttgtcatctgtttggctttatcttactgctgcttaatttgtattgtattgcaggtgggaacattctccatggccagtgaggaagtcttgaagaatagagccataaagaaagcaaagcgcagaaatgttggatttgaagtgagtgcccccttamagctcttgctattaaatactcatttgatttctgggttgcacagcaatccctccgctgggagcaatgatatcaacaaatgctttcttaaaatacttattctttgatgtaggtcatgggagatagaaaaaaataagaaacgtcaggtctggaccttaaagagagcttatccagttgaggaaataagataaatatagacaaattcaagttgagtgacaatctggagaagaaaaatgagcaaagcaatacagaggtgggcgaagtggcatcagattggaggaagaaaggaaaacgcaaggatct

SEQ ID NO: 188598 - DNA, 601 bp, Human
gatgtaggtcatgggagatagaaaaaaataagaaacgtcaggtctggaccttaaagagagcttatccagttgaggaaataagataaatatagacaaattcaagttgagtgacaatctggagaagaaaaatgagcaaagcaatacagaggtgggcgaagtggcatcagattggaggaagaaaggaaaacgcaaggatcttctgagagtcttgtctgctccctgcgattgaggccttggtagggggagccctttcactatactagaggcattttaggtgtggattttttgctagtatagtatrttaaaatgattcattcctgtgctaagaaggatggaagatgagttgtaactcctaaattgaaataatgtgctgattattaagcagtcactccgcatctaagaactcgtccccagtacatcctctcccttcagatacattctagacccaggagagtgtggtcttggtggcctggacatctggtgttaggcaggagatgccgctttgaatatcctgggtggcagctttgaaataaacctaccctacctcacgttttgcagtgtttaaaacatcaagaatagactatattcttgggtgtctcta

SEQ ID NO: 188599 - DNA, 601 bp, Human
attctagacccaggagagtgtggtcttggtggcctggacatctggtgttaggcaggagatgccgctttgaatatcctgggtggcagctttgaaataaacctaccctacctcacgttttgcagtgtttaaaacatcaagaatagactatattcttgggtgtctctaatctggaaatccaaaatgctccaagatctgaagctttttgagcaccaacgtgatgctccaaggaaatagtcattggaggatctcaaatggtcaggttagaggtgccgtgccagtaagcataatgcagacttcctgrgagcggaaatacttactttcctgagcgttctccttaagggacatgcaagcttatttcccttttatttccaaaaaaaaaggataggaaaggtgtatcattcacactttgagaagcaatgaaaagaaattgttattacaaaaatattcattacattgccaaagttttgatcataaaatgtattaaagtttgaaaacgtaaggaagggagccaggtaggtggcagtggtggggaggcagtcagtaagacgtttacaacagccagtcactcagagcgtctcataaatggtggtatgtgttaatg

SEQ ID NO: 188600 - DNA, 601 bp, Human
ggtggcagctttgaaataaacctaccctacctcacgttttgcagtgtttaaaacatcaagaatagactatattcttgggtgtctctaatctggaaatccaaaatgctccaagatctgaagctttttgagcaccaacgtgatgctccaaggaaatagtcattggaggatctcaaatggtcaggttagaggtgccgtgccagtaagcataatgcagacttcctgggagcggaaatacttactttcctgagcgttctccttaagggacatgcaagcttatttcccttttatttccaaaaaaaaaggataggaaaggtgtatcattcacactttgagaagcaatgaaaagaaattgttattacaaaaatattcattacattgccaaagttttgatcataaaatgtattaaagtttgaaaacgtaaggaagggagccaggtaggtggcagtggtggggaggcagtcagtaagacgtttacaacagccagtcactcagagcgtctcataaatggtggtatgtgttaatgggaaaacaattcaaattataaaaataaagtattcgcaattttcctaaaatatattactgtatataccaatatagtgta

SEQ ID NO: 188601 - DNA, 601 bp, Human
gtcctacgaggagtgagaaacaaagctcactgcagaagccaagggaagccattctgaaggaggggcagtcacctgtgcaaccgaaggaagttcaagaggtagaaatagtacagaccataatctacaacttaagctgaagggatgagggaaggagagggcaggagcccttgggcaactaagggaaattaagtgtaggtggataatagaaatccacagataattttagctgtaactcttagcctgaagttttcatatattaggacaattaaatgtcatgtcacccaccagaatgctgaaatgyggcttttcctaaatagtggattcagtagatctgctaagcactggagatgtattggtgagtaaaaaagaccaaaatcatcttgccctatggaagagaacaaatacatagtattaatttttcctctgtaagtgccatggggaacagtaaaaccaatgagggaaattgagggatgtggggctgtgtcagtgcccatggaggagcccacatgggtattttccctttttttttttttttgagacagggtctttgtcgcccaggctggagtgcggtggcacaatcttgactctctgcaaccgccgc

SEQ ID NO: 188602 - DNA, 601 bp, Human
actctcatttttctgaatatcttttttttgtttaacttgtggttcttgaatttttgttgtgattctagagccaatttactatcagcaatttctaaaatccctacaagtgacttttaactttgtgcaaaatcggaggctctgaaaagccacttaatggctttatagtttgtccatgaatcattgttttaaaatgacagctatcagtgtggtgggtttggaattttaaatgatgaaaaatcaaatgtagagcaacagaatctaagctctgtttattatgtgcattaaaactcatacaagttamaattttccattctttgcctcattttattgccttaaatatatcagtggtcagtaaacatctgaaattctgtagatgagattgaaactttggttttggaaaaacatgcagtaatatttaggctgactggcccatttagtaaatgaaggggttccagtttaatttttttttttttctggtgaaatcatggttataattcactcatgtggaaacttaagatttgtgaactgtctcttagatgttcggtctaagaagcagatcacttcctataatgtaatcacttctttgaacaacaacaaaaaa

SEQ ID NO: 188603 - DNA, 601 bp, Human
gggaaaaggcctactagaaaaaccttgttaaaacaatcgagtttaaggaagcagtgaggaaaaggagagtaagaagttgtcccgggttgttcagctaacaggaacatgtagatttgagactcgatcatctaagtttttgtaggctgaaagcagttgcaagccacagatgttaagaaattaggcaaatggatatttttagttaacctaccttgatgtttttatcatttctttaggcagtaaatggtctttgactgagtagtacatgaagtatctttcatttgggatttagttttattgagcygcttcagtaattctgaggctgggtggtgggtacataggtttattgcattagtctttcttaccttttatgtcctaaaaatacacataatatattttttaaatgtccttcctgcctgtttcaggaaagcagctttgggttgcaaagctgttcttatgaatacaatcttcccatctcatttcttatttctgcttgtgccagcagtttgccttataacgctgactgcatgtggagtctaggtgctgtttagccaagatgctgttgtcactcacttgctttttggtaatagaaagtacacttacc

SEQ ID NO: 188604 - DNA, 601 bp, Human
tcccgagtagctgggactacaggcatgcaccaccatgcccagctaatttttgtaattttagtagagacggggtttcaccatgttggccaggatggtcttgatctcttgaccttgtgatccacctgccttggcctcccaaagtgctgggattacatccgcgagccactgtgcccggcctctgttaagatttttaactacagccatcccctagtatcctggggattggtttcagcacccccttggatgttcaagtcccatagtcagaccagcataactcttagataggaaaagtgagtgttcstatccactggtttctcatccccagagtactgcattgagacagggtctcgctctgtcacctaggctggagtgtattggtgtggtcttggctcactgcagccacaacctcctgagctcaagtgatcctcccccatcagcctccccagtagctgggattataggtacacaccaccacactcagctaatttttacattttttgtagagatggggttttgccatgttgcccaggctggtctcaaactcctgagctcaagcgatttgcccacctcagcctcccaaagtgttgggattacatgcgtg

SEQ ID NO: 188605 - DNA, 601 bp, Human
ggctggagtgtattggtgtggtcttggctcactgcagccacaacctcctgagctcaagtgatcctcccccatcagcctccccagtagctgggattataggtacacaccaccacactcagctaatttttacattttttgtagagatggggttttgccatgttgcccaggctggtctcaaactcctgagctcaagcgatttgcccacctcagcctcccaaagtgttgggattacatgcgtgagccaccacacctggctgaggactgcatttcacaggtgtagaacctgcaggtacagaggggmgactgtactttaatactgttcatcccaacaaccttggggattaagtgttaatgctgacctgctgttctaacagtgctgtttgaaataggcatccttttgtctactgccacaccaccctcgacgcgcccgatcacatctcagataggcgtccttttgaaggaaaagattatttttaaaatgtgtagagcaagcatatggtggttagtgttcttgtataaactttgacttgatctttattcatcggctttactgataactggttactaaattctactccttgaacacatactttttgagcgg

SEQ ID NO: 188606 - DNA, 601 bp, Human
ctgaaatattacggttttctatcaggagtctagacttccattactgttttgccttgccctgctttcaagtatatcctcaggcacgggccctctgggcacagggtgaaataagggtctccccttttctttcttctctgcctcccataaataaaacaaatggggagtctttcctgaggcaggcactggggatttgaatcgagtcccagtggaggcaggatgcccctcagtgagcgcctgttccttgtcccttggttatcacagtttaagcatcagaagactcgggagattggagggataagayggacagtcgtgtgacctaatcatctgagcatcacagttgtttttcttagaattgctttttggtgagtttttatgcaactgccgttctctttaagaggatccttttatatatgtggggttttttatttttttgagacagggtctcgttctgtcacccaggctagtagtgcagtgacgcaatcatagctcactacagcctctacctcctggggtgaagcaatcctcccacttcagtctgccaagtagctgggtccacaggcatgtaccgccacacctggttaacttttttattttttgtaga

SEQ ID NO: 188607 - DNA, 601 bp, Human
tttaagcatcagaagactcgggagattggagggataagacggacagtcgtgtgacctaatcatctgagcatcacagttgtttttcttagaattgctttttggtgagtttttatgcaactgccgttctctttaagaggatccttttatatatgtggggttttttatttttttgagacagggtctcgttctgtcacccaggctagtagtgcagtgacgcaatcatagctcactacagcctctacctcctggggtgaagcaatcctcccacttcagtctgccaagtagctgggtccacaggcaygtaccgccacacctggttaacttttttattttttgtagagatggggggcgtctcaccatgttgaccagactggtgttgaactcctgggctcaagcgatcttcctgccttggccctgcagcgtgctgggattacaggcgtgagccactgtacacagcctaatacatgtgtttaaatgatggcctaggtctcccgtgtttgggagaccccgttagtggggatacctttggtaccagagcagtgacccatgtggcaattcagacaaagcttaaattacttacactggggctttggaatgattt

SEQ ID NO: 188608 - DNA, 601 bp, Human
aaatgatggcctaggtctcccgtgtttgggagaccccgttagtggggatacctttggtaccagagcagtgacccatgtggcaattcagacaaagcttaaattacttacactggggctttggaatgatttttctgacaacttgtcccctgttaaaaaaaaaaaaagtatttttctatctttggctattactgatacttgtagatgtagtcacaggaatattcaggggtgaaggtgttaaaaactcatccgagatggaattttccagtgggtaatttgcatatagagtgttgattttttttttctgtcataagcatggagatttttccattttaaggttttctatatattggaagttattttagaattaagaggtatgttcccattaaaagggattcttatttttcacaaaatagttaaaatcctgcaggtactcccttctggcatcccccccccccattaagtgtgcattttagtctgtcagtttacatggagtgctccggtggaggtttagggtgttacgtaacaaaacttcagtcacttctttaagctctggattggaatcttactgaattattgtcatttttataaaaggtggagatga

SEQ ID NO: 188609 - DNA, 601 bp, Human
tacgtaacaaaacttcagtcacttctttaagctctggattggaatcttactgaattattgtcatttttataaaaggtggagatgaagaagagaatgatgagccacccaaagtagtagttaccgaagtaaaagaagaagatgctttttactccaaaaagtaagaatccccacaacctgctggcgcatgtgttttgcaggcatggtggcatgcttcaggctggagaatgtcctcacggcacttgactgagcttccagtctcggggtcaagctttgcctgctctcaagtaacaggaagaattcttggccagttattaaatccagttctagaaatgtcctggtgggcaggtctcactcttttctgtcactttagctcttttaaagtgctttagagacaggatcttccatgatcttcccaaccccatcccatcccatcccattccatcccgtcttctctccctgtgtctttctccctccccttcctcctccccaacaaagaaatcgcagagtcagtcagtgatttcaggtttggcctcagaaggcatctctcatcccttcctggagacttggttggcctttctggattttctcatagtcaaaaagt

SEQ ID NO: 188610 - DNA, 601 bp, Human
atgctttttactccaaaaagtaagaatccccacaacctgctggcgcatgtgttttgcaggcatggtggcatgcttcaggctggagaatgtcctcacggcacttgactgagcttccagtctcggggtcaagctttgcctgctctcaagtaacaggaagaattcttggccagttattaaatccagttctagaaatgtcctggtgggcaggtctcactcttttctgtcactttagctcttttaaagtgctttagagacaggatcttccatgatcttcccaaccccatcccatcccatcccattmcatcccgtcttctctccctgtgtctttctccctccccttcctcctccccaacaaagaaatcgcagagtcagtcagtgatttcaggtttggcctcagaaggcatctctcatcccttcctggagacttggttggcctttctggattttctcatagtcaaaaagttaagcacagtaaccgtcccttcctgttgaggacttataaaaactttcatcttcctttcaattaaatgagattagtttttacaaagatatttgctgaaaaaacatttgtgccatttcagaagctttcaaagatgtgttt

SEQ ID NO: 188611 - DNA, 601 bp, Human
tttgctcaggctctgtttggatcaattaaagatttatcctgaagcttcctgtactcatttaatagagattttccacacaagtgtgaagagtggttgttagaaaactgtgtgacttgattcgtccttgaatgcttgatggtccctattatttttctccataggtgtaaactgttttacaagaaagacaatgagtttaaagagaaaggcataggtactctgcatttaaaacctacagcaaatcagaagacacagcttttggtgcgggcagacaccaatttaggtgggtaccttttttcagttrgcacaaaatcatcatcacatagtatataaaagcgtttaccctgctgactcaaggttattaatatgtttttaaacagagcgcattcaggccaaattcatcctgtatttacttatttatagttttgagtcccaggataatagtgtgtaaggaaacataaatgtgttagaagctgtaaacaaaatgatttttcattttcctttgtgttagaaatgtgactaagaagctagagattagaccatttaatgaacacccaagggaaattaaccttttaaaggaatcctttttatatagcaagtaatg

SEQ ID NO: 188612 - DNA, 601 bp, Human
agactcctttggtggagctatagcttctataattttgatgggttttgtttgtttgaatgcaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagttkttttgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagcgtatcaatttgctttcccaaaggctcttccaacc

SEQ ID NO: 188613 - DNA, 601 bp, Human
gactcctttggtggagctatagcttctataattttgatgggttttgtttgtttgaatgcaggcaacatattgctgaacgttctgattccacccaatatgccatgtacgcgaacagggaagaataacgttcttatcgtctgtgttccaaatccaccaattgacgagaagaatgccaccatgccagtcaccatgttgattcgggtaaaaaccagcgaggatgcagacgagttgcacaaaattttactggagaaaaaggatgcctgaacacgcaaagtcggctgcagaattattgccaagtttytttgctgcttccaccgccccttaaagttagtcagtttttcttctcttctttgacattctaagaacttatagataacttaaaacttttgtgaggaagattaatgtggccaataaaacctttaaatgttaagtgtcaagaaactgcactctcccttcttaagaactgcctaaagtgtaaaatacatttgaatgcaatttttggaagattttttaatgttcgtttattaaactaaccctaagtgatttcttcaaggactgcaatcagcgtatcaatttgctttcccaaaggctcttccaaccc

SEQ ID NO: 188614 - DNA, 601 bp, Human
tgcagctgtgggcaagtcagttttctcttttaaaaaaggggggacagttgtgggggagcaaaggagatgatgtgactaaagagctttgcgagtggaaacacggaccacctacagaccccaaaaatgccaatgagccggcgcagagtgaagcgttccaccagccggtttttcagcttctgcagcagccaacatctggatcgaccgtttttattcttctctccctacattgactccagctctctgaaaattctgagaccgtgtaagcttagaataaataatgagaagccgggcgcggtggctmacgcctgtaatcccagcactttgggaggccgaggtgggtggatcacctgagatcaggagttcgagaccagcctggccaacatggtgaaaccccgtctctactaaaaatacaaaaaaaattagctgggcgtggtggcatgcgcctgtaatcccagctacttgggaggctgaggccagagaatcgcttgaacctgggaggcggaggctgcagtgagctgagatcgcgccactgcatttcagtctgggcaacaacagcgaaactctaactcaaaaaaaaaaaaaaaaaggaataaatgatgag

SEQ ID NO: 188615 - DNA, 601 bp, Human
cagccaacatctggatcgaccgtttttattcttctctccctacattgactccagctctctgaaaattctgagaccgtgtaagcttagaataaataatgagaagccgggcgcggtggctcacgcctgtaatcccagcactttgggaggccgaggtgggtggatcacctgagatcaggagttcgagaccagcctggccaacatggtgaaaccccgtctctactaaaaatacaaaaaaaattagctgggcgtggtggcatgcgcctgtaatcccagctacttgggaggctgaggccagagaatygcttgaacctgggaggcggaggctgcagtgagctgagatcgcgccactgcatttcagtctgggcaacaacagcgaaactctaactcaaaaaaaaaaaaaaaaaggaataaatgatgagattaggtcatgctgatcatcatcataaaaataatagtgaaaaccccagaatgcccgtgtggagcacctactttctgtgtaccgtctgcacggacagcagccagcctggccccgggaaggacaagggctggggaggtggaccaacctggttgggtttcaggctgggtgacctgagccagctca

SEQ ID NO: 188616 - DNA, 601 bp, Human
ccgggcgcggtggctcacgcctgtaatcccagcactttgggaggccgaggtgggtggatcacctgagatcaggagttcgagaccagcctggccaacatggtgaaaccccgtctctactaaaaatacaaaaaaaattagctgggcgtggtggcatgcgcctgtaatcccagctacttgggaggctgaggccagagaatcgcttgaacctgggaggcggaggctgcagtgagctgagatcgcgccactgcatttcagtctgggcaacaacagcgaaactctaactcaaaaaaaaaaaaaaaaaggaataaatgatgagattaggtcatgctgatcatcatcataaaaataatagtgaaaaccccagaatgcccgtgtggagcacctactttctgtgtaccgtctgcacggacagcagccagcctggccccgggaaggacaagggctggggaggtggaccaacctggttgggtttcaggctgggtgacctgagccagctcaaaggcaccatgatacctcctttctggggttgttataatgatcagagatcacccgggcgcggtggctcacccctgtaatcccagcactttgggagaccaaggcg

SEQ ID NO: 188617 - DNA, 601 bp, Human
aaaatacaaaaaaaattagctgggcgtggtggcatgcgcctgtaatcccagctacttgggaggctgaggccagagaatcgcttgaacctgggaggcggaggctgcagtgagctgagatcgcgccactgcatttcagtctgggcaacaacagcgaaactctaactcaaaaaaaaaaaaaaaaaggaataaatgatgagattaggtcatgctgatcatcatcataaaaataatagtgaaaaccccagaatgcccgtgtggagcacctactttctgtgtaccgtctgcacggacagcagccagyctggccccgggaaggacaagggctggggaggtggaccaacctggttgggtttcaggctgggtgacctgagccagctcaaaggcaccatgatacctcctttctggggttgttataatgatcagagatcacccgggcgcggtggctcacccctgtaatcccagcactttgggagaccaaggcgggtggatcacctgatgtcaggagttccagaccagcctgaccaacgtggtgaaaccccgtctctactaaaaatataaaaattagctggctgtggtggcgggcgtctgtaatcccagctac

SEQ ID NO: 188618 - DNA, 601 bp, Human
tctgtgtaccgtctgcacggacagcagccagcctggccccgggaaggacaagggctggggaggtggaccaacctggttgggtttcaggctgggtgacctgagccagctcaaaggcaccatgatacctcctttctggggttgttataatgatcagagatcacccgggcgcggtggctcacccctgtaatcccagcactttgggagaccaaggcgggtggatcacctgatgtcaggagttccagaccagcctgaccaacgtggtgaaaccccgtctctactaaaaatataaaaattagctggytgtggtggcgggcgtctgtaatcccagctactcgggaggctgagacaagagaatcgcttgaacccgggaagcggaggttgcagtgagctgagaccgttcattgtactccagcctaggtgacagagtgagactccgtgcccccaccatcaaaagaaaaaaatcagagatcacctatgaaatcagcaccacaaagccagactgtggcaacgtattggttttctaggactgccagagcagagtataaggggcagggtggctcaaccaccggttcctcatagttccggaggccagaagtctgag

SEQ ID NO: 188619 - DNA, 601 bp, Human
gggtttcaggctgggtgacctgagccagctcaaaggcaccatgatacctcctttctggggttgttataatgatcagagatcacccgggcgcggtggctcacccctgtaatcccagcactttgggagaccaaggcgggtggatcacctgatgtcaggagttccagaccagcctgaccaacgtggtgaaaccccgtctctactaaaaatataaaaattagctggctgtggtggcgggcgtctgtaatcccagctactcgggaggctgagacaagagaatcgcttgaacccgggaagcggaggytgcagtgagctgagaccgttcattgtactccagcctaggtgacagagtgagactccgtgcccccaccatcaaaagaaaaaaatcagagatcacctatgaaatcagcaccacaaagccagactgtggcaacgtattggttttctaggactgccagagcagagtataaggggcagggtggctcaaccaccggttcctcatagttccggaggccagaagtctgagaccgaggtgtcagcagggtgggctccttctgaggctcctctcctgggcctgtagatgccctcttctccctgtgtcctc

SEQ ID NO: 188620 - DNA, 601 bp, Human
agaaaaaaatcagagatcacctatgaaatcagcaccacaaagccagactgtggcaacgtattggttttctaggactgccagagcagagtataaggggcagggtggctcaaccaccggttcctcatagttccggaggccagaagtctgagaccgaggtgtcagcagggtgggctccttctgaggctcctctcctgggcctgtagatgccctcttctccctgtgtcctcacacggccctccctctgtatgtgtctgtgtcctgctcaccgcttcctcgaaggacaccagtcctttggattacagcctgccctaacaacctcatttaactatgtcacccatttaaagtcactgtctccaaatagagtcccattctgagatactgggggttaggacttcaccagatagattttgggaagacacaatttagcccataatagggagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttct

SEQ ID NO: 188621 - DNA, 601 bp, Human
catttaactatgtcacccatttaaagtcactgtctccaaatagagtcccattctgagatactgggggttaggacttcaccagatagattttgggaagacacaatttagcccataatagggagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttctactcactaatgtctttgrtaaattttggagttatcttttttctttattttttgaaactgagtcttgctctgttgcccaggctggggtgcagtatgttgatcttggctcactgcaacctccgcctcctagattcaggcgattctcctgcctcagcctctcgagtacctgagattacaggcacacactaccacaccaggctaatttttgtatttttagtagagacagagtttcaccgtgttggccaggctggtctcgaactcctgacctcaggtgatcctcctgccttggcctcctaaagtgctgggattatgggcatga

SEQ ID NO: 188622 - DNA, 601 bp, Human
gagccactactattaatacttagtgaaataaaagaaagtgaggcatcagcccgtgtaacccctcaacgtgcaggcagaggaactgaggccgcagattcagcagcactctgggccttgcttgtgaatggggattttagtcactatcaaatgtattactgacttctactcactaatgtctttgataaattttggagttatcttttttctttattttttgaaactgagtcttgctctgttgcccaggctggggtgcagtatgttgatcttggctcactgcaacctccgcctcctagattcaggygattctcctgcctcagcctctcgagtacctgagattacaggcacacactaccacaccaggctaatttttgtatttttagtagagacagagtttcaccgtgttggccaggctggtctcgaactcctgacctcaggtgatcctcctgccttggcctcctaaagtgctgggattatgggcatgagccactgcgcccggccaattttggggttatctttaatctccattgagtcccagaggacaaacacattgccttcttagaaatttcagacatacattagatttcctggaatgtaagaaata

SEQ ID NO: 188623 - DNA, 601 bp, Human
caggctaatttttgtatttttagtagagacagagtttcaccgtgttggccaggctggtctcgaactcctgacctcaggtgatcctcctgccttggcctcctaaagtgctgggattatgggcatgagccactgcgcccggccaattttggggttatctttaatctccattgagtcccagaggacaaacacattgccttcttagaaatttcagacatacattagatttcctggaatgtaagaaataccatcagaatggctgagagggcattccttctctctttaagtgcgggtgcaagtccasactcctgggtatcgtgagtttccatatgacagtgtccctgaaacacgtggctcaatgcccaggacaccactccagggtcaccagatgcaagtgactggcccattgtgtcacttaggccccaggaggcccattgactcatcccagtggacacacaggccaggggccacatacctgtcctaggctgcctctcaagtgagctactgagctgcccagctctgcctgcgtcactgccctgtggccccaggtgctgtccgctgccctccagcccttcctgtgtgcttcccctttaccctgttctca

SEQ ID NO: 188624 - DNA, 601 bp, Human
tccccaacctggggaggtcagagctcctgtctggttgaggcaagggctgtggatgcggggtgtggccagcagtgcagtgatgctaatgaagggattttctaatgagttttgtatagattttcatttttaatgaaggcagggaagggatagggcagatcagaaatcaaatcttatttacaagaatcctcttaatagtgatatttaaaagatgcaaaaaacagggatcactgaccacctggtttgtctgttgtgttagccagctctttttttttttctttttgagatggagtctggccctgtygcccaggctggagtgcaatggcgcaatctcagcttgctgcaacctccgcttcctgggttcaagcgattctcctgcctcagcctcctgagtagctaggagtacaggtgcctgtcaccatgcgtggctaattttggtatttttagtagagacgggagtttcaccatgttggccaggctggtctcgaactcctggcttcaagtgattggacgcctcagcctcccaacatgctgagattacaggcatgagccactgcacccagccaaattctcttcttttgaagtggctttctgtgaggctcac

SEQ ID NO: 188625 - DNA, 601 bp, Human
tctgtgaggctcaccagctgaagtaaaatcagtttttgttcattcaacaaatctttattggttcttgatgctcaggaagaggcaggatgaaagccatgagcaggcaggcaagcccaggccagccctcctggcagcagtcgagggtgtgaggccctgagggtccatagggcccaaaggagggggtatcagctccctgagtgggtgagaggctcagagaggactgcagggagaggccgacctctccgcaaccatgggctgtagccaagcaggggttaagcagcctgcagcttcaacaaggacrtgtttggggtggtcagaagatggcagctttgatgttttcccatcatgaatcatcttgactctaggtctccaccaaggcccgacattccttgggatccagatctaaatccacctaaaactttggattagattaaacccacatgtccttcagcgtcttttggaggaatctggacacatccagtgaaacctaaagcaagtcccaagctgacattttccagcccagcatttctctaaccccttctttattttgcaaatctcactgagagcctgctaggtgccaggctccgttctggtgagtggg

SEQ ID NO: 188626 - DNA, 601 bp, Human
tccttgggatccagatctaaatccacctaaaactttggattagattaaacccacatgtccttcagcgtcttttggaggaatctggacacatccagtgaaacctaaagcaagtcccaagctgacattttccagcccagcatttctctaaccccttctttattttgcaaatctcactgagagcctgctaggtgccaggctccgttctggtgagtggggatcaatcggtgaacgaaatatgcaagtcccctggcctcgtggaggcggcattctataggggatgcagaatgcaaagaaagtaatwagtccgtctgatggtttgtaggaaggcaggatgtgccgtgggggaaacagggaggcataggggcttctgctcatggtgggtttataattttagagccgtggggttggcctcactgtgccaggacctgaatggggcgtgggcagtatggaaagtgggaagagcatcccaggccgagggaacagccagcgcaagagcccagaggagagggtgtgtacagcaaggcggccagggtggctggagtggagccagcaacggccagtcccagggaggaagcaccagatacaagggtaaccaggtggc

SEQ ID NO: 188627 - DNA, 601 bp, Human
ggctgagggggccatgagatagaggctggggtgttgggggtgagcctgaggcagctggacaccctgaggtgcctgggacacttgattgcttccaccttttggatgttgtaaataatattgctgtgaggccgggcgcagtggctcacgcctataatcccaccacttcgggaggctgaggcgggcagatcacttgaggtcaggcgtttgagaccatcctggccaacatggcaagatctcatctctactaaaaatataaaaaattagctgggcatggtggcaggtgcctgtaatcccagctgcyggtgaggctgaggcaggagaatcacttgaacccaggaagcggaggttgcagtgagccctgatcgcaacattgcactccagcctgggcgacagagcaagactccatctcaaaaacaaaacaaaacaaaacaaaaaacaacaacaaactgctgtgaacatgggtgtgcaagtatctgtttgaaaccatgcttcagttctttggatatttacccagaagtggaattgctgggtcctatgattattctatttttaattttgggaggaactgtgctccacggcagctgcacccttttccattccc

SEQ ID NO: 188628 - DNA, 601 bp, Human
acctggggccgagtctcccacgaggccggggggtgaagtgagctggccttgccctgagaaccgcctgtctccaggcattgggcagatgcagaagtcaaagcagggctcctcctgggcttccagaatcttcttctcaattcagggtcggcaccctcaccctacccaggaggctctcaggcttctctacccacagactcgtcagggtccagaggtaaaaatgggccctcactaagacctctgataagatctgacctctataacgaccctaaaagaggaaactgaggttcagagaggcccagcytccaaaatggcctctctgcagtcctgtcagggacccagacgggatcctgccctgaaggtaagctgtgaataaatggcatagtcctcttccctgagtgctcctaggaccctacgtgctagcaggtcactcaggaccgctatggccgtggaagggctgtgtctttgcaagaggtggaaaggtgcctgacagcattgcctacaggcagtaaacccaaggtgtccaggccatccctcccttaccacccagccagcaaggaaaacaagcccggccaggaggaacttgggcctggaggagctcggg

SEQ ID NO: 188629 - DNA, 601 bp, Human
aagccagacttgagtcatcactctacaggttgtgtggacagggggctcagagaggcctcccctgaggcctctcgtggaccccgctgggctgtctgcccgctcctccatctgggatctccacctgtgtttgcagaggtgctgccattgctgtctgctggggagggcggcccaggcccagggccagagctgcgagtacagcctcatggttggctaccagtgtggacaggtcttccgggcatgctgtgtcaagagccaggagaccggagatttggatgtcgggggcctccaagaaacgggtaamtttcccccttccttccctaatgagcagtgtattaaggttctccgggatgtgtatatagagcgagagtggagagagagagattttaaggacttggctcatgtgatcgtgggggctggcaagtccaaaatctgcagggcaggccttcaggctggagccccagggaaggaggggcattgcagctggagttcaaaggcagtgtgttggcagaacgccgccttccccggggaggccagtcttttttctctgaaggccttctgctgattgagtgaggcccacccacggtatgaagatgatctgctt

SEQ ID NO: 188630 - DNA, 601 bp, Human
acacctggctaatttttgtatttttagtagggatggggtttcaccatgttggccaggctgatctggaactcctgacctcaggtaatccacctgcctcagcttcccaaagtgctaggattacaggtgtgagccatcgtgcctggccaatattaatctctaaaatatagcttcacagcaacatccaggctagtgtttgactaaatatttgagtaccataccccagcccaattgacacttacgatgaaccattacaggtaacacgtgcatccgtgtcaccattgccttaactcagcacggactractccggttgtcggagccattcatgtttgtgaccttatctgaaagccgctgtcctggagtgacgctgagtgcttggagtctgggatcggacaaatctgtgctcccatccgggtcctaatgtgtaccttggtcccctcatctgggaagtggggatagttgcagtcctacttcatcaggtgctgggaggatggagtgcgagattgggtgtcaagggttgggtagagcacctggccccataaatgtctgccctcaccatctgcccttgtcccttcagctgcccggggcagcatgggtggctgg

SEQ ID NO: 188631 - DNA, 601 bp, Human
ttctttcatggaacattctggcatgtctagacctgcagatctgcctcacaagctctttcagtggttccccctgtggttagggtgttaattaggggccagtttaatccttaaatgatgcagtcagtgtacagtgacagttggtccaggggcgctgtccaggggcctggtggagggaggaagggagtgacctagagccccagcaagcctcagggctatgggaggagctttctgggaaggggagagctggtctgcaaggaggaggtgggattagctgggaaaataaccctgaaacggtcctcakggagacctgaagccttgtaaagggcacggacccactgtagcagggtactgggaggcagtgggctggggaaggaggtggggttacagggccagagagaggggccctagaaacaggcaggctggcagcagttagaagtgtatctcgtagaatctttccctggttgaggcttatcctgatgagatttgcactctgagcatcactctggccaccctgtaggaagaacaggttgtggggtgcttctgggctatgcagaaagaccaggtaggaggctgtggccacagccaggtgggcagctgcagg

SEQ ID NO: 188632 - DNA, 601 bp, Human
gggtgcttctgggctatgcagaaagaccaggtaggaggctgtggccacagccaggtgggcagctgcaggaactgaggccatggtagtgggcttggagcagtgggacagctcgagagttcagtgaggagcaggtacatgaggcctagttggggcctggccttccacgtggagcccacacccccatgtctgtgaccggcagtgagctcttctctgccttgccccttccaggtccaccccagcctacaaagggcaccctgcacaccacctgattttccagacggggaggttgggacctgaagcmgcaggccctggggggtgtccagagccagagcctgggggtctcccagtagggcagcaggtgggctccagccaggtcagcctgccttcctgggttcatctgcccagagggcgttttctatgacccagcctgaacggagctagaaaccaggcggtgcctgggtgcgtccatccctggctcatgcacgctgtgcttccaggaggcgggccctgcaagcagcagtgccgagacacgggtgacgaggtggtctgctcctgcttcgtgggctaccagctgctgtctgatggtgtctcctgtgaaggt

SEQ ID NO: 188633 - DNA, 601 bp, Human
agcagtgggacagctcgagagttcagtgaggagcaggtacatgaggcctagttggggcctggccttccacgtggagcccacacccccatgtctgtgaccggcagtgagctcttctctgccttgccccttccaggtccaccccagcctacaaagggcaccctgcacaccacctgattttccagacggggaggttgggacctgaagccgcaggccctggggggtgtccagagccagagcctgggggtctcccagtagggcagcaggtgggctccagccaggtcagcctgccttcctgggttcrtctgcccagagggcgttttctatgacccagcctgaacggagctagaaaccaggcggtgcctgggtgcgtccatccctggctcatgcacgctgtgcttccaggaggcgggccctgcaagcagcagtgccgagacacgggtgacgaggtggtctgctcctgcttcgtgggctaccagctgctgtctgatggtgtctcctgtgaaggtaatgtccctatcccaggtgccagcaggactggccggtcactgtgcttgggagctctgtgctggaggactgaccagggcctgccttctacaaccca

SEQ ID NO: 188634 - DNA, 601 bp, Human
cctgggtgcgtccatccctggctcatgcacgctgtgcttccaggaggcgggccctgcaagcagcagtgccgagacacgggtgacgaggtggtctgctcctgcttcgtgggctaccagctgctgtctgatggtgtctcctgtgaaggtaatgtccctatcccaggtgccagcaggactggccggtcactgtgcttgggagctctgtgctggaggactgaccagggcctgccttctacaacccagaccccattcaggggtggagagcagcccaggacgcgctttctcgtgttcgctggagttygcagcgcagaggcccctgccgagacttccctccaagacaatataagcactggggttgggaaagaggatggagttggggtctaaccaggttccggatccaggatctgctgagtggccttgggcacatccttcagcctctcctggcccctgcgtctgtgagatgggggagatggagaagatgctgcccctccatggggttcttgaggaccacataactacagtctcagaaaaagcagtagatatgaacgttagcaggggagagaaatcactgctttcgactccgtgcagtccacagcccgga

SEQ ID NO: 188635 - DNA, 601 bp, Human
tctgcaaacctggtcttccaggcgtagatacggcgcggtgggaagggcagctctggggtctgggctcccgcagtcctgcgccctctgtggctgcctgggcgactgcctgctcatctgcaggagggaggtggttatacccaccagggtgtctggacaggtgggatggaaggtgaaagtgcttgccaataatgttcagaacattgaaaaagttgacagtagtgcaccggtgccagctagttcagctgttaggaaagatttacgttcttatggtgcagagtaaacgatggcagatttgggtttytaaaaaggctcagtgcatgactatttaaaatcaagaccagggatgaatttcaggttctcacatgtactttctacaaaaaaaaaaaaaaaaaaaaaaaaaagcaaaaacaaaaatcccacaactgtttttgcacaacagctgccttccatccaaatccaggcttccttgaagttcaaagcatatccccttccactgcataaacacatggcatttctggctgccagcctttccccgccaagccttaggtgttatttggcagatggggaggctctgatgaggatcgtttagaacacagttttg

SEQ ID NO: 188636 - DNA, 601 bp, Human
gactgcctgctcatctgcaggagggaggtggttatacccaccagggtgtctggacaggtgggatggaaggtgaaagtgcttgccaataatgttcagaacattgaaaaagttgacagtagtgcaccggtgccagctagttcagctgttaggaaagatttacgttcttatggtgcagagtaaacgatggcagatttgggtttctaaaaaggctcagtgcatgactatttaaaatcaagaccagggatgaatttcaggttctcacatgtactttctacaaaaaaaaaaaaaaaaaaaaaaaaaagcaaaaacaaaaatcccacaactgtttttgcacaacagctgccttccatccaaatccaggcttccttgaagttcaaagcatatccccttccactgcataaacacatggcatttctggctgccagcctttccccgccaagccttaggtgttatttggcagatggggaggctctgatgaggatcgtttagaacacagttttgcagagggtttcaagcctttcagaaggacaaatccacttgtgtaaaaatgtcactcactgtatcatgagagtgacttcaaagcatggcacaccccttctga

SEQ ID NO: 188637 - DNA, 601 bp, Human
gaagcactcggtgagtggtgattccctgccacaggcatttagcctattaaaaaattattttaaaaaatacttggctgggcacagtgggtcacgcctgtaatcctagcactttgggaggccaaggcaggaggattgcttgagcccaggtttttgaggccagcctgggcaatatagcgagaccccatcactacaaaaaattagctgggtgtagtggcgcatgcctacagtcccagctacttgggaggctgaggtgggaggatcccttgagcagggaggtcgaggctgcagtgagctgtgatcrtgctactgcactccagtctgggcaacagagcaagaccctgtctcaaaaataaaataaaatataaaaataaaaaacagtctgtgttagtatttgaattcatagagacagaaagtagaatggaaggtgccggggctgggcagggtgggggatggggagtgagtgtttcctgggcgcagagtttcagtttgagaagatgaaaaagttctggagatggatgggggtgatggtggcacgacagtgtgaatgcagtaatgcccctgaaccgtctacttaaaatggttacgatggcagattttgtgt

SEQ ID NO: 188638 - DNA, 601 bp, Human
gaagatgaaaaagttctggagatggatgggggtgatggtggcacgacagtgtgaatgcagtaatgcccctgaaccgtctacttaaaatggttacgatggcagattttgtgttacataaaatttgtagttcacatgtagttcaccacaatgagaaaagaaactctggccaggcacggtggctcacacttgtaatcccagcactttgggaggccgaggagggtggatcacctgaggtcaggagtttgagaccagcctgaccaatatagtgaaaccccatctctactaaaaatacaaaaattakctgggcgtagtgatgggcgcctgtaatcccagctgcttaggaggctgaggcagcagaatcgcttgagcctgggaggcagaggttgcagtgagctgagatcacgccactgtactccagcctgggtgacagagtgagactccatctcaaaaaagaaaaaaaaaaagaaattgctgatatcagagaaatactaatatgaaaagagagaatcccatgtgaacttagtatgaatttaggaggcctgggcaagaccgctcacgctagaggagctgtgtggggtgcggccggggagctggccggcct

SEQ ID NO: 188639 - DNA, 601 bp, Human
gcacgacagtgtgaatgcagtaatgcccctgaaccgtctacttaaaatggttacgatggcagattttgtgttacataaaatttgtagttcacatgtagttcaccacaatgagaaaagaaactctggccaggcacggtggctcacacttgtaatcccagcactttgggaggccgaggagggtggatcacctgaggtcaggagtttgagaccagcctgaccaatatagtgaaaccccatctctactaaaaatacaaaaattagctgggcgtagtgatgggcgcctgtaatcccagctgcttakgaggctgaggcagcagaatcgcttgagcctgggaggcagaggttgcagtgagctgagatcacgccactgtactccagcctgggtgacagagtgagactccatctcaaaaaagaaaaaaaaaaagaaattgctgatatcagagaaatactaatatgaaaagagagaatcccatgtgaacttagtatgaatttaggaggcctgggcaagaccgctcacgctagaggagctgtgtggggtgcggccggggagctggccggcctgggttactggttctggaaagacaggaggtgagtcctgctt

SEQ ID NO: 188640 - DNA, 601 bp, Human
atgtggccgggcacagtgactcacgcctgtaattctggtactttgggaggccaaggcgggtggatcacttgaggtcaggagttcgagaccagcctgaccaatatggtgaaaccccgtctctactaaaaatacaaaaattagccgggtgtggtggtgggcaccttgtaatcccagctactcaagatgctgaggcaggagaatcgcttgaacccaggaggtggaggttgtagtgagccaagatcgtgccactgcactccagcctggacaacagagcaagactctgtgtcaaaaaaaaaaaaaagataaaaagacaagtggaacagtgagcccttaggacaggggcctcgtctgaaacccgccccagccttcctctgttacagcttccctgtcatcccctgggggagacttctgagctggggcgctgtggctcagctgccagttggcccctcgccagtcccttgccagcagggaggggtggttttcgctcagcgcagggggtggtgagcagggaagccatgggctctccgggaccagcggggaggatagtcctgctcagacttgcagcctgctcaaaggggggtccggaggaggctggcgtcga

SEQ ID NO: 188641 - DNA, 601 bp, Human
gatgctgaggcaggagaatcgcttgaacccaggaggtggaggttgtagtgagccaagatcgtgccactgcactccagcctggacaacagagcaagactctgtgtcaaaaaaaaaaaaaagataaaaagacaagtggaacagtgagcccttaggacaggggcctcgtctgaaacccgccccagccttcctctgttacagcttccctgtcatcccctgggggagacttctgagctggggcgctgtggctcagctgccagttggcccctcgccagtcccttgccagcagggaggggtggttttygctcagcgcagggggtggtgagcagggaagccatgggctctccgggaccagcggggaggatagtcctgctcagacttgcagcctgctcaaaggggggtccggaggaggctggcgtcgactgaggatggaaaccctgactcatggcaaaatcagccccgatttccacaaagaggcaatgtttgcaagtctcaacctagccctgactttcctctctacagggtgcagcactgtgtatgggctgaggctcgggagccgtccccttactgtccttccaggactggcaagcaggctgtgggctga

SEQ ID NO: 188642 - DNA, 601 bp, Human
ggttccccttttcatgtgctctcaatccttgcaatcaagctcaggaatcattgttttaaaagatctctatttatttcaaaaattatgtatgtcttgacttataaatcagcaaacaaaacctaagtgtaggaagtaaacgctcctcccctggccaatcctgcccgcctcttggcagggtccatgagcccttctgggctctgctcccttgagactttttgtttttttatgaaaatgggatcagactgttctgccacttgcttttcccccccacttgacagggtatttagaaatcatttcatgkcagcacctttatgttatctttttaaaaatgactgcatcagcagaaatacgtctttctaaggagaaaatacatcaagatagaaggtagtttcaggccgtctgggagagggctgaaaaggttctatgtcaggtcctggtcccccagcacgcaccctgggtcctctgctcccacacctctgcccatggtacccgctccctcacccaggaacagcatggtccgtggtgggaagcgttgatttccttgtgtagccagaatccatcttcctggagctcctagaaccatcctggggccccaagagcc

SEQ ID NO: 188643 - DNA, 601 bp, Human
ggccacccagctgtttctctaaagggctagatggtaactaacaacttcagtctctgtggcaaccactcaactctgccttttgcagtgtaaaagcacccctgagcaatgcataacagagtgggcctggttgcacgctaataaaactttatttacaaaagcaggtgtaagccgggtttgaaccaagggccatcatttgctggccactgatttaagggagctggaaagcaggagaccctgattctagacctaggccctggttggcccctgacttcagccatgagcccagagtcattcagtctcyggaccttggtttcctgtttataaagtgcaggcagtaatgatagtgatacctgcctcacctcacttgcaggctggctgtggtgctcgagagcggtcatggatgtaaaagcttttgtaaactgtaaattgctgcacggtcagcgcgaagggctgactcatttgactgaggagggtggacttggctggcagggagaggggtacagctgtcctcctttctgacttacgctcaagggtcttccaccatcactccctctctttgttcccccataccagatgctttgtaagtgtctgagcaaggttc

SEQ ID NO: 188644 - DNA, 601 bp, Human
ctctgtggcaaccactcaactctgccttttgcagtgtaaaagcacccctgagcaatgcataacagagtgggcctggttgcacgctaataaaactttatttacaaaagcaggtgtaagccgggtttgaaccaagggccatcatttgctggccactgatttaagggagctggaaagcaggagaccctgattctagacctaggccctggttggcccctgacttcagccatgagcccagagtcattcagtctctggaccttggtttcctgtttataaagtgcaggcagtaatgatagtgatacckgcctcacctcacttgcaggctggctgtggtgctcgagagcggtcatggatgtaaaagcttttgtaaactgtaaattgctgcacggtcagcgcgaagggctgactcatttgactgaggagggtggacttggctggcagggagaggggtacagctgtcctcctttctgacttacgctcaagggtcttccaccatcactccctctctttgttcccccataccagatgctttgtaagtgtctgagcaaggttctccaaggtgatgtttagatgcttaggtccttttccactccctctatcagga

SEQ ID NO: 188645 - DNA, 601 bp, Human
agaccctgattctagacctaggccctggttggcccctgacttcagccatgagcccagagtcattcagtctctggaccttggtttcctgtttataaagtgcaggcagtaatgatagtgatacctgcctcacctcacttgcaggctggctgtggtgctcgagagcggtcatggatgtaaaagcttttgtaaactgtaaattgctgcacggtcagcgcgaagggctgactcatttgactgaggagggtggacttggctggcagggagaggggtacagctgtcctcctttctgacttacgctcargggtcttccaccatcactccctctctttgttcccccataccagatgctttgtaagtgtctgagcaaggttctccaaggtgatgtttagatgcttaggtccttttccactccctctatcaggaagtgcaatctgtgtattcttcctccgaatttgagcagaaggagggtatccctgtgtagcatggccctcctggaccattcatgggttcacacttgctcattgtatgtcatcaaaggtaaatgccccacggtccccatgtcagagatgtgtccactcaaggaaggagactgccgtgcagt

SEQ ID NO: 188646 - DNA, 601 bp, Human
ccacgtggacagtcacctgtctccttaataccgtgcccagtgtgtggagtagatgaatgcaggagaagccaggcaggcaggtcccgatttggcgcagcgaacgatggaggtgctggagatttagggacaggaagaagggccagagaggtggtgtttgaggcggtatgcagtgataaaatttgggagccagctgggaggcggctgtgtggtccagagtgagggggttgagcccctccatttgtggttttgcaaagaggtgggaaggggagtttctttggagatccagtttttgggttctggracaccctccaggtttaaccacatggtctctgtcttttcccgctgtagatatcaatgagtgtttgagtatcagtgccccgtgccctattgggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctat

SEQ ID NO: 188647 - DNA, 601 bp, Human
ttggcgcagcgaacgatggaggtgctggagatttagggacaggaagaagggccagagaggtggtgtttgaggcggtatgcagtgataaaatttgggagccagctgggaggcggctgtgtggtccagagtgagggggttgagcccctccatttgtggttttgcaaagaggtgggaaggggagtttctttggagatccagtttttgggttctggaacaccctccaggtttaaccacatggtctctgtcttttcccgctgtagatatcaatgagtgtttgagtatcagtgccccgtgccctatygggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctatcagcccatccatcccactgtcagttcccaagcatggggcttcattgtcttgcctggactggtgcaccagcccgtctactgcctcagcc

SEQ ID NO: 188648 - DNA, 601 bp, Human
accacatggtctctgtcttttcccgctgtagatatcaatgagtgtttgagtatcagtgccccgtgccctattgggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctatcagcccatccatcccaytgtcagttcccaagcatggggcttcattgtcttgcctggactggtgcaccagcccgtctactgcctcagccttgtctggcttgtcctgagcccaaagctctcgcaccccaccctgtttacagttccatcagctccccgttggtgacaaaggatggatgcctctgcttacagtccagtcccccagagctggcccaactccacaaaccttgtaattcaggcaatgtgggtctgccactccccacacaagcactgtcctttcctctctgtgtgggtgtttgctctcacgtcattccctctgcc

SEQ ID NO: 188649 - DNA, 601 bp, Human
tggtctctgtcttttcccgctgtagatatcaatgagtgtttgagtatcagtgccccgtgccctattgggcatacatgcatcaacacagagggctcctacacgtgccagaagaacgtgcccaactgtggccgtggctaccatctcaacgaggagggaacgcgctgtgttggttggtattaagaaaacaaatctgaaatccactttcctgtctgcttccagcatgcaccctgccttctctggaagcagaaagttgatccccaaagcaaagccatttctatcagcccatccatcccactgtcarttcccaagcatggggcttcattgtcttgcctggactggtgcaccagcccgtctactgcctcagccttgtctggcttgtcctgagcccaaagctctcgcaccccaccctgtttacagttccatcagctccccgttggtgacaaaggatggatgcctctgcttacagtccagtcccccagagctggcccaactccacaaaccttgtaattcaggcaatgtgggtctgccactccccacacaagcactgtcctttcctctctgtgtgggtgtttgctctcacgtcattccctctgcccacctg

SEQ ID NO: 188650 - DNA, 601 bp, Human
tggacgagtgcgcgccacctgctgagccctgtgggaagggacatcgctgcgtgaactctcccggcagtttccgctgcgaatgcaagacgggttactattttgacggcatcagcaggatgtgtgtcggtgcgtggggggccccgcaggcctcgggggaacccagccacgtggcaccagggacacatttctgtggcacctcgagtgatgtggtctgatcctcatctcagataatcccaagtgcaggcagaccctgagagaagatcctgagtcaggagaccccattctagccccagctctgctrctgcccagccaggcggccactggcaccacccccctgtgtgtgagcctgctccccatctgtggaaaggggttctgcttgacccaggacctccaagtgctgatgagccaggtctacacatgtgggcagcatcagcgatttcctggagattcaccgctgagctgtagatccccaggagctagagatgtgtgcctttagcccagggcagcgaggggaaaagttgaccaggagtggggtcaggtcttgtctagccagtgcctgctgtcaccaaacctaggtgctcagggaagcctggcagctgcc

SEQ ID NO: 188651 - DNA, 601 bp, Human
gaccctgagagaagatcctgagtcaggagaccccattctagccccagctctgctgctgcccagccaggcggccactggcaccacccccctgtgtgtgagcctgctccccatctgtggaaaggggttctgcttgacccaggacctccaagtgctgatgagccaggtctacacatgtgggcagcatcagcgatttcctggagattcaccgctgagctgtagatccccaggagctagagatgtgtgcctttagcccagggcagcgaggggaaaagttgaccaggagtggggtcaggtcttgtcyagccagtgcctgctgtcaccaaacctaggtgctcagggaagcctggcagctgccaaccactcccccaaagtgggcactttgctagatcctggcagaccctccttgtgggtcctggggaggaggactggcaggagggcacaagttcagatgtgctgccgcagaaggagcacgaggctcgcccaccaggcaggcacagcgcggcagtcccggctctcccactgacttcccgcatgctcgggacaagtcactttgcattccttgtctgagaaatgaggctggaggccaggcgcgatggctcat

SEQ ID NO: 188652 - DNA, 601 bp, Human
aagaagtaactcagtctttcctgggccatggtgtcctcatctgtaaaacgggcatagtaggaccaaccccatagggggttgtgaggatgaaacgagattaagcatgtgaagagcttatcacagggccaagcacaggatgaagagctggcggtgtggaggctgctggctttattattatttagtagaagtagtgggattcctggcttgtgcttcctctagtcattcataaattgctgaaaagtcggcattcatatccacattagtggacaatattgtggatatagaaccagagcctggccarccttgctatgtgaccttactaaccatttgttaaggtcctgccccgggtgtgtagcaagaactcggtcctgcactggggagtgtctctagcgggggatgagagaccacactggacaggtggaggccaggcctggtgtgtgggggccacagagatgaaacacggggtggaaggctattggacgttctgtgacagccacatagtatagatttaaggcttttccagccacaatctctgttgcaaccgctgaactctgctgtggtagcagagaagtggccagaggaccatggtaaaagaatgagt

SEQ ID NO: 188653 - DNA, 601 bp, Human
aaggctggaggctatcgctgccatcctggcaggagaagttgtggtcgaagcaggcaggagcagggatggagggtccggagccaccagcgatgacgcctctccctcggccacaccccccgggacctctgtctctccgagtgtgttaacctgagggaggtggagaggagattttctgttcactgaccctgagggctactgtggaggcagggacgtatgatgctctgagcggtgaccctcgttttgtatttcagacatcaatgagtgcagcagcagcccctgtagccaggagtgtgccaacgtytacggctcctaccagtgttactgccggcgaggctaccagctcagcgatgtggatggagtcacctgtgaaggtgcggacgcccctgcctgctgagggggaaagcaccccctggtcttgccatgacacagcagcacggcctctgactttcaaaatccacagggaagagcctgctgggatttcttcacctggcaaaccttccatgtccacccttggaggcaagcgggtggtttgctgttttccctccaactgaggtttttttttttttttttttttttttttgagacacggtcttgctctgtt

SEQ ID NO: 188654 - DNA, 601 bp, Human
caggcaattaagggcaattacgatgattaccattttcatgtaaggtgtgtgtgtattttgtttgcttgtttgtttttgagacagagacagctctgtcacccaggttggagggcagtggtacaaacacggctcactgcagcctccatctcctgggatctagcaattctcccacctctgcctccttgagtagctgggcccacaggcatgcaccagtatgcctgactaacttttttgattttttgtagacacagggtctcactttgttgccgaggctggtctcgaactcctgggctcaagtaaycctcctgcctcagcctcccatgcctgggattccaggcatgagccagtgcacccagctgaggtgtgtttcttattattgaactgtggtccatatttccccctgcccgccacatgcatacttcacaccatgaacttgctgtgtgaccctaggctagtcccatcgcctctctgagcacgatggtctctgaggcttcctgtgttcagcttgtcctgtgctgctgccctcccgggccccagtgcagcccccagggcgatgtagcatggccagcagccatggccaggtgccaggacactgaggctg

SEQ ID NO: 188655 - DNA, 601 bp, Human
cctcacgctctgcttggggccctgcaatgtcgtggggctgaggctgggctcgggggctgtgcttccccaacccaagggccacagcacagatggaatgcattcaggaaaaggaggcccaccccatccaaggggtgtcctggggtctgcagcaccctggtctcctacacccaggccccagcacacttgtcctctggattgtctgagcctgtggcggctgcatccggcaggaacacttcagccctcctcccctcccctcagcagccccgtaaaggctggaacagaggcctttaggaagatgccmgccagggaggaagcagtccaggccaggggatggcgtggcctggtgtgggatggcccagggatactcatggctatgggtcagctccagcatcggctaagtaatggtggccaatggcattggttctgcattcagcccccttttctacgaatgctctagggggcagtgtgtgtcccccagagccatctgataaccatccattcaatcactgacagcgggtgctgagtagatgtttgtgagcgcgtgatcctcagtgtacacactgcgcccagaagctgagtcatggaggtggggctgtccagc

SEQ ID NO: 188656 - DNA, 601 bp, Human
acgacgagcgtgtgaaagtcaggaaaatgccggcagggatatccacaagcacctggggtggccagaactgccgtgcctcccaggagaaggagggggcctagagggccttttttctctggtgtgtggtggcttaggatcatttccatagagcttgaggtgttagggtcaaatgtgttgaactggcaagttggagcacattgtcctctaacgcatgacatggcccaggatgggtggcctgctgaggggacatgtctggaaaccagggcctgcgtggcagggggggacggggcgggctcgcctrtgccctgctctgtaatacattcagtgatgacaacccgtccctgacctagacacactggctaaaagggatttttgggccgttcccagtctgacaggcagtttgccagacagttatgtttctggtgttttaaaaagtttgagtagagcgaagtacgatcattgaagccaggacttaccaggaaaatcaaggacatgtttatttttgtgcattagtcatttgcaaagcacatagcgggtgccccaggccctgctctttgtccagaaggagccagcccagaaactcctagtgtagagaaggttt

SEQ ID NO: 188657 - DNA, 601 bp, Human
aaactggcagcctttcaggtcactcgataaatgtgctggagtaacactcaaacgaggaatgtgttgcctccaaaatccaataggcccactaggcgttgtgtctctttcttggttgtaggtggggccaaatgcaggcaacttatccttcaccttggaatatctcgacaggccccaaaccactggacccctagaaattttactgaggtagaaggtccctgaattttattatcagatttattttccatcctctggcatgcaaatgtctcactaataagtccagtgtgtttgctacttctcactyactggatccaatcagcataatgtcaccaatttaatggaccagcgtgatatcttgcagaagcgaaatgcgatcaaggtctctccgaataagattatgacatgaataagattatgacacaaagccggagagttgatacacccctgaggtatgacagtgaaggtatattgctggccttgccagctgaagacaaattgcttctggtgggccttggaacaggaatggagaaaaaggcatttgtcaagtcagtggctacataccaggtaccaagagatatggtaatttgctcaagcaatgaaacca

SEQ ID NO: 188658 - DNA, 601 bp, Human
aaaatccaataggcccactaggcgttgtgtctctttcttggttgtaggtggggccaaatgcaggcaacttatccttcaccttggaatatctcgacaggccccaaaccactggacccctagaaattttactgaggtagaaggtccctgaattttattatcagatttattttccatcctctggcatgcaaatgtctcactaataagtccagtgtgtttgctacttctcacttactggatccaatcagcataatgtcaccaatttaatggaccagcgtgatatcttgcagaagcgaaatgcgaycaaggtctctccgaataagattatgacatgaataagattatgacacaaagccggagagttgatacacccctgaggtatgacagtgaaggtatattgctggccttgccagctgaagacaaattgcttctggtgggccttggaacaggaatggagaaaaaggcatttgtcaagtcagtggctacataccaggtaccaagagatatggtaatttgctcaagcaatgaaaccacatctggtacagcagctgcaaattggagtcaccacttggttaaacttacgataatccgctgccgttcacca

SEQ ID NO: 188659 - DNA, 601 bp, Human
cgcgtctcaagtttttgatggtgacactaatctccgcaatccctccgggaatacgatattgtttttgatttactgtttttctaggtagaggcagctctcatggcttccatttggcctttccaaccataaaagccctcaccctaccagtcagggagccagtgtgggggttctgccagctgctaagtatgtctctgccaattctgcattctggcactgggaaaatgaccacaggatgagtccggggacccactggacccactgtaagtcagacctgagctaaaactccattaattacctgacytccttaagcccctatttaactggagggccacaatgacgttttgggtcccctggaatcaacctcagctcagaatcagtgtccaatagtccccaaaatgtctgatcatttccctttccccaatgcagttactctggtaaaaggccagaggtctctttggggaaggatgggagaaagattcactgcataaattgtcagtaatgtagtggggtccttcctcaagaggacccgcctccccttcattcaaggggttctgggtctgtaaactggttcaagtctggaaattgattgaggggccgtgat

SEQ ID NO: 188660 - DNA, 601 bp, Human
tgagcctcgcgtgccttggttttatttggcatggttgggagtctgtgccgcttgttacccgggggtgagctgggcactggccaccgcctggtacccccgagggctgactgaggagcgctccccactagagggtgtgtgctcgggggtccctgttcacagagcccactgtctgtgccgacagggaggccaggccgggtacatcatttcacatgtgttaacttgtcttcatttgtgttgaacccaaagaataaaggtggtggtggagaagggccctcagattgctgagcacagtcccctctcrttttacagatgtggaaactgaggcccagagagaaggggaagggttggccagggtcgtctggcctgctgtggccatgccaggtcaaggaagcgggtctgctggcccctgcctggttctttgctgtatccccggaggtgagcatttcactgagacaagaaagctctctcctgagattcaagcctcctcttctgtttgtcttgatcagaagcccaaatctgtggtgcagaaacacgggatgcggttgcggctcctaggatgcagctcttgcctcagtgaagtcgttttgcccccactgaggat

SEQ ID NO: 188661 - DNA, 601 bp, Human
tgcgctgagcagctgtgattgtgccacgggagcatgagcccttttccccacggcccttgccactgtctcctggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgyacctgccccaccccagctcatccatgtgcttgtaccctggccccacggggaggcttgcccttccctgaatctgccttcttgtggctttagcatgtgccatgctgtccccctgcagactgccattctccttgcagacttggctcagaagtcacctcctcagtgcagttagcctgagctcccctggccccaggtgcctccatcagagcatttaccccattgtgttgtggctgttccttaacgtccccactagccaggctctttgagggcagggattgtgtctggttaatttctgtattctct

SEQ ID NO: 188662 - DNA, 601 bp, Human
ggccctctctctgatcatgccaggtttgcaccagcctcgagtctcccatgttgtagtacattctccaagatgcagcccaggagcctctctgaaggaccagtctggttacgatggtctgagcttccttagaaccttccatggttgtcttttcccagcagatgaagcatagcctccttggaatggcatgggaggcctggcctgatctggcctctgcccaccctttgagctgtacctgccccaccccagctcatccatgtgcttgtaccctggccccacggggaggcttgcccttccctgaatstgccttcttgtggctttagcatgtgccatgctgtccccctgcagactgccattctccttgcagacttggctcagaagtcacctcctcagtgcagttagcctgagctcccctggccccaggtgcctccatcagagcatttaccccattgtgttgtggctgttccttaacgtccccactagccaggctctttgagggcagggattgtgtctggttaatttctgtattctctgcaactttgcaatgtttggcttgaagaaggagctcagtaaacatctgaataaacatgcaggttgatggatg

SEQ ID NO: 188663 - DNA, 601 bp, Human; identical to SEQ ID NO: 188614

SEQ ID NO: 188664 - DNA, 601 bp, Human; identical to SEQ ID NO: 188615

SEQ ID NO: 188665 - DNA, 601 bp, Human; identical to SEQ ID NO: 188616

SEQ ID NO: 188666 - DNA, 601 bp, Human; identical to SEQ ID NO: 188617

SEQ ID NO: 188667 - DNA, 601 bp, Human; identical to SEQ ID NO: 188618

SEQ ID NO: 188668 - DNA, 601 bp, Human; identical to SEQ ID NO: 188619

SEQ ID NO: 188669 - DNA, 601 bp, Human; identical to SEQ ID NO: 188620

SEQ ID NO: 188670 - DNA, 601 bp, Human; identical to SEQ ID NO: 188621

SEQ ID NO: 188671 - DNA, 601 bp, Human; identical to SEQ ID NO: 188622

SEQ ID NO: 188672 - DNA, 601 bp, Human; identical to SEQ ID NO: 188623

SEQ ID NO: 188673 - DNA, 601 bp, Human; identical to SEQ ID NO: 188624

SEQ ID NO: 188674 - DNA, 601 bp, Human; identical to SEQ ID NO: 188625

SEQ ID NO: 188675 - DNA, 601 bp, Human; identical to SEQ ID NO: 188626

SEQ ID NO: 188676 - DNA, 601 bp, Human; identical to SEQ ID NO: 188627

SEQ ID NO: 188677 - DNA, 601 bp, Human; identical to SEQ ID NO: 188628

SEQ ID NO: 188678 - DNA, 601 bp, Human; identical to SEQ ID NO: 188629

SEQ ID NO: 188679 - DNA, 601 bp, Human; identical to SEQ ID NO: 188630

SEQ ID NO: 188680 - DNA, 601 bp, Human; identical to SEQ ID NO: 188631

SEQ ID NO: 188681 - DNA, 601 bp, Human; identical to SEQ ID NO: 188632

SEQ ID NO: 188682 - DNA, 601 bp, Human; identical to SEQ ID NO: 188633

SEQ ID NO: 188683 - DNA, 601 bp, Human; identical to SEQ ID NO: 188634

SEQ ID NO: 188684 - DNA, 601 bp, Human; identical to SEQ ID NO: 188635

SEQ ID NO: 188685 - DNA, 601 bp, Human; identical to SEQ ID NO: 188636

SEQ ID NO: 188686 - DNA, 601 bp, Human; identical to SEQ ID NO: 188637

SEQ ID NO: 188687 - DNA, 601 bp, Human; identical to SEQ ID NO: 188638

SEQ ID NO: 188688 - DNA, 601 bp, Human; identical to SEQ ID NO: 188639

SEQ ID NO: 188689 - DNA, 601 bp, Human; identical to SEQ ID NO: 188640

SEQ ID NO: 188690 - DNA, 601 bp, Human; identical to SEQ ID NO: 188641

SEQ ID NO: 188691 - DNA, 601 bp, Human; identical to SEQ ID NO: 188642

SEQ ID NO: 188692 - DNA, 601 bp, Human; identical to SEQ ID NO: 188643

SEQ ID NO: 188693 - DNA, 601 bp, Human; identical to SEQ ID NO: 188644

SEQ ID NO: 188694 - DNA, 601 bp, Human; identical to SEQ ID NO: 188645

SEQ ID NO: 188695 - DNA, 601 bp, Human; identical to SEQ ID NO: 188646

SEQ ID NO: 188696 - DNA, 601 bp, Human; identical to SEQ ID NO: 188647

SEQ ID NO: 188697 - DNA, 601 bp, Human; identical to SEQ ID NO: 188648

SEQ ID NO: 188698 - DNA, 601 bp, Human; identical to SEQ ID NO: 188649

SEQ ID NO: 188699 - DNA, 601 bp, Human; identical to SEQ ID NO: 188650

SEQ ID NO: 188700 - DNA, 601 bp, Human; identical to SEQ ID NO: 188651

SEQ ID NO: 188701 - DNA, 601 bp, Human; identical to SEQ ID NO: 188652

SEQ ID NO: 188702 - DNA, 601 bp, Human; identical to SEQ ID NO: 188653

SEQ ID NO: 188703 - DNA, 601 bp, Human; identical to SEQ ID NO: 188654

SEQ ID NO: 188704 - DNA, 601 bp, Human; identical to SEQ ID NO: 188655

SEQ ID NO: 188705 - DNA, 601 bp, Human; identical to SEQ ID NO: 188656

SEQ ID NO: 188706 - DNA, 601 bp, Human; identical to SEQ ID NO: 188657

SEQ ID NO: 188707 - DNA, 601 bp, Human; identical to SEQ ID NO: 188658

SEQ ID NO: 188708 - DNA, 601 bp, Human; identical to SEQ ID NO: 188659

SEQ ID NO: 188709 - DNA, 601 bp, Human; identical to SEQ ID NO: 188660

SEQ ID NO: 188710 - DNA, 601 bp, Human; identical to SEQ ID NO: 188661

SEQ ID NO: 188711 - DNA, 601 bp, Human; identical to SEQ ID NO: 188662

SEQ ID NO: 188712 - DNA, 601 bp, Human; identical to SEQ ID NO: 188614

SEQ ID NO: 188713 - DNA, 601 bp, Human; identical to SEQ ID NO: 188615

SEQ ID NO: 188714 - DNA, 601 bp, Human; identical to SEQ ID NO: 188616

SEQ ID NO: 188715 - DNA, 601 bp, Human; identical to SEQ ID NO: 188617

SEQ ID NO: 188716 - DNA, 601 bp, Human; identical to SEQ ID NO: 188618

SEQ ID NO: 188717 - DNA, 601 bp, Human; identical to SEQ ID NO: 188619

SEQ ID NO: 188718 - DNA, 601 bp, Human; identical to SEQ ID NO: 188620

SEQ ID NO: 188719 - DNA, 601 bp, Human; identical to SEQ ID NO: 188621

SEQ ID NO: 188720 - DNA, 601 bp, Human; identical to SEQ ID NO: 188622

SEQ ID NO: 188721 - DNA, 601 bp, Human; identical to SEQ ID NO: 188623

SEQ ID NO: 188722 - DNA, 601 bp, Human; identical to SEQ ID NO: 188624

SEQ ID NO: 188723 - DNA, 601 bp, Human; identical to SEQ ID NO: 188625

SEQ ID NO: 188724 - DNA, 601 bp, Human; identical to SEQ ID NO: 188626

SEQ ID NO: 188725 - DNA, 601 bp, Human; identical to SEQ ID NO: 188627

SEQ ID NO: 188726 - DNA, 601 bp, Human; identical to SEQ ID NO: 188628

SEQ ID NO: 188727 - DNA, 601 bp, Human; identical to SEQ ID NO: 188629

SEQ ID NO: 188728 - DNA, 601 bp, Human; identical to SEQ ID NO: 188630

SEQ ID NO: 188729 - DNA, 601 bp, Human; identical to SEQ ID NO: 188631

SEQ ID NO: 188730 - DNA, 601 bp, Human; identical to SEQ ID NO: 188632

SEQ ID NO: 188731 - DNA, 601 bp, Human; identical to SEQ ID NO: 188633

SEQ ID NO: 188732 - DNA, 601 bp, Human; identical to SEQ ID NO: 188634

SEQ ID NO: 188733 - DNA, 601 bp, Human; identical to SEQ ID NO: 188635

SEQ ID NO: 188734 - DNA, 601 bp, Human; identical to SEQ ID NO: 188636

SEQ ID NO: 188735 - DNA, 601 bp, Human; identical to SEQ ID NO: 188637

SEQ ID NO: 188736 - DNA, 601 bp, Human; identical to SEQ ID NO: 188638

SEQ ID NO: 188737 - DNA, 601 bp, Human; identical to SEQ ID NO: 188639

SEQ ID NO: 188738 - DNA, 601 bp, Human; identical to SEQ ID NO: 188640

SEQ ID NO: 188739 - DNA, 601 bp, Human; identical to SEQ ID NO: 188641

SEQ ID NO: 188740 - DNA, 601 bp, Human; identical to SEQ ID NO: 188642

SEQ ID NO: 188741 - DNA, 601 bp, Human; identical to SEQ ID NO: 188643

SEQ ID NO: 188742 - DNA, 601 bp, Human; identical to SEQ ID NO: 188644

SEQ ID NO: 188743 - DNA, 601 bp, Human; identical to SEQ ID NO: 188645

SEQ ID NO: 188744 - DNA, 601 bp, Human; identical to SEQ ID NO: 188646

SEQ ID NO: 188745 - DNA, 601 bp, Human; identical to SEQ ID NO: 188647

SEQ ID NO: 188746 - DNA, 601 bp, Human; identical to SEQ ID NO: 188648

SEQ ID NO: 188747 - DNA, 601 bp, Human; identical to SEQ ID NO: 188649

SEQ ID NO: 188748 - DNA, 601 bp, Human; identical to SEQ ID NO: 188650

SEQ ID NO: 188749 - DNA, 601 bp, Human; identical to SEQ ID NO: 188651

SEQ ID NO: 188750 - DNA, 601 bp, Human; identical to SEQ ID NO: 188652

SEQ ID NO: 188751 - DNA, 601 bp, Human; identical to SEQ ID NO: 188653

SEQ ID NO: 188752 - DNA, 601 bp, Human; identical to SEQ ID NO: 188654

SEQ ID NO: 188753 - DNA, 601 bp, Human; identical to SEQ ID NO: 188655

SEQ ID NO: 188754 - DNA, 601 bp, Human; identical to SEQ ID NO: 188656

SEQ ID NO: 188755 - DNA, 601 bp, Human; identical to SEQ ID NO: 188657

SEQ ID NO: 188756 - DNA, 601 bp, Human; identical to SEQ ID NO: 188658

SEQ ID NO: 188757 - DNA, 601 bp, Human; identical to SEQ ID NO: 188659

SEQ ID NO: 188758 - DNA, 601 bp, Human; identical to SEQ ID NO: 188660

SEQ ID NO: 188759 - DNA, 601 bp, Human; identical to SEQ ID NO: 188661

SEQ ID NO: 188760 - DNA, 601 bp, Human; identical to SEQ ID NO: 188662

SEQ ID NO: 188761 - DNA, 601 bp, Human; identical to SEQ ID NO: 188614

SEQ ID NO: 188762 - DNA, 601 bp, Human; identical to SEQ ID NO: 188615

SEQ ID NO: 188763 - DNA, 601 bp, Human; identical to SEQ ID NO: 188616

SEQ ID NO: 188764 - DNA, 601 bp, Human; identical to SEQ ID NO: 188617

SEQ ID NO: 188765 - DNA, 601 bp, Human; identical to SEQ ID NO: 188618

SEQ ID NO: 188766 - DNA, 601 bp, Human; identical to SEQ ID NO: 188619

SEQ ID NO: 188767 - DNA, 601 bp, Human; identical to SEQ ID NO: 188620

SEQ ID NO: 188768 - DNA, 601 bp, Human; identical to SEQ ID NO: 188621

SEQ ID NO: 188769 - DNA, 601 bp, Human; identical to SEQ ID NO: 188622

SEQ ID NO: 188770 - DNA, 601 bp, Human; identical to SEQ ID NO: 188623

SEQ ID NO: 188771 - DNA, 601 bp, Human; identical to SEQ ID NO: 188624

SEQ ID NO: 188772 - DNA, 601 bp, Human; identical to SEQ ID NO: 188625

SEQ ID NO: 188773 - DNA, 601 bp, Human; identical to SEQ ID NO: 188626

SEQ ID NO: 188774 - DNA, 601 bp, Human; identical to SEQ ID NO: 188627

SEQ ID NO: 188775 - DNA, 601 bp, Human; identical to SEQ ID NO: 188628

SEQ ID NO: 188776 - DNA, 601 bp, Human; identical to SEQ ID NO: 188629

SEQ ID NO: 188777 - DNA, 601 bp, Human; identical to SEQ ID NO: 188630

SEQ ID NO: 188778 - DNA, 601 bp, Human; identical to SEQ ID NO: 188631

SEQ ID NO: 188779 - DNA, 601 bp, Human; identical to SEQ ID NO: 188632

SEQ ID NO: 188780 - DNA, 601 bp, Human; identical to SEQ ID NO: 188633

SEQ ID NO: 188781 - DNA, 601 bp, Human; identical to SEQ ID NO: 188634

SEQ ID NO: 188782 - DNA, 601 bp, Human; identical to SEQ ID NO: 188635

SEQ ID NO: 188783 - DNA, 601 bp, Human; identical to SEQ ID NO: 188636

SEQ ID NO: 188784 - DNA, 601 bp, Human; identical to SEQ ID NO: 188637

SEQ ID NO: 188785 - DNA, 601 bp, Human; identical to SEQ ID NO: 188638

SEQ ID NO: 188786 - DNA, 601 bp, Human; identical to SEQ ID NO: 188639

SEQ ID NO: 188787 - DNA, 601 bp, Human; identical to SEQ ID NO: 188640

SEQ ID NO: 188788 - DNA, 601 bp, Human; identical to SEQ ID NO: 188641

SEQ ID NO: 188789 - DNA, 601 bp, Human; identical to SEQ ID NO: 188642

SEQ ID NO: 188790 - DNA, 601 bp, Human; identical to SEQ ID NO: 188643

SEQ ID NO: 188791 - DNA, 601 bp, Human; identical to SEQ ID NO: 188644

SEQ ID NO: 188792 - DNA, 601 bp, Human; identical to SEQ ID NO: 188645

SEQ ID NO: 188793 - DNA, 601 bp, Human; identical to SEQ ID NO: 188646

SEQ ID NO: 188794 - DNA, 601 bp, Human; identical to SEQ ID NO: 188647

SEQ ID NO: 188795 - DNA, 601 bp, Human; identical to SEQ ID NO: 188648

SEQ ID NO: 188796 - DNA, 601 bp, Human; identical to SEQ ID NO: 188649

SEQ ID NO: 188797 - DNA, 601 bp, Human; identical to SEQ ID NO: 188650

SEQ ID NO: 188798 - DNA, 601 bp, Human; identical to SEQ ID NO: 188651

SEQ ID NO: 188799 - DNA, 601 bp, Human; identical to SEQ ID NO: 188652

SEQ ID NO: 188800 - DNA, 601 bp, Human; identical to SEQ ID NO: 188653

SEQ ID NO: 188801 - DNA, 601 bp, Human; identical to SEQ ID NO: 188654

SEQ ID NO: 188802 - DNA, 601 bp, Human; identical to SEQ ID NO: 188655

SEQ ID NO: 188803 - DNA, 601 bp, Human; identical to SEQ ID NO: 188656

SEQ ID NO: 188804 - DNA, 601 bp, Human; identical to SEQ ID NO: 188657

SEQ ID NO: 188805 - DNA, 601 bp, Human; identical to SEQ ID NO: 188658

SEQ ID NO: 188806 - DNA, 601 bp, Human; identical to SEQ ID NO: 188659

SEQ ID NO: 188807 - DNA, 601 bp, Human; identical to SEQ ID NO: 188660

SEQ ID NO: 188808 - DNA, 601 bp, Human; identical to SEQ ID NO: 188661

SEQ ID NO: 188809 - DNA, 601 bp, Human; identical to SEQ ID NO: 188662

SEQ ID NO: 188810 - DNA, 601 bp, Human
tcctgctgccccacatacacatcagctccctcccaggcttgtactgagcagaggcccccagagaaggagcagcgcccaccccacagaggaggcctcgatgctgtgtgcgcaggtgacaccacctgccctcaggacgtgacgctgcccaggctgcgggttgagaacgtaccactgaatcctggtgtcagctctgccagacgctgggagtaaaaggtgctggactgggtcagcttcaggctcttcaggtgctgctcaaaaatctcccgcctctcctgccagaaccaggggaggaaagacagtygggctcaagcctagttactgccacaggtgcggcatgtttgtctgtgggggggggggtccccaagtagctgggattacaagtgtgtgccatcatgcctgagttttgtatttttagtagagacggggtttcgcaaagttggctaggctggtctcgaactcctggcttcaagtgatccacctgcctcggcctcccaaagtgctggggttacaggcgtgagccaccatgcctggccacaagcagcattttaaacacgaacagaacactgttggatggccgggcccggtggctcacacctgtaat

SEQ ID NO: 188811 - DNA, 601 bp, Human
ctatctctggagacaacacagaccgggaaccaccgtctgcttttccaccccggggcggaggacggagtgcgggtgccgtctggacctcctgctgccccacatacacatcagctccctcccaggcttgtactgagcagaggcccccagagaaggagcagcgcccaccccacagaggaggcctcgatgctgtgtgcgcaggtgacaccacctgccctcaggacgtgacgctgcccaggctgcgggttgagaacgtaccactgaatcctggtgtcagctctgccagacgctgggagtaaaaggygctggactgggtcagcttcaggctcttcaggtgctgctcaaaaatctcccgcctctcctgccagaaccaggggaggaaagacagttgggctcaagcctagttactgccacaggtgcggcatgtttgtctgtgggggggggggtccccaagtagctgggattacaagtgtgtgccatcatgcctgagttttgtatttttagtagagacggggtttcgcaaagttggctaggctggtctcgaactcctggcttcaagtgatccacctgcctcggcctcccaaagtgctggggttacaggcgt

SEQ ID NO: 188812 - DNA, 601 bp, Human
gactgtgagggtcagagggaggcggctttgccgggactgcgtggtctgactctgggtctgacgggaaacgccggcatgactggtcactgtgtggaagcaacataactccactatctctggagacaacacagaccgggaaccaccgtctgcttttccaccccggggcggaggacggagtgcgggtgccgtctggacctcctgctgccccacatacacatcagctccctcccaggcttgtactgagcagaggcccccagagaaggagcagcgcccaccccacagaggaggcctcgatgctgtktgcgcaggtgacaccacctgccctcaggacgtgacgctgcccaggctgcgggttgagaacgtaccactgaatcctggtgtcagctctgccagacgctgggagtaaaaggtgctggactgggtcagcttcaggctcttcaggtgctgctcaaaaatctcccgcctctcctgccagaaccaggggaggaaagacagttgggctcaagcctagttactgccacaggtgcggcatgtttgtctgtgggggggggggtccccaagtagctgggattacaagtgtgtgccatcatgcctgagtttt

SEQ ID NO: 188813 - DNA, 601 bp, Human
gagacacagaaccgccaggctccatccgccctgacgcccgtctctcctcccaagggcagttagttccacaccccatcttgtggctgattccacctaacagctcatgagcattgatggcaaagaaattaaaggctctctagtaaccacaaaattctagtgaaagaccctaacgaataatcaaagggcaaattcatctcataataaaagggaggtttgttgacattaacttttaaaatgtgaaccacacagcaggaaaagcatcttgaggtatgatttctatttctacaacttgacagagacygtgagggtcagagggaggcggctttgccgggactgcgtggtctgactctgggtctgacgggaaacgccggcatgactggtcactgtgtggaagcaacataactccactatctctggagacaacacagaccgggaaccaccgtctgcttttccaccccggggcggaggacggagtgcgggtgccgtctggacctcctgctgccccacatacacatcagctccctcccaggcttgtactgagcagaggcccccagagaaggagcagcgcccaccccacagaggaggcctcgatgctgtgtgc

SEQ ID NO: 188814 - DNA, 601 bp, Human
ttcaactggcttgtggttcccactcagtccttcctgctttgctactattatcaaaagcttttcgatttccacataaaagtaaatggttacacgaaaataaatttcagtaagacacaggcagcgccagtcctctcgacccgcagggctgtcggagagaagccaggtgtgttttgcagtgtctggcacagcagctgccccactcctctgcaggaacccactgctttcccaagctgaagccctggggacctgcaagaggcgtgttcgtgctaggaattcactcgaattgagggtgaggaactcrgttctcgcagggatagctcgcaaaggaggctcgtgctcctcaaacacctggggcaagaaccacttcccttttcaaacgttcaacctgtctcacactgacagtgcgggtctgaactccattccatgagatgactgatcacgtctgggtgttgccatcatagctatggaaacctccagcagctccgattcccagtttggtcctctctcctcacagacgtcgcagaccccacactgagcagccacggaacggcagtcagaggcggtcagcccaccggtcacccgtcaccaaaactcatctccc

SEQ ID NO: 188815 - DNA, 601 bp, Human
tcagcttactggtgaggcttcatttcctgtctcagattttccacacatctgtaagtgtccattctgtacaacttgaatcagctcgtggtcctgagcactcaagtacgtcatgtattttctttcaactggcttgtggttcccactcagtccttcctgctttgctactattatcaaaagcttttcgatttccacataaaagtaaatggttacacgaaaataaatttcagtaagacacaggcagcgccagtcctctcgacccgcagggctgtcggagagaagccaggtgtgttttgcagtgtckggcacagcagctgccccactcctctgcaggaacccactgctttcccaagctgaagccctggggacctgcaagaggcgtgttcgtgctaggaattcactcgaattgagggtgaggaactcggttctcgcagggatagctcgcaaaggaggctcgtgctcctcaaacacctggggcaagaaccacttcccttttcaaacgttcaacctgtctcacactgacagtgcgggtctgaactccattccatgagatgactgatcacgtctgggtgttgccatcatagctatggaaacctccagcagc

SEQ ID NO: 188816 - DNA, 601 bp, Human
ctcactctgttgcccaggctggagggtagtggtgcgatcacggctcactgttgcttcaacctcccaggttcaagcaatcctcctgctgcagcctcctgagtagctgagaccagaggtgtgctccaccaccatgcctggctaatactctttattcttttcttttaagagatggggtcttgctgtattgcccaggctggtctcaaactcctggcctcaagcaaccctcctgcctcagcccccaaagtgctgggattacaggcatgagccacagtgcccagccagggacaaatgtttgcattamatctcccctgttcagcttactggtgaggcttcatttcctgtctcagattttccacacatctgtaagtgtccattctgtacaacttgaatcagctcgtggtcctgagcactcaagtacgtcatgtattttctttcaactggcttgtggttcccactcagtccttcctgctttgctactattatcaaaagcttttcgatttccacataaaagtaaatggttacacgaaaataaatttcagtaagacacaggcagcgccagtcctctcgacccgcagggctgtcggagagaagccaggtgtgt

SEQ ID NO: 188817 - DNA, 601 bp, Human
aaccctctgaggagtgtctcctcctgccccatggttgggggggtgccacagggtcggggcaagggtcacagaacagcagcttttgactttctccctggcaggatgggcagaggcctcctctgagttacgggcctcctgcttactttccctctcccctcagacctggaggcgcagctcccatccccatcactttctggatccttatggcttctactcaccccttcagaagctttttgcctcagggacaaggctttttttctgtcagtgacagggtctcactctgttgcccaggctggagggyagtggtgcgatcacggctcactgttgcttcaacctcccaggttcaagcaatcctcctgctgcagcctcctgagtagctgagaccagaggtgtgctccaccaccatgcctggctaatactctttattcttttcttttaagagatggggtcttgctgtattgcccaggctggtctcaaactcctggcctcaagcaaccctcctgcctcagcccccaaagtgctgggattacaggcatgagccacagtgcccagccagggacaaatgtttgcattaaatctcccctgttcagcttactggtga

SEQ ID NO: 188818 - DNA, 601 bp, Human
ccccaactcaaaacgacactcttcaggtcaaagggctgttgaaggaggtcgtgatttcttcttttataaatgttgcaatcatcgaaatagctcctgctgcttttaggaacaagtgcaaccctctgaggagtgtctcctcctgccccatggttgggggggtgccacagggtcggggcaagggtcacagaacagcagcttttgactttctccctggcaggatgggcagaggcctcctctgagttacgggcctcctgcttactttccctctcccctcagacctggaggcgcagctcccatcccmatcactttctggatccttatggcttctactcaccccttcagaagctttttgcctcagggacaaggctttttttctgtcagtgacagggtctcactctgttgcccaggctggagggtagtggtgcgatcacggctcactgttgcttcaacctcccaggttcaagcaatcctcctgctgcagcctcctgagtagctgagaccagaggtgtgctccaccaccatgcctggctaatactctttattcttttcttttaagagatggggtcttgctgtattgcccaggctggtctcaaactcctgg

SEQ ID NO: 188819 - DNA, 601 bp, Human
cggctctggacaccccaactcaaaacgacactcttcaggtcaaagggctgttgaaggaggtcgtgatttcttcttttataaatgttgcaatcatcgaaatagctcctgctgcttttaggaacaagtgcaaccctctgaggagtgtctcctcctgccccatggttgggggggtgccacagggtcggggcaagggtcacagaacagcagcttttgactttctccctggcaggatgggcagaggcctcctctgagttacgggcctcctgcttactttccctctcccctcagacctggaggcgcrgctcccatccccatcactttctggatccttatggcttctactcaccccttcagaagctttttgcctcagggacaaggctttttttctgtcagtgacagggtctcactctgttgcccaggctggagggtagtggtgcgatcacggctcactgttgcttcaacctcccaggttcaagcaatcctcctgctgcagcctcctgagtagctgagaccagaggtgtgctccaccaccatgcctggctaatactctttattcttttcttttaagagatggggtcttgctgtattgcccaggctggtc

SEQ ID NO: 188820 - DNA, 601 bp, Human
agctgcagctgcggctctggacaccccaactcaaaacgacactcttcaggtcaaagggctgttgaaggaggtcgtgatttcttcttttataaatgttgcaatcatcgaaatagctcctgctgcttttaggaacaagtgcaaccctctgaggagtgtctcctcctgccccatggttgggggggtgccacagggtcggggcaagggtcacagaacagcagcttttgactttctccctggcaggatgggcagaggcctcctctgagttacgggcctcctgcttactttccctctcccctcagayctggaggcgcagctcccatccccatcactttctggatccttatggcttctactcaccccttcagaagctttttgcctcagggacaaggctttttttctgtcagtgacagggtctcactctgttgcccaggctggagggtagtggtgcgatcacggctcactgttgcttcaacctcccaggttcaagcaatcctcctgctgcagcctcctgagtagctgagaccagaggtgtgctccaccaccatgcctggctaatactctttattcttttcttttaagagatggggtcttgctgtattgc

SEQ ID NO: 188821 - DNA, 601 bp, Human
tgctcctgccccgtgtggtcaaagcaagcctctctctgcacatctgcctcttggagctgcagctgcggctctggacaccccaactcaaaacgacactcttcaggtcaaagggctgttgaaggaggtcgtgatttcttcttttataaatgttgcaatcatcgaaatagctcctgctgcttttaggaacaagtgcaaccctctgaggagtgtctcctcctgccccatggttgggggggtgccacagggtcggggcaagggtcacagaacagcagcttttgactttctccctggcaggatgggyagaggcctcctctgagttacgggcctcctgcttactttccctctcccctcagacctggaggcgcagctcccatccccatcactttctggatccttatggcttctactcaccccttcagaagctttttgcctcagggacaaggctttttttctgtcagtgacagggtctcactctgttgcccaggctggagggtagtggtgcgatcacggctcactgttgcttcaacctcccaggttcaagcaatcctcctgctgcagcctcctgagtagctgagaccagaggtgtgctccaccaccatgc

SEQ ID NO: 188822 - DNA, 601 bp, Human
ctgtaatcccagcgctgtgggaggccaaggcgggcggatgacctgaggacaggagttcgagaccagcccgaccaatatggtgaaaccccgtccctactaaaaatagaaaaattagctaggtgtgatggcgggcgcctgcagtcccagctacttgggaggctgaggcaagagaatcacttgaacctgagagacggaggttacagtagggcaagatcatgccactgcactccaggctgggcgacagagcaagactccgtctcaaaaaacaaacaaaaaagaatgacgggggggtgagctgagrccccggcctctccctggctgggccctgctcctgccccgtgtggtcaaagcaagcctctctctgcacatctgcctcttggagctgcagctgcggctctggacaccccaactcaaaacgacactcttcaggtcaaagggctgttgaaggaggtcgtgatttcttcttttataaatgttgcaatcatcgaaatagctcctgctgcttttaggaacaagtgcaaccctctgaggagtgtctcctcctgccccatggttgggggggtgccacagggtcggggcaagggtcacagaacagcagctt

SEQ ID NO: 188823 - DNA, 601 bp, Human
agacccaccttcatcacggcctccgtgtgctccagcatccagcccaccaaggcgtggcccgactcatgaaacgcaaccactttctgttcttccttggacaggatcttgctctttttggcagtccctgaaagaatgccggggtatgagttgggcgcggtggctcacgcctgtaatcccagcgctgtgggaggccaaggcgggcggatgacctgaggacaggagttcgagaccagcccgaccaatatggtgaaaccccgtccctactaaaaatagaaaaattagctaggtgtgatggcgggcrcctgcagtcccagctacttgggaggctgaggcaagagaatcacttgaacctgagagacggaggttacagtagggcaagatcatgccactgcactccaggctgggcgacagagcaagactccgtctcaaaaaacaaacaaaaaagaatgacgggggggtgagctgagaccccggcctctccctggctgggccctgctcctgccccgtgtggtcaaagcaagcctctctctgcacatctgcctcttggagctgcagctgcggctctggacaccccaactcaaaacgacactcttcaggtcaa

SEQ ID NO: 188824 - DNA, 601 bp, Human
taacacgcaactttgctacaactcacacctgagaaccaatcacggagaccagcactgacaaaccaagctggcaactgctacagcgtatgcattgtttgcagtgaaccctgaggtaggaacacagcactgccgccttctcaggtgagcctcaaacctgcacggcttcctggggctccactgtaaagacggcacctgcgttccgagtagagacctcctcttggcagcactcggactcccggtggtggagccacgtcttagagaagctgtaacatcaccatttggtaagaataaatgtccatcragttcacagctgcctacaagagtagttttttgtttgtttgtttgaagtagagacagttttgccctgttggccaggctggtcttgaactcctgacctcaggtgatccaccatgcccagcctagaatagtattttttaaatgtacactcaactcacttctttccaatgttaggagtcatttggggtggacaggcaaaggcagcgaaaccccattgcatggtgtaaccttccacgagtcaccccagtagcagcaccatgctccgatgtgacacagcccactcctgcctcccacgtccgagttc

SEQ ID NO: 188825 - DNA, 601 bp, Human
cctgggtctattgctcggtgtatttatttgatattcttcccagattcacatctataatttcattaggagcatctatgtcctcatttgagaagaaaatactccacaggtgggaactacagcagagcccagaaggaagaaacccaggtggggcctgcagctgagctccgctggggcggccgtgggcgacccttgtgtggtagacccagggactccctccccggggagcacagagggcagcggtgtggccagagccgactcacatggtccatcatctgctgcaggccttggctgaaggggcgcygcccgatgcccatgaggccctcctgcgcctcagggaaggagatgggcccgatgccaggtgccatcccaaactgcttcaccatggagtaggcgatgcgggtgaccttcctcaggtcgtcctgtgcccctggagggcggggtcgagacagaggcatcctcagcactgcaggcgcagagcagtgctgggccccaggtgtcccggtcagagcactgaggcagcaccacctccatccccttcctcccgaggacccaccgtgaagctggacagtgaggacgttggcacctcaccactgttccttaa

SEQ ID NO: 188826 - DNA, 601 bp, Human
gacctgcccctggggtggcctggccagaccacagaaaacactgccacagccacatttcactggtttctgtgaaggcagaactcttccagattttttgttgttgttgttgttaattacctgctcctttcctcactcttccagattttctaaagaaaatggtaacccctgaagctagggtgatttacctgtggctgtattgcaagagacaaacacttcctctctagggctggtgtgggattttactaagttctgcaacccactgagtgtgtgagtagctgacagttcatacacggggcagacmcaccactcctcagccagtgagaagccttgcctgcagctttgctcccgttgtggctcccactgtgatgtgcccgagctctgcagagctgctttgtcaaccgtgatgagcatgggtccacaggcaggcctgcttcagccggggacggcaccgcccacacctgcccagaggcggctgctgctggctggggacgacagtctaagggccccaaacacgatccccacgtgacacacagtgctcgcttgaaagacacaaggggaggctgaagaaacaactacctatccactgcctacccatctgttc

SEQ ID NO: 188827 - DNA, 601 bp, Human
ggagtttttcacttagtccctgcattactcaaattataaactgaaaccacaagaccctgtgatccagggcaagcccaccagctcctctgcattagagctggccagacaatgcaaatgtagattttccaactacacagtttattagtaaagtatctcaacaattctcagagcagtaaaaaccaaggcatccccaacactgcatgcgtgactagaccagcaagaagtcctcaacttgcaccagtccacatggcagcagggggcagtggtgagtcctccggagcccagtgcctgggcctgactggccccattgatgagtgagctggatgacagggccgctggagataggacaatcggctcacagggtcctttcatgtccgatccccttagcattccgagggagccacaggaactggggcggtcgtgcaagcgtcggcatgaacaggggtctgtttggagtctgaatgctctgctgcctctgggtggcctcagccacactgggaacgactgtctataaccctgggaactcgaagtgttccatgctcactcgggaagcactgataaccttccccataggggaaacgactcacaaacacaggactcc

SEQ ID NO: 188828 - DNA, 601 bp, Human
aacacaactgcggatgcacctggagagcaaagccacacgctcgggaaactggggtgccctacgggcttcctgggccagcagctgccagcaggtaagtgtccaggctgtgccaagggctttgcagagggctgggaggggctgctgaaggcagcgggtagggttgtgagtaggctgaggccagagaaactgaccataatcccctacactttcacacttaaaatggtaatgataacaacaatgctaccttttaccgaggtttactaggagcccacgctagcccccatacgtgcactacccactrtcttctttaaacttcaaagaaatgctatgcagtggatcattcactgattgcatttttcagatgagaaactgaggcgtgtaatttgcccaagacttcaaagctagtagagggatggagatgagatttgaacctgaatttttgtgcctccaaagttgcatttgccccattaccctggggctgcctcagtcacctttactgttgagaagggatttttacagctattatccaatcaaataccattggatggatgaggtgttaagaacaatgaataaatggaggtgtgttcctgtatccacctac

SEQ ID NO: 188829 - DNA, 601 bp, Human
agcagctgccagcaggtaagtgtccaggctgtgccaagggctttgcagagggctgggaggggctgctgaaggcagcgggtagggttgtgagtaggctgaggccagagaaactgaccataatcccctacactttcacacttaaaatggtaatgataacaacaatgctaccttttaccgaggtttactaggagcccacgctagcccccatacgtgcactacccactatcttctttaaacttcaaagaaatgctatgcagtggatcattcactgattgcatttttcagatgagaaactgaggcrtgtaatttgcccaagacttcaaagctagtagagggatggagatgagatttgaacctgaatttttgtgcctccaaagttgcatttgccccattaccctggggctgcctcagtcacctttactgttgagaagggatttttacagctattatccaatcaaataccattggatggatgaggtgttaagaacaatgaataaatggaggtgtgttcctgtatccacctacaaccacgctgttcaatagaaatatgaactacattggtaattgacaagtttctattacccacagtaaaacacgtaaa

SEQ ID NO: 188830 - DNA, 601 bp, Human
acagccacacaccaagacatgcgacctctgtagttgagggtcaggatcccacatgggctcactttcctcttaagtgactataaatgagggcctgggtatgaataaagttctctttttcttcttttttaaaaaatcatggacttgaagatagagtaagaccaattgataaaatggagttattatttctttttttttttttttgagatggagtctcattctgtcacccaggctggagtgcagtggtgcgatctcaactcactgtaacctccacctcccgggttcaagcaattctcctgcctcrgcgtcctgagtagctgggattacaggtgcacgccaccacgcccagctaatttttttgcatttttaatggagatggggtttcaccatgttggccaggctggtcttgatctcctgacctcaggtgatccacccgcctctgcctcccagagtgctaggattacaggagtgagtcaccatgcccagcctggagttactttttctatattgcacagcccagcctttcagccatattaaactctattccatcaagaagaacaaaagaaaactccataattgagaaatgctcctgattttttcagtg

SEQ ID NO: 188831 - DNA, 601 bp, Human
caggcccccacccctttccaggcctagaggaaaggccacctcccagcccagtccttccacaacacgctgccttcatctcacttggggtcagaggcagccactctgcggtcctgggccccagaaatccagagctctctccctctgccctcacttaggccactctggctggggcttcatgcccacctttccagactctgggctctggtgttccgtgctcctcacagcactccttacccctcctgtttctccacctgcagctgcctcttcccccccttgtccacagaactcctcctggtcctgsagctcagttccatggcaaccctctgtgactcctcagggcccatgcagggcctgaggcctcagagcaagctctcagcaactgagccccaagttggcacctagagagaaattcgacctccttagcctgggccccaaacagagaatccaagagagacctcagtcactcaatagcacggtggggatgtccattttggtggcactttcttggatcaggctggagcaagcagtggggaaggtcagagcaggcaacaatttccataaatgtttgggaaacaacatttcctcttgctttcagaggggg

SEQ ID NO: 188832 - DNA, 601 bp, Human
agttggaaaggagacaggctctcctccctgccatcaccaccccagctagcacagaaagctcctggggccattctggggagtgggggccccctgtcccctggaatctccccacagcctgtctcacccccacccagaggagacaaagacaggttttcagaaaagccaggaagaggagccaggaggagggaaacaattgctgtcactgtgcagagagtcacatcatggaaagcaacacgaaactagggtgccaggagggctcacaccatggcagaatcaggaaggccgtcctggggaggggggatcttcctcatccttatatcactatgtaagtttggggccagggttggctccatgggtgcaccaccagtgaagtctcataggatgctgcactggagtgcagcgatgccatcagagatcactgcaacctcaagctcctggcctcaagagatcctcttgccttggcctcccaaagggcttggattataggtatgaggcaccgtgcccagccaatagttttatctttgaatttgtgttttaaaagtgaagtcttgtgggacaatggagtatggaccaggggctcttgaatggtcctacctccctc

SEQ ID NO: 188833 - DNA, 601 bp, Human
aaaggtctgcatgagcatccccattccccagggagtggaaattaaatagcagataaaaattaccataacaagttgaaacatgacagaagaaaggaaaaagcattatatttgagtaacttaaatcgcactttgttcctgctctttgaacatggggccccacattttgcactgggatccgcaaattatatagctggtcctagttagggttcatgcatatgaagttctgtttcaattccaaacctctctcctcccactcctcagctgtgttagaacctccaagcctcgctaagtggtgaaaacrgacagaaaaaccccaggtggcaactacagaggctgaggaagacctgggccatttccctctccagccttgctctgtgctcctgacttttcttaccaaatgaacgatgctgacaataggctctgatggcaacatcaggccctttcatcctcaaataggccaaacacaagcttggaataaggcagccttgtgcctcggagctgcagatgaaaggagagtggggtcagaggagcagccctcagagaccaggtgtcaaaacaaaaggaacagctgaagccagggggagaatgaagctgcctgagg

SEQ ID NO: 188834 - DNA, 601 bp, Human
caaccgtgtgatcttgagccaaggtcttcattgatctctgcatctcagtttctcatctgaataatgaggatgattagagacttcctttgacatgataaaatatctctaagaaggaaacactaggccttccacagaaattaagaatgagaaaaagatgcccgctctctctcgttggttagaggcagtagtcaatatgattagacaagagaaagtacttggtataagaattggaaagaaagagggaaaaatttggtctttctggaaatcccagaaggaacaatgtaaaaactatacgacaaamaataagatgatttagtgaagtagcacgttataaaataacatcaaaaagcaatgctgaggctgggcatgtgggcaaatgcctgtaatccaagtacattgtgaggccaaggcagaaggatcacttgagcctgggaggttgaggctgcagtgagccatgattctacaactgcactccagcctgggtgacagagcaagaccctgtctctaaaagaaaaataaataaataaatgctgctgggcatggtggtacaaacctgtagtcccaggtattcaagagggtgaagcagggggattgcttgagc

SEQ ID NO: 188835 - DNA, 601 bp, Human
ataaaattagatccatttcttgctgtaccctagggtcagttctaaatgtatcctagatataaaatcaaaaatgaaaccatacaagtagaaaacataggtgaattcctttataacttggatgtgggaaaaatttttcttgttacaattcaaaatacaaaagcaacaaaggaaaatattgataaatttgattaagaaaaattttaaaatgttgcatttcaaaatatcaccataagcaaaattaaaagataaatgacaaactagaaaaaaaaatgcaatgtaggatacaaaaggttaaaatagmcctattttatacacagcatttaaaatttgaggttaaaaaaagccgatagcactcttttatttttaaatgttagagatatgaacagacagttgacacaaaaaatagatgaaaatggctcctaatgtctcaactgcactcataataagagaaatttttaaaatctacctgagataccacttttacctatccaattagcaaaactctaaaagtatgtcaaactatttgttggtgaagctctagggaaacaggcaagtttatacagtgttgatgggaatagaaaatgttacaacccctatggag

SEQ ID NO: 188836 - DNA, 601 bp, Human
accacttttacctatccaattagcaaaactctaaaagtatgtcaaactatttgttggtgaagctctagggaaacaggcaagtttatacagtgttgatgggaatagaaaatgttacaacccctatggagaaaaatttggcaacatctagacaaattatataggcatttatgtatacataatttgacccagcagtcctgtttctaggacacactcccaatgacacactggcaaaaatatgaacaagaagtatgtacaaagctgttcactgcaatcctatctgtaataccaaaatactggaaamatccaaatacctcccaggaggggactcgttgaataaaccatgatgcatctgcaaaggaacaagaaatcgctctatagctactatggagtgatgatctccaggatatgttattgagctaaaaggcaagatggaaagagtgtgtatttcattctaccatctagctaagaaaagggaaggatatgaatatatacatacatatgtgtttacattggaaaaaatggaataaaacaaaccataagtatttttaaatgttacttataggagggtggaggggaaaaagtagcagggaaaggtagggca

SEQ ID NO: 188837 - DNA, 601 bp, Human
aactattccaagtggctttttaaaccacaggaatttaactgtacattcctagtggagatgcaaaagacaacagaaaaaaacccaacaatttttcagtaatcacattggtggtggtagcactggcactgttattctgacactggtgtgtgtgtgtgtgtgtgtgtgtgtgtgtgtgtgtactgtgggacagagtaagagagtaactatatttgtgttattgaaaactgagacttgaatgtgagtgaaaggagatacagttgtaagatgcatgacgtttagtgacaattctttagtcttgaawttaaatcagaattatcaatataaagtcatgatatatgtgatcatgaaaataaatatatgcctatttccaagtctgaccactgaaaagatctagaagcaatggccaacttagcgacaatgaacatttttagcctcagatttgggtctctaacaaccatctttcactaaaagaatggggggctccttgtagaaatggctgaatccaggttcgaggataggaaatatacaagacgagtctgaaacaccttgtcataccagaaagcaaggacgctatgaaaaactactacagtcatgtcagaag

SEQ ID NO: 188838 - DNA, 601 bp, Human
tgagacttgaatgtgagtgaaaggagatacagttgtaagatgcatgacgtttagtgacaattctttagtcttgaaattaaatcagaattatcaatataaagtcatgatatatgtgatcatgaaaataaatatatgcctatttccaagtctgaccactgaaaagatctagaagcaatggccaacttagcgacaatgaacatttttagcctcagatttgggtctctaacaaccatctttcactaaaagaatggggggctccttgtagaaatggctgaatccaggttcgaggataggaaatatwcaagacgagtctgaaacaccttgtcataccagaaagcaaggacgctatgaaaaactactacagtcatgtcagaagacttaggagtcaattcaaagaagctcccactaaccaaagatggttgggaatcaataagaatattatcagggcttccagtaaggtgaacaagaagacatccatgtgctgggagggtggctaccccaactccatggggacagaactcctgtgctcaggactcttctacacctcatgctgtggaatctaaagcaacagcaaagctgaggtccaactgccataaggatg

SEQ ID NO: 188839 - DNA, 601 bp, Human
gtgacagcacaaatgagctgcagcccagcagcaaagcacatctcgccaggctgaaaatacctttctaaccgctggacctaagtcacacattcagagcttttaatattgtgactatgtgaagcaattgaacatgaaattctgattgaacttgaactgcctttttgccttaatagtaaagaatgtaaaagtttagagatgttttaaagtttaaagaaagacttgtgagccacttccaagtgaatccatagagacctgttagctcccctcttgggaaatagacaaaatgtcatttacagttttsaaatattaaagtaagtcagttatagaataaaagcatgatccatcaagttttaaaagaatattattaagaacattaactgcaatagattgaaatccatcaaatatgtcagtataacaccgaaaaaaaaaaaaaaaactaattaatcacctttggagcccactgaggaaccaactcatttttaaaactggtaaataatgagagaaaataaagcattttcctgcctttcttataagacctataggtatatccagtaagaaaaataaataaagagaggaattatctttttatagatgtattcca

SEQ ID NO: 188840 - DNA, 601 bp, Human
aggctgaaaatacctttctaaccgctggacctaagtcacacattcagagcttttaatattgtgactatgtgaagcaattgaacatgaaattctgattgaacttgaactgcctttttgccttaatagtaaagaatgtaaaagtttagagatgttttaaagtttaaagaaagacttgtgagccacttccaagtgaatccatagagacctgttagctcccctcttgggaaatagacaaaatgtcatttacagttttgaaatattaaagtaagtcagttatagaataaaagcatgatccatcaakttttaaaagaatattattaagaacattaactgcaatagattgaaatccatcaaatatgtcagtataacaccgaaaaaaaaaaaaaaaactaattaatcacctttggagcccactgaggaaccaactcatttttaaaactggtaaataatgagagaaaataaagcattttcctgcctttcttataagacctataggtatatccagtaagaaaaataaataaagagaggaattatctttttatagatgtattccagctaataaagaaaaataatagaattattaattttatttatatctata

SEQ ID NO: 188841 - DNA, 601 bp, Human
aggcaataacaataatcaaatggctatgaccttcacaaaatgcgaccagcagccgttctgcatctcctggtggagtacacatcaccacctatgaagtagtcttgcaaacaaacaaaaaacctgaatatgattaagcctcaagataaaactactaatttacagaaaagaagggggtcagatgaacgggttaattctatagtaagctctactgtgtctggaaatttagttttaataaaggcagcacttgaagccaatagagggaagggtggactttttaataagtgatatttagacactagayagtcataaggaaaataataaaagtattattatagagatgaaaccagcaaaatccaaactctgggaaactataagacaaaagacccaattttttaacaaataaaaattgcaagggaaagaagcaagatggtaagagaaatctatacagtaaaagagactaaattaacatatcagcccatcaaaatgggctttatttggatcactatccaaacaattaaaaaatatattagacacgagaaaagataaacactatttgataattgagaaagtattacgaaagtattattaatttttagacgtg

SEQ ID NO: 188842 - DNA, 601 bp, Human
taaggaaaataataaaagtattattatagagatgaaaccagcaaaatccaaactctgggaaactataagacaaaagacccaattttttaacaaataaaaattgcaagggaaagaagcaagatggtaagagaaatctatacagtaaaagagactaaattaacatatcagcccatcaaaatgggctttatttggatcactatccaaacaattaaaaaatatattagacacgagaaaagataaacactatttgataattgagaaagtattacgaaagtattattaatttttagacgtgatcatsgttgtgaagtcatgtgttctttttaaagcattcttataatttgccagtacaggctgaaatatttgaagaagaaataatatgatgtctgggatttgttgaaaataatctcaggcagagtggcaagacgtgtgggcacaagtaaaacaaaataggccacgtgcttataatcaaggaagctgggtgatgcatatatgggggtccactataacagatttcttgtgactgacatttgaaatttttgtaaaaatgcagctagaagacctacctcatcgggttggtgcaggaatgtaaatgaaatga

SEQ ID NO: 188843 - DNA, 601 bp, Human
atccaaactctgggaaactataagacaaaagacccaattttttaacaaataaaaattgcaagggaaagaagcaagatggtaagagaaatctatacagtaaaagagactaaattaacatatcagcccatcaaaatgggctttatttggatcactatccaaacaattaaaaaatatattagacacgagaaaagataaacactatttgataattgagaaagtattacgaaagtattattaatttttagacgtgatcatggttgtgaagtcatgtgttctttttaaagcattcttataatttgcmagtacaggctgaaatatttgaagaagaaataatatgatgtctgggatttgttgaaaataatctcaggcagagtggcaagacgtgtgggcacaagtaaaacaaaataggccacgtgcttataatcaaggaagctgggtgatgcatatatgggggtccactataacagatttcttgtgactgacatttgaaatttttgtaaaaatgcagctagaagacctacctcatcgggttggtgcaggaatgtaaatgaaatgatgtgtgtaaatcgcctggcacataatcaatgctttaagtttgtgg

SEQ ID NO: 188844 - DNA, 601 bp, Human
ctctactcacccctgttctctcccctctcttcccacctcctcagctcctactgctagccctactgcccagagtacttccaggtaccattcccagctttcaactttacttcattttcatcatcttcattcccaccccccaggtaacctttctccagctctgaggagaaaggttaggtgatggagagatttattatcactcacccaccagggaaacacgggccttgttttgttcatctgcgcaatgaagatgaaaccattgctctcacatgaggagtaactgggacaaggaggagaagccccrggaggtcacgggagttcactgggtgtgggtacccagcgtccctgaggagattgcctgggaaatgaggcgctcatggcagcatccagcccacccaggccaggaacgtctccagggacagccttgggtaggcccctgaattcctgggtgcagttggcccagatccagccaccccccggaatgggcacaggcactctgggagttctctgggttcatcttctgtgaggcatgtccctgctcaatcccaccagccaaagaccactgagaacatacctatgtttttcctaacaaaatcatgttcct

SEQ ID NO: 188845 - DNA, 601 bp, Human
ggtaacctttctccagctctgaggagaaaggttaggtgatggagagatttattatcactcacccaccagggaaacacgggccttgttttgttcatctgcgcaatgaagatgaaaccattgctctcacatgaggagtaactgggacaaggaggagaagccccaggaggtcacgggagttcactgggtgtgggtacccagcgtccctgaggagattgcctgggaaatgaggcgctcatggcagcatccagcccacccaggccaggaacgtctccagggacagccttgggtaggcccctgaatwcctgggtgcagttggcccagatccagccaccccccggaatgggcacaggcactctgggagttctctgggttcatcttctgtgaggcatgtccctgctcaatcccaccagccaaagaccactgagaacatacctatgtttttcctaacaaaatcatgttccttccctaacaaaatcatttacttccgtaagactcatgaggataaaaccatccacagtcttcactgaactgcaggcctctgatatgacccttgtgttgcgtgacgtctgcaaacgttaacaagaactttcactctctgtct

SEQ ID NO: 188846 - DNA, 601 bp, Human
tccagctctgaggagaaaggttaggtgatggagagatttattatcactcacccaccagggaaacacgggccttgttttgttcatctgcgcaatgaagatgaaaccattgctctcacatgaggagtaactgggacaaggaggagaagccccaggaggtcacgggagttcactgggtgtgggtacccagcgtccctgaggagattgcctgggaaatgaggcgctcatggcagcatccagcccacccaggccaggaacgtctccagggacagccttgggtaggcccctgaattcctgggtgcarttggcccagatccagccaccccccggaatgggcacaggcactctgggagttctctgggttcatcttctgtgaggcatgtccctgctcaatcccaccagccaaagaccactgagaacatacctatgtttttcctaacaaaatcatgttccttccctaacaaaatcatttacttccgtaagactcatgaggataaaaccatccacagtcttcactgaactgcaggcctctgatatgacccttgtgttgcgtgacgtctgcaaacgttaacaagaactttcactctctgtcttaatttgggcc

SEQ ID NO: 188847 - DNA, 601 bp, Human
catccagcccacccaggccaggaacgtctccagggacagccttgggtaggcccctgaattcctgggtgcagttggcccagatccagccaccccccggaatgggcacaggcactctgggagttctctgggttcatcttctgtgaggcatgtccctgctcaatcccaccagccaaagaccactgagaacatacctatgtttttcctaacaaaatcatgttccttccctaacaaaatcatttacttccgtaagactcatgaggataaaaccatccacagtcttcactgaactgcaggcctctgwtatgacccttgtgttgcgtgacgtctgcaaacgttaacaagaactttcactctctgtcttaatttgggcctctccataacatacggggctacctaggaagatgggattatgtgcagtgtatttgtcaccttgggctgccagaacaaaggcccatggactgtcttcaacaacagaaaggcattttctccctattctggaggccagaagtccaagatcaaggtgtcagcaggattgtttcttctgaggcctctctccttggctcatggaagggcatcttcaccccgtgtcctcacacaggct

SEQ ID NO: 188848 - DNA, 601 bp, Human
ctccataacatacggggctacctaggaagatgggattatgtgcagtgtatttgtcaccttgggctgccagaacaaaggcccatggactgtcttcaacaacagaaaggcattttctccctattctggaggccagaagtccaagatcaaggtgtcagcaggattgtttcttctgaggcctctctccttggctcatggaagggcatcttcaccccgtgtcctcacacaggcttccctctgtacatctgtgtccaaacttcctcttctcagaagggcaccaggcatcttggagtagggcccaccrtcaggacctcattttaaccgaattacctctttaaagaccctttctccaaatacagtcacattctggggtactgggccttaggatttcagcacaggaatttgggggaggaaggacacgattcagcccgtaatacccattttacagataaagaaactgaggccacagttagtgttccagccaggatcaattcagtgttgtttctacccctaaaatactgtttaaaaacttcctgtcacattcatctataaggcccgagttagtcctgtcccagaaccctgaagggtaggcgggcccacagtc

SEQ ID NO: 188849 - DNA, 601 bp, Human
ggcccatggactgtcttcaacaacagaaaggcattttctccctattctggaggccagaagtccaagatcaaggtgtcagcaggattgtttcttctgaggcctctctccttggctcatggaagggcatcttcaccccgtgtcctcacacaggcttccctctgtacatctgtgtccaaacttcctcttctcagaagggcaccaggcatcttggagtagggcccaccgtcaggacctcattttaaccgaattacctctttaaagaccctttctccaaatacagtcacattctggggtactgggscttaggatttcagcacaggaatttgggggaggaaggacacgattcagcccgtaatacccattttacagataaagaaactgaggccacagttagtgttccagccaggatcaattcagtgttgtttctacccctaaaatactgtttaaaaacttcctgtcacattcatctataaggcccgagttagtcctgtcccagaaccctgaagggtaggcgggcccacagtctatgtagagtgcccgtttgataagatagagctatagtcgacacaggccccactctgtgagttcagactttgggatg

SEQ ID NO: 188850 - DNA, 601 bp, Human
aggacctcattttaaccgaattacctctttaaagaccctttctccaaatacagtcacattctggggtactgggccttaggatttcagcacaggaatttgggggaggaaggacacgattcagcccgtaatacccattttacagataaagaaactgaggccacagttagtgttccagccaggatcaattcagtgttgtttctacccctaaaatactgtttaaaaacttcctgtcacattcatctataaggcccgagttagtcctgtcccagaaccctgaagggtaggcgggcccacagtctaygtagagtgcccgtttgataagatagagctatagtcgacacaggccccactctgtgagttcagactttgggatgtgcctctttttctgtccttctctgcctcttttaatttggaagaaactgtcagaaagggtgattgatccttctgcaagcacatctctaactggaactaactgctttaaccaggacgcatgaggctgggcggcttccgacccatcagatggctcagaactgagacttgcaagtttaatagctttgctgctggggaatagcacagccctcctcgggatttctcattgtct

SEQ ID NO: 188851 - DNA, 601 bp, Human
tgtttaaaaacttcctgtcacattcatctataaggcccgagttagtcctgtcccagaaccctgaagggtaggcgggcccacagtctatgtagagtgcccgtttgataagatagagctatagtcgacacaggccccactctgtgagttcagactttgggatgtgcctctttttctgtccttctctgcctcttttaatttggaagaaactgtcagaaagggtgattgatccttctgcaagcacatctctaactggaactaactgctttaaccaggacgcatgaggctgggcggcttccgaccyatcagatggctcagaactgagacttgcaagtttaatagctttgctgctggggaatagcacagccctcctcgggatttctcattgtctttttcagtgattttaatactcagaaaaatgtgctgagcagtcagcactcaaggcagaatgactttatctgagtagagttcagagacgccccatggtgtgtggctccggctccgccaaaccactccgccacaggaggtgagcacctgctcgggtgggcgaggcctggcatgagggatttccacagactgctgggacccctgcccccgacagggg

SEQ ID NO: 188852 - DNA, 601 bp, Human
aagggtgattgatccttctgcaagcacatctctaactggaactaactgctttaaccaggacgcatgaggctgggcggcttccgacccatcagatggctcagaactgagacttgcaagtttaatagctttgctgctggggaatagcacagccctcctcgggatttctcattgtctttttcagtgattttaatactcagaaaaatgtgctgagcagtcagcactcaaggcagaatgactttatctgagtagagttcagagacgccccatggtgtgtggctccggctccgccaaaccactccgycacaggaggtgagcacctgctcgggtgggcgaggcctggcatgagggatttccacagactgctgggacccctgcccccgacaggggcgatcacctctcaccaccacctagcccagtggtaggggccaagatgccagtctccacggagtgaggcacggctctgttaaatcccaccagccaaagacccctgagcacatactcataggtggaaagagtgtattagcatgccgcagcaacagaaaaatgtaccaggagaacccgggacatctcaggaaaagggagttgggaggggcttgttatg

SEQ ID NO: 188853 - DNA, 601 bp, Human
aatctttacacaagaggtagaaggaatgaagcaggcatagagctgctgttagtaaagaagcagcagtcatcactcgaatcagctggaagaggggatgttgagtttttgtggttgcagagcgtccttgcctctctgtccagatagaatcaccgcgtgcccttgtctccatctccttccaccatgatcacagagtgagctggtctgattattgctgatattctgtaaacgctcgtgcataggtgagaatactctggtctagctgtcagctgccaacggtcagggccatggttttccttccttrcagcaagcaggcatcctcagcctcctcctccacagtagtgggaggaccacggagtcagaacggaggtgcaagcgacctctcttctcacgtgtcctgtgcagcccctgtgaggctgggggctgagaggtaattgtttgggctgtgctgtgactttaggagcagggcccactctgtgcctctcacgtgctgagcagagtgtgtccctggaatccacactcctacctgtctcacccatctctcccccagagtctatcttggcagtcctgcatctatgcaatcaactgagttagaacatagcaa

SEQ ID NO: 188854 - DNA, 601 bp, Human
atgcgtcgggaagggaggaacctgtcctctctggctcctgctgtttctctatcacccaggatggcggccagcacatagatgcatgataaatattggttaaatcaacaaatggaagtgccccacaaagtaatcagttaataagaggcagctatgttggtttcccagggctaccataacaaaggattacaaactgggtggcttaaaacaacagaaagctattctctcacaggcctggagactagaggctggaaaccaagatgttagcaggggcagctccttgtgaggactgtgagagagaatyggtcccaggctgctctcccagctctggtgatggcgggcaatccttggccttccttggcccgtagatgcatcacccccatctctaccttcattcttccatatgtctgtgtccaaattttcctcttttcataaggatgccagttacattagatgagagcctaccctaatgacctcaacttgatgacatctgtaaagatcttatttccaaaaaaaaggtcaccttcacaggtactgggggtcaggactgcaacttatcttttggatggtacacaattgaatccataacactggctattgttct

SEQ ID NO: 188855 - DNA, 601 bp, Human
tttctctatcacccaggatggcggccagcacatagatgcatgataaatattggttaaatcaacaaatggaagtgccccacaaagtaatcagttaataagaggcagctatgttggtttcccagggctaccataacaaaggattacaaactgggtggcttaaaacaacagaaagctattctctcacaggcctggagactagaggctggaaaccaagatgttagcaggggcagctccttgtgaggactgtgagagagaatcggtcccaggctgctctcccagctctggtgatggcgggcaatcyttggccttccttggcccgtagatgcatcacccccatctctaccttcattcttccatatgtctgtgtccaaattttcctcttttcataaggatgccagttacattagatgagagcctaccctaatgacctcaacttgatgacatctgtaaagatcttatttccaaaaaaaaggtcaccttcacaggtactgggggtcaggactgcaacttatcttttggatggtacacaattgaatccataacactggctattgttcttttcacattatagtcctgattcccaacattttgtcctgttttg

SEQ ID NO: 188856 - DNA, 601 bp, Human
ttaaatcaacaaatggaagtgccccacaaagtaatcagttaataagaggcagctatgttggtttcccagggctaccataacaaaggattacaaactgggtggcttaaaacaacagaaagctattctctcacaggcctggagactagaggctggaaaccaagatgttagcaggggcagctccttgtgaggactgtgagagagaatcggtcccaggctgctctcccagctctggtgatggcgggcaatccttggccttccttggcccgtagatgcatcacccccatctctaccttcattcttycatatgtctgtgtccaaattttcctcttttcataaggatgccagttacattagatgagagcctaccctaatgacctcaacttgatgacatctgtaaagatcttatttccaaaaaaaaggtcaccttcacaggtactgggggtcaggactgcaacttatcttttggatggtacacaattgaatccataacactggctattgttcttttcacattatagtcctgattcccaacattttgtcctgttttgtcaactgtcatttaaaaatgttgcagaaatatcagtatttctgcacctaaccc

SEQ ID NO: 188857 - DNA, 601 bp, Human
ccttgtgaggactgtgagagagaatcggtcccaggctgctctcccagctctggtgatggcgggcaatccttggccttccttggcccgtagatgcatcacccccatctctaccttcattcttccatatgtctgtgtccaaattttcctcttttcataaggatgccagttacattagatgagagcctaccctaatgacctcaacttgatgacatctgtaaagatcttatttccaaaaaaaaggtcaccttcacaggtactgggggtcaggactgcaacttatcttttggatggtacacaattraatccataacactggctattgttcttttcacattatagtcctgattcccaacattttgtcctgttttgtcaactgtcatttaaaaatgttgcagaaatatcagtatttctgcacctaacccatttcatcctctcttccttttgtacttgaaattaaattccacatcctggctgggcgtggtggctcacgcccgtaatcccagcactttgggaggccaaggcgggtggatcacaaggtcaagagatcaagaccatcctggcctacgtggtgaaaacccgcctctactaaaaatacaaaaat

SEQ ID NO: 188858 - DNA, 601 bp, Human
attgtcatggtagctactataaggctggcacaggtttcggttttattatggtcattcatgagatttttaatgagggcttactatgcaccaagcactatgggagttcaaatatcagagccaaaattcttggactctgggacctggaggtctagaagggatgaagtgtaaacaaatccacacactggtccatccctgttacatgccaagcactgtgctgggcacgtgatggatgtcaaccgtaggtcaaacaggaaggactcacgaagtacagttacaaatgcagctttggtttgatagggcyctctcccaagatccctttcaacttgctcagtgggtggtagacattcttcccagcccctgggcgaaaacatggagggtcccatgatttttctgatcacttgcaggaaactaaaaacgtcacactcgttttaagccacaaaacagtatcaactcaggaaatagaatgtccagttgatatattattcaacatatcaaccctcactttctcccctgcccaggtagggccaagcacctagcaaggatgctgaagtcagttccgtctctctttcctgctattctcctcactcccacttccctgtgg

SEQ ID NO: 188859 - DNA, 396 bp, Human
aacagtatcaactcaggaaatagaatgtccagttgatatattattcaacatatcaaccctcactttctcccctgcccaggtagggccaagcacctagcaaggatgctgaagtcagttccgtctctctttcctgctattctcctcactcccacttccctgtggctgtttctagcccagttgaaatctaagcaggacaaagggacgggaaagggaaagggaaagggaagggaagggaagaagggaagggaagggaaataaagaagggaagggaaataaagaagggaaaggaagggaagggaakggaaataaagaagggaagggaaggcaagggaaataagagaaaggagggcaagggaaggctagggaaggcaagggaagggaggggagggggaagag

SEQ ID NO: 188860 - DNA, 601 bp, Human
ctacgtgatatgggcatgtgcctccagcaagtacagggcagagagagagaaacatcatttaagtggtgctggcattaagtggtgatgacatagcctcatgtccagtactgagtgggagatggaaagcatgcatttgcttcctttccagacaggctggctcatttcccctgtgcctctcatgatgagaggattatgcatgctgagtatgatgctggtgattcaagtgaggaagtttccagataccatgcatgactcctggtttaagccaattatctcatcatggttcaaccaaagaaacaayaatttattcaaatgctggagaaaactcccagccatgctggttttattgattctgggtctccaagatggtgcccttctaaagaatttccaaggatcattttgtgcaattgcaatgttctccttagaccttcgtcaccattggtgggacttcagtgcttagcagctcaaggaacccagcatgttctccgtagctgtatcctctagatcctcacagcctccctttagaataagcagaacaggtgtcattacctcctttttacagataaagaaactgaagctcagcagtgataaatacgatgtc

SEQ ID NO: 188861 - DNA, 601 bp, Human
atgattcttccagtaggacatcagacacatccatcctggcaacaacacactaaactgtccattacgtcccactggaatcaattgaggttatgtttctgacaacagagaatagtttgttcccttcgttacattagcctgggccaaggggtaaagcatatctatccctttattgcccgtaagtgtcccttagttccagtggagattaagaaaactggaatttattgagcacatactatatgccagaatttgttctgagggttttgcacatcttaaatcatttaacctcacaaaaaccctatgrggccattccttgtatgattcctttttatagatgaggaaactgatacacagcaccagttaaataacttttccaagattcacaggttgaagtgatagagacaaaacctttaacgtgggtagttggattccagagtctgtatgcccgggtccactctcgacagactaaagctcaaaacagtttgaccttgaggttttccaggaggaaaagcatgaggctgaggagaacacttatgttagattggattcctgagacgcaaagcccaagcctagggttctcttgtgggccacgtagtatggaagt

SEQ ID NO: 188862 - DNA, 601 bp, Human
aatcaattgaggttatgtttctgacaacagagaatagtttgttcccttcgttacattagcctgggccaaggggtaaagcatatctatccctttattgcccgtaagtgtcccttagttccagtggagattaagaaaactggaatttattgagcacatactatatgccagaatttgttctgagggttttgcacatcttaaatcatttaacctcacaaaaaccctatgaggccattccttgtatgattcctttttatagatgaggaaactgatacacagcaccagttaaataacttttccaagrttcacaggttgaagtgatagagacaaaacctttaacgtgggtagttggattccagagtctgtatgcccgggtccactctcgacagactaaagctcaaaacagtttgaccttgaggttttccaggaggaaaagcatgaggctgaggagaacacttatgttagattggattcctgagacgcaaagcccaagcctagggttctcttgtgggccacgtagtatggaagtgctcctggagaaacccgcaagaggcagggaggcaggacacggagggaagaccaagcaagggagccacctcagggc

SEQ ID NO: 188863 - DNA, 601 bp, Human
tgatacacagcaccagttaaataacttttccaagattcacaggttgaagtgatagagacaaaacctttaacgtgggtagttggattccagagtctgtatgcccgggtccactctcgacagactaaagctcaaaacagtttgaccttgaggttttccaggaggaaaagcatgaggctgaggagaacacttatgttagattggattcctgagacgcaaagcccaagcctagggttctcttgtgggccacgtagtatggaagtgctcctggagaaacccgcaagaggcagggaggcaggacacrgagggaagaccaagcaagggagccacctcagggctgccccacccccaagccagggcgctgggctttcatgcccccagctgtcagacagagccagtaagtcaagctctggggccctagggcactgctccacaaatgagccacagggcccagctgtggggagtgaatgcacatggaacgtggggacacaaaaaaatagttccaaaaaaaaaaagaggatgggtcagagcagtgacagtacctgctgcagcagccacgcctgggataggaaaggagcacctgtgatctgccgtaagcctcaac

SEQ ID NO: 188864 - DNA, 601 bp, Human
cagcaccagttaaataacttttccaagattcacaggttgaagtgatagagacaaaacctttaacgtgggtagttggattccagagtctgtatgcccgggtccactctcgacagactaaagctcaaaacagtttgaccttgaggttttccaggaggaaaagcatgaggctgaggagaacacttatgttagattggattcctgagacgcaaagcccaagcctagggttctcttgtgggccacgtagtatggaagtgctcctggagaaacccgcaagaggcagggaggcaggacacggagggargaccaagcaagggagccacctcagggctgccccacccccaagccagggcgctgggctttcatgcccccagctgtcagacagagccagtaagtcaagctctggggccctagggcactgctccacaaatgagccacagggcccagctgtggggagtgaatgcacatggaacgtggggacacaaaaaaatagttccaaaaaaaaaaagaggatgggtcagagcagtgacagtacctgctgcagcagccacgcctgggataggaaaggagcacctgtgatctgccgtaagcctcaacaggtccc

SEQ ID NO: 188865 - DNA, 601 bp, Human
cttgtactctgtcctgattgaattccacccccacccccccagaggtcactgctgccctaaatttggtgcttaccactcccatgaaagttttactacatatgtataaaacctttcctaggactattttgcattattttaaactttatgttaaattgtgttatactgtgtattagtcagggttctccagggaaacataaccatagaatgtgtacagagagagatttattttagggaattggctcacacagttatggaggctagaagtccaagatcaaagtgtcagcaggttgggaggcccagkgaagaggtgacactgcagttcaaggctgaaggctgtctgctggtggaatcctattttctcaggggacctcagtctttgctctgttaaatcccgcaactgattggatgagaatacccacattatggcacgcaggcaacctgctttactcaaagtccaccaatgtcaatgttagtctcatccaaaaacaccttcacggaaacatctagattgtttgaccatcacatattatttccatctgcaacttactttcttcacttattgtgtttttgagatttatctgtgttgacaaatctatcattt

SEQ ID NO: 188866 - DNA, 601 bp, Human
cctgattgaattccacccccacccccccagaggtcactgctgccctaaatttggtgcttaccactcccatgaaagttttactacatatgtataaaacctttcctaggactattttgcattattttaaactttatgttaaattgtgttatactgtgtattagtcagggttctccagggaaacataaccatagaatgtgtacagagagagatttattttagggaattggctcacacagttatggaggctagaagtccaagatcaaagtgtcagcaggttgggaggcccagtgaagaggtgacrctgcagttcaaggctgaaggctgtctgctggtggaatcctattttctcaggggacctcagtctttgctctgttaaatcccgcaactgattggatgagaatacccacattatggcacgcaggcaacctgctttactcaaagtccaccaatgtcaatgttagtctcatccaaaaacaccttcacggaaacatctagattgtttgaccatcacatattatttccatctgcaacttactttcttcacttattgtgtttttgagatttatctgtgttgacaaatctatcatttcattgtatatga

SEQ ID NO: 188867 - DNA, 601 bp, Human
aaccatagaatgtgtacagagagagatttattttagggaattggctcacacagttatggaggctagaagtccaagatcaaagtgtcagcaggttgggaggcccagtgaagaggtgacactgcagttcaaggctgaaggctgtctgctggtggaatcctattttctcaggggacctcagtctttgctctgttaaatcccgcaactgattggatgagaatacccacattatggcacgcaggcaacctgctttactcaaagtccaccaatgtcaatgttagtctcatccaaaaacaccttcacrgaaacatctagattgtttgaccatcacatattatttccatctgcaacttactttcttcacttattgtgtttttgagatttatctgtgttgacaaatctatcatttcattgtatatgaggggacttcaaaatgttcctggaaaaaaaatggaattaagagataaaaatacaaaatgtaaactttttttttttttattatactttaagttttagggtacatgtgcacaatgtgcaggttagttacatatgtatacatgtgccatgttggtgtgctgcacccattaactcgtcatttagcatt

SEQ ID NO: 188868 - DNA, 601 bp, Human
ggtttccagtttcatccatgtccctacaaaggacatgaactcatccttttttatggctgcatagtattccatagtgtatatgtgccacattttcttaatccagtctatcattgttggacatttgggttggttccaagtctttgctattgtgaatagtgccgtaataaacatacgtgtgcatgtgtctttatagcagcatgatttataatcctttgggtatatacccagtaacgggatggctgggtcaaatggtatttctagttctagatccctgaggaatcgccacactgacttccacaayggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgattttcttctgcaatgccgcttgaccccaatacatactcgacagtagttccaaatagccagaaaacggcactttcaatttttccaccctacaagatctaaataattcttgtcataaaatgggcaaatggtctgaggtgcctgacgtc

SEQ ID NO: 188869 - DNA, 601 bp, Human
ctccacatcctctccagcacctgttgtttcctgactttttaatgatcgccattctaactggtgtgagatggtatctcattgtggttttgatttgcatttctctgattttcttctgcaatgccgcttgaccccaatacatactcgacagtagttccaaatagccagaaaacggcactttcaatttttccaccctacaagatctaaataattcttgtcataaaatgggcaaatggtctgaggtgcctgacgtccaggcattcttttacgcatcggtccctctctagtctctgttcccaatgcractcatcccaaatcttccttctttccctcccgcctgtcccctcagtcccaaccccaagcgtcgctgagtctttctaatcttccttttctacagacccatctgacctctcccctcctcaccaggccgagctaggtcccaattcttcctcagcctccgctcctccaccctggtccgctccttttatcacctcccctcctcacacctggtccggcttatggtttcattccgtgactagccctcccccacctgcccagcaatttactcttaaaaaggtggctggagctgaaggcatagtcaagg

SEQ ID NO: 188870 - DNA, 601 bp, Human
tagactcctaggcaagtgtggataatgctgttctggagcctgcatcatccaccttctacctcaggggaagctggcaggataacagagccatgattatccagctcacacccctccttgtagacataaagtaggccccaagggctcaaagattttgcccactgtcagttggtttagagcagggttctcaaactctggaatgctcagaatcacccaggggccatatagaaaacagagattgctgcgccccaccctgttgaatttctgactcaatgggtctggagaagggccccaaatttatatkcctaacaagttcccagggatgctgatcctgctggtcctgggactcaaatactttgagaactactagcttacagtaatgattctccaacctgggcatatcagaattacctgggcacttaaaaatgtcagtgcagtgcacaagccatagactaattaaatcagagtccccaggggttgggtccaggcttcagcagttttagagctcaccaggtgacttaatgtgcatccaggcttgagaaccgtgctcagctacacctcccactcagtccctgaaggcatctgggtttgcagccactctcct

SEQ ID NO: 188871 - DNA, 601 bp, Human
cctgagttttccctggagttctgtgttgcaacactcccatgaggctggtagcccgggaagccaggttatcagaagttggctgcaattgccttcattttaataaatcaatgtgtgacaactgcactaacagtgccctcaaatctattgaaacagtgacttttaccattcattgtctaactatcacataattggcctgttggtaacatttataatctgattctttttcttttgggctactcagttatgctaattaagttcctttatctgcagatatgaaaatgagcagccatttcgaaaggcrgcagaagaggaaattaactctctgtataaagtcattgatgaggctaatttgactaaaatggacctggagagtcaaatagaaagtctgaaagaagaacttggctctctatcaagaaactatgaagaggtaggagggggctggggttgctgggttggccacaagaccagaagttcacatctgtctgcctgtgcttcataacaaggccacagtagctcatttctgactctccacattgcgtgcccaggactgcagggaacatacctgtaaaatactttcagatccttgaagtgggtcaggtta

SEQ ID NO: 188872 - DNA, 601 bp, Human
cagcagtttgcaaactttgcttctgtcccagccctcctgcggtgtgcaccacactgtggtaactgtttctttgggaaaggacagactattataattatcagaaataaatccttcatagtatgaaaaagaaaaaaaaaaggtcattattatctcctcctcaccccttggagaatcatcactagcccaacagtaactcaaacattaattctgaacagattcattagtgtttttttaatagagtaatctgaaagctacatctcagagaaaacagacagtatttgttttagcttggccaatgctkcctgggcctcttgcagaaaggcagagctcagaaaatatttgcagaatgagtgaattcctctgatcatcaacagagatctgaactgacagccagaattcctccaataaatagttttgtcagttgcagttgtgccctcaggggctgacatttgcccatcctgagcatctcttgtcggtttcttggcggcatagcataaatgtgaaatggcttagcacacacagctttcaaaagcttttgtaaagaaaatgcaagcatgcatttaattacctttcggaccacagaggctgaaaattaattaac

SEQ ID NO: 188873 - DNA, 601 bp, Human
gttcccacaacctcctctgcagagggataagtagatagtttgctagaacagtgcccagaactcaaggaaacactttacatatttttgccagcttattataaaggatacaattcaggagcagccaaatggaggagatgcttaaggcaacgtatgtgagaaggggcacagagtccccaactccaaatttttgactctattataataacacttggcttaaaatgcaaacacgtcatacagctatacaaaaatattctttcttttatccttattctataagcttgttttctatttttaagagggkttttttttaaccttttaaactttttttgttaaaaactaagacacatacatacacattagcctaggcctacacagggtcaggatcgtcaatatcactgtcttccacctccacatcttgtcccactgaaaggtcttcaggggcagtgacatgtgtggagctttcagctcctgtaacaacaatgccttcttctggaattcctcctgaaggacctgcctgaggctgttttaccgttaactatttttcttttttaataagtaggagtacgctaatgataaaaagtatagatacagtaaatacata

SEQ ID NO: 188874 - DNA, 601 bp, Human
tttgtagaaacaggatttcagtatgttgcccaggctggtcttgaactactggcctcaagcaatctttctgctttggcctcccaaagtgctgggattgcagatgtgagccaccatgcccagctgatttcttttttaagaataaataagtgacatcttgtggaatgtgaggttggagaggcctttgtccccggggggctaaaagttatgccagacttctgttgggagcttttcaaaccaagcgtctgtgccctccttgtgggattcttctatgacacaagatagggaacccctgtattcccaygggaccattgtttacctttctccatgaacagcacgatgagattagcatgatctcatgaaatctgaaaagtgcttaagagccaaggcaggtagctgcattctgcagtagaacaatgctcatataaagcaattgatcaccagttgcaaaaaccagagtgctcgagtgacttgctcaaacctgcacagcaactgcttagtgaaaggcagaagacacatgaggcagacagctcatctggatacatgatctgctgagaatgcacttgcaatttcaaagaccaggaagtatcaacattctctctcc

SEQ ID NO: 188875 - DNA, 601 bp, Human
tttaatttgaaatttttgaaatttgaaaatctttattatgtttcaaaatgtcgacatgctctcctgccccagaagtaattgcactcctaccctgctggagtgcaaacacgggcggctcaggtcctgtgcagtttcaaagcctagggatcaacatatctgaatttcatcacacaccctaacaactgcactgggcaacaaaacacagccccaccttcctatcctcaggggctagatgacacacctactctctggtctatgagaagaaatctggaggcacagggttgaaatggaaacagaaatrgagttataataaccagaaagcacaaatctaaaaagccattggataaaaatgtgtaatacttttaggtgaattacttttagcagtggttactttaggtgagttaaagcaattaagtgggaagtatctcttgtggtgagatgatttgagaaggaacacagtgacattaaaacttgtagtgatcaaattacattcttttgctctttcaatcttaaactagaagaaagcctctgttcagtgctgggaggtctttaacacctctgttgtacttatttatctcccctttccacaaagagaaagcag

SEQ ID NO: 188876 - DNA, 601 bp, Human
ctgcaagggatactgtttcattggtttctgcagcgatctagaattttgcttccatggaccaggcaggcatcacctgggagtgcagatttctgagctgtactcaggatcccctgcatcagagcccacattttctcaagatcctaaggtgacgctcatgcgcatttaacctatagtttccattttaaactaacctacagtttacagataactaacctacagtttccattttaaacacgtttatttgtaaaaaaaagagtgaattggtttaaataaaaatagcatgaatgagtattaagagagwgtgaaaaaccatgtcagtggtgcaagaacatttgagaaacacctaaatacagtatttttgctaatgaaactaagacatggtgtttcagccaagaaaccagtaaatatcacggaagctgctcactggattgagaggggacaaatcatgtgagggactgtggctatagccttggccagcagctttacactagacctgcacaccaaggctttgaaacttgcctccattccttccctggcttttccgtatggagtgatggtaaatgtttcacaactgctttctgggtgaaatatatgtatatgt

SEQ ID NO: 188877 - DNA, 601 bp, Human
agccttggccagcagctttacactagacctgcacaccaaggctttgaaacttgcctccattccttccctggcttttccgtatggagtgatggtaaatgtttcacaactgctttctgggtgaaatatatgtatatgtatatatgtgccaatcacattcacaatactgcttaagggtaatgtaacaattcccactgatttttttatatataattttagaaataacacaaattttaagacaaaatactttgctatttcaattacacctataacttcagcatgacttgctatttcttggaaaatwcaccaaccattttttataattctatcatcaacaatagtatcacaaaatcagactacaaaaaatgcttgattactaatttctgattaagcaaaaagtcactcacattatttgttactggtggcaaatctgtagggggtctgaagcaacctcaattcttgcctcctcagaagaaagaattcaactgaagggcataaagcagaagagacggaggcaagttttagaacaggagtgaaagtttatttaaaaactctagagcagagaccgggcgcggtggctcacgcctgaaatcccagcactttg

SEQ ID NO: 188878 - DNA, 601 bp, Human
tcatcaacaatagtatcacaaaatcagactacaaaaaatgcttgattactaatttctgattaagcaaaaagtcactcacattatttgttactggtggcaaatctgtagggggtctgaagcaacctcaattcttgcctcctcagaagaaagaattcaactgaagggcataaagcagaagagacggaggcaagttttagaacaggagtgaaagtttatttaaaaactctagagcagagaccgggcgcggtggctcacgcctgaaatcccagcactttgggaagctgaagccggcggatcaackgaggtcaggatttcgagaccagcctggccaacatggagaaaccccatctctactaaaaatacaaaaattagccgggcatggtggcaggcgcctgtaatctcagctactcgggaggctgaggcaggagaattgcttgaacctgggaggcagaggttgcggtgagctgagatcgcaccatcgcactccagcctgggggacaagagcaagacttcatctcaaaacaaaacaaacaaaaaactctagagcagaaacaaaaggaaggaaatacacttggaagagggccaagcaggcaacttgaaa

SEQ ID NO: 188879 - DNA, 601 bp, Human
gaatcctctttctgtctctcactggccatataatcttgagcaaataactcaatctccctgtgcctcagtttcctatgaggataataatgacatctccttcatagggttgtaaagattaaattagatacttgattaaaactgttaacaatgtgcttggcacagaataagtgcctaatacatattctttattattagtagtatttaactattactatttaattgttactaaatatttgactcttcatagtagcatttaactattaccactttgttatttaactattaaataacaaaagttatktgttggccactattactttttacatttggaaaatatatacagtcagtgttttcatgcttttaagattctaaaggcttcagcatgcttaatctgctggaagcctcacagtgaccacaggagggagtcattatatgataatgagtattattctccattcattgtggtctgtgttccatgggcagaaattgagactctgagaagctgaatgatggcttagggacacaagctgttggctaaccagtcagagctgggtccaaggcttctgttctccttcagcgactccaaagcctttaatggtca

SEQ ID NO: 188880 - DNA, 601 bp, Human
actattcaccaaaattaaaaatatataccctttctaatcagcagttctactacaagaactactttctcaaagacatgctcttgtatgaaaaataagggatcaaagctttttctttgcaccattgtttgtaatagagaaagaaagactagaaacaatctgagtgtccaccagcagagacttctaaatacattgcagcccttccaaacaagacaacactgtgcagccgctataaagaatgtactcaatttctattaggttggtgcaaaattaattgctgtctctgccattgaaagtagtggcraaaactgcaatcgcctttgcaccaacctaatatgtactgatatagaataatttctaagatactttaagtaccaaagcacgggggggggcaatacatatttatttataaatatataaactatttctggaaagaggaataagaaactagaaacaagagaactggataattaagacacaggagaaaatgagactttatagtctgtaggaaatcttttgaattgtatttcatttgcaggcatcgtatgttcaaaataaatacatttttgtatacaagttggtgaagggacctgtttaaaaaaaa

SEQ ID NO: 188881 - DNA, 601 bp, Human
ttgtatgaaaaataagggatcaaagctttttctttgcaccattgtttgtaatagagaaagaaagactagaaacaatctgagtgtccaccagcagagacttctaaatacattgcagcccttccaaacaagacaacactgtgcagccgctataaagaatgtactcaatttctattaggttggtgcaaaattaattgctgtctctgccattgaaagtagtggcgaaaactgcaatcgcctttgcaccaacctaatatgtactgatatagaataatttctaagatactttaagtaccaaagcacgggggggggcaatacatatttatttataaatatataaactatttctggaaagaggaataagaaactagaaacaagagaactggataattaagacacaggagaaaatgagactttatagtctgtaggaaatcttttgaattgtatttcatttgcaggcatcgtatgttcaaaataaatacatttttgtatacaagttggtgaagggacctgtttaaaaaaaaagacatttccagccaggcgtggtggctcacgcctgtaatcctagcactttgggaggccaaggcatgcggattacctgagg

SEQ ID NO: 188882 - DNA, 601 bp, Human
agctcgtctctttcattattaattatttattaaaatattaaaataataaaatgtattaataatgaagcaatccaccctctgatctctggaatggattgaagttctatttgggtattaaacatcttttcttagatgtcccctccaggaggtcatttgcattgttctaactacagcttcgttggtgcaaatcaaaggttggtccatgtaatccttgtgcagctgagatggcctggagtcaatgaggcgcatgataggatgtaggtccgtgcaagcatgtataagaaaaggatctgaggatctkaggggaggaaaatcaagagtaatagagtcagaagggctcagctcctccatttatcccttgggtaaagaggcaaatccctgaaccacagtttcctcttctgcaaaatgggtatgatagtcacagtccagcccacttctcagtgtttctagggggatccaatgtgtggatgcacatgagcatgctcttctgactcttagcattattttgagaacttgctatgttcctagaactgtaccaagtgctttggagacataaaactaatgagatatggtccctgcctccaaagagttaatgtggctt

SEQ ID NO: 188883 - DNA, 601 bp, Human
ggagtcaatgaggcgcatgataggatgtaggtccgtgcaagcatgtataagaaaaggatctgaggatctgaggggaggaaaatcaagagtaatagagtcagaagggctcagctcctccatttatcccttgggtaaagaggcaaatccctgaaccacagtttcctcttctgcaaaatgggtatgatagtcacagtccagcccacttctcagtgtttctagggggatccaatgtgtggatgcacatgagcatgctcttctgactcttagcattattttgagaacttgctatgttcctagaacygtaccaagtgctttggagacataaaactaatgagatatggtccctgcctccaaagagttaatgtggcttcggtggaggagctgatacaaatgtgagggaggggcagatgggagagagcacccctgctgtgggagtcaggaggtagacttcgtggtgggtgctctcctcactcactagctatgtgaatgaacagctttcattttctcacttgtaaagtgaggatctattttggctatcatatctagttactgtcttagtagcttaagacaacagtgaatcacttgttctctcattctgtga

SEQ ID NO: 188884 - DNA, 601 bp, Human
atgaagaactcacctagaagatggagcaaaaactatagacagatgatccaaccgtgattctgtgaagcgtgttcccaaatcacagatgttacaaatccaatgtcaacaacaactagtcacaagttaagtactttcatgcataaacaaagagagaaaacccagggaggttggaacaaatgatgctcaaagtcaaggtggccatttctgcatcctcactgctatagaaaggtttccagattctattagttaaataataaccctagaccagatactgatctagatttattttctagtgatcacrttttgcctcttataaatatgcctcagacagatgagaatctgactcaacattctcatatcctatggaattaagaagatttaaataaggtaatatggtgatccatgctaacagcagtcatgattcaagatggtgtcgtgacagaattttctgtttcatccacagtggtcataagggtgtaaaaagtctcctcctggaggacagggtacagaaacttgttgcatcaaaatttaattcaatccaatttagaaagatatttgttttttgtgtgttatattaaaaagccagatgctaaagtatagg

SEQ ID NO: 188885 - DNA, 601 bp, Human
agggaggttggaacaaatgatgctcaaagtcaaggtggccatttctgcatcctcactgctatagaaaggtttccagattctattagttaaataataaccctagaccagatactgatctagatttattttctagtgatcacgttttgcctcttataaatatgcctcagacagatgagaatctgactcaacattctcatatcctatggaattaagaagatttaaataaggtaatatggtgatccatgctaacagcagtcatgattcaagatggtgtcgtgacagaattttctgtttcatccayagtggtcataagggtgtaaaaagtctcctcctggaggacagggtacagaaacttgttgcatcaaaatttaattcaatccaatttagaaagatatttgttttttgtgtgttatattaaaaagccagatgctaaagtataggtgaaccatagttaaaactattggaaaatgttgaacacagatacagttttttaaaggggtttattgattagctctgtagttttcaggacatggtgcatgggaagatgagaagaaagaagtttccagtctaatggggagacatagatagtgcaataagtgta

SEQ ID NO: 188886 - DNA, 601 bp, Human
gtgttgatgctgctgtagggtggggataaagatggaaacatactgggccagctgtgtgtgccatatcaggggccctggggagccatcaatggagtttaagcagaggagatacaggcccaggtttgggctttggacagagtactgtggctatttgtgtgtggaactcaggaagaggaggaactagaggtggggagatgagctaagaggccactgagggtaccacaggtgagaggtgacaagctcccaatcccagaccatggtggctgcagaatgtgaaaacttctcaagagatacaagaagmaggactcataatatacaggaggccatgatggttgcatttggaaggaagagaaggaaggaaagcaggaacacatctttccctggtttccagctcacatgggttcacccgttgaagcatagactagggggagccagcaggttcaggaggcagccagtggcttcattttggacaccttgatgtgaggtctgagtatatgtttccagtaagaagttcagtggcaggtccatagctactgaaggaaagattggtggtggaattatcaacgcaggacgtggcctggagacgactcatgagtatgtt

SEQ ID NO: 188887 - DNA, 601 bp, Human
tgtcctcgggtttggaccgggttcgctcttttgtagaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgcagaaggacgtggcgtcctaccacgccctgctggacagggaggagagcgggtaagcctcgcttccgcgtcaattatccaagagatgcatattcrtggctttaaaaataattattttccaaacactgtagaagtatttaagaagaaatcaccccagacttcctctcacataggcacccattcccacagcctagctgtgtccttcctttcctattcacatacaaataatatatataatatattcacatactaatacattttctatatgtatgcatatttatgtatgtatatatacacacatacattcacatacatgtgtatacctaggacgtacataatagctgttaggaatgtttcagttgcttgtaatagaacctaattaatgaggctataaac

SEQ ID NO: 188888 - DNA, 601 bp, Human
tcaagtgatcctctcacctaagcctccagaatagctggggttacaggtgtgagccgtgacaccccagctgggcatcttttttaaatgcagattctgcttcagtacgtctggggtggggtctgagagtcttcctttctaacaagctcccaagtgatgactatactgctgctccacagactacactctgagtagcaaagatgtgtaaatcatttatttaagagtcccagaaacaggtgatctaggctgctcaaagatttcattaaggactcaagctcttttcatctttctaacataccatgayaacattggctttttgtctttatctttgtcaccccatggttaccatatgccagccacagatccaaacatcacatcctcattcctggccggaagtgggagagaagaggcagcagcaaaaaaaaaaaaaaaaaaaaaggctttttctttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtc

SEQ ID NO: 188889 - DNA, 601 bp, Human
tcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagrtcaacaggatcccaaggcagaagaatttttcttagtacagaacaaaatgaaaagtcaaaaggctttttcttgaatgatcctctcctttaatcagtgaaggaaagacattttgaggcttgcagtggactgtcccttatatctcattggccagaacctgcttatactggccatacccatctgcaagggaggctaagaaagcaactctttagcttttccagactccatagtggaggcaggcaaggggttgggactaggagttgagttagtctgccataattacacacacacacttgcactcac

SEQ ID NO: 188890 - DNA, 601 bp, Human
gccagaacctgcttatactggccatacccatctgcaagggaggctaagaaagcaactctttagcttttccagactccatagtggaggcaggcaaggggttgggactaggagttgagttagtctgccataattacacacacacacttgcactcactctttttttaatagataaggattccagaggcatatacatcagccttgggccttagcttccttgccaactctttccagaaacccaggcccttattttgtatcatagttctatgccttcttatttccctccaagactccttgtctgacrtatgttgaataaggaatagagacagcttagtgattgtatcatccaacccctcctgattcaagagagaacacaaagacccagaatggaaaaagatttgcgcatgatcacacaggaggcggagacagcactgggatgggagcccaggtctcctgctctctccaactgtgtaacctctctttattcagaaggcgggagagcctcaaggaagcgacctaaccacgccctgctttcaaatggaaaatatgtcatccagctcctctccaactgtcttttattgaattgatttttgttgattataaa

SEQ ID NO: 188891 - DNA, 601 bp, Human
gaaagcaactctttagcttttccagactccatagtggaggcaggcaaggggttgggactaggagttgagttagtctgccataattacacacacacacttgcactcactctttttttaatagataaggattccagaggcatatacatcagccttgggccttagcttccttgccaactctttccagaaacccaggcccttattttgtatcatagttctatgccttcttatttccctccaagactccttgtctgacatatgttgaataaggaatagagacagcttagtgattgtatcatccaamccctcctgattcaagagagaacacaaagacccagaatggaaaaagatttgcgcatgatcacacaggaggcggagacagcactgggatgggagcccaggtctcctgctctctccaactgtgtaacctctctttattcagaaggcgggagagcctcaaggaagcgacctaaccacgccctgctttcaaatggaaaatatgtcatccagctcctctccaactgtcttttattgaattgatttttgttgattataaaagccagatgttcctaacaaagtatttttttttcggatgcctatgagc

SEQ ID NO: 188892 - DNA, 601 bp, Human; identical to SEQ ID NO: 82443

SEQ ID NO: 188893 - DNA, 601 bp, Human; identical to SEQ ID NO: 82444

SEQ ID NO: 188894 - DNA, 601 bp, Human; identical to SEQ ID NO: 82445

SEQ ID NO: 188895 - DNA, 601 bp, Human; identical to SEQ ID NO: 82446

SEQ ID NO: 188896 - DNA, 601 bp, Human; identical to SEQ ID NO: 82447

SEQ ID NO: 188897 - DNA, 601 bp, Human; identical to SEQ ID NO: 82448

SEQ ID NO: 188898 - DNA, 601 bp, Human; identical to SEQ ID NO: 82443

SEQ ID NO: 188899 - DNA, 601 bp, Human; identical to SEQ ID NO: 82444

SEQ ID NO: 188900 - DNA, 601 bp, Human; identical to SEQ ID NO: 82445

SEQ ID NO: 188901 - DNA, 601 bp, Human; identical to SEQ ID NO: 82446

SEQ ID NO: 188902 - DNA, 601 bp, Human; identical to SEQ ID NO: 82447

SEQ ID NO: 188903 - DNA, 601 bp, Human; identical to SEQ ID NO: 82448

SEQ ID NO: 188904 - DNA, 601 bp, Human; identical to SEQ ID NO: 38416

SEQ ID NO: 188905 - DNA, 601 bp, Human
agctactccagaggcagaggcaggagaattgcttgcttgaacccaggaggcggaggttgcagtgagccgagatcataccactgcactccagcctgggtgacaaagtgagaatcggtctcaaacaaaaacacacaaattagctgggcctgctggcgggcgcctgtaatcccacctattcgggaggctgaggcaggagaatcgcttgaatccaggaggtggaggttgcagtgagctgagatcgcgccactgcactccagactgggcgacaagagcaagactgtctcaaaaaaaaaaaaaaaaagaggtggggtctctctgtcacccaggagtgcagtggcttcatcatagctcactgcagcctgggacttctaggctctggtgatcctctcacctctgcatcccaagtatctgggactacaggcacattgcggctggcttttttgggcgggggagtcggagagtagtatgttctcaggccccagaaccatgttcagcacatagaaggtaaacatttgctgaatgaagccacttgcacgaagtcacacgcagctgagattcaaaccacacctaactgtgaggaactgtgtcaggcactctgctt

SEQ ID NO: 188906 - DNA, 601 bp, Human
gtctgagaccagcctggccaacatggtgaaacctcgtctctactaaaaatacaaaaattagccgggcgtggtggtgcggcctgtagtctcagctactccagaggcagaggcaggagaattgcttgcttgaacccaggaggcggaggttgcagtgagccgagatcataccactgcactccagcctgggtgacaaagtgagaatcggtctcaaacaaaaacacacaaattagctgggcctgctggcgggcgcctgtaatcccacctattcgggaggctgaggcaggagaatcgcttgaatccrggaggtggaggttgcagtgagctgagatcgcgccactgcactccagactgggcgacaagagcaagactgtctcaaaaaaaaaaaaaaaaagaggtggggtctctctgtcacccaggagtgcagtggcttcatcatagctcactgcagcctgggacttctaggctctggtgatcctctcacctctgcatcccaagtatctgggactacaggcacattgcggctggcttttttgggcgggggagtcggagagtagtatgttctcaggccccagaaccatgttcagcacatagaaggtaaaca

SEQ ID NO: 188907 - DNA, 601 bp, Human
aattcaagaaaaccacccaaaatgacctaacattatcaaacattaataagagaatgtagagctaccatgcactttctataatgaaaatctctttggatagaatttgaacttcaaagcagcactacactggtttgtgtactaagccttggataattcaaaccagatgcattacattttaccgaaaaaatttagtacaagcagtcctacttagcaccaggttttatttattagcttacctttctgttcctctcaagatgctttcgaacagcaactgctttcttaattaaatggtagagatcttcaggaagatcaggagcaagtcccttagacttaagaattcttaaaattttattgcctgtcacaaaacgtacttgtgcaacaccatgtgaatctctcaggattacacctgaaaagggaatcacgttttaactttcaacacgaaacacaaactggagaatgtgatgatgtcaaggctcagaaatcagggcatagtttcctatctgtaagatgggggtatacttttatacatcacagaaaccaacgtgagaatgcacataaagctcactcagacatccaaggaaggtttacccaacactaagga

SEQ ID NO: 188908 - DNA, 601 bp, Human
ctaggaaaataaatatgaaacatgcttttagttaaacaatcattttattgcttgagtacacagacaaatttatgcgaccagggcagaggctgtagatgattcactgaaaaagaaaaaaggggaaagaaagaaaatcaggattaatactagtccctccacattcattaacagaatctccccactaatggtgctattctcaaacagttaataaatccaaactatataaagtgcaccaaacttctgaatacctgaaccaactcattgtgttcaagcacaatgaatgaagatgctcactcagacrtccaaggaagaactggccaacataaggaaaaacatttctggtggaaactgcgaatgtctggcaaccaatcatcatagtgagcaattcatgtgaaaattaattcaaactcctgggagtagaggtatgaaaggaaaatctacctactatctaaaagagagtcaaagggcttattcatggtctaaatctggggtctgcaactatggccctctgcttgtctttattaaagacaagcagccacacccattcgattatgtattgcctgtggctgctttcccactaccaggccagagctcaaagagc

SEQ ID NO: 188909 - DNA, 601 bp, Human
aaacacttccccatcaaacaagatcaacacatatgaaccactgatatatataatttttcttctaggaaaataaatatgaaacatgcttttagttaaacaatcattttattgcttgagtacacagacaaatttatgcgaccagggcagaggctgtagatgattcactgaaaaagaaaaaaggggaaagaaagaaaatcaggattaatactagtccctccacattcattaacagaatctccccactaatggtgctattctcaaacagttaataaatccaaactatataaagtgcaccaaactwctgaatacctgaaccaactcattgtgttcaagcacaatgaatgaagatgctcactcagacgtccaaggaagaactggccaacataaggaaaaacatttctggtggaaactgcgaatgtctggcaaccaatcatcatagtgagcaattcatgtgaaaattaattcaaactcctgggagtagaggtatgaaaggaaaatctacctactatctaaaagagagtcaaagggcttattcatggtctaaatctggggtctgcaactatggccctctgcttgtctttattaaagacaagcagccaca

SEQ ID NO: 188910 - DNA, 601 bp, Human
ttataagctgctcaactggtttaaggggccaatcaagggatgtgatggacagtatcttactgctccctggaatcctaacatcaatcacccaaaacacttccccatcaaacaagatcaacacatatgaaccactgatatatataatttttcttctaggaaaataaatatgaaacatgcttttagttaaacaatcattttattgcttgagtacacagacaaatttatgcgaccagggcagaggctgtagatgattcactgaaaaagaaaaaaggggaaagaaagaaaatcaggattaatactrgtccctccacattcattaacagaatctccccactaatggtgctattctcaaacagttaataaatccaaactatataaagtgcaccaaacttctgaatacctgaaccaactcattgtgttcaagcacaatgaatgaagatgctcactcagacgtccaaggaagaactggccaacataaggaaaaacatttctggtggaaactgcgaatgtctggcaaccaatcatcatagtgagcaattcatgtgaaaattaattcaaactcctgggagtagaggtatgaaaggaaaatctacctactatc

SEQ ID NO: 188911 - DNA, 601 bp, Human
ggatgtggccaccttacagagctgtgggggtgatgctgcttttccagtgaacctgaagggcagaatattgaatcgaagaggattattcttgagccttaagagctaatggagtttgccttgctaggttttggacttgcttgggacctgtgacccctttatttcttccaatttctcccttttggaatgggaatgtctatcctcttcctgtagcaccattatattttggaagcacatagcttgtctggtttcatagtttcacagctgaaaataaattttgcctcaagatgaataatactgctaktctcacccacatctaattttatttagatgagactttggactttagattttaagttgatgctagaatgagttaatttcttttgaggccgttgggatggtataagtgtgagaaggacatgagttttgggggtcgagagtggaatgatatagactgaattgtgttcccccataatatgtttaagctctaacttccaacatgactgtaattggagatagggggtaattaaggttaaatgagttaaatcataagggtggggctctaatctgataggataatcataagtgtggggctccaatctga

SEQ ID NO: 188912 - DNA, 601 bp, Human; identical to SEQ ID NO: 37607

SEQ ID NO: 188913 - DNA, 601 bp, Human
cactccagcctgggcaacagagcaaaaccctatttaaaaaaaaaaaaggctgagcaagtgctgtaattccagcactttgggaagccaaggcgggcagatcacttgaggtcaggcgtttgagaccagcctagccaacatggtgaaaccccgtctctacttaaaaaatacaaaaatttgtcgggcatggtggcgcacgcctgcagtcccagctactcaggagtctgaggcaggagaattgcttgaacccaggaggcgggggttgcagtgagctgagattgcgccactatactccagcctgggmgacagagtaaaactccgtctccaaaaaaaaaaacatagaaaactacagattattccaagcctacagactaaaatcttttacaacatctattccccaaaaagacgtggtaaacaagcagaaccacacttcaggggaatattaggaagctgcgccaactagaaacgcaatgaccacacagcacgggccctgcaggctgtgcccacgtcctcccagggtcccacactgcaggctccttgtggactcaatgcttggacacgcttacctctgcgggggaatataaggagcgcacacggtcggcag

SEQ ID NO: 188914 - DNA, 601 bp, Human
ggcatgggagcacacgcctgtagtcccagctactcaggaggctgagacacaagaattgctggaacctggcagcagaggttgcagagagctgaaatcgtgccactacactccagcctgggcaacagagcaaaaccctatttaaaaaaaaaaaaggctgagcaagtgctgtaattccagcactttgggaagccaaggcgggcagatcacttgaggtcaggcgtttgagaccagcctagccaacatggtgaaaccccgtctctacttaaaaaatacaaaaatttgtcgggcatggtggcgcacrcctgcagtcccagctactcaggagtctgaggcaggagaattgcttgaacccaggaggcgggggttgcagtgagctgagattgcgccactatactccagcctgggcgacagagtaaaactccgtctccaaaaaaaaaaacatagaaaactacagattattccaagcctacagactaaaatcttttacaacatctattccccaaaaagacgtggtaaacaagcagaaccacacttcaggggaatattaggaagctgcgccaactagaaacgcaatgaccacacagcacgggccctgcaggct

SEQ ID NO: 188915 - DNA, 601 bp, Human
aagctgaaatttttagacctcttatacagaagctcttaatacaaaccctagactttttgactcataggtagaaatccaagcaaaaccatctcttcaaagtcagattaatttacaaagacaaacaccttggttttgacagggttttccctggatgggaaggattatgagcattttttgttcattctgtctgaattgactaattatctgagtatttacagctctgtgaaaagaaactggacttcactttggtaaagtagagtaatattaacaaaaatcacttaaaacttctttttttttttttgagacacagtttcactctgtcacgcaggctgcggtacagtagcacaatcttagctcactgcaacctcccagcctcaccgcccgatgcagctcagcctgcatgcgtcccacctgtgctgtcctcccctcacatgtggggcaggtctgacacctcagagggtcctgctcactgacccccggcagtcctggagggtctgtgtggtactggggctctaggcgtctcccccagccaagctgcaagctcagcaccaggctggctctacccgccctgttgaccggcaggccccatctgtgctcacag

SEQ ID NO: 188916 - DNA, 601 bp, Human
tgagccaagatcaccgcactgcactgcagcctgggcaacaaagcaagactccacctcaaaaaaaaggggggaaaaaaaagaactatcttttttacttgaaattttaattttttaaaccactagaattataaaagcagtccgtccctgaaggcagattctgttctgtccacagggaataaggaagatcctctttctctaaaatctctaaaacgctgctcagatggggtctcatctcccttccagcgtgactggctggcctgaagcataacatcctcagatgctctaggtgggtcctacaccrgagccattggttagtgcacaccataaccaactagactcagcatccccgcccacggctgcacatcaagaagcttcaccatgggccaggcacagtggctcgtgcctgtattcccagctgaggctgggaggaggctgaggcgggaagatcgcttgagtccaagagtttgaggctactgtaagccatgatcacgccactgcactccaacgtgggcaacagaacaagaccctgtctctaaacataaaataaaaaataagaagcttcaccctcatctacacagaattcaaatgcacagctgaggcc

SEQ ID NO: 188917 - DNA, 601 bp, Human
ttcatgtgagatagttcaagttcagacttcctgctaacaacatctattaggacatgggctggaccaactcatcttcctatggaataccaagacaggagatccagacaaactccatcatgtgcaccaagcccaagctcaaacaatcagctggtgcagcatgtctgctgaatgactgtgctgtgatgggctaggaccagcaggcggcccaggggccctagactgctctgttcacctccatccaaccacatcgctctgcacaccaggcaccatctctgtaggctcaccactaacaaagggaccrgtaccatctgaggactgcctttaccaacaagactaaaagatttcttggaagaatatcaattccaggggtcaatgtttctctttctctaaacatgcctcacatagaggatctccagatgcagctgcgtcaaagacaaccaaaattcaagagactgctctggataaccatgcaaaaccccttagagacagggtctcactctgtcacccaggctggaatacaaaggtgcgatcacaactcactgcagcctcgacctcctgggctcaagcaatccacccacctcagccttccagtgttaggatt

SEQ ID NO: 188918 - DNA, 601 bp, Human
cttcatgtgagatagttcaagttcagacttcctgctaacaacatctattaggacatgggctggaccaactcatcttcctatggaataccaagacaggagatccagacaaactccatcatgtgcaccaagcccaagctcaaacaatcagctggtgcagcatgtctgctgaatgactgtgctgtgatgggctaggaccagcaggcggcccaggggccctagactgctctgttcacctccatccaaccacatcgctctgcacaccaggcaccatctctgtaggctcaccactaacaaagggacyggtaccatctgaggactgcctttaccaacaagactaaaagatttcttggaagaatatcaattccaggggtcaatgtttctctttctctaaacatgcctcacatagaggatctccagatgcagctgcgtcaaagacaaccaaaattcaagagactgctctggataaccatgcaaaaccccttagagacagggtctcactctgtcacccaggctggaatacaaaggtgcgatcacaactcactgcagcctcgacctcctgggctcaagcaatccacccacctcagccttccagtgttaggat

SEQ ID NO: 188919 - DNA, 601 bp, Human
gaaacgcagcccatgctctgagcactcagagttttccccagcacaatttttatttgcttcagctttttcaattaaaacaaatctaggccaggcacagtggcttatgcctgtaatcccaacactttgggaggctaaggcaggcggattaccttaggtcagtcaggagttcgagaccagcctggccaacgtgacgaaaccccatctccactaaaaacacaaaaattagttgggcgtggtgacgtgcacctgtaattccggctattcgggaggctgaggcaggagaatcgcttgaacccagggrgcagaggttgcagtgagcgtagatcacgccactgcactccagcctgggcgacacagcaagactccatctcaaaaagaagaaaaaaaaaaaaactgtttccagatatagtaatgtccatttctgtagaggagaatccctcctgcctgtcagcctgcaccaggaagggctctgttgtgagctgccagctacaatctgcactaaaacccagaaaaccaacaaagtcacaggagggcaggaatgagtcagtgtctgaaacggcattcaggtctgttcctcatacaggagagcaggcgctcctgc

SEQ ID NO: 188920 - DNA, 601 bp, Human
aaatcaagctccccaccagcccgagcccaggaggtgctctcaggaaagccaccatcgcctccagcaggtagcacctaggctggagcagaggtgattatgtgtggcagtaatctgccccgctgtccccagtagtaaagaaaacttcacataaattttcaaccccacttctaccaaaagtaagtaaatatggtgaaagtgaagagagacagaaatcagctacactgtggtgtctcccctctgctgagaacatcttctacatgcctggggtgcttcagggaagagaacccggcctagaggaacrttgccccacaaagctaggggtgggaatgacatggttgggtacccaagtcgccgggggcagggcagagctgtctaaatggccagatgactgtggttcatggcccacggccctgctctgcgaaatgctacctttagttcagtaaatgccagcatctttaggagagtctgagtgcagaggaaggtgcggtgaggccagtgagaaacgcagcccatgctctgagcactcagagttttccccagcacaatttttatttgcttcagctttttcaattaaaacaaatctaggccaggcacagtggct

SEQ ID NO: 188921 - DNA, 601 bp, Human
ggaggcggaggctgcagtgagccaagactgtgccattgcactccagcctgggtgacagagtgagactccatttaaaaaaaaaaaaaaaatttgtaaagactcctagaggaaatacagggagcagctttacggctgcagagtggggacgagtttcttcaagcagacccagcatgcacatgccacatggggaaagggtgataaatttgaggagtacgatgaaatgaacaaacttcggttcatcagacaatagaaaattcaggctgcttttcagaacctttacacactgacgggtgcacgaacrgaattccatggccaggactcgcttcaaaacaatggaatggaaggaatgggagaggggaggctggccaggtgcgtataacttctaaagttgagtgaaagaacagggggctctctccaaagatttccaaactaaaaaagaatattttaaagacatcactaaaaatgaaaagatacactcacccacgggcacaagcccccgacaaacagtgcacaggcagggcaggagcccccggtgcaggcccagaaccctggcatgacacacacgcagaccccatgccaggtggtgcgaggtggaggacgc

SEQ ID NO: 188922 - DNA, 601 bp, Human
gcaccatggaatgggtatcatcaaaaggacagcgcctgagaatatacaggggtacagctgccttggaaaacaatctggcacttcctcaaaatactaaacagcattaccacatgacccagcaactccactcctagaatatacccaagagaaataaaaacacactacctaaaaactgttacacaaatgttcagagcagcattgttcataatagctccaaagtaggaaaaaaacaaacatccatcaaaagatgaacagatttttttaaacgtggcctatccatacaatgaacattacgcagccrtgaaaaggaatggcacaccgacccagggggcacgatggatggaccttggaaacatgctcagtgaaagaacaaaaaaaacacatttcataaaagaacaaaaaaacacatttctatgaaatgcccacaacaggcaaatacacggagacaggatgcagatgggtggctgccagggctgggggaggatgagaaggtgggaagttggggtaatggctaagaggcacagggtttcctttggaggtgataaaaatttctaaaattggtggtggtgataaatgcacaactctgtgaactaaaatccac

SEQ ID NO: 188923 - DNA, 601 bp, Human
acaggaaacaaaaagaaaaaataaactgggcttcatgaaaaatgttaaaatgtgtgcattaaaagacacacagcagagtgaatgggaggaaatattttcaaatcacgtatctgaaatgggattaatatccagaaactcctaaaacttgacaaaaaataatccaattcaaaactggttaaaatactcaaatagacaattcttcaaaagtgcaaatgctcaataaacacagaaatgcaaatccaaactatgatgtcaccttcacacctattagaatggctatcaaaaaatactaacaaaaaacaaaaaaaaaatgttggtaaggatgtggaaaccctgaacccttgcgcaccgccggcaagaacgtaaaaaggtgtagccgctgtggaaaacagtgttgtggctcctcaaacacttaaagacagaaatgccgtgtgacctggcaatcccacttccgggtatacacccaaaagaactgaaaacaggctcagatacttatcacccatgttcttcacagcattattcacgatggctaaaacatggaagcaacccaagagcccatggaggaaggaatgggtaagcaaaagcttatctccacatacag

SEQ ID NO: 188924 - DNA, 601 bp, Human
cacatctgtgtcagcgggcccaaaaccttagacactgtccactcagacgccatgggagaggtgggcactggtccccatgtcacctccaagaagagagacagagctcaaggtataagccgctaacaggtgctgttttaccgtgctcactaaaatgacatcagtcatcttcaagtctcccaagaaatgcaaagtgctgcccttgggggcacatggagccaccaagaccctcggcgcctctcatccaccaagggaacccaacgccgcctcttccggcagaacctggctcaagcgtggagcctgyaggagaacactcaccagacccagaactgaccgtgaggtgccttctcacagggaacccgccgggggaactttgccagagtgacccatcagcaagagctcccgtgcagatgtggaacccctttaggctaaaacaatcctgcccaccactccaagggcagtctgcatgctcaggacaccaaacgcctgcccacgaagcacagccctccaaggacagccaacggaaggaagccagaggctggagagggcatcggcaggtgcactgggacgctgggctctgatcacagccccacagggctcctcc

SEQ ID NO: 188925 - DNA, 601 bp, Human; identical to SEQ ID NO: 37608

SEQ ID NO: 188926 - DNA, 601 bp, Human; identical to SEQ ID NO: 37609

SEQ ID NO: 188927 - DNA, 601 bp, Human; identical to SEQ ID NO: 37610

SEQ ID NO: 188928 - DNA, 601 bp, Human; identical to SEQ ID NO: 37611

SEQ ID NO: 188929 - DNA, 601 bp, Human; identical to SEQ ID NO: 37612

SEQ ID NO: 188930 - DNA, 601 bp, Human; identical to SEQ ID NO: 37613

SEQ ID NO: 188931 - DNA, 601 bp, Human; identical to SEQ ID NO: 37614

SEQ ID NO: 188932 - DNA, 601 bp, Human; identical to SEQ ID NO: 37615

SEQ ID NO: 188933 - DNA, 601 bp, Human; identical to SEQ ID NO: 37616

SEQ ID NO: 188934 - DNA, 601 bp, Human; identical to SEQ ID NO: 37617

SEQ ID NO: 188935 - DNA, 601 bp, Human; identical to SEQ ID NO: 37618

SEQ ID NO: 188936 - DNA, 601 bp, Human; identical to SEQ ID NO: 37619

SEQ ID NO: 188937 - DNA, 601 bp, Human; identical to SEQ ID NO: 37620

SEQ ID NO: 188938 - DNA, 601 bp, Human; identical to SEQ ID NO: 37621

SEQ ID NO: 188939 - DNA, 601 bp, Human; identical to SEQ ID NO: 37622

SEQ ID NO: 188940 - DNA, 601 bp, Human; identical to SEQ ID NO: 37623

SEQ ID NO: 188941 - DNA, 601 bp, Human; identical to SEQ ID NO: 37624

SEQ ID NO: 188942 - DNA, 601 bp, Human; identical to SEQ ID NO: 37625

SEQ ID NO: 188943 - DNA, 601 bp, Human; identical to SEQ ID NO: 37626

SEQ ID NO: 188944 - DNA, 601 bp, Human; identical to SEQ ID NO: 37627

SEQ ID NO: 188945 - DNA, 601 bp, Human; identical to SEQ ID NO: 37628

SEQ ID NO: 188946 - DNA, 601 bp, Human; identical to SEQ ID NO: 37629

SEQ ID NO: 188947 - DNA, 601 bp, Human; identical to SEQ ID NO: 37630

SEQ ID NO: 188948 - DNA, 601 bp, Human; identical to SEQ ID NO: 37631

SEQ ID NO: 188949 - DNA, 601 bp, Human
ctcctttctcccatctttcagtgactgacccagtgtaacccccatcagatgttgtcctcatgcccctggggctggctgtgttcaagagcctgtgaccttgggggccccctgggagctctgtggtatcagctaaatgatgtttctctcctgagtcatgcctggggctgtgggtaggggtcaggggaagagcggaggaaaggacagggcacacaaggacagccccacccaacatattcagcctgatccttggaggccagaaatgtgagactaagtcctgactgctgaggggtagcaggaggaacctgcacctcccagaaagcagaccctctctctggaccccggttgcctgcaaatcaatgaccctgggtgagagtgaggttccaggaaggtcacaagtcatatcaaggtgaggggggctcacagctggagaatctccatcctgctgcccatctctgaacagatcagtgaagatgccagagccaggccctggaggtcaattggcagagccctaccctgccccacccgacactcagctactcacatcaatcccgggcttcccgtctggcccatctggcccagctttgccaggctcgcccttggg

SEQ ID NO: 188950 - DNA, 601 bp, Human
gtttctgccccagacctggaggagtttcccagtggccaggagcaggcccaggaacttccagaaagaccacccagcttgccagcttggagatagaaggcaggaggcagtgaacagagggtggctgaggctcaccttggggcctcggattccaatctcaccagggaggccaacaggtccaggaggcccctggggagcagagagttgatggtcaggatgcctcagagggtcagataccctgggcacaaaggtagagacaggcacccaaagcccgtttctccacttttactttttttttttttttgccaaccccagagagactgacagactgaggctttaaggaccagagaattgcagagccagtggacaggcccagagtgggctggccctgggtctctggcaggtccacttattcctgacactatcacagcaagctggctccttcccatggtggccattccctcgaagcctttctgttgtcccctccttccctgggagttctggggatcctgccccatccctgaggacttacaggaggtccagcaaaaccagggccctggaacagaaagaaagaaaattggcttcatggctccctctgcaggtc

SEQ ID NO: 188951 - DNA, 601 bp, Human
tgtgagatccaccatcttgggagatgaaggcctgattgacaggggatggggccagcggcgtccctaaaagacctagtgccgggtgggctcataggaggggtttctgccccagacctggaggagtttcccagtggccaggagcaggcccaggaacttccagaaagaccacccagcttgccagcttggagatagaaggcaggaggcagtgaacagagggtggctgaggctcaccttggggcctcggattccaatctcaccagggaggccaacaggtccaggaggcccctggggagcagagagktgatggtcaggatgcctcagagggtcagataccctgggcacaaaggtagagacaggcacccaaagcccgtttctccacttttactttttttttttttttgccaaccccagagagactgacagactgaggctttaaggaccagagaattgcagagccagtggacaggcccagagtgggctggccctgggtctctggcaggtccacttattcctgacactatcacagcaagctggctccttcccatggtggccattccctcgaagcctttctgttgtcccctccttccctgggagttctggg

SEQ ID NO: 188952 - DNA, 601 bp, Human
aaaacaactagatgatctctgctgtctaatagaaaaataaaagtataagaattttttaatttttaaaaagaaaagaaaataatttaaaaaactaaataataataacagttaactgtgttttctgctccatttttctgtaaacttaaaaccgcttcccccaacaggtctattaattgggaaaaaaaaaaaaaaagagttaagagaactgggatcgagaccaaatcccattagccccatggctgatttgctggaatctcattgtctggccccagtgaccatgggactggatcccagggcttckcctaaagtctgaatttgggctgactgggctcttggcacagatggtcctccccagcaggtcacccacttgggcagacacacacacactcactcacacacacatacatacactcacagtcacacacacacactcagagatatcctcacacactcacatacacatactacacacactcacagacagcctcacacatacacactgtacacatacactcatatacacacagtctacacacacacacactacacactcacacacactacacattcacactcacgcacacactcatgcactctcaca

SEQ ID NO: 188953 - DNA, 601 bp, Human
gggtccacgaatacctgggctgccctgcaaagcggagagagatcaggtcaccctcaggatgttgggcccctgtctggctgtgcagagaggggaaccactgagaacagtggcctctaggtcccagagttcctctggcacaggccacaccatgcaggggccggaggagagagccttgggagtacccttcctgccctggcaccagcaggagggaggagaagtcagtgccaggaggccaggctgggctgagccagagcaggggtgggagccagaatccactgagaccttggccaaggccccacamtccactcagccaaaggaacacaacaaccgaatgcagtgtgtggatgctgtgtgagtcttgatttgaacaagaaccaggaaaagacatttttgagataattgggaaaaactgaacagagactggccattagatgatgttagggagtacttgtttattttgtcagttgtgataatgtgattatgtgagaatgagtgcttattgtttagagatatgtacaaaagtatctagggctgagatgataggatgttaaggatttacttgaaaacatcagagcaaagcaataacaaaatcaaaggaagg

SEQ ID NO: 188954 - DNA, 601 bp, Human
cccagggaggagaaagagcttccctgaatcattgggtcagggcagagccagactaactcggagctctccctaggttagggctccaccccatggcctcaccctaaagcaggaacccttgtgtcagtgcagggggcatttacctctttcccagggggaccagagaatccaggaaggccctgcgggcccggctcaccctgcaggaaaacagttctcaggtcagtctgggtggcccagtcaggcccttggcctcagggaaacccaacgaagcctaaacagagcctggaaccagatgagctgggamgggggagagggtattcttggttcaatcctcttggctcctgattttcctgtttgtttctcctctggattttaagccatgccatcctatctgcactgaggcaggctgaggagtgcatgatgggtgggaggtggcaggagggaggtggttaggcccaaggggcttatgttctggctgagcctctgagacttggctgaggcctgggccttgctgtcttcctggccccagacttccttgctcaattctgtccccagcttgggatcgcctcacctggtctccagggcctccttttgtcccaggctg

SEQ ID NO: 188955 - DNA, 601 bp, Human
gaacgaacaactctgcctgttggattcccagcccatcaacttggccatctaggaaagtcacactccagaacagagccagtccccaccctccctgcaatgtacatagggaaacaggcccagggaggagaaagagcttccctgaatcattgggtcagggcagagccagactaactcggagctctccctaggttagggctccaccccatggcctcaccctaaagcaggaacccttgtgtcagtgcagggggcatttacctctttcccagggggaccagagaatccaggaaggccctgcgggccyggctcaccctgcaggaaaacagttctcaggtcagtctgggtggcccagtcaggcccttggcctcagggaaacccaacgaagcctaaacagagcctggaaccagatgagctgggacgggggagagggtattcttggttcaatcctcttggctcctgattttcctgtttgtttctcctctggattttaagccatgccatcctatctgcactgaggcaggctgaggagtgcatgatgggtgggaggtggcaggagggaggtggttaggcccaaggggcttatgttctggctgagcctctgaga

SEQ ID NO: 188956 - DNA, 601 bp, Human
gctcccacgatgccaggaacgccccgagggccagggtgcccatgggggccctgcttgcctgggtacccagggggcccaggaggtcctggaggacccatcatgcccaccgcacccagggcttcccgcttggcactcacggcgacctctgccagttgctctggagggagggagggagggagggagagggaagtctatgagatgggtgtcagcagtaacactaggggaggcagagcattccgatgggccctggcccctaggtttgcagacagaaaagcaccaccttccgtgggctctgttttgyggaagtcaaaggcccagagtgacttattcaaggtcccaaaacccttcagagactggactggaaggagcccccaggactccagattttcagacaagtgaacacgtggaggctccgggagggggtgagggggcggcgatgccctcgaactgactgtgaggaggggttgctgcccctcaccttgcagcatcttcagcgccacatccacgatgtgctggtcagtggcatcccggccctgaaagcagaggcctttcaggaagaagcccctggctacaagggcccaccgctcctatcccacctggc

SEQ ID NO: 188957 - DNA, 601 bp, Human
gatctgacccacggctcccacgatgccaggaacgccccgagggccagggtgcccatgggggccctgcttgcctgggtacccagggggcccaggaggtcctggaggacccatcatgcccaccgcacccagggcttcccgcttggcactcacggcgacctctgccagttgctctggagggagggagggagggagggagagggaagtctatgagatgggtgtcagcagtaacactaggggaggcagagcattccgatgggccctggcccctaggtttgcagacagaaaagcaccaccttccgtrggctctgttttgcggaagtcaaaggcccagagtgacttattcaaggtcccaaaacccttcagagactggactggaaggagcccccaggactccagattttcagacaagtgaacacgtggaggctccgggagggggtgagggggcggcgatgccctcgaactgactgtgaggaggggttgctgcccctcaccttgcagcatcttcagcgccacatccacgatgtgctggtcagtggcatcccggccctgaaagcagaggcctttcaggaagaagcccctggctacaagggcccaccgctcc

SEQ ID NO: 188958 - DNA, 601 bp, Human
ccggagccgctgccacccaaatcgggaggctgagcggggagcgctggccggaaggcccagctgcgccgcctccagcagctgtgtggccttgagccagccactctgcctttcagagcctcggctggcccacctgaaaaacggaaagaagacgcctaccgtgcagtgttattgtgaggatttgcacgatgatgggcatagaatttgtggtgcacaattggtgatgagtgaattttcttgccttcctcccccaccttctctttgaacctgcggactgaggaaggacgcctccatcccccacccyacaggcctgtgttccagcgcctgccacactatggagtgatgtgttcacacagctgtcctcccctgcccatctgttagactgtgggggcagggattccccgttccaggaaaacaccgtgcagaggaggggctctggcagtgtggcatgaaagtggaatatgccacccaaatacccgccaggctagagggccctgggagagtgcaggggacgagtgcctcagaagcccagccccggtacctggtctcagctccacctggggtgggtcccagtgtgcagcagaagggccgagtttggagcccc

SEQ ID NO: 188959 - DNA, 601 bp, Human
ttggagcccctcccctctcctctaggtgggggatgggggatttgttccagggccgtggaccctccagggtgggatgcgcccctgctcatgacactgcccgcaggtaccgctattaccagaatgtgtgcacgcaaagctactccttcgtgtggtgggactgggcccgctgggagcgagagatagactggatggcgctgaatggcatcaacctggcactggcctggagcggccaggaggccatctggcagcgggtgcgtgcccactgtcccttccccaccctcctctatggcgggagccaccstaggtgttttcacccgccccccagcatgggcgcagtgtctctctctagaagtgctttcagcgtgcacagtggcttgggcctcctaaaaactgaggcttccggccgggcgcggtggctcacgcctgtcatcccagcacttcgggaggcctaggcgggcggatcaggagttcaggagatcgagaccatcctggccaacattgtgaaaccccgtctctactaaaatacaaagaaatagcaacctgggcaacagagcgagactctgtctaaaaaaaaaaaaaaaaaaaactgaggcttccagtt

SEQ ID NO: 188960 - DNA, 601 bp, Human
aggaaggggaacatcacacaccggggcctttcgcggtgtgggggtcaaggggaggagtagcattgggacagatacttaatgcatgcggggctgaaaacctagatgatgggttgatgggtgcagcaaaccaccatggcacatgtatacctatgcaacaaacctgcatgttctgcacagaactgaactgaaagtataattaaaaaaaaaaaaaaaagctgggtgcggtggcccacacctgtaatcccagcactttgggaggccgagacgggcggatcacaaggtcagcagatcgagaccatcstggctaacacagtgaaactcagtctctactaaaaatacaaaaaattagccgggtgtggtggcgggcacctgtagtcccagctactagggaggctgaggcaggagaatggcatgaacctgggaggcagagcttgcagtgagctgagaatgcgccactgcactccagcctgggggacagagtgagactctgcctcaaaaaaaaaaaaaaaaagaaagaaaaaggagcgttgcttgtttcaggccacaggaaggggagagatagtgaaagtttttcagagaaggtggccagggaaggagaaga

SEQ ID NO: 188961 - DNA, 601 bp, Human
tgcagcaaaccaccatggcacatgtatacctatgcaacaaacctgcatgttctgcacagaactgaactgaaagtataattaaaaaaaaaaaaaaaagctgggtgcggtggcccacacctgtaatcccagcactttgggaggccgagacgggcggatcacaaggtcagcagatcgagaccatcctggctaacacagtgaaactcagtctctactaaaaatacaaaaaattagccgggtgtggtggcgggcacctgtagtcccagctactagggaggctgaggcaggagaatggcatgaaccygggaggcagagcttgcagtgagctgagaatgcgccactgcactccagcctgggggacagagtgagactctgcctcaaaaaaaaaaaaaaaaagaaagaaaaaggagcgttgcttgtttcaggccacaggaaggggagagatagtgaaagtttttcagagaaggtggccagggaaggagaagaaaggactgtaggcagagagcatagcctgtacaaagccatagaggcaagagaaaccaggagctgtagagaagttggcaaggctgttgaacactatggtgaacactatggcggcttccat

SEQ ID NO: 188962 - DNA, 601 bp, Human
tgagcagtactgctccaagtgtgacccaaaaccagcagcagcagcagcagcagcccgagctgtgagatggcaaattctcaggccctacccaagacctgaaggagaagctacattttttttttttttgagacagatttcactctgttgctgaggctggagcacagtggcacaatctcatctcactgcaaccttcgtctcctaggttcaagcgattctcctgcctcagcctcccgagtagctgggactataggcacccgccaccacgcccggcaatttttgtttgttttgagatagagtctckctctgtcacccaggctggagtgcagtggcacgatctcagttcactgcaacctctgcttcctgagttcaagcgattctcctgcctcagcctcctgagtagctgggattacaggcgccccccaaccacactcggctaatttttgtatttttagtagagacggggtttcgctatgtaggtcaagctggtttcaaactcctgacctcaaatgattcgcccacttcagcctcccaaagtgctgggattacaggtgtgagccaccttgcctggccaatttttgtatttttagtagaaacaggtttc

SEQ ID NO: 188963 - DNA, 601 bp, Human
cttccctgttggtccacagccagatgctgatgtgataacatcatcatttttaaaatggaaagtgaaaaatcaataatatcaattgttttcccttttttagcagaatattatcatgtatacttggtcaaggacggataaataaaaatgaaaagtttattggatgaaacagttggaaagctacagttataataatgttggttccaagaaattttatgaatagcctaattcagtgataatatattgaacttggaattgttttttaaaatttaatttggaaatgaaatttatttatatttttctrgaaatgtaagagtgaacagacctaagaaagaatgggaaaggactgattttccttaaaataaaaggaacagatgtctccatttaactctctaaggaaggaattctgttccttgagtggttggatttcagggtgttttgtttaagctgtttatctgccattttcttcctacctctttgaaataaaaaaatttatgaacagaaactccttgttgaaaaggaagtccaaattctctttctgctagtctctaatattgaatttatgagcttaatatcatgtacaaaatgaacatatgaacatata

SEQ ID NO: 188964 - DNA, 601 bp, Human
ttccatcacgactctaggaataattcgcagttctgaaccatgttttagaaaaacatttccagcaggtctgtgcaggattttttcctattccatcattggtaataattgcacttcttgcagcaggaacttgaaattcttctgttgcaaactgtaagactgctgtgaaaggtgtactttcaggaacagagtactttgtacgccagccgcgggtcagacctcagagtgatcttaaaggaaacctttgacatggtggcgccgggaggaacccagaacccacgccaactccgcggagcaaccccamttcctccatggtgccggggaccacaccgccccactcacccttatccagtttttaaagtgtgtgatgaaaattggttactttggagttcctttttttcttcttttaatcattccatagattaacgggtaaaaatggagactatgcgggttaaggaaagagactgggaagcagcccttgagatctccacagaacctcagggttccatggaacccagcctgcaaaccgctggtctagatgatcctaaataaggtgctaactctaaaacttatttatttctttttaagatctggtgaggaagga

SEQ ID NO: 188965 - DNA, 601 bp, Human
gactctaggaataattcgcagttctgaaccatgttttagaaaaacatttccagcaggtctgtgcaggattttttcctattccatcattggtaataattgcacttcttgcagcaggaacttgaaattcttctgttgcaaactgtaagactgctgtgaaaggtgtactttcaggaacagagtactttgtacgccagccgcgggtcagacctcagagtgatcttaaaggaaacctttgacatggtggcgccgggaggaacccagaacccacgccaactccgcggagcaaccccaattcctccayggtgccggggaccacaccgccccactcacccttatccagtttttaaagtgtgtgatgaaaattggttactttggagttcctttttttcttcttttaatcattccatagattaacgggtaaaaatggagactatgcgggttaaggaaagagactgggaagcagcccttgagatctccacagaacctcagggttccatggaacccagcctgcaaaccgctggtctagatgatcctaaataaggtgctaactctaaaacttatttatttctttttaagatctggtgaggaaggatattatcct

SEQ ID NO: 188966 - DNA, 601 bp, Human
ggcccctgaaagcagagctttgaggaaagataaaccagcagcaacagcagccagttttacagctgaagaatgggaaaaaattgatggtgatataaaggtatatagtaataccaattttccatagatattgttgagacattctatatatgtttacttcacttatcggaaatcctaggcttcttgtttgtccgtaaagggcttttagtgtcaattaggcaggattggttgctttttacacccaggggaacattgcgaattcgcgtgtgtgtgcgtccgtacatgtgtatatttaaattgattraataatattctgtcctattaaaaaacctataatttaatcatcttcaataaatagtgctgtataaacatgtttatttgtaattttttttcttttttttttgagatggagtcttgctttgttgcccaggctggagtgcagtggcacgatcttggctcactgcaacctctgcctcccaggttcaagtgattctcctgcctcagcctcccgagcagctgggattacaggtgcatgccaccatgcctggctaatttttgtatttttagtagagatggggtttcaccatattggccagacttctcg

SEQ ID NO: 188967 - DNA, 601 bp, Human
tttcactgagttttgacaaacgtatatgatacagaacatttccatcaccactaaaagttttctcttgcccatttgtggtcagtgtagaccccactgcctggcctttggcaaccactgaactgtcagcatagttttgccttttctagacttgcatataaatgtaatcatacagtatgttgtcattcctgtgtgtcttctttcacttatataatgcttttgagattcatctgtgttgttgcatgtgtccatagtttgctcctctgagttgctaagtagtatggaattgtatgaatatcccacmgtttgtttacccacttacctttgataagacccgcagtggatgcctaaaacctagataatactgagccctaaatatactatgttttgactgccaaaatgttttccaaagtggctgtaccattgtgcaatcctgacagcaatatataaaatttccacctgctttacatcctggtcagcacatagtattgtccgttttgttagttttagccatcctaccaggtatctcattgtggttttaatttgcgtatctctagtgactaatgatattgagtgtcttttcatgtaacttctattgtgaggt

SEQ ID NO: 188968 - DNA, 601 bp, Human
caccacccccggccttttttcatttttttttaacagtatctttggaaaagtgaaatttttaacttttgatgaaatcttttttttattgtttgggcctttgtgttttatctaaaaaatctttgtttaatccaggacatctaatttttctcctaggaagtttatagttttaattcttatatctaggtctataatcagttttaatttttgtattggtgtttgaacaaaaagtgttcaagcaccatttaataaaatattatctttaaatttcttggtaccattgtcaaaaatcagttgaccaaakctgggtgtggtggcgcatgcctacagtcccagtttctctggaggctgagacaaggggatcacttgagcccaggagttttaggctatcatgcactattaccaagcctgtgaatagctgcttaactctaggctggacaacacagcaagacctcatctctaaaaaatcttttttaaaaaatcaactgggctgagcacagtggctcacgcttataatccagcactttgggaggctgaggcgggtggatcacttgaggtcgggagttcaagaccagactggccaacgtggcaaaaccccatctct

SEQ ID NO: 188969 - DNA, 601 bp, Human
tattggtgtttgaacaaaaagtgttcaagcaccatttaataaaatattatctttaaatttcttggtaccattgtcaaaaatcagttgaccaaatctgggtgtggtggcgcatgcctacagtcccagtttctctggaggctgagacaaggggatcacttgagcccaggagttttaggctatcatgcactattaccaagcctgtgaatagctgcttaactctaggctggacaacacagcaagacctcatctctaaaaaatcttttttaaaaaatcaactgggctgagcacagtggctcacgcytataatccagcactttgggaggctgaggcgggtggatcacttgaggtcgggagttcaagaccagactggccaacgtggcaaaaccccatctctactaaataccaaaaattagctaagcatggttgcgtgtgcctatagtcccagctactcaggaggctgaggcacaagaattgcttgaacctaggaggcagaggttgcagttagctgagatggtgtcactgaactccagtctggatgacagagcaagactgtctcaaaaaaaaagaatcagttgatcttatgtgtgggtctatttctgac

SEQ ID NO: 188970 - DNA, 601 bp, Human
aaatgctatactcattaaacaacaactccccattttccccactcccctgtcccctagcaaccaccattctattgctgttcctataagtttgactactttagatacctaattttaatttcaatttttaattatacaagtttgtatttatctaattgctttttcatattgacttcatatcctgcaattttgttaaattcatggattagttctaggaatgtttttgtagattcattggattttctacctgcaggatcatgccatctgtgaaaaataagagatgtgcttcttttccagtctgccttttatttatttatttatttatttatttatttttttatttttttattttttacttgctttattgaactggctagaacctccagttcagcagaagtggtaagagcagatcctcgcctatttcccagtcttacagggaaatcgttctgactttcactgtgaaatataacgttagctttaaattttgtgtagatgccctttatcaagttgaagttttcttctgttccttgtttgatgagaatttttatcatgaatgggttttgaattttgtgaaatgctttttctgcatttattgagatgaaca

SEQ ID NO: 188971 - DNA, 601 bp, Human
gctgaattcagcaagaccacagggttctgtctgggtacttttcctgtgctgcagcctggaaactgcagtgagttggagcaaatgtagggcttacctcatttgttcacccttctttcaagaatcactgtcctgtgccacctgttgtctagtgtctgaccaccatcactccatatatcttacccagttttctagaatttaggtaagagagtaaatctagttcctgactccgtcaggccagaagaagtccctttattgatttttctttttttttttctgagacggagtctcgctctatcgcccrggctagagcgcagtagcacaatcttggctcactgcaatctctgcctctccagttcaagtgattctcccgcctcagcctcccgagaagctgggattacaggcacgtgccaccgcgcccagctaatttttgcattttttctattaatgtgtttctcattgttttgtaagagttctgtactgtatattgtaaattttcctctagcttgttgtttaccttttaaatgttgtgtgtggtgttttttatttttttaaatttttatgctatcctcttaattttattctttaagaacttttcattggc

SEQ ID NO: 188972 - DNA, 601 bp, Human
ggccaaggcgggtggatcacttgagcccaggagttcgaggcctgggcaacatagcgagaccccatctctacaaaacatttttttttttattagtgtggtgtggtggcacatgcctatagttctagttctatctattcaggagactgaggtaagaggattgcttgagccctagtggtcaaggctgcagtgagccatgatgacaccactatactccagtctgggcaacagagcaagaccctgtctctaaaaacaaagtgcaaattagggcttgaggtattaaatatttagtataatataacartatctaataatttagatattatgtgtttctcaaatatctgcttgtgacagaaaatagcccttaagggggatacttgtcaaaggacaaaattacaacaaatttcaagatctaattggcttctattaacaattcatgaatcaggatggcatctcctctaaaaatttagaaaatatgctccaatggccatggcagaacagctggtttttataaggtagcttgagcagggataaggcatacaaaaaatagactatttaataacaggttactttccttgtaagggttaaagcagaaatttggcta

SEQ ID NO: 188973 - DNA, 601 bp, Human
gtttatatagttcttagtattgctattagcaaacctgagcctaatgagaatgaagatatgtaatagtttaaaaacaaatcagtacctactttattattataaattctgctatacttacctttcttcagactatatagataaatattttaaagttaatattccttagtacttatctagcaaaaaattgtaccctctctgggagactgattatttgtgagcattatggctattgtttgcctttctctcattctgttctggtgcagaacctgccctctgtctttagcagtgggaatgtggctaytttgggccactgttagtgcttggttaggatgggcccatgacccaagctagccaatcagtccttccttggaatttctctaactgaagatggagagaagagtcactctccttttcctctggtggagagagctgtgaggttataattccagaatgcttgtggtgatgtttcctgccacatggagaaagcaagtacccatcagggaaagtgaaatcagtaggtagagaggagcagaacctgggaggggcagggagagctggagaaagggcataggaatcccctcatccagcagcacccttgccc

SEQ ID NO: 188974 - DNA, 601 bp, Human
tgatttctcatttagattttcatagctcattctaacactaaaattcaaattggtcaaatttataattatgttttaaaatagcatattaaaatatgtcagataaaatttctaacttttcaggcaggcgcggtggctcatgcctgtaatcccagcactttgggaggttggggcaggcggatcacgaggtcaggagatcgagaccatcctggctaacacggtgaaaccccgtctctactaaaaataccaaaaaaaattagctggatgtggtggcatgagcctgtagtcccagctacttgggagrctgaggcaggagaatcgcttgaacccgggaggcagaggttgcagtgagccgagattgtgccactgcactccagcatgggcaacagagcaagactctgtctcaaaaaaaaaaaaaaaaaaattctcacttttcagaattaccaaacttgattctttttcaaagtaatgacttattacacaaagttctccttatataatagttaatgatgagtactagagaggcattcattgtcagtattaaataattaccaaattatacattgaaacgtacccaaaaaatcaaatgcgaattatcaaagtg

SEQ ID NO: 188975 - DNA, 601 bp, Human
tcttttatgtacctcagtgtcatctcctatgtgtgtatcaacatgaaaaagggtgtagttgagctttgggtaattacatcctaaagtattctgtgctgctcatatcttccacttgccaaatatgttgtaaccataatgccacatattaaaaaacataacttttatattggtaaattttcagctcttctgcgtcgtgctactacatataaacatcaaaacaagctccgggaagctacagaagatttgagtaaagtactagatgttgagcctgataatgatttggccaaggtaagtatagaaygtgatttctcacctaattctgtagttggctgtttctgtatttattttaaagtggtatcaatcttgccaaacaaattatgttgaagatcaggtcacagctttaaaaggtaggtatattccagacaccccaaaacgttaacatctatttcaagtggaagaaagcagaatcttaaaattttttttcaaaactataaaccttcctctgaaagacaaatatcaatttttctttttcctatagtgttgtaggcaatgtttttctctgagccatgtggagtggtatagaaggtaccttcctaggtag

SEQ ID NO: 188976 - DNA, 601 bp, Human
ttctgtagttggctgtttctgtatttattttaaagtggtatcaatcttgccaaacaaattatgttgaagatcaggtcacagctttaaaaggtaggtatattccagacaccccaaaacgttaacatctatttcaagtggaagaaagcagaatcttaaaattttttttcaaaactataaaccttcctctgaaagacaaatatcaatttttctttttcctatagtgttgtaggcaatgtttttctctgagccatgtggagtggtatagaaggtaccttcctaggtaggattaggggtgaactcygtggccattgaagagtgtttctctttgtaatgagcatggtagcatttgctacctgactgagcagactgactcagttatacacttaggggatctgtattcacgcctaaagagtagaggtaagtgtcaagaactgagattttcccctgcttacaaatgaacaaggtggcctaccagaggatacaagatatcctgagtcaaacacgaaaagactttgtcactccaagcagatgagcttcacgttcatgtcagttccccttgctcccaagtcccacaggggtgacacagagtggcccagatgga

SEQ ID NO: 188977 - DNA, 601 bp, Human
ccaagcacttcaggaggctgaggcaggcagatcacttgatcccaggagtttaagaccagcctgggcaagacagctgaacttcatctccacaaaaaatttaaaaagttagccagacatggtggtgtgggcctgtagtcctagctactcgggaggcaggggtgggaggataatttgagcccgggaggtcaaggctgcagtgagctgtgattgcaccactgtactccagccggggcagcagagggaaaccctgtctcagaaacaacaacaccaccaacaacaaaacaaaacaaacaaaaaagcyacagaccacagactgggagaaaatatttgaaaatcgtatatccaacaaaggatgatatatctatttttcatcagagtcagcataaaatatttcagaattttcagcattactctaaaacagtaatgtgggctgggtgtggtagctcacgcctgtaatcccagaacttcaggaggctgaggtgagaggattgcttgatcccacggtttgagactagactgggcaacatagtgagacctcatctctatattttaaataaacagcgtatgtagcatgatttcatttgtgtaaaactgtacatct

SEQ ID NO: 188978 - DNA, 601 bp, Human
tgacacagaccatttgccagttaactttaaatatctctctttgataattgttttgtatatatctacttgattgcaaacaaatgtgttggtttcaaaacaggtatgggtagccccatttatatgccaaaaatgaacgtattactagaaaattgctatgtgtgtttttcaaaaatattttaaatatgcaaaagaaataagtataatttaacacttgaaacaatattttaagagaatctagactagataaagggttatcttcataatataaaacatcgaaagttatgtcaactttgaggggaargatttgcctcctcacatgacaagggacataaaaacttttccctccgtcagctgggcgcggtggctcacacctataatcccagcattttgggaggccgaggcgggtgcatcatgaggtcaggagttcaagaccagcctggccaacatggtgaaaccctgtctctactccaaatacaaaaattagctgggtgtgatggcatgcacctgtaaccccagttactcaggaggctgaggcaggagagtggcttaaacccgggaggcggaggttgtggtgagccaagatggtgccattgcactccag

SEQ ID NO: 188979 - DNA, 601 bp, Human
tcaggttatttccagtattcactaatcatgagtaaaaactgctatacacactcatttgcaggtttttgtgtaaacatatgttttcatttcccctgagtaaatagctaagagtgggactgctgggtcatacggcaagtatatgtttaactttattggaagttgcctgactgttttccagagtggctataccattttgcattgccattagtaacatatgagagttctagatgcttctcgtccttgccagcatttggtattgatttttttcccctttttacccattctattaggtgtatagtgktttctcatcagttttaatttgcattttcctgatgagaatctttttatgtgctcatttaccatctctatattactttttgtgaagtgtctcttcaaattattccaccaattttcaaaaattgggttgttgttttcctactgttaagtcctgagaattctttttataatcttgatgcaaagtcttaaaatttttttgtctgtagcttttttcattcttttaacagtcttttacagagcaaaggtttttcattttgtagaagtacaatttatccagtttttttaatggactgtgcttttaatg

SEQ ID NO: 188980 - DNA, 601 bp, Human
ccctgagtaaatagctaagagtgggactgctgggtcatacggcaagtatatgtttaactttattggaagttgcctgactgttttccagagtggctataccattttgcattgccattagtaacatatgagagttctagatgcttctcgtccttgccagcatttggtattgatttttttcccctttttacccattctattaggtgtatagtggtttctcatcagttttaatttgcattttcctgatgagaatctttttatgtgctcatttaccatctctatattactttttgtgaagtgtctsttcaaattattccaccaattttcaaaaattgggttgttgttttcctactgttaagtcctgagaattctttttataatcttgatgcaaagtcttaaaatttttttgtctgtagcttttttcattcttttaacagtcttttacagagcaaaggtttttcattttgtagaagtacaatttatccagtttttttaatggactgtgcttttaatgttatatcgatgaacactttgcctaagtcaaagtcatgaagattttcttgtaagtttttctttttcagagatagggtcttgctctgttgtt

SEQ ID NO: 188981 - DNA, 601 bp, Human
tgtagctgtcaaagagtttggtatttattccatctatctccttacagagacgcaatcagaggaaagtgagcatctaccctcccttgcagtgctgttggtgttgctacttaaaaatgaaagctaagaaaattaaagtcactcacaaacagaagaataaatatagatcagtatttctcttgtgctagaactggcaggatcaggagagtggaagtcagggatttccaggagttcaaacaatcaacaaaatcataaaggtgaataattttgattatgtgaaaatgaaaaacgtgtatgttaggcrccataaaaaaaactaaaagacaaatgacaaactaggaaagatggcaaagggttgataaccttataatatgaaaagtttctacaaaacaataagaaaaagatgaggtgctagtacaaaactgggcgaagcatacagacaaatcactaatgaagaaatagaaatgatcagtaatctttgtattactcataaaaatgaaaatcaaatattctttttctttcctatcaaattggctgagatagaaaaaatagtaccctttgttgtcaaaagtgaggtaagataagcattaaaaatattttaata

SEQ ID NO: 188982 - DNA, 601 bp, Human
gtgtctttatagcagcatgatttataatcctttgagtatatccccagtaatgggatggctgggtcaaatggtatttctagttctagatccttgaggaatcgccacactgtcttccacaatggttgaactagtttacagtcccaccaacagtgtaaaagcgtttctatttctccacatcctctccagcacctgttgtttcctgactttttaatgattgccattctaactggtgtgagatggtatctcattgtggttttgatttgcatttctctgatggccagtgatgatgagcattttttcrtatgtctgttggctgcataaatgtcttcttttgaaaagtgtctgttcatatcctttgcccactttttgatggggttgtttttttcttgtaaatttgtttgagttctttgtagattctggatattagccccttgtcagatgagtagattgcaaaaattgtctcccattttgtaggttgcctgttcactctgttggtagtttcttttgctggatgcacaagttttaaatttttatatgaagtccaattttttttttcagagccccccttaagaaagatttttttcagattttttttcttttg

SEQ ID NO: 188983 - DNA, 601 bp, Human
tctagttctagatccttgaggaatcgccacactgtcttccacaatggttgaactagtttacagtcccaccaacagtgtaaaagcgtttctatttctccacatcctctccagcacctgttgtttcctgactttttaatgattgccattctaactggtgtgagatggtatctcattgtggttttgatttgcatttctctgatggccagtgatgatgagcattttttcgtatgtctgttggctgcataaatgtcttcttttgaaaagtgtctgttcatatcctttgcccactttttgatgggggtgtttttttcttgtaaatttgtttgagttctttgtagattctggatattagccccttgtcagatgagtagattgcaaaaattgtctcccattttgtaggttgcctgttcactctgttggtagtttcttttgctggatgcacaagttttaaatttttatatgaagtccaattttttttttcagagccccccttaagaaagatttttttcagattttttttcttttgttgcttgtacttttgatatcatatataagaatccattgtcaaatccaaggtttaaaaacttactcctgtgtttta

SEQ ID NO: 188984 - DNA, 601 bp, Human
ttgtggtggtgtaagagtagaggaaaaacagtttgtgagagtttttccaaaagagcgtccaacttagttttgttttctgttttgtttttatttgtttttagtatgtggaaatccagttgtcacatcaccatttgtttaaaaaaaaaaacaaaaaacaaaacaaaaaaacctgttcttttcctactgaatagacttggcacccttgtcaagaatcaactggccaggccgggcgcggtggctcatgcctgtaatcccagcactttgggaggccgaggcgggcggatcacgaggtcaggagatygagaccatcctggctaacacggtgaaaccccgtctctactaaaaatacaaaaaattagccgggcgtggtagcgggcgcctgtagccccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaatcaactggccatagatgtatgggtttacttatcaactctcagttcctttccactggtctatgtgt

SEQ ID NO: 188985 - DNA, 601 bp, Human
ttaatgtgtttttatacttgatgcttgtcttaaggtgatcatccactgattttcacttaaataattgtgcttttctattccctctgtctctgtgcttaaaatcttggctttaccattcatgaaaaagaatggaaaatatatccattaagaatcagataagaattcgttaaaagagaaagcttggaaatctctatatttaagtactttttaacggtgctgtgaaatgattaattgctttgttttaaatattgctaagacaccataaattaaatatttacacatcctttttatatttaaaaayagattcaacaattattaaagctattaatacctgaactcctaatcaaaatcaaagaaatttttagtttgaataaggcaatgggatggaaaatttgctgtgtttttaaggctccctttaagtttaaaaactaggtgcctaatttgtgacttttttgctaaattcacttttaaaatgacttaaaaatcacttacgctttatttttctttcaaatctttttctcctaatcttttaaaataaggaaaggtgcctccgtgttgggtattataattgtattcaagtttttgcaactccattcaaaaa

SEQ ID NO: 188986 - DNA, 601 bp, Human
taactaattccaatccactgcggcatcagagtaactttcctgaaacattattttgttcagattgtttccaacaggcctttaatggctcagtattggcttcgaaataactgtaaacttctctgtcactacactgcctccaagcaagtttctccttccgtttggtctactggaccacttgcttactctcgcccaccttgttctctgagcccttgcccatgttgcccctaatggtggtaatgccctttgcacatcttatcttctgaagttcttgctcagctgccccttctctctaccttcttgrgtgccctagacttcctggtcatctgcaggcctgtaacacctacactgacactcggtcacacctctaagtcctgttatccactgaagggggtttaaacacatcgaggttaggaaccatgtcttttcttttttaatagacaaataatcactgtacatatttatggggtaccgagtgatgcttcgatatatatgatgtggccaggcacagtggctcatggccaggcacagtggctcacgcctgtaatcccagcattttggcaggccaaggtgggtggattgcttgaggtcagtttgagaccgt

SEQ ID NO: 188987 - DNA, 601 bp, Human
gcctgacatcagaccgcatcctcagttgtgctggctcacactcgctaatcattacatttttcaggattttgtgagctggttgatgtcaagttgatattttgaaatctgccatggtgggataccatttaataccatgaaatgagcaaatgccacaaatctgggcttcccacccctccttttttctttacccagagagccagttgttaagggcttttaccagtgctcctaacagaccagaccatgtgaatttgttggataccaagcccgtggtgatttgcagccaacatcctttcagctcaastgtctgtttctaatccattacccttcagacttgttttaggcctttccacagtgagggaggtcaggacactttagttaaaacttgagacccctaacattagagctgctgcaaaagagtggatttgtgttgtccttatctgagatcctctaaggtgattaacatttactggctaaaattggctgtgtttcagtgtagacagaggagaaagtcaagtatgggactccagccatggtgtccagggtggctagagtaggggcttgtccaaggggagggcaggagatggctcaccagagagggaag

SEQ ID NO: 188988 - DNA, 601 bp, Human
atcattacatttttcaggattttgtgagctggttgatgtcaagttgatattttgaaatctgccatggtgggataccatttaataccatgaaatgagcaaatgccacaaatctgggcttcccacccctccttttttctttacccagagagccagttgttaagggcttttaccagtgctcctaacagaccagaccatgtgaatttgttggataccaagcccgtggtgatttgcagccaacatcctttcagctcaagtgtctgtttctaatccattacccttcagacttgttttaggcctttcyacagtgagggaggtcaggacactttagttaaaacttgagacccctaacattagagctgctgcaaaagagtggatttgtgttgtccttatctgagatcctctaaggtgattaacatttactggctaaaattggctgtgtttcagtgtagacagaggagaaagtcaagtatgggactccagccatggtgtccagggtggctagagtaggggcttgtccaaggggagggcaggagatggctcaccagagagggaagtgggcgtcggtttaggtaggttgtgctaaccttaagagctgttttct

SEQ ID NO: 188989 - DNA, 601 bp, Human
tgagttcttttttttttttttttttttttggagactgagtcttgctctgtccccgaggctggagtgcagtggcgcaatctcagctcattgcaacctctgcctcccaggttcaagtgattctcctgcctcagcctcccgagttgctgggattacaggcactcaccaccgcacctggctaatttttcatattttttgtagagaaggggtttcaccatgctgcaggccaggctggtcttgaattcctgacctcaagtgatccacctggtttggcctcccaaagtgctgggattacagggatgarccactgtgcctggcccaaaagttcttatcaccagataagtggtatcaggagtcaaacactgagaaagaaaaacaggcaaaatttaaaataagaggagaaaattttacctatgaaaataatttttagatgtattttgggaaaaactaccatttgattttaaatgtcttacctctgaggagcattggttgttttccaggggtgtgtttggagagtggccatttggagtgcagagttggggttgggggggtgttgaagatcttgaaggtctctaagcctggcctctcccctcaccacagcatc

SEQ ID NO: 188990 - DNA, 601 bp, Human
atagatgtccacttcaggctttaagaggagtgttcactattcacaaaataattgccaagcaaaacactgtggatatttgtatcccatttcattgactggttctgtcgtatccaagcttaaccagaggtctgaagtgctcgtgtaccactgtaaaagcgctgtgtgaggcagcatagatggagatgacagaaaacactgtgagggttgctagttcacatgtgcagccttattggagactctgcctcttgtcatatagtcacctgagccctgttagcattgtttgcttaattctctccatctstaaggtggttctggcctctgttactgtctttagaatcccagtagagaaaagatggcatgtcaagatggataacatgacagaattattacttgtatcttattttatttttttgagatggggtttcgctcttgttgcccaggctagagtgcaacggcatgatcttggctcaccacaacctctgcctcccaggttcaagcacttctcctgcctcagcctcccgagtagctaggattacaggcatgtgccactacgcccagctaattttatatttttagttaagatggagtttccatgttggtc

SEQ ID NO: 188991 - DNA, 601 bp, Human
gctccagactgaagcgctccccatctcttctgcactcagggctggatatcatcccctacctccctcttccagtcagcaagctcagatgctcctaccttctaaatcccaaatccatcttcagtgtgaccctttctgtctccttgccaccatccccctgtcattcccttgctctgggccactgtcctctcctcctaaatgtctgcagcacccttatggtgtccttgcacagctttgttccatcatctcattctccaagctgtagccagagggactgtctaaaacatggcaaatgtgtcagccyctattaaaaacccttcatcggacttccattaagctcagtttataaagctcaacttccttccatgacttacagtgcccttcgtgatctggcctgcctgctcttccagcctcatccctgcattccagccatatggaactcttcttaattcttcaggaacaccatattctcttccactgtaggtgcaggtctgtgcactcgctgtgtccttggcctccactccccgctacctccatctgaactttctcaacccagtgcatttgcattggataattcttaacttcatactctggatttcaactt

SEQ ID NO: 188992 - DNA, 601 bp, Human
aaagtggatattgtatcattccacttttcttcacacagattcttctgcatggaaatcctgaggaatgaatgttcatatttatagaaaataacatcacaaggaaaaaccagaacatattggaaaatagtacttcctgaaataattttttaagctcaattttattaaggtgtaatacaatgaagttcatacattgtaattgtgcaggtcattgacttttggtatgtgcatatcctcttgtagccaatatcccaatcgagataaagaacattttcttctgaaggtggtgtgtgctaaaaaaaaataacattttcatctttctagaaagttctctgtgcccctgtacaataaatcttcctccctccacccctaccctcaggcagccattcatctgatttctatcactatagattagttttgattgttttggacattaccataaatcatatagaatggactctactgtttggcttctttcagcataacctgagatttgtttatattgtgtgggtatcaggaactgttcctttttatcaccgtgttgtatgaatatatcacaatttgtgtatatattcaccagttgatgacacttaggttgtttcca

SEQ ID NO: 188993 - DNA, 601 bp, Human
gtcagatcctgaggggcttggtaggccatgctgaggaggctggacttaattctgaaggtgatggagcctccagagcagggtaaatggtggtgtaatggatcagatttggggacctcatggaaggttgataagaggggcccaggatgaggaggaaggtaagtgagagatcaccaaggtgagaagcaggtacctgaaggaaagtaatgtccaaggaaagggagaagtatgttagctgctgtggctgctataacaaagcgccatagactgggtggcctgaacaacagaaatctattctggaggygggaagtctcagcttgcggtgttaataggggtggtctcttcagaggcctatgtctctggcttacagttgctgtcctctccctgggtctccatgtggccttccctctgtgtgtgtgtgcccaaatcttctctttttataaagacacagtcatcttggactaggtagggcctactgattttaacttgattacctctttaaaggccctgtctccaaatatggttacattttgaggtactggaggttagaacttcaacacaggactttctgtggggacgtagttcagcccataacagaagggaa

SEQ ID NO: 188994 - DNA, 601 bp, Human
gatgcctcccaggttctggctgggtggctgagggtagtggtgtgataatggggagcattcaggagcggggcagtttgggagtggggagaggattgttttgactgattgagtctgagatagttgttttaattccgtgcccatgactgaaagggaactatctaggttctgcagggagaagagcagtcatgttgcataatatagcaaatgaggaccacccaggtgcactgaatggccaccttttccagattgtagatccactctggctgcagtgcagtcagcgtgcatgtcccgccaggacccycgtgctgccctgtgacccccgccccatgctgagggagccacacagtgtccatgtgaccctaacacatgcctccccgccggccctctttttttttggttagcaacacactcacttgtaaaaaaaattcctagatggtgtatggcaccacaaattaaaagagactcctttgaaatttactcacctctttgagcttagtagatttggtaaatgaggatctgtatggctcatgagtttacagatggccaaactcttggagcacatttacctcttactggctgcctgactttctgaacctggtga

SEQ ID NO: 188995 - DNA, 601 bp, Human
cttttcaaatgtcttataggagggaaaagcctttgtatcttaccatgccgggggaaatgaacaacttgcaatttgcttcgcactctgaatcccacgtttgcaacatgtagagcaagcactttagacaccacaaaacaagggcagcctacattacggccaaatataggatgtgtttctaaatcgtgatgcagtaaagcctacgattccttttccagcgttcaaaatcctttgaacactcccaaaaaaggatgccagggccagcgcctccctccaagaggaagcccctttcttctcagctctsaccgcagcctgccacttcccccaacacattcaaatcatttgagagacggagagctggggagcgtgcgccggtggggacaggcgggagagctcggtttctgcattcccaccctccacgtctgacctcatcctcagtcatttcggcgcagcggggccccacctgcacctcgctcctttttactgcgtccctcgccagctgccccgctattagggaaacacacctctgaatcacccagttcactcggacaccctgggcccccgatccgacagccttcctgcttcgttcctcccctcccaaccc

SEQ ID NO: 188996 - DNA, 601 bp, Human
tatattcgccacccaggaccagtttattaaacgcgcactacattcaattcttttcaaatgtcttataggagggaaaagcctttgtatcttaccatgccgggggaaatgaacaacttgcaatttgcttcgcactctgaatcccacgtttgcaacatgtagagcaagcactttagacaccacaaaacaagggcagcctacattacggccaaatataggatgtgtttctaaatcgtgatgcagtaaagcctacgattccttttccagcgttcaaaatcctttgaacactcccaaaaaaggatgscagggccagcgcctccctccaagaggaagcccctttcttctcagctctcaccgcagcctgccacttcccccaacacattcaaatcatttgagagacggagagctggggagcgtgcgccggtggggacaggcgggagagctcggtttctgcattcccaccctccacgtctgacctcatcctcagtcatttcggcgcagcggggccccacctgcacctcgctcctttttactgcgtccctcgccagctgccccgctattagggaaacacacctctgaatcacccagttcactcggacaccct

SEQ ID NO: 188997 - DNA, 601 bp, Human
catataaaccttgaaaatatgctaaataagggcaagacacaaaagaccacatagtgtatgattccatttacatgaaacgggaggacttctaaggggtatggggtttctttttgggggggatgaaaatgttctaaaattgactgtggtgacagctgcacaactctgtgaatataccaaaaaccacagaactgtacactttaaacgggtgaactgtacagtatgtctcaatgaagctgttataaaacaaaaaaagttccattctgcactctagaaatacaaagtactcagaaaggagtacagmatcttgttcactcactttaaaggatctgaactagggcaaagaaaacccagagagattctattacttaacattctaggtactaggtcatactgaaatattcatgaagaattctgttttaatacagaaaaggtatcttaagtttaaaaagacatacaagtgtcagaaaagagttttcataattcaaggagacagtaacacagagaagtcataaatggaaaacaagcttaagaggttttatcacatggatttgtaccttgaaaatgcaagtagctctcaaatttattattgccccacccctgg

SEQ ID NO: 188998 - DNA, 601 bp, Human
ttgaggagggtgtggtttaaggtctaatttctaactagtaagaccccactattcataaattggaaatcatcaaaatttaaaatctttgttcctaaaaaggggcaccatcaagaaaatgaaaggacatgtcagaatccaagaaaatttttgcaaatcatacagctgataaggcacttgaatctagaatacatgaacaacttttataacaccaataaaaagacaacccattaaaaaacgggcagagcatttgaatggacatttctccaaagattacacatacaaatgttcaccaaccacatgraaagatgctcaacatcattagccattagggaaacacagatgactagaatcaaaaagtcagagagtaacaagtgttggcaagaatgtggagaatttagaaccttcatatactcttggtgaataccgtaaaatggtgcagctgctttggagaagtctggccattcctccaatagttaaatatagagttaccatacaacccatcgattacattcctaggtaaatactcaggagaaatgaaaacgtatgttcacagcattattcataatagccaaaaaggaaaaacacccaaatgttcatcaac

SEQ ID NO: 188999 - DNA, 601 bp, Human
ctagcaagaagcggagccaagagtgaagcccagctctatctggccctaaaggcctgcaccctcacggcctcagttcccctaaatacaaaactctcttagaacgagaactacagaaggtacccatagctcactgtccctaactagacaaaaaagttgacatttttctttctcttctgtactaccttgccacaatccaagctttaacgaacacacaaagaaaaggtatcccgaaatggccaactggtttctcctaattctcagaaaggtgctaagtgaatttatttatttatttatttatttwtttgagacggattctttctctgccgcccaggctggagtgcaactctgtcgcccaggctggagtgtgatggcgcagtctaggctccctgcagcctctgcctcccaggtttcaagcaattcccctgcttcagcctcctgagtagctgggactacaggcgcgtgccaccacacccggctaatttttgtatttttagcagagacaggttggccgtgttggccaggctggtctcaaacccctgacctcgtgatctgcccgcctcagcttcccaaagtgctgggattacaggtgtgagccaccacg

SEQ ID NO: 189000 - DNA, 601 bp, Human
aacagacatttaagagagaagagagggaacaggaatgtattcagtacctactctgtattaggcacttcatataattttccttgcttaatcttgccaatgaccctgcaaggtaagccttttgcatctccacactacagaggaggaaagtgaagctcagggaggtgagggagctggcaaagtcacagctagcaagaagcggagccaagagtgaagcccagctctatctggccctaaaggcctgcaccctcacggcctcagttcccctaaatacaaaactctcttagaacgagaactacagaargtacccatagctcactgtccctaactagacaaaaaagttgacatttttctttctcttctgtactaccttgccacaatccaagctttaacgaacacacaaagaaaaggtatcccgaaatggccaactggtttctcctaattctcagaaaggtgctaagtgaatttatttatttatttatttatttttttgagacggattctttctctgccgcccaggctggagtgcaactctgtcgcccaggctggagtgtgatggcgcagtctaggctccctgcagcctctgcctcccaggtttcaagca

SEQ ID NO: 189001 - DNA, 601 bp, Human
taatgtcagatgtaaaatgtattaaacttactctatttgcttctctgcagttccattcattaacagacatttaagagagaagagagggaacaggaatgtattcagtacctactctgtattaggcacttcatataattttccttgcttaatcttgccaatgaccctgcaaggtaagccttttgcatctccacactacagaggaggaaagtgaagctcagggaggtgagggagctggcaaagtcacagctagcaagaagcggagccaagagtgaagcccagctctatctggccctaaaggccwgcaccctcacggcctcagttcccctaaatacaaaactctcttagaacgagaactacagaaggtacccatagctcactgtccctaactagacaaaaaagttgacatttttctttctcttctgtactaccttgccacaatccaagctttaacgaacacacaaagaaaaggtatcccgaaatggccaactggtttctcctaattctcagaaaggtgctaagtgaatttatttatttatttatttatttttttgagacggattctttctctgccgcccaggctggagtgcaactctgtcgccca

SEQ ID NO: 189002 - DNA, 601 bp, Human
actttgattcaaagtctaaaatcctcaggtgggagtaggaatccatacccttaatagcttaatgtcagatgtaaaatgtattaaacttactctatttgcttctctgcagttccattcattaacagacatttaagagagaagagagggaacaggaatgtattcagtacctactctgtattaggcacttcatataattttccttgcttaatcttgccaatgaccctgcaaggtaagccttttgcatctccacactacagaggaggaaagtgaagctcagggaggtgagggagctggcaaagtyacagctagcaagaagcggagccaagagtgaagcccagctctatctggccctaaaggcctgcaccctcacggcctcagttcccctaaatacaaaactctcttagaacgagaactacagaaggtacccatagctcactgtccctaactagacaaaaaagttgacatttttctttctcttctgtactaccttgccacaatccaagctttaacgaacacacaaagaaaaggtatcccgaaatggccaactggtttctcctaattctcagaaaggtgctaagtgaatttatttatttatttattt

SEQ ID NO: 189003 - DNA, 601 bp, Human
caaatctttaaaaccactgcttactagtgctcagattataagactgaggaaatttaaaaggatcaataaaatactgtcaaggagctttacattaaaaatagaaatcaagtttaccaaaggtttatccaagagatatcatgtattttcaagtttcctaaaaatgcatctaaaaatcctcctaaaaacctggaccaaacttcacagtttaatacatgcacaacctgaatatgtgggaaaaagcaacaacaacaacaacataggtacatgctaccaactgtggtgattaactgaagaaaactcygtgaataggcttggtttgcagatctggcaaaagagcatgacgaaaggctaagcaaatggaactgctgcactgggtcaaagactacaaagggaaagccatgtcaggttcacattgttaaataaaaaatccacactatactataaattcacacaactaactataaaaattaattcataccacacaaaggaaggggcagttaagttcctgatcttgggtaaatctgtcaagctcctgccaccaaagtctcctcatctgtaaaatgaggaatagaccagcccacagtgcttcctgttctggctg

SEQ ID NO: 189004 - DNA, 601 bp, Human
taagaatgaaaggaattagaatctttaactaggaaagaatgcttgaccattacgaaaaggaatttaagtatctttcctgtgaagtaagcaaataatggtgattaaacatttgtcataaggaagggatgcttgtgaattttgtcatgcacccctatgatatcaaaagtagaaaatacagcctgacggcttcactctcctaacacttcctttcccatgtgtgtctactatggtctctcatgaaaaatctacagctttgttcatccagaatgaaggcctcagcagttgttgagacatggggacmcacacccagttccacaatggagcaagaaagtctcttacaccaaaccaccatgtgaccagacttgcagtctgtcttggtttcccaaagacagaacaaccacattgtgaaacaataatcaacctttgctaatcctaagtggttttcattatgtctgttacaatctatatattaatagttcagtactgggcctgtgttgttcctgtctaaacttggtgttttcaaatacagacggcctactaatgccaatttttctggcaagatgcaatgcaagggcacctttgcaataataatcggtcttcc

SEQ ID NO: 189005 - DNA, 601 bp, Human
aaatggaaaagaaaaaaaaaagatcagaaagtattttgaaaaaaatttagcagagtcactgttttggagtgacaggaagaacctttctaaagcaggcatggtttcttcctgattccaggtatcaggactagcctccttacgtggggtctgcctgacttcacatgcctctgctcaactttccccttgaaaccttgctgtaatgactgaatgcaaacatttcaaagagacaatctgtttatcagtaaggaacctcctctttaaaaatattaacattgtacacctctaaaagggttaaagaacmtgagtgaaatgacatgaataaagcctgtagtcatcccaaccctgaataacagcggtagtctagcagggaaatgaatttgaaccatgtgctttgctaccatgatttaaagaaagtgagcttaaccagggaagtagaagcttcaaattaagagagagatgaaggaggatgaagaacaaggagggccagcacagacctggagggctgcagtggcatgagacccctggacgccacacagcctgcacagggaggctcctggggcatggggcatgagtccttacttctctttcacatgactaccag

SEQ ID NO: 189006 - DNA, 601 bp, Human
tattttgcatcataaaatgtttgaatgaaaagagttctttgaaaccagtagttcaaacccttcacagaggcactaacagaatggagaggtcaataatttcccactgtttgatgaaaaaagtgactttttgataagtttataaaagaatagaaaaatagacaggacgagtgcccagctctggccattataagatgccccaatttacaatcactaccatgccctgatcaactttccaaaggtcacagaaaccaagccacttcgccaaaacctaagaccctttcaagctgtgaagttcccaaayggaaaagaaaaaaaaaagatcagaaagtattttgaaaaaaatttagcagagtcactgttttggagtgacaggaagaacctttctaaagcaggcatggtttcttcctgattccaggtatcaggactagcctccttacgtggggtctgcctgacttcacatgcctctgctcaactttccccttgaaaccttgctgtaatgactgaatgcaaacatttcaaagagacaatctgtttatcagtaaggaacctcctctttaaaaatattaacattgtacacctctaaaagggttaaagaacatga

SEQ ID NO: 189007 - DNA, 601 bp, Human
catcacaatagtaactaaagagaaattatctattccttatgaaagtaggacaaataattttaagtagaaggccagcaaaaagatccaggggcttcctatccctaatacttttttaaacaactacatttatggtttatggtaccctcaaaaaactaccagaaataacacacacacgtatacacacaaatgcaattacaaaataattcattttttgtgaccacttatcgtgaatacaatataaaccaaagtctacagtttttcagactttagtatgtataaatgaactcctaagcgattagaycattttaacagttgtagtggtgcacaattcaccctatcttaacttactcggtccttgtcaaattctcaagtcaaacgaattctcaaatacattaaatccttggggctccaggagtcactcaaatgccctaaggcctgccctatgatttctctggtgctgggcagggcacacctagaggtccactgcagacaaacctccaccttcacctcctccttcagggagaacataaggctatttaatgacaatagcgcattaaaggatgagaaactcaaaaagagaaagatagtgaaggaaaacagc

SEQ ID NO: 189008 - DNA, 601 bp, Human
taccaaaagacaaagcgaaactgtgtctcttaaaaaaacaaaacaaaacaaaacaaaactgtaattccctcacatcttattaaagagagacccttttatgaactaaaagatgccataatgaggcctgtaactcacttaaaatataatagaaatgacactacagaaattttgcagttactaaaatgtgagaatatataaggacttcgaaatcatctctagctcttcaatgacagaaatatatatttctattacagagataatgtgcaaggatgacatgtttacaaccctccacatctcccarttttctgcttatcaccagcatctttataaacacaaccacctcttttggtccctggagctttgaaaaagcattgctgaagaaacgtcccttgggaagacaaaggcaggcgctacctgacccgcctcctccctccccccctcccccccgcatactcacaacactggcagcagccatctccctaaagtgcaccacaggagaccagactcagaagcttaattctgtgtctctcttcaaagagcagaacacaactcaaagagccaaattaatcccaagaggtctcacaccaaccgcaaaactttt

SEQ ID NO: 189009 - DNA, 601 bp, Human
ttacattttataatctatactcattttaggaacttcttacaaagagacttggttggggaccacctaaagtcaaacctaagcactcactggcaatgtgaagcagaaagcagtgagcgcattgcagagcgtaatgtgacgctatgaaaatgactgccgaaaatcaagtctgacaagaagtaaaatgagcagcaaaacagtaacacataatgaacctgaagacaaaagataaaattcctaaaactgggctgggtgtggtggttcataccagtaatcccagcactttgggaggctgaagcaggargatcccttgagcccaggagtctgaggctgcactgagctattattgcaccactgaacttgataccaaaagacaaagcgaaactgtgtctcttaaaaaaacaaaacaaaacaaaacaaaactgtaattccctcacatcttattaaagagagacccttttatgaactaaaagatgccataatgaggcctgtaactcacttaaaatataatagaaatgacactacagaaattttgcagttactaaaatgtgagaatatataaggacttcgaaatcatctctagctcttcaatgacagaaatata

SEQ ID NO: 189010 - DNA, 601 bp, Human
ccgggaggcagatgttgcagtgagccaagatcgcgccactgcactcctccagcctgcagcctggcaacagagcgagagtcagtctcaaaaaaaaaaaaaaaaaagaggaacaacctgaaagagcatgcataaaacactagaaacacacacacacaccccaaggatagtatctaaaaggtgagacattacaggtgcggtggttcacacctgtattcccagcactttgggaggctgagctcaggagttggagaccagcctgggcaacatggcaaaactccatctctaccaaaaatacaaaaaattagccgggcatgatggcgcatgcctgtggtcccagctactcaggaggctgagggcaggaggattgcttgagcccaggaggcagaggttgcagtaagccaagatcacgacactgcactccagcctgggggacacagtgatacccaaaaaaaataaaaataaaaataaaaggtgaggtataataaagaggtatcatactttttaaagttttcaaagaagagcactcgtatatttacattttataatctatactcattttaggaacttcttacaaagagacttggttggggaccacctaaag

SEQ ID NO: 189011 - DNA, 601 bp, Human
gcacagtggctcacacctataatcccagcactttgggaggccgaggtgggcggatcacgaagtcaagggattgaaaccatcctggccaacatagtgaaaccccatctctactaaaaatacaaaaattagcagggcgtggtggcgcacaactgtagtcccagctactcgggaggctgaggcaggagaattgcttgaacccgggaggcagatgttgcagtgagccaagatcgcgccactgcactcctccagcctgcagcctggcaacagagcgagagtcagtctcaaaaaaaaaaaaaaaaaagaggaacaacctgaaagagcatgcataaaacactagaaacacacacacacaccccaaggatagtatctaaaaggtgagacattacaggtgcggtggttcacacctgtattcccagcactttgggaggctgagctcaggagttggagaccagcctgggcaacatggcaaaactccatctctaccaaaaatacaaaaaattagccgggcatgatggcgcatgcctgtggtcccagctactcaggaggctgagggcaggaggattgcttgagcccaggaggcagaggttgcagtaagccaaga

SEQ ID NO: 189012 - DNA, 601 bp, Human
gaaaccagctgtaggcattcaaatgtactgagacaaacaagagggtatctgttatgaccaaggaagcaaatcttacttctcactgaaaatccttagcttagccagaggactatgtgctcagttgtccaagaaaagaacaacctgggccgggcacagtggctcacacctataatcccagcactttgggaggccgaggtgggcggatcacgaagtcaagggattgaaaccatcctggccaacatagtgaaaccccatctctactaaaaatacaaaaattagcagggcgtggtggcgcacaacygtagtcccagctactcgggaggctgaggcaggagaattgcttgaacccgggaggcagatgttgcagtgagccaagatcgcgccactgcactcctccagcctgcagcctggcaacagagcgagagtcagtctcaaaaaaaaaaaaaaaaaagaggaacaacctgaaagagcatgcataaaacactagaaacacacacacacaccccaaggatagtatctaaaaggtgagacattacaggtgcggtggttcacacctgtattcccagcactttgggaggctgagctcaggagttggagacca

SEQ ID NO: 189013 - DNA, 601 bp, Human
caattaggcaagaaaaaggagtaagagacattcagattggaaagaaagaagtaaaactatttctgtgtgctgaagacatgatcttatatacagaaaatcccgaggaatccactaaaagaaccagtaagttcagtaaggttgcaggatacaagattaatatataaaaatcatttttttttttaagatggagtcttgctctgtcacccagggtggagcgcagtggtgcaatcttggctcactgcaacctccgcctccggggttcaagcgattctcctgtctcagcctcccgagtagccgggamtacactgcacccagctaatttttgtatttttagcagagacagggtttcactatgttggtcagactggtctcgaactcttgaccgcaggtgatcctcctgtcttggcctcacaaagtgctgggattacaggtgtgagctaccatgcctagccgtatttttataaaatcataacaaacaatccaaaagtgaaattaagaaaacaattccactcacaatacatcagaaataaaatacttagaaataaacttaatcaaggagatgaaagactcatactctgaaaactcaaaatactgttgaaag

SEQ ID NO: 189014 - DNA, 601 bp, Human
ctatgggaggaattcaaaagacacagccatcacccttgacttcaaaagccttctaatctccttctaacacagacgtaataatcagagcaactcactaccaaaccgcctagtgctaagtggtacacagtgagaaacaggaaaagtcagcctaaagcagcctaacgggtaagagccaggtctgggaaaagcagagcaaaagtatttaaatggaaagcaatgtgatcaaagtgatgtttaggatgacagtaaatgtggcaggagcacactggacagcttacacaggaacaagctcaaagccagrtactgggctaggaagctatttgacagtaaaccagacttgaggaaggcctggagtgatacagcagtaacagttgggacctaggaaaggaaaaatgcaggggctattgtcggggggaaacaaaaccaggctgggttttcactgagctgatcatccaccacagccacttccctagtaaaccagggactctgaaggggaggggaggtgacacagagctaggttcctaggctgtcttatgtgtcatttcagactccaaattcgactaaatcatctgatagacactgaaagctttgtgctttcaga

SEQ ID NO: 189015 - DNA, 601 bp, Human
agtgtaggtcactgaatgcaaggaaaaaccaaatcataagatcagttagctggggcactgcacacaggtctccctcaaatgggataagtgaaactcagtttctcatggtctgtaaaagcaaagatgaactcacagaacctttgtggatgtgaaagttgaaaggaaatgtctgaattcagaggaagattagccattcattatgtctattttgtgcttcttaattggcttgttccatttctttgaaggaaaaaaaaagtcttacatttatccctcagtctataaaaggggaaataaaaactcrtaactccaaaacaaatcatggtgctccagtgtctgaccttagctaacaagctatggctgtcttctcagttggctgccataaagcctaccagtaaaatgtcaagtttccaaatgccccttgctcttggtgaaggaataagctaaaacaatgtggagaccaaatgcaactggccttgagttcaaatccccactccaaaaccagatgaagaacacttataacagtgtagtgtacttatctgccactgaacgacaattttttgaacagaaataaaagtatctaaataaaaaataaattttcaac

SEQ ID NO: 189016 - DNA, 601 bp, Human
tcaggtgatccgcccgcctcagcctcccaaagtgctgggattacaggcatgggccactgtgcccggccagaaaataacttttatacacagctgcttatgttacagagagagaaacagaggagcggaaggataaagagacacatccacgtcccactacaagtcagtgactgagccaggactgaactccacagctcatcaattcccagatttgtgatcttccctctatgccacattgacgctaagagctaaatacacacactttaatacacaaaaatctcacatagtactcatgaacctatckactatagaaacccaagtattgatcttatttccaatggctgtcacagggcttagcttataccaatgtcacctcctctaaaacaaactcatatttaaggagcaaagctagacagacagtattatagcctgggaaagaccctcgatgctcctctaaaaagcaacacctcatctaaacatgacaatttgtaaagcaacttattctatcctagttcccataatgctggttaaagaatgaaatacaaggacacattcattaagtgtaggtcactgaatgcaaggaaaaaccaaatcataagatcag

SEQ ID NO: 189017 - DNA, 601 bp, Human
ttgatgtatttatccctattactcttttcacttcagattttaagtcctggaagacagaaaccatgtctaacttattttacattctcccagaatctaaccacaagcctcatgaggttgcaataagaagccttatttactgctgacactaaatagctttcaaaagaaattcatggaaaaccatgttttcaaatgggagcctttctgaaagggtcataatccaccttaattccaacgtgtacatattcagtattattatgtacagagtcccaaacgcatcaccaaaactaacctgcctgtctayaaccagaaacaaaaaagggaaaacattctcagaagcccatgagataattattaaaagccatacccatcttttaaggttcgtgtttaaaatcatgccaggctgctatcaacatgtattggagcctaacacacatctaaacatcatttcttgctatcttgatttcaaacataacttcatattataattgggaatttagtttttctttgcctttaaaccaaagcaacacctcatgataaaactatttcatagttgccaagacactaaagttgtaggagtctcttttccagggtaaagagccct

SEQ ID NO: 189018 - DNA, 601 bp, Human
agacataaataaagcaagatcccaaatattcccacacacagctcctaaaataaatgggagaaacacagttgtgtataagaaagtaccacacagctacaacaaaggagcccatgggagagaagaagagatcatgacccaaaaagctaacagagacctggccatacccatcctatcctggccagagcagcattcttgtcccaggtagtttctgtgagggtgaaatcagctatcattccaattcaccaaagttgcttcacagtatttcacaatactcaaggaaggaagggagaaagaaagcaayttgggaagacaggagccatctagttcgcatcctccagccaagagaatgtcaagagatcaagagcatataattcttaccgattcctccccctcttacttgtttaaggcaggatttacaggcttgttgtgatatgaagtgtgtcggggggagggaggggacgggggggttgtatgtgtatctatccagaaacactggtgtgtatgagccctccatggttcacaatagggagggaatgtctcagttctatctacgtcacgagtgtggctactccacaaaggaaaggcttattcatgccaacgt

SEQ ID NO: 189019 - DNA, 601 bp, Human
ttctatttctgcaatactacaaaaatccacctaaactagacatcctggagtctgaaggaggaatgtgcctaccacctacttctttgccctcctagggacagagcccctctactaacttaacagtttaaaagttgggttggctcctcttctgtttcatctttagctcctacgcagaggaaaaaaaaaaacctgaattcaaaccgaaccttctctgtgatgtcttccttaccttctaagcctagggtgaaactatctctcacaccccagtgctaaagcacttcatgcacaaagcacccccctkgagagatcaagcacagttgttgaagcttcttaaaagcaagaacctagccgggtgtggtggctcacgcctgtaatcccactttgggagggcaaggcaagaggatcaggagttcgagaccagcctggccaacacagtgaaactctgtctctactaaaaatataaaaattagccgggcatgatggtacacacccgtagtcccagctactcacgaggctgaggcaggagaagtgcttgaacctgggaggtggaggctgcagtgagtcaagatcgcaccactgcactctagcctggggaacagag

SEQ ID NO: 189020 - DNA, 601 bp, Human
attctaaaatataaaacagtgcttattctagttcttttccccataacaatcaaggaaaataccaattttgccaaattcacactgaaagtgaaagaaagggtcaagaaatgtaggattttctaccaaaaagctatccttcagcttcttttgactcataatgttagttcacactatgcataaatgatttgtttatcttccaatcaaacattctatttctgcaatactacaaaaatccacctaaactagacatcctggagtctgaaggaggaatgtgcctaccacctacttctttgccctcctrgggacagagcccctctactaacttaacagtttaaaagttgggttggctcctcttctgtttcatctttagctcctacgcagaggaaaaaaaaaaacctgaattcaaaccgaaccttctctgtgatgtcttccttaccttctaagcctagggtgaaactatctctcacaccccagtgctaaagcacttcatgcacaaagcacccccctggagagatcaagcacagttgttgaagcttcttaaaagcaagaacctagccgggtgtggtggctcacgcctgtaatcccactttgggagggcaag

SEQ ID NO: 189021 - DNA, 601 bp, Human
tccattagaccacagcttttttttttttttttttttttgagacagagtcttgctctgtcgcccaggctggagtgcaatggtgctatctcagctcactgcaacctctgcctcctgtgttcaagccattctcctgtctcagcctcccgattagctgcgataacaggcgtgtgccaccatgcccagctaatttttgtatttttagtagagacagggtttcaccatgttggccaggctggtctcaaactgctgacctcaggtgatccacctgcctcggcctcccaaagcgctggaattacaagcktgagccaccgcgcccggctaaaccacagattctatatcctcccccctaaagaaaaattcgttcacactcagtagaaaaaaaattaataaaaatatacatgtacaaatcaaataaggactcagcaacctaagttctaattcacaaacaacctcacggtcttggacaaccactcaatttggtttcaatttctacaactgtagaacagaggaatgatcccaccctaccaagtgaaaaaacagagacactgttcatgaaggggactatccacgtacgatctgctgacattctgcagtctcattt

SEQ ID NO: 189022 - DNA, 601 bp, Human
ttatcagcacggcgcctggcacttaaaggaagccctcaacaaatgtgaactgctgcgatttcatcactgtcactgtgtcctcacaaggcatggtatagaccaagtactttccaaacctaagacaattctctgagctgacagaatgaaagccctgtcaagttactgtttttgttattaaactctctaatcccagagaaagaatgcaaaggattcagtgtccattagaccacagcttttttttttttttttttttttgagacagagtcttgctctgtcgcccaggctggagtgcaatggtgckatctcagctcactgcaacctctgcctcctgtgttcaagccattctcctgtctcagcctcccgattagctgcgataacaggcgtgtgccaccatgcccagctaatttttgtatttttagtagagacagggtttcaccatgttggccaggctggtctcaaactgctgacctcaggtgatccacctgcctcggcctcccaaagcgctggaattacaagcttgagccaccgcgcccggctaaaccacagattctatatcctcccccctaaagaaaaattcgttcacactcagtagaaaaaaaat

SEQ ID NO: 189023 - DNA, 601 bp, Human
atgaaagaaggcacttatcagcacggcgcctggcacttaaaggaagccctcaacaaatgtgaactgctgcgatttcatcactgtcactgtgtcctcacaaggcatggtatagaccaagtactttccaaacctaagacaattctctgagctgacagaatgaaagccctgtcaagttactgtttttgttattaaactctctaatcccagagaaagaatgcaaaggattcagtgtccattagaccacagcttttttttttttttttttttttgagacagagtcttgctctgtcgcccaggctgsagtgcaatggtgctatctcagctcactgcaacctctgcctcctgtgttcaagccattctcctgtctcagcctcccgattagctgcgataacaggcgtgtgccaccatgcccagctaatttttgtatttttagtagagacagggtttcaccatgttggccaggctggtctcaaactgctgacctcaggtgatccacctgcctcggcctcccaaagcgctggaattacaagcttgagccaccgcgcccggctaaaccacagattctatatcctcccccctaaagaaaaattcgttcacactc

SEQ ID NO: 189024 - DNA, 601 bp, Human
gggagggctgaggcaggagaattgcttgagcctgggagacggaggttgcagtgagctgagagcgtaccactacactccagcctgggcgacagaatgagactctgtctcagaaaaaaaaaaaaaaaaaattagccgggcatggtgttgggcacctgtaatcccagctacttgggaggctgaggtgggagaatcacttgaacccggaaggcggaggttgcagtgagctgagatcgcaccactgcactccagcctgggcaacagagcgagactccatctctgaaaaaacaaaaaaagatggatmaatctgataatcactggttcctgcaagaaaggaaatgtaacattatgttaaagtcgcacaacgctttacccagcaggcctactctttctcataactaatgtatgttttcacaaagtaataaattcccatggtgataaaaagtgacacattcattcgagtgataagtcaaatcaaatattcccctttaagaagctcaaggtatcccacacacaatttctttcaagtttgcattctggagtgtatcatataaacccacaccttcctagggtgctggattcagactgctttctacacggtttc

SEQ ID NO: 189025 - DNA, 601 bp, Human
gtgtttttaaagcagctagtggtgtattacacatgtaccgcagccatgttcaccttcccaaactctcgaaattcaacattgggaattttgcttccaatatgtcctacatattacaaaagatcattcagaatgactgtttcttcatgtaagaatgattcctcacataattatttctgacccacatattggtttgtggttgaagacactaccaattggtgttaaaatggatcaatctaagctgggcacggtggctcacacctgtaatcccagcactttgagaggccgaggcaggtggatcatstgaggtcaggagttcaagaccagcctggccaacacggtgaaacttcatctctactaaaaatacaggccgggcacggtggctcacacttgtaatcccagcactttgggaaaccaaggcaggcagataggtcaggagttcgagaccagcctggccaaaatggtgaaatctcgtctctactaaaaatacaaaaattagcccgttgtggtggcacatgcctgtaatcccggctactcgggagggctgaggcaggagaattgcttgagcctgggagacggaggttgcagtgagctgagagcgtac

SEQ ID NO: 189026 - DNA, 601 bp, Human
gcaaaaattaaagagataatgtctgagaatttttcaggttcagttaaatgcataagtctttagatttaagatgcacaaatcccacctccggcagtataagtgaaaacaaattcttatctattcatatcctagtgcaatttagaacacctaaaacaaagagaagatcccagaagcaacaacagagaaaggacagattacctactgacagagtaattagactgattgtgagcagatttctcagaagcaatcagagaaacaaaaaaatggaaaacatcttggaaatgctaagaaaaaccaccayccttgtattccatacccagaaaaactatcattcaagaatgatgacaagaaaaaagcaaacaaaaggcactgcagacaaaaagagacagaatttaccatgggtaaacccttgttcaaaaaattaaattcttagatttgtctcaaagaattgctatattaattttgaagaattaagtttaaggactcatttcaggaaaagaaagtaaagtagaaaggtatagcaaaacaacagtgagcaaataaataaataaagcaaatacaaacaggtactatgtaaaacagtactaataataccaacttg

SEQ ID NO: 189027 - DNA, 601 bp, Human
cctcctgcctcagcctcctacatagctggaactataggtgtgtgccaccatgcgtggcttgaatgtgtgatatttcataacttaaaacatcctaaggctggaaggccagaatgaagtttgacacacatttaaatagacaaaccaaaaggagagaattaaaagaatggaacagaggcaaaaattaaagagataatgtctgagaatttttcaggttcagttaaatgcataagtctttagatttaagatgcacaaatcccacctccggcagtataagtgaaaacaaattcttatctattcatawcctagtgcaatttagaacacctaaaacaaagagaagatcccagaagcaacaacagagaaaggacagattacctactgacagagtaattagactgattgtgagcagatttctcagaagcaatcagagaaacaaaaaaatggaaaacatcttggaaatgctaagaaaaaccaccacccttgtattccatacccagaaaaactatcattcaagaatgatgacaagaaaaaagcaaacaaaaggcactgcagacaaaaagagacagaatttaccatgggtaaacccttgttcaaaaaattaaat

SEQ ID NO: 189028 - DNA, 601 bp, Human
actaaatagtaagtaagtgaggacattatcttataaaattttaccagctaaaaattgaaaacaaaatgacagaatttactgtcaccatattgcaacccctagtgaatgactggatataggcacagaatacacaaatggaaaaaggatgaaacccagacactgtgacatcatgtgcttcctagcgtatggaagaacataatgcgaacaatatagtctagccaaaaggacagaacctgaatctgaccgcacttcaggttccagctgccaatttgcaggaaattcagaggacagaggagcaagytgaactgcaacatgagggtacaatcagcaaaatccagatggttgaaaagcacaggtcaaaggtcagggcttccgaatagataaattgtagggaaaagaaaatgatgaaggaggaatctttagattaagacttaaaagactacatatcaagtttttaaaactggcaagaccaatctagagtctagaggtatacacctgagtgattaccactacaaagaaaggcaaggaaatgagtattacaaaagtcaggagagtggttactttgagagggaggagggatgttgtgactgggatggggcac

SEQ ID NO: 189029 - DNA, 601 bp, Human
agcctcaagatgtgagtgaattgctgcaatctcatgataaaacttgaacagatgaggagttgttccttatggataagcaaagaaaatggtctcttgagatggaatgtactcctggtaacgacgctgtgaacactgttgaaatgacaacaaaacatttagaatattacttacataaacttagttgataaggcagcaaaagggtttgagaggactgactccaattttgaaagaagttctatggcaggtaaaatgctatcaaacagcatcacatgctacagagaaagcttttgtgagaggccargtcaatcagtatgacaaactttattgtcgtggtctcatccagcccaaccttcagcaaccaccaccctcatcagtcagcagccatcaacactgaggggaaaccctccacagcaaaaagattacactctctttggtaatacagtatttttaaatgtatatatatatatacataatgctactgcatacttaatagatataattttcccttaaaataaaccaggacttccgaaagaaatggcttgggcagggatgtccaaagtgagcctgaaacacctcaacatatcacatagcaaggaatcta

SEQ ID NO: 189030 - DNA, 601 bp, Human
agccagttagccaagttgtgaatgcaaaagaaaagttcaggaaattaaaagtgctactccagtgaacacatgaatgataaaaaagcaaaaacagccttgttttagtggtctggatagaaatacaaaccagccacaagattcccttaagccaaagcctaatccagagcaaagtcctaactctcttcaattccatggaggctgacagaggtgaagaagctgcagaagaaaagttggaaactagcagaggttagttcatgaggttaacgaaagacgccatctccattatataaaagtacaaggcaaagcagcaagtgctgatggagaagctgcagcaagttatccggaaggtctggataagatcattgatgaaggtggctacactaaacaacacattttcagtgtagatgaaacagccttttactgaaagaagatgccatctagaactttcatggctagagaggagaagtcaatgcctggcttcaaagcttcaaaagatgagctgcctgtcttgttagaggctcacgcagctggtgactttaagttgacgccaatgctcatttaccgcaccaaaaatcctagggcccttaagaattatgctaaa

SEQ ID NO: 189031 - DNA, 601 bp, Human
gaaaaactgtgagtcaataattttatttatttatttatttagagacaggattggtctcactctgttaaccaggctgtagtacagtggcacgatcacggctcaatgcagccttgatcttccaggtccaagaggtcctcccacctcaggctcccaagcagctgggaccacaggcactcaccaccacacccagctaattttttatttttttgtagacacggggtttcaccatgttgcccaggctggtcttgaactcctgggctcaacccgtccacctgcctcggcctcccaaattgctggaatyacaggtgtgaggcactgtccctgcccaatcattttatattcagagaaactcactttcaagtaaaaagatcacagataacttattatcagtatacaagaactcagagaatattgttcccactccttcttaaggaatccacccaagaacaagcttcggatgatccaaatgcctggtgcaagattgacacaatgattgatggagagtacttcaatgtagttactcacagaaccaagggaggagagactgctgaatgtaacagctatgtggtcttgaaaatacagaatacatcatttttaaatg

SEQ ID NO: 189032 - DNA, 601 bp, Human
tataggggatattaagtgattaaagggtgatttaaatatcagttctatacttaaagattttttaaaattagaaagatttatcccaaagcattatttaatttacaaaatgtgcactccagcaatgccaataaaagggcgacattgaggattctgggaagatgagagaatctcagtggcagcattttttgggggtttttccgaagtccctccgtaaaaagacagagctagcagaaaacaaaacaaaacaaaaatccagggacaacatttacacaaactaggtgatatccccaaaatttaagcrggtgggagcaaacaccaacagccacacgacctgcatgtgatcagcctcgggtgtgtgtgggaagggacagcaaggggacacctgacagacctgagggcagcaggccggtgtgagatcagcagcagaaactgggaaggattttgccttttccaacagaagctgggcacatgggtactgaatttaaaaggtctgaagaggcaggcacaatctagaccccagcactctcaaaatcacccacagcgggctcccttccaggatgggcccacaaaggagacactccaggaaatgaaatcgaatttc

SEQ ID NO: 189033 - DNA, 601 bp, Human
gatttgagagaagggagaagcgtcctttaaacttaaaaatttggactattctatagctggagacaattaagactatcattttgcaatatctttccaactcccagactctggaaggaacaattatgcaatcccattgtccaaattagccattttttgcatttgtgtttgattactaccctgcagataaggaacaatgttgaatcaacatcattcactaaacttaagttgactgctctttgtattatttaaagcactattattttcttggagctaatatttcccccaagtaaaatacttaggyagccacaatcttaaaactctctttgagaagatactgctgaagaaaagaactcacagagccaaaactctgcaaagctaggagtgaagtgtagtttctgggagtacaatttacacaactgctgtgtgatagtataaaatgctgtttcacaaagtagtacatgaaaggtaaactgtgtcaatataatttaattttaggctgtgtaaagaagccacgtctaaaaaatgggggaatgtatcttaagattggtgttccctctcctaaaactgcaaagtagctgtcactaaatcaatgcccacaaaa

SEQ ID NO: 189034 - DNA, 601 bp, Human
aatctgtacaaaatggaattaagacgaagccctccctgctgaatgcctgagaggaaccaaaacatcacttccatttttatttcagggcaaaaactatattagaaagcattaaagctcttttaaaaattgtctagcaggttttccagtctttgtcaaatgccttcccacccgccaaaaaaaactatattaggaaaatttataatggaagcaaaaatggattagatagggtatttttgttgatttctacagaagaataaactgatttgagagaagggagaagcgtcctttaaacttaaaaatytggactattctatagctggagacaattaagactatcattttgcaatatctttccaactcccagactctggaaggaacaattatgcaatcccattgtccaaattagccattttttgcatttgtgtttgattactaccctgcagataaggaacaatgttgaatcaacatcattcactaaacttaagttgactgctctttgtattatttaaagcactattattttcttggagctaatatttcccccaagtaaaatacttaggtagccacaatcttaaaactctctttgagaagatactgctga

SEQ ID NO: 189035 - DNA, 601 bp, Human
acactaattggtcatgttagcattaagaagggatttcacttctgggagcctgaatttccttaatactggggacagctgtgcttactcaggggttattagaagggttaaatgagctcaaacattttgcatgccccaaagcaccaccctaataggaaatactgcaactagggagaagagcatggggctttctttggagctagacagatctgggtctggctgagccttttatcagctgtgtgacccttaacaaaactgccactctctgagcctgtttcctaagttgtaaaataggccacactcrtggcttactgtgcggatacaataactaaatattatcatgcacataaaggcttagaatagcgcatggcaaaaaaaaaaaagagcctaccatattttcatgatgactttttttgctgttaatatgaccactatgacgccatatatatttctaggtctgaacatcagaatttcttagaatgagtcttgtcttcaaattaattcagcactgtacccaattaattaatactaactaatttacacccaagatatcattatgtgtgaaagctctggtttatacctaggccaattaccacagtaagga

SEQ ID NO: 189036 - DNA, 601 bp, Human
agaaagaactcttagaattcaaccaaaggacaaataacccaattgaaaaataggccagtcatctaaatagacatttcaaggaagacatataaatggcgaaaaagcacatgaaaagatgtttggcattattagtaattacagaaatgcaaatcaaaaccacaagctctctcttcatgcccattaggatggctagaatcaaaaagacagataacaagtgttcacaagcatgtgaaaaaatcagagcctgcacacatggctggtgaaaatgtaaaatggtatagccaccatttggtggcagacyttggaaaacagcctggcagttccttaaatgattaaacagagttatcatatgatccggtaattccactcctagggatatacccaagaggatggaaactatgtgtctatgcaaaaacttgtacaagaatgttcatagaagcattatttgtaatagcccaaaggtggaaacaacccaaatatccatctatcgataaatggctgaacaaaatgcgacatattcatacactggaatattatttggccataaaaaagaatgaagtactgatacatgctacaacatgagcaaactctaaaaacatta

SEQ ID NO: 189037 - DNA, 601 bp, Human
tgagatcatgccattgcactccagcctgagcaacaagagcgaaactccatctcaaaaaaaaaaaaaaaaaaaaaagaagtaggaaactggagaaaaaaactacacaacagtaacaaaagttgaagctaaactctgggatggacaattgaaccttcctctgccttcttccctataggcaaacaggtaacttcagccccggcagctggatcatatagcctaaaaatatgcagaacacgacaatcacccattctccttcacatgtaaaagggagaatgcagaccagtctgttgctgctgccctrtattgagccttgatgagaaaggtagcagggaattttccatgaaggaattccagctctggaatttttttcctctccttaatcagactgaggttctgagagaacatcaaaaatgattcccaagtatagtcgatggtgattataaaaaacatggcatcttttttgaaaagtgggccttagtttcaatagttacttggcattataattttttatttaactcactatgagtcataaacattgtgtattcccagttaaaaactgaactgcccctcctcctttttactggtgaggggaaagaccttt

SEQ ID NO: 189038 - DNA, 601 bp, Human
tttgctcacaacagatctgtacctttaaatgaagagaaaaataggccaagactgctctgatcatggtgagaagcccaaactgtaatcaagtagctacatagattcagaaacggattctgaaagaagcccacaatgtcaactcattcaccatctcagctcaccaactccttccttccttcaagggtctgccccacgcctccaggcccctttaaaaagaggcagcatgtgttgctcctaggatgttagttcaaggatgaagcaaaatacgggaaggacatcctagaggtggattcttgccaayaaagcaatttggaaatcatttagaaaaaatagtcactaacatccaggatacttaagttacctaagggttagaagtaggaaactggccgggcacggtggctcacgcctgtaatcccagcaccctgggaggccgaggcgggcagatcacctgaggtcaggagttggagaccagcctgaccaacatggagaaaccctgtctctactaaaaatacaacattagccaggtgtggtggcacatgcctgtagtcccagctacttgggaggctgaggcaggagaatcgcttgaactcaggaggcggag

SEQ ID NO: 189039 - DNA, 601 bp, Human
caggctggtctcaaactcctgacctcaaatgatccacccacctcggcctcccaaagtgctgggattacaagtgtgagccaccatgcccggccacctgttgcatctttaacagctgtgtttggaaaagggtgaggaattgattcatcaatattcaatactaagctgcaaaatcaggaatgcagccaattggtttaattgatcaagacttataaactcttaaggactctagtgaactgatacaaactatttctttgtgaaaaaaggctacaaagtgagagacttgagtaaaagctggaaaatktacaactctggagagaagcacaactggggagacagaagcctttataagccttctcttattcacagttggtgtctacacacaacagggtcccactgaccagtaccgctgcctgccttaaaaagcagaaagctcacactcactcaagtgctccaactactgagttttcatcctaggaatactcacagcaacaatctcttgtttcctgggatcaatgactctcactttcttgtctttggaagctgtgcagatcagactgccattccggttccagctcacattgtaaatcatgtctgaatgcat

SEQ ID NO: 189040 - DNA, 601 bp, Human
ccaactaaaaaaaaaaaatcacatagagagttttggtttgtttgtttttgtttgtttgagacggagtctcgctgtgttgcccaggctggagtgcagtggcaccatctcggctcactccgcctcctgggttcaagtgattctcctgactctgcctcccaattagctgggattacaggcacccacgaccacacatagcaaattttttatttttagtagagattaatataaaaaaggggcttataaaaattctcttccttttatttggaagacgtaagtatcaattctttaattgtgagaccagaacagcaagcgttttaaaagtccacataaacacagtgttacacaaatgtttggtacgaccttatatgtgatgatgtagtgctaattattctgttgtttgaaatggccagtggtcactgagtctcagaggatatatttgttgactagcatgagaaaaaagcctgtcccttaggaagcctgctagcatttagaatatgaattttctaaaaatcagaagtagtacagagaggtagaaattatatcatagctgaacttcctaaatcaagctaacctaccgccccattataggacctttggtttc

SEQ ID NO: 189041 - DNA, 601 bp, Human
taccacatatgattgttatgaaaagaaagaggtagcaagtagcatatttagcacagtcctggcatacaataaatgctcaagaaacacttcataaatcggagacattctgaacaactgtgtttatagtctgtcgaacttttagatgacaacaaatgtgtttcaaaatattggatgtaatcataaatttgaattcagtctattttgaaccatattttgattagtttggtttaaaccacaattttcaattatctttaacagctttccttcattattccaactaaaaaaaaaaaatcacatagasagttttggtttgtttgtttttgtttgtttgagacggagtctcgctgtgttgcccaggctggagtgcagtggcaccatctcggctcactccgcctcctgggttcaagtgattctcctgactctgcctcccaattagctgggattacaggcacccacgaccacacatagcaaattttttatttttagtagagattaatataaaaaaggggcttataaaaattctcttccttttatttggaagacgtaagtatcaattctttaattgtgagaccagaacagcaagcgttttaaaagtccacat

SEQ ID NO: 189042 - DNA, 601 bp, Human; identical to SEQ ID NO: 26335

SEQ ID NO: 189043 - DNA, 601 bp, Human; identical to SEQ ID NO: 26336

SEQ ID NO: 189044 - DNA, 601 bp, Human; identical to SEQ ID NO: 26337

SEQ ID NO: 189045 - DNA, 601 bp, Human; identical to SEQ ID NO: 26338

SEQ ID NO: 189046 - DNA, 601 bp, Human; identical to SEQ ID NO: 26339

SEQ ID NO: 189047 - DNA, 601 bp, Human; identical to SEQ ID NO: 26340

SEQ ID NO: 189048 - DNA, 601 bp, Human; identical to SEQ ID NO: 26341

SEQ ID NO: 189049 - DNA, 601 bp, Human; identical to SEQ ID NO: 26342

SEQ ID NO: 189050 - DNA, 601 bp, Human; identical to SEQ ID NO: 26343

SEQ ID NO: 189051 - DNA, 601 bp, Human; identical to SEQ ID NO: 26344

SEQ ID NO: 189052 - DNA, 601 bp, Human; identical to SEQ ID NO: 26345

SEQ ID NO: 189053 - DNA, 601 bp, Human; identical to SEQ ID NO: 26346

SEQ ID NO: 189054 - DNA, 601 bp, Human; identical to SEQ ID NO: 26347

SEQ ID NO: 189055 - DNA, 601 bp, Human; identical to SEQ ID NO: 26348

SEQ ID NO: 189056 - DNA, 601 bp, Human; identical to SEQ ID NO: 26349

SEQ ID NO: 189057 - DNA, 601 bp, Human
ttttttttttttttttttggcaggactcttcacagtctttaatatgctaatgtaaaatgactaggggagcacccagagtatggcatttttgccaaagctatttgctatttgaatactttttcacagaacatcccatgggactgatagaactcattttagaggaaatcaaaaccttaaaacatgtttatgtctgtcatagctaagtgtacttagatgcttttaatttgattatttaaaaacaaaataggagtatcagctaaactacatactaagtaagtgacttgttttgtatggaaaaaaacaccacaaatacttacctaatagaaacaagctataaagatttttacaacccaaaatgtaaaaaatggctaaaaataccaaatattgcacacatacctggcagaattcacatgtaacttgaatttcataagttgaataacttatcacattctttttctcatggcaagaatactgaaaaacaaagtggtttcacactgttaaaaatagttctgaaacacttcttgaaacagtagaaaataaagtgctcaaattactctctgtaacactactgtcaccccaaaactagtcactattaacaatt

SEQ ID NO: 189058 - DNA, 601 bp, Human
tcatcaatgtctgatttttaaaaccattaggagaaaagttgataggaacttcataatggttggaccaggctgacagcatctgaattcacagattagtcttaaattaacaccaaaggttgttaagggtggggacagggaatgtcaaaagtcgaaagtgaatctaatcaagcctccctagctccaactacaaggaaattcaggagacagaaaaagaagttaaacaacaccaccaggaggcaatcatccaaatccaatacagatattttcaatttacgatgggtttattgggacataaccccaycatgaattgagcagtatactgactgtattactttcccaccatcgtaaagtcaaaaaacactaagatgaatcactgtaagttagaacaaatgacctggtctcctcaacaagtaaatgtcatggagatgaaaagaagagcaaaggaagagggttgctgttttccattagaagaaatttaataaacatacaaccaaattaaggacctttttggatcctgatttgaacaaaacaaatgcaaaaagacatctctgagtcaggattactttcctacttttaaatttcgatttaaaagttctcaatt

SEQ ID NO: 189059 - DNA, 601 bp, Human
gagttgatgaaggaaaagtcttttatagaatttcaacaagtgcagaagaataaaataattagaaaattgccactttagctgggtgcagtggctcatgactataatcccagcactttgggaggctgaggtgggaggatggcttgagcccaggagttcaagactagcctgggaaagacggcgtgaccccatctctacaaataatttaaaacagccacttgtggtagtgtcgtggtagcgtcatggtggtgtacacctgtagtcccagctactctggaggctgaggcaggaggatctcttgagyccaggaggtccaggctgcagtaacctgtgattgtgccactgcaatccagcctgggtgacaaaataagaccccatctctttaaaaaaaaaaaaaaaaaaaaaaagaccatcctggctaacactttcgaaaccccacctctactaaaaatacaaaaaattaaccaggcatggagaagggggaggaggaggaacaagtggaagaggaagaataccaccactttaatccctaatgaaataatggatctgggcaactatcatcaatgtctgatttttaaaaccattaggagaaaagttgatagga

SEQ ID NO: 189060 - DNA, 601 bp, Human
acgggaggatgtgcataggtgatacacaaatattacacgattttatataagtaactggagcatcctcaaattttggtatcttcaggagatcctggatccaatcacccacagatattgaggaacaactgtatatctaaaaaaaacgactgattttcacaggactctaagtagaagtggagtaagagattgaaagaaaagcctggcatacagcaaaccagtaagggcttgacagacaagtcatacaacccaacaactaagaaaatgcactcatctgaaaactggtttaaaaaaaaaaaaaaaagaaagaaagaaaaaagatcagtgtgtttaatctgccttttgtgcataaaatgtatttccagtaaccaaagagttgatgaaggaaaagtcttttatagaatttcaacaagtgcagaagaataaaataattagaaaattgccactttagctgggtgcagtggctcatgactataatcccagcactttgggaggctgaggtgggaggatggcttgagcccaggagttcaagactagcctgggaaagacggcgtgaccccatctctacaaataatttaaaacagccacttgtggtagtgtcgtg

SEQ ID NO: 189061 - DNA, 601 bp, Human
ggacttttcgtgaccttaatgttatgtcaattaaggattcataactttaaaaaatgccccatgaattctatctcacattatactaaaaattaagtcacagtagatcatagacctaaaagtgaaaggcaaagcataagtttctagaagaaaaataggaaagaatcttcatgattttggagtaggcaaaggttaaacaggacacaaaaggtccataaaagaaaagattgataaaacagattttactctacatagtgcattttattctgtttaaattatacctcaataaaaagcaaaaaaggarcaaacagttatttaacctaatactaggaaaaagacaaaaattatacaggtaactacatccagagacagtgtgttccaggaaaccttacagaagctttgagaaggacacaaactataaaaaataattaaaaataaaagaatatgtacagtcagccctctgtatctatgagttttgcatccatggattcaatcaatcttggatcaaaaatatgtgagaaaaaactgcatctgtactaaacatgtacagactttttttcttgtcattattacctaaacaatatagtgtaacaactattcacac

SEQ ID NO: 189062 - DNA, 601 bp, Human
tcttcagccaggtgtggtggctcatgcctgcaatcccagcactctgggaggctgaggcaggtggatcacttaaggtcagaagttcgagacaagcctggccaacatggtgaaaccctgtctctactaaaaattaaaaaataagctgggcatggtggcacacacctgtagtcccagctacttgagagaggctgaggcatgagaatcacttgaacctggggaggtagaggttgcagtgagctgagactgtaccactgcactccagcctgggcaacagagtgagactctgtctcaaaaaaaaaawaaataaataaataaaataaatcccagtgcttttatgtatgtgtagaaactgaaaaatctgtaacaaaatgcaaaagacaatgaataaacaaggcagtcatgaagaattgtaattaagctagaggacttttattaccagatatcatgacccattataaaattacaataattaagacactgtggtatcagtccaatgataaacatacaaagaaatggaaaagaaggagtacagaaatggaaccacacataaggctacctgatttgtacaaatgctcaactgcagttaagtgggaaaaggatg

SEQ ID NO: 189063 - DNA, 601 bp, Human
atgctgtttccttgtaatgtatcaaaacttttgccaaagatttgatatatctcatttttaggaaacccatgctggttcacagtagtcactgcttcatgtttaaagcatgtacgcaatgatcactgagaatacaaatggtttccaggaagtcaccattattaatctcatatacaaaatttgtgaaatgtgttaacaaaagttttattgctttatccaaaatatttattgctataattgtcaaatagcctatggacaacttgatattgcactggtaggtgcaaggatgacacttggggaaacrctggtctagacttctggtttctagtccaacacataaagaacttgaaagtcatcattcctgtcctcataaagagaaataagttaaacaaacggaaaatcatcaactcttcttacatccatcagagaaatgaggtcaaagggcagtgccctgaaaagttaagactgaggcagacactgagaatcacagtttattaatagcaaatgcctgctgctggtgccagtactaggcagagacaaaaagcagagacaagccattttcttgtaccctgtacaaatttttgacctacacaatctgtgagca

SEQ ID NO: 189064 - DNA, 601 bp, Human
atattaaagacgttaggcttaacaacattaatacattagtgatactctaagaagtaaataccagttaatttcataaaagttcagtaagcaaaataattctcatataatatcgatctgatttctaattaggcagtttatcaataattttcaaccaataacagtcaaattatacttttatatcttggacttttgtgtaggatttccacctttccattacaagatataatgctccccccctccgtattggattatactttctaaagctcagttgcactattgaagaaaaagcagaatttcttgmcaaaagtttcctgggttttttttcatcctaactctaaaattttacagaatactgtaagaaaatacttttagtgataacatattatatcatcaatgttttaataagtggaaatatacaaaataatttaaagtaatttatatattacctggccacatccaggcgcagtacatagaaagggtttgtcatcactcatattccacaggtccttgtattgcctataatcaaacagaagacactttagagtacatattttaaaataaagaataatttaaaatataaatctcaagatttttcattaag

SEQ ID NO: 189065 - DNA, 601 bp, Human
tggtggcgcatgcctgtaatccaagctacttgggaggctaaggcaggagaatcactttaacctgggaggcggagattgtggtgagccgagattgtgccattgcactcctgcctgggcaacaagagcgaaattccgtctcaaaaaaaaaaaaaaagttagcttcaacccctatctcacaccatacacaaaaattaattcaagattaaagagaaatctaaatgaaacagtaagttttagaggaaaacaaaggagaataccttcataatctaaaggcaagcaaaaatttctgacaagtcacagraagcaacaaccataagaggaaaaaaattaatacattaggattcattaaaattagaaacatctgctcatcaaaagatattattacgaaaattaagatgcaaaccacagaaaaagaagcctctgacaaggactggtatccaggatatataaagaactcctacaactcaataataaaaagacaacccaattttttaaaatgagcaaaagatttaaaaagatacttcacaaaatgtaagggatacaaatggccaacaaacacaatgaaaaaagcagcctggtaatttcctaaaaagtcaaacat

SEQ ID NO: 189066 - DNA, 601 bp, Human
tattattattccttttaaacatattagatagacacaaataagttttcaagccattgggccaatagctcatttcactacttttttcactagtttaaggactattgaacaacagcaggaagttacactgatatattcactgtctctctcatgcacacacacgcacacactcccacacatacatctccattgtcactttagactaaatataaaatgaatctttatctcctttataaaacagcttataatgtgtaaacattctaccaaagaaacatttttcaatgacggggcaccaaaagcaaaratactaccaagtatatggaagactaacaaagataaatgaatctttcaccaaattatctcagtgtctcttttactaaattccaaggagcatcactttaaaacaagtgaaattaacaggcatgtggaaaacctaagagtaactgaggcatacaagaaaagatttaatagcacaagtctagtattaaaaactctttgtaatcatttctataggactctctctgaagttgtattgtcaccaaaatagattttaaattgtaaaaatctatttgaaaccttaaatttaactaagaccattgtgtta

SEQ ID NO: 189067 - DNA, 601 bp, Human
ctgaaggagagtgttcagatgcaacaacacttccactacttgacatattcattcactcttcagacatttactgggcagcaactataggcagtaggaccacaatcaaacttttccccacccaggtactgtcttcctattactttatcattataagaatctcccccaattttggagaaataagaaacagtggtacttttgacagattgctgaataacaaagttctcagaaaacgaacatatctgcagagcatactgacattaatattttatgctttttctttgtattgctgttttaaatataygtgtcttacatcctacactaaaagcatctgaaagtaatatttagtttatgtttcaaagaacctcataatgtggcttttccactgaaggcaatcattaaacatttgtgaatgaatgcattttggtgcaggtcccagattttaaaactgcaaactcaacaaattaatagataagaagttggaatgttgtcgcctaggaattttattctatcaattttctttgcttggattagtttgaccccaaatattcaaatcaaagaactgcatgtagaataaataacattgtgttcgtacaaaacatac

SEQ ID NO: 189068 - DNA, 601 bp, Human
aaaaaaaagcattatctcactcttctgtataagtaacatatctctaagttacttatggaacttagttaggatatgttggaagttcccctacatttttcctacgtatattgttttcgataaattaactttgttaccttcaatttcttcattacaaaaatttcaatactgtaagtagagggaaaaccaccgaatatttgctttattatctatccaaaacactgcatagaacaatttggtctctatactgattaataatttaaaagtattacagtatttgggtgtaattccagacttatatgayatataacaagctttacaagagaaaagaaaaatctggagttaatctgaatatttatgatatgtaaatctgtgatgacacaaaggatctgaaatttatatagttttgttttatcataatacttataaaatatacaaaaaagtagcaaaattatacatgacatatatgtatatatacatagatgtgtgtgtgtatatatttaaataccaaaaaaaggcagctaatacagcatggaatgacaatcaaccaatgtatgaactgggtttttcttttcacatacagtgaaaaataatcatctgctta

SEQ ID NO: 189069 - DNA, 601 bp, Human
tgctaaggcagaaagtttcagagaaacaaagagcttcatgcctaggagagtgaactttcgaggttgttactattttgcttgtttggttcctttggttctagctcttaatgtctaatgtaaaatactccaaaaaaaaaaaagcattatctcactcttctgtataagtaacatatctctaagttacttatggaacttagttaggatatgttggaagttcccctacatttttcctacgtatattgttttcgataaattaactttgttaccttcaatttcttcattacaaaaatttcaatactgwaagtagagggaaaaccaccgaatatttgctttattatctatccaaaacactgcatagaacaatttggtctctatactgattaataatttaaaagtattacagtatttgggtgtaattccagacttatatgacatataacaagctttacaagagaaaagaaaaatctggagttaatctgaatatttatgatatgtaaatctgtgatgacacaaaggatctgaaatttatatagttttgttttatcataatacttataaaatatacaaaaaagtagcaaaattatacatgacatatatgtat

SEQ ID NO: 189070 - DNA, 601 bp, Human
aagcaataccatatatgtcatgtcctgaggtaggaaaaagctttgaatatttgatgaacacaatagagaggcatgaggtaaggatagatgcgtagacaggcccagatcaaagagggcttatgccaaggagtgtgaattattttaaatacaatggtagaccattgaaagattttaagcaggtgacatatttaatgtattaaaagtcatcttacagaaaatggattggaggtagaagcaggaagacaagttagaaggtaactgttaataatccaaacaaaagatgatgatggtttgggcttamgtggtgtcactgaacacagacatagaggatgagattcaggtctgataaaatatgctgttagtttcagtgtaaaagaaagaagaaattaaggatgacccctaaattctcagctagaacaactaaatggatggagaaaatttactgagatggggaaaactgggggaagaatcaaggactctgattttgacctattaagtttaagatgtctattagacatagaaaaggtaatgtcaagatggagttggatataaatctggcaatctggtgagatacctatgcccatagaaatttgggagtcat

SEQ ID NO: 189071 - DNA, 601 bp, Human
agatggtatttcctctggttttacaaattatagaacaaaaagttttaaaagattttacccagaactccttaaatagtcagtgtaaaaattgggtctatggtgttttatgaattggcctgtatgctgccacttatcatcaaaatcttattaagctacataggaagaaggataaagtagtagtattgtaacttcatttattcagtaagttgagaacttatgctcccaaggactagctctcaaggaagagacaataaacaagtaaaacaagtaagaaaatttcagattgtagtaaatgttaagygttacagaataatacgtgcaatgtaacaaaggatgaaagattagctgaaggtaaggaagagtcagttaatttagacagcatagtaagaataggtgagcttctttgcaaaaacagcattcgaactgatgataaaaggatgaggaggagagcatttcattgtagggagaaggaagcaataccatatatgtcatgtcctgaggtaggaaaaagctttgaatatttgatgaacacaatagagaggcatgaggtaaggatagatgcgtagacaggcccagatcaaagagggcttatgccaaggag

SEQ ID NO: 189072 - DNA, 601 bp, Human
actgtgttatggctgatacaattaagtaacagaaataagaacttttagagcaatacaaataattgttaattccagttagctacctcttctatatcaataatttcttcatatcaaaaggccacgtaatactgatatcttgaatgtaaaataaataattaccggagtgaactctttcaagtcaggaaaacagaatttgtcagccaagaccttaaagatggtatttcctctggttttacaaattatagaacaaaaagttttaaaagattttacccagaactccttaaatagtcagtgtaaaaaytgggtctatggtgttttatgaattggcctgtatgctgccacttatcatcaaaatcttattaagctacataggaagaaggataaagtagtagtattgtaacttcatttattcagtaagttgagaacttatgctcccaaggactagctctcaaggaagagacaataaacaagtaaaacaagtaagaaaatttcagattgtagtaaatgttaagtgttacagaataatacgtgcaatgtaacaaaggatgaaagattagctgaaggtaaggaagagtcagttaatttagacagcatagtaaga

SEQ ID NO: 189073 - DNA, 601 bp, Human
agtcagaacttgtaagcagcacattgggaacctgtaatgatgctggacgaacaatagctgatgtgggctgtgcagtttgtgccaatggtacttcctatttaacaatgagataaaaaagggtggcatttaaaaatacaaatcatgtaccttagtgaacagaatgtaacacacttctaaaagcatctacagaataataactgctaaaagcaaattaatatctcaaattaattaaaagaacattttagaagagctgtaaagattcaaatgcaatgttcaattaatattttaattttaaaaagamtcgttttttttttttccagtacaacttgttctcctatcaatccagaaataagttagactgggcaacttggctatgataccaagagaattttaataaaaaataaaaatataatccattctcagagaatcacagaacttaaaatccagaagggactgtttagtccccctccctcattatactgtatgaagaggaaacaggtccagtgagactgtgttatggctgatacaattaagtaacagaaataagaacttttagagcaatacaaataattgttaattccagttagctacctcttctata

SEQ ID NO: 189074 - DNA, 601 bp, Human
gtgtttattttttgtagagatggggttttgccatgttgcccagcctggtcttgaactcctggacttaggcaagccacccaccctggtctcccaaagtgctgggattacaggcatgagccactgcacttggcctaaaaataatttttaaaagctacactgtaaatgattacactgtactgatcagtaacaagcatcttagaaggtaaaagaaaaaactatctttttattacataaataagtacctaatgcttggtgtaagatttccagggagagaataatagagagattcataaagtaataacgtaaatgatttagatgaaaaagaaaatactgtgttctggaaactgtgctagatgtctcaaaaagtggttctcaggatgaaaatttgaatgtcaaagacataactgaagagtttgtttgaataaaactgttttatgtaatgtaagtaagaaaaaagcaattttctaacacacattattccaaacaatgtgtttttaaatgttcattaaactattactttttttttttttttgacttggggtcttgccctgtcatccaggcaggatccatagctcactgcagtctcaaacgcctgggctca

SEQ ID NO: 189075 - DNA, 601 bp, Human
atttatagaaaaaagtccaatgaatatgtaaaaatacttttagatgcagtacacaataacaggatctccttttaatatctatatctgctctattcagttcccactgcatggtaaattaaattgaatttttcatcaatcagtatactaaaataggaagtgcaaaaaatgcccctggtgaagctcttctgctatcaagtgaagaagattcatcttagtatttccaaagctctgacctgaacatactatgatgtgaaaaatttcctccttgggtttttagggtcttctctaacaatcaataacsacctaatttttatactcttcaaccaactgctgttcattcagataatatgtaagttttattgctaaaacagggtgtcctgtgcaaatttctgactgattgtctgcactaatggagaatagcagtaaaaatttttcaggccgggtgcggtggctcacgcctgtaatcccaacactttgggaggctggggaggggggatcacgaggtcaggagttcgagaccagtctgaccaacatggtgaaaacccgtctctactaaaaatacaaaaattagccaggcatggtggtgcacacctgtaatccc

SEQ ID NO: 189076 - DNA, 601 bp, Human
ctccacctcccagccgcctgccttggcctcccaaagtgccgagattgcaccctctgcccagccgccaccccgtctgggaagtgaggagcgtctctgcctggccgcccatcgtctgggatgtgaggagcccctctgcccggctgcccagtctgggaagtgaggagcgcctcttcccggccgccatcccatctaggaagtgaggagcgtctctgcccagccgcccatcgtctcagatgtggggagcgcctctgcccggccgcgaccccgtctgggatgtgaggagccccgccgcccggcagcygccccatctgagaagtgaggagcccctccgcccagcagccgccccgtctgggaagccaggagcgtctccgtccggcagccaccccgtccgggagggaggtggggggtcaacccccgcccggccagccgcctcgtccgggagggaggtggggggtcagcgtccacccggccagccgccccgtccgggagggaggtggggggtcagcccccgcccggccagcagccccgtccgggagggaggtggggggtcagcccccgcccggccagccgccccttccgggagggaggtggggggtcagcc

SEQ ID NO: 189077 - DNA, 601 bp, Human
caacactttgggaagctggggtaggcagatcacttaaggtcaggagttcgagaccagcctggccaacatggtgaaaccccatctctactaaaaatacaaaaattagctgcatgtggtggcggaagcctgtaatcccagctactcgggaggctgaggcaggaaaactgcgtgaaccctggaggcagaggttgcagtgaactgagattgtgccactgcactccagcctgggcgacagagcaagactctgtctcaaaaataaataaataaaaataattatgcaataataaaaacaattggcccrgtgcggtgactctcatgcccgtaatcccagtactttgggaggccgaggagggtggattgcctgagctcaggagttcaagacaagcctggcagagcaatctttacaaaaaaatacaagtagtcccagctacttgaggggctaaggcaggaggatcacttgaggctgggagatccaggctgcagtgagccaagatcatgccacaacactccagcctgagtaacagagccaaaccccgtctcaatcaatcaatcaataaaagaaaaacaacacaattttttaaatgggcaaaagacctcacaa

SEQ ID NO: 189078 - DNA, 601 bp, Human
caaagagaaagactgtccaaaaacaacaacaacaaaaaaagaattacagtcaggtgcagtgactcacgcctgtaatcccaacactttgggaagctggggtaggcagatcacttaaggtcaggagttcgagaccagcctggccaacatggtgaaaccccatctctactaaaaatacaaaaattagctgcatgtggtggcggaagcctgtaatcccagctactcgggaggctgaggcaggaaaactgcgtgaaccctggaggcagaggttgcagtgaactgagattgtgccactgcactccarcctgggcgacagagcaagactctgtctcaaaaataaataaataaaaataattatgcaataataaaaacaattggcccggtgcggtgactctcatgcccgtaatcccagtactttgggaggccgaggagggtggattgcctgagctcaggagttcaagacaagcctggcagagcaatctttacaaaaaaatacaagtagtcccagctacttgaggggctaaggcaggaggatcacttgaggctgggagatccaggctgcagtgagccaagatcatgccacaacactccagcctgagtaaca

SEQ ID NO: 189079 - DNA, 601 bp, Human
gcactccagcctgagtgacaaagagaaagactgtccaaaaacaacaacaacaaaaaaagaattacagtcaggtgcagtgactcacgcctgtaatcccaacactttgggaagctggggtaggcagatcacttaaggtcaggagttcgagaccagcctggccaacatggtgaaaccccatctctactaaaaatacaaaaattagctgcatgtggtggcggaagcctgtaatcccagctactcgggaggctgaggcaggaaaactgcgtgaaccctggaggcagaggttgcagtgaactgagaytgtgccactgcactccagcctgggcgacagagcaagactctgtctcaaaaataaataaataaaaataattatgcaataataaaaacaattggcccggtgcggtgactctcatgcccgtaatcccagtactttgggaggccgaggagggtggattgcctgagctcaggagttcaagacaagcctggcagagcaatctttacaaaaaaatacaagtagtcccagctacttgaggggctaaggcaggaggatcacttgaggctgggagatccaggctgcagtgagccaagatcatgccacaac

SEQ ID NO: 189080 - DNA, 601 bp, Human
aagaattccaggctgagtgcagtagctcacgcctgtaatcacagcactttgggaagccgaggcaggtggatcaccttaggtcaggagtttgagaccagcctggccaacatggtgatacccatctctaaaaatacaaaaattagctgggtgtggtggcaggtgactgtaatcccagctactaggaggctgaggcgggagaatcgcttgaacctgggaaggggaggctgcagtgagccaagatctcaccactgcactccagcctgagtgacaaagagaaagactgtccaaaaacaacaacaamaaaaaaagaattacagtcaggtgcagtgactcacgcctgtaatcccaacactttgggaagctggggtaggcagatcacttaaggtcaggagttcgagaccagcctggccaacatggtgaaaccccatctctactaaaaatacaaaaattagctgcatgtggtggcggaagcctgtaatcccagctactcgggaggctgaggcaggaaaactgcgtgaaccctggaggcagaggttgcagtgaactgagattgtgccactgcactccagcctgggcgacagagcaagactctgtctcaaaa

SEQ ID NO: 189081 - DNA, 601 bp, Human
taccattaagaaaaataaaggcaagctacacactaaaagaaaatagacagtagaaatatacgtacctctctctctaacaaaaaccttatatccagtgtaaataaagaattccaggctgagtgcagtagctcacgcctgtaatcacagcactttgggaagccgaggcaggtggatcaccttaggtcaggagtttgagaccagcctggccaacatggtgatacccatctctaaaaatacaaaaattagctgggtgtggtggcaggtgactgtaatcccagctactaggaggctgaggcgggaraatcgcttgaacctgggaaggggaggctgcagtgagccaagatctcaccactgcactccagcctgagtgacaaagagaaagactgtccaaaaacaacaacaacaaaaaaagaattacagtcaggtgcagtgactcacgcctgtaatcccaacactttgggaagctggggtaggcagatcacttaaggtcaggagttcgagaccagcctggccaacatggtgaaaccccatctctactaaaaatacaaaaattagctgcatgtggtggcggaagcctgtaatcccagctactcgggaggct

SEQ ID NO: 189082 - DNA, 601 bp, Human
tacttaagaaagacaattgagagaattattgagtacatagctttacatgtatatagcttagcgtgtttaagattatattttaagctctttaaaagcaatcattacataactgtacatgtaaattgccttgagaacttaggaaagcactaggtttttaaacttgtaatcttaataaatcttatattattttttaaaagtagtccctgaataatcattatgtgtacaagtcaccatcaagggcattaaaatctgcccccccccaaaaaaatatgaaatcaaaacccaaaacaaaatagctcaytgataaaatacaatcctaattgctacacatgctggaaaagaaaaccataatggtcttcttagaagaacattcttttttgactctcctgatggctactgaacacatttgcaagaaaaatctcaaaatttaagatcatgtctattgaatttcttagaacccaagaaatgtttgccatgtaacaattgatagaaatagctgttaaatgatgttgttaatataaaaagaatattgaagtgtgaaataatttctatgcaacaaaaaaattcaagtaaccagaattcccttatccagtacactgac

SEQ ID NO: 189083 - DNA, 601 bp, Human
atgtatcactaagtttagttaaatttaagaattatttaagtacttaagaaagacaattgagagaattattgagtacatagctttacatgtatatagcttagcgtgtttaagattatattttaagctctttaaaagcaatcattacataactgtacatgtaaattgccttgagaacttaggaaagcactaggtttttaaacttgtaatcttaataaatcttatattattttttaaaagtagtccctgaataatcattatgtgtacaagtcaccatcaagggcattaaaatctgcccccccccaaaaaaatatgaaatcaaaacccaaaacaaaatagctcattgataaaatacaatcctaattgctacacatgctggaaaagaaaaccataatggtcttcttagaagaacattcttttttgactctcctgatggctactgaacacatttgcaagaaaaatctcaaaatttaagatcatgtctattgaatttcttagaacccaagaaatgtttgccatgtaacaattgatagaaatagctgttaaatgatgttgttaatataaaaagaatattgaagtgtgaaataatttctatgcaacaaaa

SEQ ID NO: 189084 - DNA, 601 bp, Human
cccatcttcaatgttcttcagttgggatgacagaattgtttatatggtgagtcttcttaagcccactgaagcttaaaaaagtaaaccaataccactgacattttaatttcaaacttaaatttcaaataaactatacctatttggtattttacgttctacaagtgtctaatctaacttgccaagcggaataacacgttacccttggactttaagtgaaaatgtttaattaagagattgacttgggcctgtgattttagttgttaagtgctgagataatgggcctgtgattttagttgtaagygctgagataatcttaagtaagcttctaaataattaatgaatatttaagaaaactatgtatcactaagtttagttaaatttaagaattatttaagtacttaagaaagacaattgagagaattattgagtacatagctttacatgtatatagcttagcgtgtttaagattatattttaagctctttaaaagcaatcattacataactgtacatgtaaattgccttgagaacttaggaaagcactaggtttttaaacttgtaatcttaataaatcttatattattttttaaaagtagtccctg

SEQ ID NO: 189085 - DNA, 601 bp, Human
tgaatctagggaatgtgagctgggaaccacttatttggagaatgtggacttggagttctatctttaaggcatgaaagaatcaagttctgtgaccatttatctggtcattaagaaagctctgtgcactgggatacgaacccatcttcaatgttcttcagttgggatgacagaattgtttatatggtgagtcttcttaagcccactgaagcttaaaaaagtaaaccaataccactgacattttaatttcaaacttaaatttcaaataaactatacctatttggtattttacgttctacaagtrtctaatctaacttgccaagcggaataacacgttacccttggactttaagtgaaaatgtttaattaagagattgacttgggcctgtgattttagttgttaagtgctgagataatgggcctgtgattttagttgtaagtgctgagataatcttaagtaagcttctaaataattaatgaatatttaagaaaactatgtatcactaagtttagttaaatttaagaattatttaagtacttaagaaagacaattgagagaattattgagtacatagctttacatgtatatagcttagcgtgttta

SEQ ID NO: 189086 - DNA, 601 bp, Human
ataatttgcacagataatcagaccacagtatctcagcaatgaaagggacttcagggatccaacagacctgagactattattgctgatactgttcttaataactgagatgtagttcttgggccccaaatacatattattacaggaattggagtcagagttatgtatattacactttcctaagattcttatagaggtgcatctttgaggggatggaggctaataagagagtgagagcgagtgcaactgagagacaaaagagagatagagatgtgagaaccatgttgcagcctacccagtgcttcccaaacttcttagaaatacataactgtctggggtgttaagtgttaagaacacatattcttggcaatcttttcctttcttccttccctgagtacagcagaaaggggtgagtgagagaagagcttttaaaaaagacccccaaataataccagtacaagtatttccattcacttcaactaagaacaattcagaaatttttataactatttcaaaacttgtaatttcttccttttcatctaggcctatcttcttactgtctatcatatgtgatccagatcccataaaaactgaagcatatatg

SEQ ID NO: 189087 - DNA, 601 bp, Human
ggacaataaattatattcattttttagaaataaccctttaaaaatgtaaaaaatcatacttaacttgcagaccacacaaaaacacccatgggttgcatatggcctgtgaatcattgttaaaccctgaggtataacattaacacatatacacaatcactcagcccctcattttcccttttggtccctaagtaaagttggttagtggatgacaaccacaactacatttcattatatattaagtttttaaaagacaagatacagttatgtaaatacctatgcttaggtggcaatctaaaacttrtttatatgtgtttctttgattgaaaacttttgctttttaatgccaatgctaatattcttcaagtaaagataaaaggtctaaatagaattctgaaacatttaacaggagtacaataatcctttactagaaagaattagaaaagcactgcaggcatataacaatatcaatcatctcataggcagtcacaaactagagataagtgaaaggggtctctagtataaatagctgccataaagcatatttgctcctttggtgatgtttcacaagttttaattcaggaatcatttgatttatgttagt

SEQ ID NO: 189088 - DNA, 601 bp, Human
agtcttatataaagctcaagataaattctgcaggtaaattaccaaactatttttcactctaacaaattccaaaaaataaagttatcatttctttgtccaaataactagcattacaaagagagttatttcatgtataaagtatttcacgcctgggcaacatagcaaaacctcatctctacaaataatttaaaaaattagccaagtgcggtggcatgtgcttgtggtcctagttactcaagaggctgaggtgggagaggattgcttgagcctgggaagtcgaggctgcagtgagccatgatcrcaccactgtactccgcatgggcaacagaggaagatcccgtctcaaaaaagaaatattttaattgtaataaagattaagcatttaaattagagcgtttattttacttacataattgcaacttaatgttttagaaaaatatttctatggctggcttcaagatttgcaatcttgaaatttttttcttcatcctcctatttttctttttctttttttttttgagatggagtctcgctctgtggcccaggctggagtgcaatgacgtgatcttggctcactacaacttccgcctcctgggttcca

SEQ ID NO: 189089 - DNA, 601 bp, Human
tgtgaaatttagggtcagtctttttctaagggtcaagttcttatatttattaatactcatttttctggtagggagaatcccacaggagccttaattttcattttaattgttccctctgctccccaatgaatcagcttggttatctcagattagtaagagaaagaaatcttcagtcactagtaatattgtctagtgtataagactataaaacaataggtatcttcaagtctttcacaaaccccaaaactgtgccacagaacaaatgaatatgggtgtcaaaaaatgaactcttggccgggcrtggtggctcatgcctgtaatcccagcactctgggaggccaaggcgggtggatcacttgaggtcaggagttcgagaccagcctggccaacatggtgaaaaccagtctctattaaaatacaaaaaaattagctgagcgtggtggtgcatgcctataatcctagataattgggaggctgaggcacgagaatcacttgaacccgggaggcagaggttgcagtgagtcaagataacaccactgcacgccagcctgggcaatacagcgagactcagtctcaaaaaatacgaaaaaaaaaaaaaaaa

SEQ ID NO: 189090 - DNA, 601 bp, Human
gaaatgatctgtactgccactggccatattgtacctggtctgtggataattagagtccttcagtttccaaagctgtcaatctggcacctttcacgagcaatatattcactttaaataaaacaaaacagaacaaaatttataattcaaagaatgaaataatttaaaaataaaaactgctactgaagaaacttatagttgtgctataaaccaaaaaaatagacaagaaaagtgaaataacagtgatatttttaaattttaaaattctctgcactttatatcacaactttataaagttcaaacyggatagtttagctacttttgtacacaggtaaacacattttaaatttcttcactgtatcagtgttgaaagttttatattatttcatctcagcatccaaacaaacaggtttacaaaactatgatttactatagattccatacacacccaatatcatgtcctaaaatgtttggaggcccaactaggaaaaaaaaaatctatgttcacaattattaaaaaagaaataaaacaaaattcacatatatgcaccatacctgcagctgaccatttaatgaactcaagtcttcagctttcttctctaaa

SEQ ID NO: 189091 - DNA, 601 bp, Human
aaatgttttctaaaaatttctgaaacattctggattaaaaatttatcagatgatgggctgggcacagtggctcacgcctgtaatctagcaatttgggaggctgaggcgggtggatcacctgaggtcaggagttcgagaccagcctggccaacatggtgaaaccccatctctactaaaaatacaaaaattagccgggtgtggtggtgcacacctgtaatcccagctacctgggaggctgaggcaggagaatcactggcacccgggagctggaggttgcagtgagccgagattgcaccactgyacttcagcccaggtgatagagtgagactccgtctcaaaaacaaaaaaacaatttatcagatgataaatgataaaatatatttcttaataaaccctagaagataagcacatattttaagtctatgtgatgtggtaagttgtattaaaattttcttctaaatcattaaaataaaatcgttaaaaataagttctgcaagacaatctatttgttctatcatgtcaatattcaaagcaaaataaagacttaaagatgtctgcttcacattaaaaaaatttaaattataaaacttacatttggtta

SEQ ID NO: 189092 - DNA, 601 bp, Human
aacagacttgatataaaatagccatttttgcagcataaattagtacctacagtctgtactattaaaaaaaaagaaaatttagaaatgttttctaaaaatttctgaaacattctggattaaaaatttatcagatgatgggctgggcacagtggctcacgcctgtaatctagcaatttgggaggctgaggcgggtggatcacctgaggtcaggagttcgagaccagcctggccaacatggtgaaaccccatctctactaaaaatacaaaaattagccgggtgtggtggtgcacacctgtaatmccagctacctgggaggctgaggcaggagaatcactggcacccgggagctggaggttgcagtgagccgagattgcaccactgcacttcagcccaggtgatagagtgagactccgtctcaaaaacaaaaaaacaatttatcagatgataaatgataaaatatatttcttaataaaccctagaagataagcacatattttaagtctatgtgatgtggtaagttgtattaaaattttcttctaaatcattaaaataaaatcgttaaaaataagttctgcaagacaatctatttgttctatcatg

SEQ ID NO: 189093 - DNA, 601 bp, Human
atggtaaatttgtcttactagttaaaattttctgtacgaagaaacccttgaattgactgatttatgtaacaatacagagaagtggtattaccacatctattctacaggtaagacaactgaagacaacagtgattgtgttttatgtcatacaactataaaatagcaggtcattcagaagattttgttagttaagaacagaaaaaaaatacacatacctaaatcactttgttcatgtaatatttgaaaatttaaataataataaatattctaacagacttgatataaaatagccatttttgcwgcataaattagtacctacagtctgtactattaaaaaaaaagaaaatttagaaatgttttctaaaaatttctgaaacattctggattaaaaatttatcagatgatgggctgggcacagtggctcacgcctgtaatctagcaatttgggaggctgaggcgggtggatcacctgaggtcaggagttcgagaccagcctggccaacatggtgaaaccccatctctactaaaaatacaaaaattagccgggtgtggtggtgcacacctgtaatcccagctacctgggaggctgaggcaggagaat

SEQ ID NO: 189094 - DNA, 601 bp, Human
agtaattggctgggtgcagttgctcatgcctgtaatcccagcactttgggaagctgaggcgggcagatcacttgaggtcgggagttcgagaccagcctgaccaacgtggagaaacccatctctactaaaaatacaaaattagccaggtgtggtggcgcatgcctgtaatcccagctactcaggaggctgaggcaggagaattgcttgaacccgggaggtggaggttgcagtgagctgagattgcgccattgcactctagcctggggaataagagcaaaactctgtctccaaaaaaaaaaaacaataatttataaccaacagtattcaatttttggtctagattaccataaatgtctctaatataatttgatgaaattgctcttttagcaatgatttgggaaaactaaaacatgattaaatttagtgaatgcggcaataaggttgaatatattttaaggcctaatatgtatttggtaaaaatatgaacaatcatacctcaacacttgttaaaccttgtattacatataaaatatataagtaaactatgggtcattacagcccactacactgatcagctaagcctacatgtcacatgaaggat

SEQ ID NO: 189095 - DNA, 601 bp, Human
ttgggagactgaggcgggcagataacttgaggtcaggagtttaagaccagcctggccaacgtggtgaaaccctgtctctactaaaaatataagaattagctgggtctggtggcgcatgcctgtaatcccagcgacttggaaggctgaggcaggagaactgcttgaattcaagaggtggaggttgcaccactgcattccagcctgggctacagagtgagactcaagtctcaaaaaaataaaataaataaataaatacataacatacacacacacacacacacacacacacacacacacacacacacaattctctctttaaatagacaggtctgaaactgatgaacaggacatcaatttctacatttcaaacttaacggttggtggtattcagactgttgatctaattagactacctggtttactaacatatagttgtaacatgaagatgccagtagctaggaaaggttaatgaacatcaaggactgaagaggtacagtacttgattcttgctacaacgtatatttgtgctaactgaattttaattggcattaacttggggaaacaatggaaaaggccaagaagaagaaattaaaaataaaaa

SEQ ID NO: 189096 - DNA, 601 bp, Human
ctttgggagactgaggcgggcagataacttgaggtcaggagtttaagaccagcctggccaacgtggtgaaaccctgtctctactaaaaatataagaattagctgggtctggtggcgcatgcctgtaatcccagcgacttggaaggctgaggcaggagaactgcttgaattcaagaggtggaggttgcaccactgcattccagcctgggctacagagtgagactcaagtctcaaaaaaataaaataaataaataaatacataacatacacacacacacacacacacacacacacacacacacacacacaattctctctttaaatagacaggtctgaaactgatgaacaggacatcaatttctacatttcaaacttaacggttggtggtattcagactgttgatctaattagactacctggtttactaacatatagttgtaacatgaagatgccagtagctaggaaaggttaatgaacatcaaggactgaagaggtacagtacttgattcttgctacaacgtatatttgtgctaactgaattttaattggcattaacttggggaaacaatggaaaaggccaagaagaagaaattaaaaataaa

SEQ ID NO: 189097 - DNA, 601 bp, Human
gactgggtgtggtggctcatgcctgtaatcccagaactttgggagactgaggcgggcagataacttgaggtcaggagtttaagaccagcctggccaacgtggtgaaaccctgtctctactaaaaatataagaattagctgggtctggtggcgcatgcctgtaatcccagcgacttggaaggctgaggcaggagaactgcttgaattcaagaggtggaggttgcaccactgcattccagcctgggctacagagtgagactcaagtctcaaaaaaataaaataaataaataaatacataacayacacacacacacacacacacacacacacacacacacacacacaattctctctttaaatagacaggtctgaaactgatgaacaggacatcaatttctacatttcaaacttaacggttggtggtattcagactgttgatctaattagactacctggtttactaacatatagttgtaacatgaagatgccagtagctaggaaaggttaatgaacatcaaggactgaagaggtacagtacttgattcttgctacaacgtatatttgtgctaactgaattttaattggcattaacttggggaaac

SEQ ID NO: 189098 - DNA, 601 bp, Human
agagcacagcacattgcctgatatggactgagtagacagacatattttagagaggaccacgtaattctatgtctaggaggtaaaaaatatcaaagaaggtgaaatgaaaaagcttaaataatatgaatctggtcagaggtcctaacttcatcatttatagcaataatctcaccaatacagctacactgttaattttctcagttatgtaaattggcatattatgtagtatcacctcaattacggaactctaaaaatcacaaatgtcttctctctgaaacactctatacattcataataaacygtattatgtaacaaaatgctatatgtgacaaaagtactgaaagtgttatgtgttggctagctaagtgatataaaataagtgatttaaatatagactgggtgtggtggctcatgcctgtaatcccagaactttgggagactgaggcgggcagataacttgaggtcaggagtttaagaccagcctggccaacgtggtgaaaccctgtctctactaaaaatataagaattagctgggtctggtggcgcatgcctgtaatcccagcgacttggaaggctgaggcaggagaactgcttgaattca

SEQ ID NO: 189099 - DNA, 601 bp, Human
ggctgggaaaaaagtagtgtttcaccctgtcaatctaagacaaagtgttatcctgagaagatgaacaaaatatcatcaagtacttacagtatattttaaattattagctaatccattttgttgatctatagtaatgcttaggaaaaaagctagaaacaggaaaactcaaactctctagattctaaaaaattatacctctctactgcattctataataaccttacagaaattctgatatttaatcttgaatattagaagcacagtctccatttttaaagtagcagctcagttcactctgacrgtatttcactgacgtagcctaaggctataggtaatggaacattactcactatgatagccagatttcttctgcatggcggttacagggcaatctttatgagccagaagaagctgtttcagctgtgccacttcatttctcagcagggtgacttcactctggagaagaaacaacttatgtaccttaccacagactaaacatattttttactatttaaaacaagcaaggattaaagtataaaattggacatcactggcagaacattaaaaacaaagaaaatatgctgattaaatatgtctaatc

SEQ ID NO: 189100 - DNA, 601 bp, Human
actaactagatatctcaatataaaggtttacaacaataaaaacgttacacaatgctgacattatctaagaaagaacaataggatctgataccttaaagggatatcatatattgttaaaggcagtcagctgattttaaaaagaaaaatatcatcattaatgaacggaggctgggaaaaaagtagtgtttcaccctgtcaatctaagacaaagtgttatcctgagaagatgaacaaaatatcatcaagtacttacagtatattttaaattattagctaatccattttgttgatctatagtaaygcttaggaaaaaagctagaaacaggaaaactcaaactctctagattctaaaaaattatacctctctactgcattctataataaccttacagaaattctgatatttaatcttgaatattagaagcacagtctccatttttaaagtagcagctcagttcactctgacggtatttcactgacgtagcctaaggctataggtaatggaacattactcactatgatagccagatttcttctgcatggcggttacagggcaatctttatgagccagaagaagctgtttcagctgtgccacttcatt

SEQ ID NO: 189101 - DNA, 601 bp, Human
tacaaaatgtttctttcttttgaattactgacactggcaaattaaaatgaagtggatacatatggttgaaacaatcttcacatttacaaatatcctgaaatatcactaaatcataaagactaaaactgtgggttatatattataaatgttgcctaatgcattcccaactctgttgtttgttacaaatttgtatactatggacaaaattggccatttattcaagagtaacagctggttccaacactgtgcatcttatcaaaaaagaaggacattacaaaaaggaaaaggcacaattaacctytaaaatgctgaaaacaaaagaatctcattctttgggaaaacatttagcaggaaatttacaagcagataatttaactactgttcccgttttaacatttttataaactaactagatatctcaatataaaggtttacaacaataaaaacgttacacaatgctgacattatctaagaaagaacaataggatctgataccttaaagggatatcatatattgttaaaggcagtcagctgattttaaaaagaaaaatatcatcattaatgaacggaggctgggaaaaaagtagtgtttcaccctgtc

SEQ ID NO: 189102 - DNA, 601 bp, Human
attactagatatcaaataagcaagatttatatgctcaaaactgacaaaaatcagcgttctaaatatatatggcaattgagagtagctaaatctacggaatcttttaaattaaaaaatattgcccattctgatgaaactgcttacaatgactacaagtaaagatggtggccattaagttttatcgtgagcacctgaggaactgtttgcatccaatacaaaatgtttctttcttttgaattactgacactggcaaattaaaatgaagtggatacatatggttgaaacaatcttcacatttacwaatatcctgaaatatcactaaatcataaagactaaaactgtgggttatatattataaatgttgcctaatgcattcccaactctgttgtttgttacaaatttgtatactatggacaaaattggccatttattcaagagtaacagctggttccaacactgtgcatcttatcaaaaaagaaggacattacaaaaaggaaaaggcacaattaacctttaaaatgctgaaaacaaaagaatctcattctttgggaaaacatttagcaggaaatttacaagcagataatttaactactgttcccgt

SEQ ID NO: 189103 - DNA, 601 bp, Human
taaatgctgaactagtagcttctataggaaattatgttgttaagtcagatgggaaccataatggcctcatccctgaagcaatcattgttaatataaatcccaaacatatttctatatggttccaatttactccaatgtgtttcaccatcctgtcaaaattactagatatcaaataagcaagatttatatgctcaaaactgacaaaaatcagcgttctaaatatatatggcaattgagagtagctaaatctacggaatcttttaaattaaaaaatattgcccattctgatgaaactgcttayaatgactacaagtaaagatggtggccattaagttttatcgtgagcacctgaggaactgtttgcatccaatacaaaatgtttctttcttttgaattactgacactggcaaattaaaatgaagtggatacatatggttgaaacaatcttcacatttacaaatatcctgaaatatcactaaatcataaagactaaaactgtgggttatatattataaatgttgcctaatgcattcccaactctgttgtttgttacaaatttgtatactatggacaaaattggccatttattcaagagtaacag

SEQ ID NO: 189104 - DNA, 601 bp, Human
ctacatgactagacaggaataaagataggattatttccaaacaacaaaaatatcctattcatttcttatattctcataacttagtactctatgtactaaaaatgtattaatctagattttcagtcatttaagtatacagtatataaacctacgcatctatacacttaagatatcttgtaaatcaattgtcaaatgaataactggtttgcatctgctgagcatacattgcctggataatagagtcaaaactgttgggattatctaataaattatcaaagatttaaaaattacaggtaattcygaattggatacaatttaagagaacagttaatttccttttaattttataaaacaatttatttccttttaaactatgaaaatccaagagagatttcttgttaagaaaatcacgtatgcataaatgctgaactagtagcttctataggaaattatgttgttaagtcagatgggaaccataatggcctcatccctgaagcaatcattgttaatataaatcccaaacatatttctatatggttccaatttactccaatgtgtttcaccatcctgtcaaaattactagatatcaaataagcaagat

SEQ ID NO: 189105 - DNA, 601 bp, Human
attacaactcaccactgttagcaagagctgtgtgctacaacataatgaagagtgtaaatttttcaaaggtattcacttagtcaatttctgtatctatttttactactacacaacagagaagtcagacttatttcaaagatttcaaacttgaaaatataaattacctgaaaatttctacaaaatccaattatctcccaagatctgaagagaattaattttatggtagaactatatttcagttaatttgattatctacatgactagacaggaataaagataggattatttccaaacaacaaamatatcctattcatttcttatattctcataacttagtactctatgtactaaaaatgtattaatctagattttcagtcatttaagtatacagtatataaacctacgcatctatacacttaagatatcttgtaaatcaattgtcaaatgaataactggtttgcatctgctgagcatacattgcctggataatagagtcaaaactgttgggattatctaataaattatcaaagatttaaaaattacaggtaattctgaattggatacaatttaagagaacagttaatttccttttaattttata

SEQ ID NO: 189106 - DNA, 601 bp, Human
agaagtagtaatcctttaaaaattatataaaacagaatgaatacttaaaaaaaattatagattcagatggtacatatgcaggtatgttacatgggtatattgtgcaatcctggggtttgggcttctattgaacctatcaccaaaatagtgaacatagcacccaacaggtcgtttctcaactagtgcccctctccttcacccccctacttttctgatcaagcagtaatgaatgttataaaatatttataattcagttattaaaatagccaatataatcattacataatcattacatgtatawagaaaacaaaatactggcaatgacagtttaactggagggaatactaaaaagctctatttgttttgtttcaccactattcttttttttttttaagtatttatatgtgatttttaaaatttttttatttttatcactttttaaaaattatactttaagttttagggtacatgtgcacaacgtgcaggttagttacatacgtatacatatgccatgttggtgtgctgcacccattaactcgtcatccaacattaggtatatctcccaatgctatccctcccccctccccccaccccacaacag

SEQ ID NO: 189107 - DNA, 601 bp, Human
ctagaatgaagacatgaaacaggaagttcctgatcttgctctcctctcctccttatcctccctgtctcagttaacacaataacacagtcaaagatgccgtctagtatgtttcccaaaaacacccagaaagagttcagcagcctctctggctaacctgtcctagagctgcacagcagtccaataatgtaggaacttccttctcttaacttggatttgagacgttttctttttccacatacaggtctgaaagcagcaggccactgcgtaattaaactgtccctcattggcctcaggaagaatmatcttgggccctttctatgtttctggacggctgcttcccaaccctctagccgtctttctggctcttttgcagactcttctctaggaagcacaaggctgaagacataaagctctggcaaccgtcacacctcacggcctcttcacggcctgctgggctttgctctgggctgtgcctgctccttaaactctggtgccgggaaaaggatttcctcgtctcatattcaagctgtccctactgctgcttctctactcctgttttgtgttagtaaaagaaggaaggaaagaaaagggggaaggagga

SEQ ID NO: 189108 - DNA, 601 bp, Human
tgggctagaatgaagacatgaaacaggaagttcctgatcttgctctcctctcctccttatcctccctgtctcagttaacacaataacacagtcaaagatgccgtctagtatgtttcccaaaaacacccagaaagagttcagcagcctctctggctaacctgtcctagagctgcacagcagtccaataatgtaggaacttccttctcttaacttggatttgagacgttttctttttccacatacaggtctgaaagcagcaggccactgcgtaattaaactgtccctcattggcctcaggaakaataatcttgggccctttctatgtttctggacggctgcttcccaaccctctagccgtctttctggctcttttgcagactcttctctaggaagcacaaggctgaagacataaagctctggcaaccgtcacacctcacggcctcttcacggcctgctgggctttgctctgggctgtgcctgctccttaaactctggtgccgggaaaaggatttcctcgtctcatattcaagctgtccctactgctgcttctctactcctgttttgtgttagtaaaagaaggaaggaaagaaaagggggaagg

SEQ ID NO: 189109 - DNA, 601 bp, Human
taactttcttttccccactagcatgaatgtttggtatatatcaccattttatccctctgaaaccagggtcactcagacatctgtggatgtcgacccgcagtgccactctggtattatctgggattcagggaggagaggcctgcctatgttgaggaagaagagagatttgtgaagttagcctcattcctcttctatttagagagttcaggaatgtgtccatactgttcctccccacaaaatttaccattttttctccagattaaaggtgacttcatctctttccactttgacctttaaactyaactcagtattcaacttggcagtcattcctatctaaaaattacacacaagattaatactccaggtgctctctaccacccaacaggatctgttaccttctgccattctgtgtctccactcgttctttcagaacctggggatcagaggttttgtataatgatgacactttataagccattttttgcatctcaaacacaatggaacacagcgcagtgaaagtggaaagatggggaaggggctgagaaataggagagaataaggacccccagaagaaatacaaacagcttttggaaggatgcat

SEQ ID NO: 189110 - DNA, 601 bp, Human
agacagaaagtagaatggtggctgccaagagctgggggaaagggaatggggagttgttgtttaatgggtttaagtttcagttttgcaaaataaagagttctggagattggttgcacaatatgaatatacttaacgctactgaactgtatcttaatggttaagatggtaaattttgttatgtgtcctttatcacaattaaaactcccccaaaacctatagttcttagtatttcccaatatgatggtgataacaataataccttacaaatgtccgggaacttctttctgagaaatccagagasctgggcctccagatttgttcatgccaactcaaaacgataccaaggatgagttcagttgtaaaagttgcacttatcagagtttaactttcttttccccactagcatgaatgtttggtatatatcaccattttatccctctgaaaccagggtcactcagacatctgtggatgtcgacccgcagtgccactctggtattatctgggattcagggaggagaggcctgcctatgttgaggaagaagagagatttgtgaagttagcctcattcctcttctatttagagagttcaggaatgtgtcca

SEQ ID NO: 189111 - DNA, 601 bp, Human
ttcagtttgttgcactatgacagggttctacttcaaggactcatcttttcccagtttattcttttccaggaaaagctttctatgcactttcatagacaaatgcaactcttcttgtcattttctggttcctttttttgggagaaggggacacttagagcttttttttcccctttaaacagcaccaaccttctgactgatgacgaaatagagggaaattgaaatggcagagtaaaaaatcaatcaggcacataggcaatcccttccctggtagagttacagagtatacattagtattcatgayattttagttaggagacaacatctccagcaaaagaatcaccacacagcactgtgtcaggccgtctatcacatctttcctaccacttccttgcacagaatctgtaatccaaacacctaccatggtcacccctccagaatagccccattggtcttgctccttttcctgggacaacagcccaagtcccctctgcatccttactgctcagaagcaagacatgaacattttgtttgaggcattcctgaagaaaaatgataatgatcttataatatgaggtatcttcaagtttgtgttttgggagga

SEQ ID NO: 189112 - DNA, 601 bp, Human
aagtctgaaagcatatattgtttgcttagaaaaaagttttaggagaggtctggtggcagttcaagaatgttcacttagttagatgacttctaaactgggacttgcctaagaagccacactgcagggaggaggcggaggtggaacagcagttctcttcctttagcagccctccatctagccttccgcgtagcaggctggtgaggtattgagcagcccctctattggccccgcacccagttttcagaagttaagttcattctacaggtctctaaatgcttcaaggacgaccaaatctatccaytgttggcctggaaatcaaagaagacattccaaatcttcaccattcagtaaagcagtgacttactgaaagaattacagtttactagcaaaccccccaaatgaatctctatgtataatacatgcataacttcctagtctgaagatagcagtattccaaataattgtaggctccaagatatcacttagtgacttctaatttaggaaacatatgctctagagaattcctcccattatacacacacacatacacacacgtatatttgtgtgtgcgaacacatatcctactataacaaatgactct

SEQ ID NO: 189113 - DNA, 601 bp, Human
tatcctctggcctttttagttccccttcccttacagctacctccttatggacccttaaaggaagtctttaaaacatagagaggctgaggcaggagaattgcttgagcctaggggttcgagactgcagtgtgccatgactgtacctgtgaatagcaactgcactccagatggagttcggcaacatagtgagtctctctctatcaaaaaaaagtaaactatttatccttcctgattcatcaggatcttataaaaaacattgttattttccaaattatttttcttacataaaacctcttaaacwgttttattctgataactatgctcatcagccttgactttcctctgttttgcagggaaggctattaaatgctctggggaagaggaataaaaagctcagagacagggccagggaaggaagcatgctgtccatgtaggtaaattctgccctgagctttcacaaggtgatgggcatgaaatggcagaggcgaaagtagggagtggagagaaggggaaaagaagagggaagaagagaaagtctgaaagcatatattgtttgcttagaaaaaagttttaggagaggtctggtggcagttcaagaatg

SEQ ID NO: 189114 - DNA, 601 bp, Human
ttatcctctggcctttttagttccccttcccttacagctacctccttatggacccttaaaggaagtctttaaaacatagagaggctgaggcaggagaattgcttgagcctaggggttcgagactgcagtgtgccatgactgtacctgtgaatagcaactgcactccagatggagttcggcaacatagtgagtctctctctatcaaaaaaaagtaaactatttatccttcctgattcatcaggatcttataaaaaacattgttattttccaaattatttttcttacataaaacctcttaaayagttttattctgataactatgctcatcagccttgactttcctctgttttgcagggaaggctattaaatgctctggggaagaggaataaaaagctcagagacagggccagggaaggaagcatgctgtccatgtaggtaaattctgccctgagctttcacaaggtgatgggcatgaaatggcagaggcgaaagtagggagtggagagaaggggaaaagaagagggaagaagagaaagtctgaaagcatatattgtttgcttagaaaaaagttttaggagaggtctggtggcagttcaagaat

SEQ ID NO: 189115 - DNA, 601 bp, Human
ctcacaatactctcaactaccttgacataaaagcagaggaaagcttgatttgttaaggtattgcttttgctcattttgtttaaaaaaacttctttttcttaaaataagaattatggaatcattaagttttaagcaataagaagcaaagttcgaaacaagaatcctgattcttcacttctgtttacccaaaagaacattctctctctgatttcagtcccagaaatcaaaccagtgaacacatcactatgcagagtcacattccatgtttttaatggaagttttagaagctacagatgaattyaggagtgatattaaaccaagaccattaagaaagatgacttttttctaggattctaactcctatattcagacacacatatccaactgcccacttgacatctccacttggctgtctgtctcatagacatttcaaactcactatatcccaaacaaaagtcttagtatctcccctccaccccaaattgctgtactcacagcccgccccatctcagtctgatggcatttctattcttactacacttaggccacttcctattttccttaactcctctcttttgcttattatttttcaatccaactg

SEQ ID NO: 189116 - DNA, 601 bp, Human
gacttcagaagtcaaatgtaactcaatagtcttacatgcttagatccaacccagaagaactcagggttctccttcctgaatgaagataatttgaagttgcatatttcgatccatagttggctgaacccacagatgcagagcttgtgaatatggagggccagcggtatctccttttctacaggaagacggcatagtttaattcattaaaatttgtaaaactacataatatctgtttcaatgacaaaaagcaatttcaattatatttaagatgacatttacataaacataaaaattataaccrtctcacaatactctcaactaccttgacataaaagcagaggaaagcttgatttgttaaggtattgcttttgctcattttgtttaaaaaaacttctttttcttaaaataagaattatggaatcattaagttttaagcaataagaagcaaagttcgaaacaagaatcctgattcttcacttctgtttacccaaaagaacattctctctctgatttcagtcccagaaatcaaaccagtgaacacatcactatgcagagtcacattccatgtttttaatggaagttttagaagctacagatgaat

SEQ ID NO: 189117 - DNA, 601 bp, Human
aaactaacttcataattttgtcatgcctgcataccaccaaaactatatgatttgtttaatatttttatttaactcaactaacctaaaaaaatctaaagacatatttagtgtcatcctaagtaactatatccatgaaatcatgaatttcatatgttgttgtacattttttctactacacattaaaacaaatacatatttaaataaagaacgtttatccatgtctcctaaaatcacctcacaaaccacctgtggtatgattatcaaactttgaaaacactgttcttggggaagggaaaggaamgtaacactataggatcccctctctatgccgccagtgctccgtggggtgcgcctatcctaactcaccgaatccccactctcctatgagcaggctgatggtcactgctacccactggttgtctttcaggcttgcatttattctggctgattagcacttgtgtctgccccgcggtcagaaattttatatggcaacctgtattaactataaggaaattcttaacaatttttatttttgtttttaatttttgtgggtacacagtctttgttttgattttccagaggttacagagctgccaagtct

SEQ ID NO: 189118 - DNA, 601 bp, Human
attttagctgaaattctgagtatcattcaaacaggggagccaatgcttggtattaacaaagtgctgttttctactgctgagctcagatgacagcccaccctctatttgccaaaattagtggatgagaaatcatttcatgaactcatccaaaaacatgaagtgcactaataaagctttactgccatccctcagtcatcactttgcttggctaggctggtggccagcaggaatatctccctctacaaaactgtttcaaagtaatgacttggaggaagtggtgtgctgataccatgaaaaaaaattccctcaaacacaaagatagttcaaaaagcatctgtatatggctcagaggaaacaaacagctcagctcatttcaactcaaaagaaacccaagagaccagtttaccttggccatggttacacacatgcaggcaaacttaaggttggcatttatccagggattttgatccgtgccaaaagggatgatgagttatccatcctgaggtcaagatggaataaagaaaatacactgaaagagaatcatgtgtctataagaggatttcacaccttcctcttcacgagacagggaggcctcgacccc

SEQ ID NO: 189119 - DNA, 601 bp, Human
aaaaaaaaataaagttgataaaaggatgggtcaattcagtggtgatttgcctcaaggataactcctcccacttcctatacaaaataagcaattacattaaaaaaatacagtcagaattttatggaatcacatcagtttttaatgtatgaatcagagaacataacaatcactataaatgtagcatggttatgtattttaagtctctagtcctattttccttagtgtaggcataaaagttcttaaaggcttagaatttactcttaaaatactataaaatattactatttttatgacaaaagcmatttatgaatttatggaaaaggaaatatttataaaatatgttagtaaaagcactgtttatgtttgtatagcaacatttaaaagtattcaaaggtcattcattgctaaaaatatttaaagcaaaataaaagggaagttaaaaacagcttcacttaaacttgcagtttctaaaacttatcaggacccaagagcctggaagtatcaaagattaagtggaaatccatattcaaaagagttctgtggaattcttataaagagaagagcaggcaaaggtcatcggaggacattattttagctgaaa

SEQ ID NO: 189120 - DNA, 601 bp, Human
tctccattattagtatatcttactccattagtggtttgttatctggatttaaaaaaaaatcacagggatttagtcttttccttatttcctcctatttgaacctaaaggttacctaaaagctccatgatttttcataaacaaaataaaatattctaaccattcgtagactgactgggtggaaggcagtgaccgtttctgtgtgtttataaaccaaatgttcataaaccaaggactacctttattttattagctgtggctaattttgtgcagtctatgagaatttttaccactgtaagaaatrtttctatcccatgctgggaggagagggtaggacctctaggcacatcttaccatagctcttcctgcctcaaaggcaaaagcaggaatgccttggtttatgttatgcacatgcagacatgtgtaaacttctaaagtctaaggtacagaaaacagcagttgtgaccctgagtcaccttattttagtgttcacaagaccaaagttcccagaaatcaaggtgtaatttaggctgacctaatgaatactcaagcttctctcatttttaccattttcattagccattatgcaaatattttagaaaag

SEQ ID NO: 189121 - DNA, 601 bp, Human
tactcccatcagtactcatttcttctttttaacatgtgctattatgacgtttcaaaatctttgccaatttgataggtttatttattgtcttctccattattagtatatcttactccattagtggtttgttatctggatttaaaaaaaaatcacagggatttagtcttttccttatttcctcctatttgaacctaaaggttacctaaaagctccatgatttttcataaacaaaataaaatattctaaccattcgtagactgactgggtggaaggcagtgaccgtttctgtgtgtttataaaycaaatgttcataaaccaaggactacctttattttattagctgtggctaattttgtgcagtctatgagaatttttaccactgtaagaaatgtttctatcccatgctgggaggagagggtaggacctctaggcacatcttaccatagctcttcctgcctcaaaggcaaaagcaggaatgccttggtttatgttatgcacatgcagacatgtgtaaacttctaaagtctaaggtacagaaaacagcagttgtgaccctgagtcaccttattttagtgttcacaagaccaaagttcccagaaat

SEQ ID NO: 189122 - DNA, 601 bp, Human
ttaggataaatttttagagtacaatcactagaagacatgaacagtttttttttaaggaatcttgatacatacgattaaattattttctcaaagttttagcttgcatactcccatcagtactcatttcttctttttaacatgtgctattatgacgtttcaaaatctttgccaatttgataggtttatttattgtcttctccattattagtatatcttactccattagtggtttgttatctggatttaaaaaaaaatcacagggatttagtcttttccttatttcctcctatttgaacctaaaggttacctaaaagctccatgatttttcataaacaaaataaaatattctaaccattcgtagactgactgggtggaaggcagtgaccgtttctgtgtgtttataaaccaaatgttcataaaccaaggactacctttattttattagctgtggctaattttgtgcagtctatgagaatttttaccactgtaagaaatgtttctatcccatgctgggaggagagggtaggacctctaggcacatcttaccatagctcttcctgcctcaaaggcaaaagcaggaatgccttggtttatgttatgc

SEQ ID NO: 189123 - DNA, 601 bp, Human
gcccagctcatattatattatgaagagcagcctcaccaagatcactgtcagagcagcactaatccaggcaaactaggatgcaaatggaaagggctccaaagtcctttgggggttagtcgtttcaatccaaggaccatttccataaaacaaaaacaaaaacaaacaaacaaaaaaacttgatgatatattgctaggccagcccacaaaagtatatttagttcataatgtcactaaactaaaacttcagttctgagtcctcaaaggaaaggactttaaggtggtatcaggaggaggaggaggragggtcgtccctctctggggctccccagcctcagcttctgcctctgcccccaccttcaggccacctccaaactttcccttggtctcatgcaagacactaaggggctcctgtcccccaaatatttcttaccctaaattgtaattccctttcctgggataagatgatctcattgaggcatcaggaggaaatcaagttgtcttttatttaaaagagaagagaggtgttaacccatgttaacccatatgatgttgaatttttttgagatcagagaagacatttagttggaggaagacaccacat

SEQ ID NO: 189124 - DNA, 601 bp, Human
aggaaagacaaaggaaaatgcttcctgctggagcatgtgcacatatgttgttcctttaactccaaatacgtatgcaggggtggtggtaggatcagaaaatgtgtgatcagaaagtgaccagttccccaccattttgtgtgggttttattttctttctgctccgtgttgactcttttccccacaacacggaagctgcttaatccaaagacttggaccatttcattctgtttcagatccattccaacaaaatgatcagttggtggcttatgtaaaaagcagctccatgactacatttaaataytgactagtttgggaataacaaaccacaaaaatttggggtataaaaaccacatgtggtttatgttttgtaggacaccctcaggaagataaatggacaaagtagaaaaaaaatataaatggtctctccctgcctcacccccaccatcattaaataaaaacaaaaaacacacaaaaataaaatgaaacaatgattaaacaaaactcaagctgggtgctactcctggctttggatggcagttgtgtcttggcaaggcaagttaagtagtggtctgggaactgtggctaaggtcaacgtgtcaga

SEQ ID NO: 189125 - DNA, 601 bp, Human
ggctcagtgacctaagactcccctaggggccctctgactgcatataagccaggcctggctagtgcagctgcctgggagaggcagacccaactactctgcaggtggacagtaaatggtgggcatttgtgagtgccataagaatggggggccttcctgggattcagatgatctgcaatgtaccacactgtctcactcagtaaagaattgtcccacaggaccttcaaaggtcctgttacatattgatgtggttgaaaaaactatttctagttatctgagcctagaccttaactccaatttatayataaactcaaaatagttattgcactgttgtattcattccctgtattttccggtaatgcaaatgtcatacaaatgaaatactttgttttgttcagatatttaccaagagttagttgcccctttggaaaatcatgagcccaaggacaatgtcaatggtgttactgaagtctttaactcaagagagcctgcaatggcagctgtcacacccaccgtgatcctacgcatacacgcaaacacctgaccatgtacttttgttttctgatgagttgtacctgatcacttacaaactgaagttatttta

SEQ ID NO: 189126 - DNA, 601 bp, Human
cactgctgctgccccaacaacttagaacagtatctggcataatgcaggtgcttgaaaatatttgtaagtgaattttacaagcttccagctctaagtttagttctaactttcacttaacctggggttgtgattatgctgctccacgtttggctctaggcaaaaaggtgccaggataaagtggaaattgttagatttgctctccaaaaagacctggggaggctcttgcttctcccaacaggttgacacaagacagccatttaaaaagacaataatggggggccctgccaacagatttaacgaytctttctcacgcagggctgtttgccagtgtcaggaagagaatgagttagaaaatagtgagatgactgacttggaaaagaggcaggggaaccaaactagggtgaaaaaaaagaggcccaggactatctagaaaggacagtcccataacggcttcacgtactcatatccaacaaatctgcattctatgcccctgtgtgcctgatgccagtaccctagatgctgaggacacagcgtggaagttcacctctccatgctgagtttggcagttttgtgctcagcaaaaaccaagaaacaaaaagca

SEQ ID NO: 189127 - DNA, 601 bp, Human
aagtccttgccatgactagcaaggtcctcgaggatttgacactcccccacttcccctctccttccttgacctctttccctaccttctccccccatctctttgccttagggattttgtgcttgctgtcccctcttctgaggacactgttctcttggctgctcccctcactccactcatgttctgcagtatttgtgcctgatctgctcttcccaccagagaggcagctccacgagggcagagtttgtcttggtcactgctgctgccccaacaacttagaacagtatctggcataatgcaggtscttgaaaatatttgtaagtgaattttacaagcttccagctctaagtttagttctaactttcacttaacctggggttgtgattatgctgctccacgtttggctctaggcaaaaaggtgccaggataaagtggaaattgttagatttgctctccaaaaagacctggggaggctcttgcttctcccaacaggttgacacaagacagccatttaaaaagacaataatggggggccctgccaacagatttaacgactctttctcacgcagggctgtttgccagtgtcaggaagagaatgagttag

SEQ ID NO: 189128 - DNA, 601 bp, Human
aaatgaacttcaagggacacatacaaactacagcattcacggactcaaacacttcagtggctttccattttataccaagtaaaacctaaagtccttgccatgactagcaaggtcctcgaggatttgacactcccccacttcccctctccttccttgacctctttccctaccttctccccccatctctttgccttagggattttgtgcttgctgtcccctcttctgaggacactgttctcttggctgctcccctcactccactcatgttctgcagtatttgtgcctgatctgctcttcccaycagagaggcagctccacgagggcagagtttgtcttggtcactgctgctgccccaacaacttagaacagtatctggcataatgcaggtgcttgaaaatatttgtaagtgaattttacaagcttccagctctaagtttagttctaactttcacttaacctggggttgtgattatgctgctccacgtttggctctaggcaaaaaggtgccaggataaagtggaaattgttagatttgctctccaaaaagacctggggaggctcttgcttctcccaacaggttgacacaagacagccatttaaa

SEQ ID NO: 189129 - DNA, 601 bp, Human
tcaatgtcagtcccggaaaagtcttggtccacctagagccaactctgcgctttatagttataaattcttaggaagagtttattctgcttgaagccatctcttaaaacaaggaattgactaggtattgttggatttgtggccagtagaagagctaaattggcttctcttccccgaggtcttagtgctaacacttctagtaccacatgtgaagagatactgcagtaaagaagttttaaattaagggctcagaaaaaatacattgccttagtctgttttgtgctgctgtaacagaatactggckactgagtaatttatgaaaaggccagatacggttctggatgctgagaagtccaaggtcgaggggccacatctggtgagggccttcttgccgtgtcattaccatggctgaaggcaagagagcatgcacaatgagaggcagggaaggaaggaaacagaattcatccttttatcaagaacccactcttgtgataactaacctagtcccatgataaggacattaattcatttataagggcagagcactcaggacctaatcatctcttaaaggttccacctctcctttgggaggctgaggcaggcg

SEQ ID NO: 189130 - DNA, 601 bp, Human
cacattagaggtgtggggctggaatggcagtattatacccacattatagacgtggagactgagcatgaagccaatgcagtaagagcgaggggagcctgagactcaagaggtacagcaatcaaaagcaacatgtgggccagcgcaggggctcgcgcctgtaatcccagcactttgggaggcagaggcaggcggatcacaatatcaggagttcgagaccaatctgaccaacatggtgaaaccctgtccctaccaaaaatacaaaaattagctgggcgtggtggggtggtgcgcacctgtaatyccagctactcaggaggctaaggcaggagaattgcttgaacccggaaggcggaggttacagtgagccgagattacgccactgcattccagcctgggcgacagagcaagactctgtgtcaaacaaacaaacaaacaaaaggcaacgtgtagatgttacttggatcctgagtcaaataaactaaaaaacaaaaatgaggcaattggaaatttggatattgttcagatatttaatgatattaagatattgataattgttaggtgtgataatgttactgtggttatattgtattttacaaagaat

SEQ ID NO: 189131 - DNA, 601 bp, Human
tccctggctgcagtgactggttcagagactacttttgaaccaaggagatgtagtgagacttattctaaggtgtgtggggctgaattggtagtatgttatccacattagaggtgtggggctggaatggcagtattatacccacattatagacgtggagactgagcatgaagccaatgcagtaagagcgaggggagcctgagactcaagaggtacagcaatcaaaagcaacatgtgggccagcgcaggggctcgcgcctgtaatcccagcactttgggaggcagaggcaggcggatcacaatrtcaggagttcgagaccaatctgaccaacatggtgaaaccctgtccctaccaaaaatacaaaaattagctgggcgtggtggggtggtgcgcacctgtaatcccagctactcaggaggctaaggcaggagaattgcttgaacccggaaggcggaggttacagtgagccgagattacgccactgcattccagcctgggcgacagagcaagactctgtgtcaaacaaacaaacaaacaaaaggcaacgtgtagatgttacttggatcctgagtcaaataaactaaaaaacaaaaatgaggcaat

SEQ ID NO: 189132 - DNA, 601 bp, Human
agtattggaaatgatgaaaagatgaaatagatggcatagtgaattataaaaaatcatgctgaaactttaaaatagtggaaaaaaaactaaaataagaaaaagaactaaaaagaaaattcaacatatgaaaagagtattatggggatagattatgggcaattgcatggagatagtccgaagagctggcctaacatgatgcagctattctgtgattgtgattttggggattttagatgttcaggattttagactttagagatttatactttagggattttcatctttgggaatttcaacattygggattatggtgttctggactgtgtcttttgggattatgatccagatctggagtaactctactctgactccaggaatggaaagtgaccagccctggctaattaaagccttgggttccctggctgcagtgactggttcagagactacttttgaaccaaggagatgtagtgagacttattctaaggtgtgtggggctgaattggtagtatgttatccacattagaggtgtggggctggaatggcagtattatacccacattatagacgtggagactgagcatgaagccaatgcagtaagagc

SEQ ID NO: 189133 - DNA, 601 bp, Human
cttgtagtattctgcaccctgttaatataaattgatgtaatcttacttggggaaaagtctgcagtgtattctgttgtgttttggcagctcagcaaccattccccctacttataatcacgtccatttgtttgtatggagaatcatcccgtgctcactctcaaaccatgtgcatccagaggcattcactcccattccagacagaggaaaagcatgtgattcaaggctggctaatcagagccttgcattcatttggccctagagacttctggtgatggcttgtgatcatcagaatcaaggaaayttgtaggctgaggcgagctctatccctgagggatgaggctggaaccagatctgttgaggatgtaggggatgggcctgctgcactcatcctttgaccacatggggtctaaaaccaagaccaacaaaatgggaattggaagagggagaaaaaccaagtgctggtgttgttggttgagccctgaatctatctataactgaagatggcctttttctagacctttaatttatgcaaataaattctctattttatttaagctggtatggtcacgttttctatcattagcaatgcaaagactcttaa

SEQ ID NO: 189134 - DNA, 601 bp, Human
tttccagcagccacgttctttaaaaagaaaagaactttaaggctgcaggagacttgcagagatcaaagtctacatcaccacttacagaggaagaaacaggggtccagagaagttaggcatcctgctcatgtcacacagctggcagcagcagagcagtggccaaagcctgggctccactccactgtccagcgccattaatgtctttagcctcatttcaggttcgggtgataccacctacctcctttctgtaagtacaagaagaggcagaagaaagagggtggagagaaaggctgtgatgcgratgggagaggttgttatactataaccaaaggcctgagataagtggattgaaagcctggatgaataaagacaatcacaattctggacttaaagagaattttaaatgcgtatctctttcccatttaatatgcatcagtctgagcttaatgacagagtaaaacaataaccaataggctcgcagaccaatcacataaagaatcctccatattaatctatagaaataaaaaaccaagagcaggcagaagattataaaacaataatgtaggtctagccagtgtagaaaaagtgctgaagaatcaca

SEQ ID NO: 189135 - DNA, 601 bp, Human
gtggcttacaccattgggcaatgtgaagagaaaaatggattaagaaaattgaaaacaaatagaacaatcagaaaggaagggggggaaataaaaagataaagaaaataaggcaagaaaagctggagatggggagagatcatgtggtgggtagaggagagctacaaccacactgctgacctcagaggctttggaagccacctctgcagtggatgacccacaggtgctggatgtaacagtgctgtctggccttccgcagtgaagcggagttctcagctcagtgtcagcttttccagcagccacrttctttaaaaagaaaagaactttaaggctgcaggagacttgcagagatcaaagtctacatcaccacttacagaggaagaaacaggggtccagagaagttaggcatcctgctcatgtcacacagctggcagcagcagagcagtggccaaagcctgggctccactccactgtccagcgccattaatgtctttagcctcatttcaggttcgggtgataccacctacctcctttctgtaagtacaagaagaggcagaagaaagagggtggagagaaaggctgtgatgcggatgggagaggttgt

SEQ ID NO: 189136 - DNA, 601 bp, Human
ggccaggctggtctccaactcctggcctcaagtgatctgtccacctcagcctcccaaagtgctgggattataggtgtgaaccaccacgctgcccagcataatgttcctttaaaagcttaagactgttccccctgaaatggtaaataacaaatgccaagactagacttaagccttcttgggagaagctgttaaagggaaattttccagagaaaaggtcagcaggtaaaacccttggcccatcagtgggcctggcagtgcaggcagagtcttatgcagtgcaggtggcttacaccattgggcratgtgaagagaaaaatggattaagaaaattgaaaacaaatagaacaatcagaaaggaagggggggaaataaaaagataaagaaaataaggcaagaaaagctggagatggggagagatcatgtggtgggtagaggagagctacaaccacactgctgacctcagaggctttggaagccacctctgcagtggatgacccacaggtgctggatgtaacagtgctgtctggccttccgcagtgaagcggagttctcagctcagtgtcagcttttccagcagccacgttctttaaaaagaaaagaa

SEQ ID NO: 189137 - DNA, 601 bp, Human
ctgttccttaaatgcaccaagctcatttgcatcttcaggccttttacttgcaagcctggtactcacgcctggtacactcatctttttgttcctttttattcttcaaatgtcagcaaaaatgctctccctcatgacccatttctgctgttttcttttatgcatagcatgcgtcaccgcttgacactgtcttatttatctgtttatttacttgtatgtttctctccactagaattcaagctctatgagagcagggaccttgtccatcttgtttctgctgttgcttcagcatctaatgcaggtktttgactgctgttgcttcagcatctaatgcaggtgtttgaaaatagtgtttgttgaatggaaaagaaaatcaatgtttcttacgaattctactacagcataatgttccttttttttttttttttttttttttttttttgagacagagtcgtactctgtcacccaggctggagtgcagtggcatgaccttggttcattgcaatcttcacttcccaggttcaagcgattctcatgtcttggcctccctagctgggactacagtcgtgcaccaccacgcctggctaattttttttttgtattt

SEQ ID NO: 189138 - DNA, 601 bp, Human
tttagagagacagtcttgctgtcacttaggctggagtgcagtggcgtaatcatagctccctgtggccctgacctcctgggttcgagcaatcctccagcctcagcctcctgagtagctgagactacaggcatatgccactgcacctggctaatttattttatttttatatttggtagagatgggatcttgctttgttgcccagcctggtcttgcactcctagcttcaaagtgatccttccatcttagcttcccagattgctgggattacaggcttgagctaccatacttggcagcaaatgarttttgaaacgtgattttggtgcccaagtcagggtaataatatacagcttaagtcagctgcagatccatagctttctatgccaaatgtttctgtcccccacacttaatgggataacagtaactctcctagaagatgcttgacaaaagcatagagataaagagggtggaaggaagaaagtcagatttctcattattaaagaactcaagaggtggatggcaatggaatacatgtagaaaacattttatcaaaaccttgagttatgtatagaacgatctgaaaatgctcataattttttcttaa

SEQ ID NO: 189139 - DNA, 601 bp, Human
gcctgaactcatttatattttactttatatataatgctcttaactcattttcatctatgtatttcttgagtgcttttggcatcttcaggttagttttttgtttgttgttgttttcttcaagatttcttttttttcttttatattgtagagaatacaaaaatatacaaagatgaaaaaaaaaagcactgaagttgtatttaaccactaaaggaagcactgaataataattaatttttatatgaaaaagggttgggggtaataaccagaggtaactctttgttattttgatacatgtccttcyagcttataagtacatgtacatctctctctctctccctctctctctctgtgtcacacatacacatatacacacaattgtttgacaaaaaaatattaacagaacaaaatttataatacatgtaacacaaaagtgttttcctgagaaaaggtttttaaattcatattgagttattacaaccataaaaaataactgcaagggcattcattacaaagacagtgaatccactccaagtcaccctgcaaaaataaaatcatcgagcaaactcaaattgctgctaagacggtgaattttaaaaagcat

SEQ ID NO: 189140 - DNA, 601 bp, Human
aagcagctttatccaattacatttatcattaatttggactattcaaaaatataaagcattttgctctataaatgttgctaaaagtaacccttaaatactatcatacttaaaatgaatggtggaatattaaacttcttttccccaaaaagattgaatcaatagaggaatattttatttgctgggggtgggggagggtatcagaaataatataactggatagattcaaaaatccaactgctctcttgccctcattattttctatttttatttacatttatttattgattttttttttttttttgagacagagtctggctctgttgcccaggctggagtgcagtggtacgatcttggctcactgcaacctccacctcctgggttcaaacaattctcctgcctcagcctcccgagtagctgggattacaggcgtgtgccatcacacttggctaatttttgtattcttggtagagatggggtttcaccatgttggccaggctggtcttgaactcctgacctcacgtgatccacccgcatcagcctcccaagatgctatgataataggcatgagccaccatgcctgaactcatttatattttacttt

SEQ ID NO: 189141 - DNA, 601 bp, Human
gcaggggttctattagagaagataagaagcagctttatccaattacatttatcattaatttggactattcaaaaatataaagcattttgctctataaatgttgctaaaagtaacccttaaatactatcatacttaaaatgaatggtggaatattaaacttcttttccccaaaaagattgaatcaatagaggaatattttatttgctgggggtgggggagggtatcagaaataatataactggatagattcaaaaatccaactgctctcttgccctcattattttctatttttatttacatktatttattgattttttttttttttttgagacagagtctggctctgttgcccaggctggagtgcagtggtacgatcttggctcactgcaacctccacctcctgggttcaaacaattctcctgcctcagcctcccgagtagctgggattacaggcgtgtgccatcacacttggctaatttttgtattcttggtagagatggggtttcaccatgttggccaggctggtcttgaactcctgacctcacgtgatccacccgcatcagcctcccaagatgctatgataataggcatgagccaccat

SEQ ID NO: 189142 - DNA, 601 bp, Human
ttacaattaattctagattgcactgcctagggcccacactacagaatgacatgaggtggggagtgattcctaatagtccccagtgaacacagttgacaatcctccaaaggccggtctctaatcccaagtgggcaggggttctattagagaagataagaagcagctttatccaattacatttatcattaatttggactattcaaaaatataaagcattttgctctataaatgttgctaaaagtaacccttaaatactatcatacttaaaatgaatggtggaatattaaacttcttttccccmaaaagattgaatcaatagaggaatattttatttgctgggggtgggggagggtatcagaaataatataactggatagattcaaaaatccaactgctctcttgccctcattattttctatttttatttacatttatttattgattttttttttttttttgagacagagtctggctctgttgcccaggctggagtgcagtggtacgatcttggctcactgcaacctccacctcctgggttcaaacaattctcctgcctcagcctcccgagtagctgggattacaggcgtgtgccatcacactt

SEQ ID NO: 189143 - DNA, 601 bp, Human
ttatttaaataagctgtttcttagtttcatagccaacttacaattaattctagattgcactgcctagggcccacactacagaatgacatgaggtggggagtgattcctaatagtccccagtgaacacagttgacaatcctccaaaggccggtctctaatcccaagtgggcaggggttctattagagaagataagaagcagctttatccaattacatttatcattaatttggactattcaaaaatataaagcattttgctctataaatgttgctaaaagtaacccttaaatactatcatacytaaaatgaatggtggaatattaaacttcttttccccaaaaagattgaatcaatagaggaatattttatttgctgggggtgggggagggtatcagaaataatataactggatagattcaaaaatccaactgctctcttgccctcattattttctatttttatttacatttatttattgattttttttttttttttgagacagagtctggctctgttgcccaggctggagtgcagtggtacgatcttggctcactgcaacctccacctcctgggttcaaacaattctcctgcctcagcctcc

SEQ ID NO: 189144 - DNA, 601 bp, Human
gttcatgaacttgtatgaaaaaaaagtacatattatttctactaagcactaactgaaatgtagcatttcctttgattatgaatgcaggccacaaaccataatatctgatattctttcacccatagttttcacgtgatattttcacatcatattacaactacacaccaacaattttcaacatgctggcaacgtttagatccattgctagatcttgttgtttaaaccattaataaagaagtacatattttaataaattagtttcctttgtaattctctgtattttattttatgcatttaaacrtagacacaaaagggtccctttgggactgggagtggtgacttatgcctataatcccaacactttgggtggtcaaggtgggaggactgcttgagcccaggagtttaagactagcttgggctacaaagtgagccctttatctctaaaaataaaataaaataaaataaaaacaaattaaaattaaattttttaaaaaaaggagtcctttgggctttaccagtgggtttatagaatgaaaaagggagaacatgagaccttggtcaggcaaatttggttctgaatccttgctctgccacctggcag

SEQ ID NO: 189145 - DNA, 601 bp, Human
ggttcatgaacttgtatgaaaaaaaagtacatattatttctactaagcactaactgaaatgtagcatttcctttgattatgaatgcaggccacaaaccataatatctgatattctttcacccatagttttcacgtgatattttcacatcatattacaactacacaccaacaattttcaacatgctggcaacgtttagatccattgctagatcttgttgtttaaaccattaataaagaagtacatattttaataaattagtttcctttgtaattctctgtattttattttatgcatttaaaygtagacacaaaagggtccctttgggactgggagtggtgacttatgcctataatcccaacactttgggtggtcaaggtgggaggactgcttgagcccaggagtttaagactagcttgggctacaaagtgagccctttatctctaaaaataaaataaaataaaataaaaacaaattaaaattaaattttttaaaaaaaggagtcctttgggctttaccagtgggtttatagaatgaaaaagggagaacatgagaccttggtcaggcaaatttggttctgaatccttgctctgccacctggca

SEQ ID NO: 189146 - DNA, 601 bp, Human
ctgggagaggagggcttccctcctctcatggacttgacagcccacatcagagccacagccagatcttactgaaggccttggccctagagcacggatcctaacagaccaggcattcctgcctggatcctcacacccagagtctgtggatagaattcaagggttcatgaacttgtatgaaaaaaaagtacatattatttctactaagcactaactgaaatgtagcatttcctttgattatgaatgcaggccacaaaccataatatctgatattctttcacccatagttttcacgtgatattttcacatcatattacaactacacaccaacaattttcaacatgctggcaacgtttagatccattgctagatcttgttgtttaaaccattaataaagaagtacatattttaataaattagtttcctttgtaattctctgtattttattttatgcatttaaacgtagacacaaaagggtccctttgggactgggagtggtgacttatgcctataatcccaacactttgggtggtcaaggtgggaggactgcttgagcccaggagtttaagactagcttgggctacaaagtgagccctttatctct

SEQ ID NO: 189147 - DNA, 601 bp, Human
ctgtgagatctgggcaaaagaatcagccctatttcagaggggcttgctagtgttgcagactggaacttactttcctggcagcctccaacttccccagagaagtagagccccaaggccctgggagaggagggcttccctcctctcatggacttgacagcccacatcagagccacagccagatcttactgaaggccttggccctagagcacggatcctaacagaccaggcattcctgcctggatcctcacacccagagtctgtggatagaattcaagggttcatgaacttgtatgaaaaaaaagtacatattatttctactaagcactaactgaaatgtagcatttcctttgattatgaatgcaggccacaaaccataatatctgatattctttcacccatagttttcacgtgatattttcacatcatattacaactacacaccaacaattttcaacatgctggcaacgtttagatccattgctagatcttgttgtttaaaccattaataaagaagtacatattttaataaattagtttcctttgtaattctctgtattttattttatgcatttaaacgtagacacaaaagggtccctttggg

SEQ ID NO: 189148 - DNA, 601 bp, Human
cttcctgctcttctgctggataacactgcctcactcactcactgcccttttaatggtctgataaacactttcaggcaggcgaattagtgccacagctcacctgttaactaggctggaatctgttttcagtaagagactgtctcaggcaaggattcttttaaagtctgtttcttaaattgctctttctggcatgacatcaattagtcacccatagggccacatgggcattgtgagcaggactgggtgcctgtgttagggggtcctccatcaaggggcatctccagcggcacattcagaggcyttggagtcagacgtctcctaggaccagcaggaacgaaagggatctgattcaggcctgactactgcgaaagatgctggagccaaatcaatggtatgatcagagttgggaaaggcttaccaaggaagggggatagcctggtctgcccggtgggcccaagagatgggctgtgggaacagtgcatccacgtgcttggttgatgaaaaatccctcaagactattttgtctgactccacgttcaccgattaactttctgtcattctgtgatcctaatatctaggaaagggtggatattctggtcaa

SEQ ID NO: 189149 - DNA, 601 bp, Human
cctcatgcgatcctcctgccttagcctcccatagtgctgggattacaggtgtgagccactgtgtcaggctttttaaactcccaatagtcccttaattgcaaaaaacaatttcttagaatttaaaatattcatttagttcaaccactacaagttaatgtggaaaactgaaacctaaacaaatactttctattgagataatgctaaatggcttgctttctgtgaacagaaatggactggagaagctaaaaaagacactgctggacttgtcacagccgccgggaaacaagaattaagacagttyggaagagtcccattcaaagtgggcggtctagaaaatgaaaattttaaattccacagcagcaacagcagctctcatgtatggagaatctgctggatccagggctctatccttgcgtggtctctgactcctaagacagcggaagccagcatcgctgtgctcatttgatagactcagagaaattaaatcactccctaaaacaccctgaagcaattcattcagtcatgtccttttgcttcctgctcttctgctggataacactgcctcactcactcactgcccttttaatggtctgataaacac

SEQ ID NO: 189150 - DNA, 601 bp, Human
gctaatttccatgacaatcctttcatgctctcccaccccctctggctttctcctcccattcttcctgacattcgccaagtctgtgtgtgcactgcaggaatatgaaaatgaatctacttctagtcccgccctcaaagttcctagtcctccagggagagggcatggagaatgtcaggtggaaagcagggagcagcagctgaggcggggtggacgtgtggggggtcaaccttatgtttggagcactcaaagaccagccatccctatctctgtgctccttagcatttcctcagaggatctaagygaaaacagagcgggcatgagaagtcagacctaggactcccaggctgtttaccagaaatgcatttcatttagaagagcctgtcttagctttgtttgggtaaaaaattatatataaataaaataaaaaagaagagcctttctgcagagtgtgcttgctctgaaaacaaagggaagaccagattccgtagctgggtaggaaagtttagggaccccaggtgggtgagggggcagggcggagagggcagcctggcaaacaccagggccaggagagacgatggccaggaagtgcctggtgagttac

SEQ ID NO: 189151 - DNA, 601 bp, Human
agtcccagctacttgggaggctgaggcaggagaatcacttgaacgggaggtggaagttgcggtgagctgagatcgtgccattgcactccagcctgggtgacagagcgagactcaaaaaaaaaaaaaagaccaggatgaatccactgaagaaattctttcaggaaataaacatctaaatgcctaaatgcaagtatagatttaaaggaggatgtgaatgtgtatggcagaggtggtggagggagatatttgtcaaaaacagattgggaagaagaggggaaaaggcagaaaaaaagaaaggagkgagaccggaagacactttaatggaatgcactgcaggcagagacctgggtttctagaccgtccagcccagaagttaaaggccagacattgagttcatctgaatgaaaacagtgcacactggtctcagaactgatcctgcaaaccctatcttgggccagcacatgtccctgcgcagatgcggcagaaaacacctcatcagccacattccacccttgtactatccatcacacgagaccttaaacaaacaaaacccttcgtgttgtttgtatttgctgggtttcaggatttggcttaccctggg

SEQ ID NO: 189152 - DNA, 601 bp, Human
aaggagcaggatgagccgggcacagtggctcacgcctgtaatcccagcactttgggaggccgaggtgggtggatcaactgaggttaggagttcaagacaagcctggccaacatggtgaaaccccgtccatactaaaaatacaaaaattagctgggcatggtggtgcttgcctttagtcccagctacttgggaggctgaggcaggagaatcacttgaacgggaggtggaagttgcggtgagctgagatcgtgccattgcactccagcctgggtgacagagcgagactcaaaaaaaaaaaaaagaccaggatgaatccactgaagaaattctttcaggaaataaacatctaaatgcctaaatgcaagtatagatttaaaggaggatgtgaatgtgtatggcagaggtggtggagggagatatttgtcaaaaacagattgggaagaagaggggaaaaggcagaaaaaaagaaaggagtgagaccggaagacactttaatggaatgcactgcaggcagagacctgggtttctagaccgtccagcccagaagttaaaggccagacattgagttcatctgaatgaaaacagtgcacactggtctcag

SEQ ID NO: 189153 - DNA, 601 bp, Human
cttccccaaagaggtctatcaaaggagcaggatgagccgggcacagtggctcacgcctgtaatcccagcactttgggaggccgaggtgggtggatcaactgaggttaggagttcaagacaagcctggccaacatggtgaaaccccgtccatactaaaaatacaaaaattagctgggcatggtggtgcttgcctttagtcccagctacttgggaggctgaggcaggagaatcacttgaacgggaggtggaagttgcggtgagctgagatcgtgccattgcactccagcctgggtgacagagygagactcaaaaaaaaaaaaaagaccaggatgaatccactgaagaaattctttcaggaaataaacatctaaatgcctaaatgcaagtatagatttaaaggaggatgtgaatgtgtatggcagaggtggtggagggagatatttgtcaaaaacagattgggaagaagaggggaaaaggcagaaaaaaagaaaggagtgagaccggaagacactttaatggaatgcactgcaggcagagacctgggtttctagaccgtccagcccagaagttaaaggccagacattgagttcatctgaatgaa

SEQ ID NO: 189154 - DNA, 601 bp, Human
attaataggcagttcttctcactaggtttcaacctcagatgagttatataaatgtgtctcatggaaacctggggcaagaaactttctctccaagcctcagtttccccatgtgaaaatggtgaaaatgaaggaaccatcagtgtgaggctcctcctcagtgaaggcttcacaagctggagagggctttgtaacagagcgtatcttggggcctttccatatgaccaagtggagagttgccaaattcctgaagagggcacactaacttccccaaagaggtctatcaaaggagcaggatgagccrggcacagtggctcacgcctgtaatcccagcactttgggaggccgaggtgggtggatcaactgaggttaggagttcaagacaagcctggccaacatggtgaaaccccgtccatactaaaaatacaaaaattagctgggcatggtggtgcttgcctttagtcccagctacttgggaggctgaggcaggagaatcacttgaacgggaggtggaagttgcggtgagctgagatcgtgccattgcactccagcctgggtgacagagcgagactcaaaaaaaaaaaaaagaccaggatgaatccac

SEQ ID NO: 189155 - DNA, 601 bp, Human
attaaaaatgggataggccaggtgcaacggctcacacctgtaatcccaacactttgggaggccaaggcgggtggattgcttgagctcaggagttcaggaccagtctgagcaatatggtgagattcccatctctacaaaaaatgagccaaatgtggtggtgcatgcctgtagtcccagctagttgggaggctgaggtgggaggatcccttgagcttgggaggtcaaggatgcagtgagctgtgttcataccattactccagcctgggtgacaagacaagaccctgtctccaaaaaaaaaaaagggggataaaccctggtgttggtgaattattcttgtaacatctgattgatttagatttgttttttggtattttagtgttctcttatctatgatgataagtggtccataatagggtttcttaattataaacattttgggacagataattcttttttgtgggtggctgtcctgtcctgttctttacagaatgtttacagcatccctggcctctacccactagatgtcagtagcagccctccctgtcccccaaagtagtgactaaaaatgtcttcagacattgccacatatcccctggaatgc

SEQ ID NO: 189156 - DNA, 601 bp, Human
cacaaatatacaaatatccaggctaggcacagtggctcacacctataataccagcactttgggaggctgagactggaggatagcttaggccccagaagtttgagaccaccctgggcaacaaagtgagacctcgtctctacgaaaataaacaacaacaacaaaatgtagccaggcatggtggtgcacacctgtagtcccagctacttaagaggctgagtgagaggatcacttgaacccactgaggctgcagtgagctatgattgcaccactgcactccagcaaaaaaaaaaaaaaaaaaaamactaagcaaatatccacaattgagttatactttttcccatcagtatttttcattttatgtgttttttcttaaaattaagaacaaattcactaagcagtattaagcctgcttttttcatttaacactttgttagcacttcttgtgtcatactctttgaaaacatgagtttaaaggattctattgtattgtagaacatgaatgtattacattaaaatttatttaactactcatttgatggccctttagattgctattaattttttaatatcatgaagcccaatagtaggctttagtaattta

SEQ ID NO: 189157 - DNA, 601 bp, Human
aacttccaccgcctccgccaccacctcctccgccaaatccgccgcctccaccaaagccaccaccaccgcctccagcaccagctcctttaggttctgtagaagaagagacacccgacagactatgccccctggtctggcccaggtaaaccataaaacaacagtacaacagggagctggccggctctcggcctccagtggacaactgggatttcttcattaaaatgcaggattttaagagttccctcagctcagtcagaactgcccgctccaggcagtcccaagcccagtggtggaagaaacraaaataaaggatgatttgtccccacactccccacttgactggctgccacatgggtcagtatctgtttgttccgtatcctaagatttggcaaatagaaggatcttcaggctgggtgcagtggctcacacatgtaatctcagcactttgggaggctgaggtgggaggatcgcttgagccagggaggtcaagactgcagggagccaagactgtgccactgcactccagcctgggtgacagtgagaccctgtctcagtaaaaaggatcttcaaagaaagagggtcgcaagggaggaggagatgc

SEQ ID NO: 189158 - DNA, 601 bp, Human
tgagtggccagcaggggttagtcacaaggagccctgcaggacagaaggggttccgattttatctaaggcacaggaagaagcatttggacagatgtatacagtggagtatcatgaacttaagagagaactttcttcttctttttttttttttttttgagacagtgcctcctctgttgcccaggctggagtgcagtggtgcaatcacggctcattgcagcttcaacttcctgggctcaggcaatcctcccacctccgcctcctgggtagctgcgactacaggcaagagccaccatgcccactractttttgtttttttttagtagagacaggattttgccatgttgcccaggctgttcttgaatttttgggcttcagccatctgcctgccttgacctgtgaaagtgctggaattataggtgtgagccaccatgcctggcccattttattattttatttttctttgtcttttgccttaatttcttcacctgttgttaaagtactaaatgtatacatttatcagctgccttaaatccttttggtgagttttaaataaatttaaattcaaatttaaatggtggtctggcaagatagaacctctcat

SEQ ID NO: 189159 - DNA, 601 bp, Human
ttcaaaaggattctgcaaatatctcttagcattatgtataggcaagagccaggatgaagtgggcgagagttctggtgagatgcctattcattatgagaggacaagaacaagatggcattggtagaatcatgattttcatttttcctcatcaccatctctgtctcccagcccttgtacctctcagttttgaaactaagtcagctgtcttaggtgaaaaaattaattatcccaatgtaaatctccaaatgtgagggcttatctagtccctatgaagagaaatgccccaaaaaaagtggaaaamtgtaaggggaaattataagaaaagagttatgactgcaataagaaaaaactaagaaaggaaaaagaaccatcagtaaagtttaattgtaagagttgacaccagtggatggaattcatctacaaagaagcaggcaactacacaacttttttttggtaccacgtcaacctctgcttcagtattggcaggacagaataatcccataactgctctggttcaacaagggagaaactaaagggggaaccaaagagatggaaaatttcaaaccaccatcccagaatctcttggaactcaaggtaattc

SEQ ID NO: 189160 - DNA, 601 bp, Human
aacagatttctattttccactggcagaataacagaaatgatcatttattgaatataactatatgccaggaaataagataaccactatacatgcttgtctcatttaattcttataacaactctgagaggtacagggataggagacaaggcctcagaggttttggaagcttgaaaagctcatcagaagactgagtggaggagccaggatctgactccaaatctattagattccaaggcccactccccataacactgaagccaaacaactcagaatacacagggcctttgatgaactctcataygctccttgtgggaatgtaaattggtaggaaattcctggaaggcaatttggcagtacctattgaaatccatagtttactatgcacactcactgacccagatattccacttataggaattaatccaaaggaaatacagagatgtgtacacatattttgctacaaaaatatatcactgcattatctgcaacaggaaaaatctagagatggcccatatgaccaagtgaggggattggttaaataaatcaaggtacatttgtaggatttaatattaggtagctgttacaagtcaggctgtagaat

SEQ ID NO: 189161 - DNA, 601 bp, Human
tcactccggctttcgtttcttgccagtttgctgggataacttttggtcgtttgtacatatggctctggaggtggcaaatcggaaatcggatggaagtagaatctgctttcccactcatctgggaagagaaacaagcagtatcttcagtgacagacaatgtgctatgaagacttacgtaacgaaaggcacagaatgaaagagagaaccacagacatcagtgctagtttttatgcctagaagtttacagaaaagctggaagtgctacaaaggtcacgaattagtacactgacatatatacagrcctgcaaatcaaagcaaagtggttttagtgagagtgattaggatccagccagtccctcttaggagctgggggctaaggtatgggacacctttttccccattgataacaatggcagagataggcaacttagtatctgcaggccgtcaggcctcttacctacagtgaactgtttagaaatgtacataataagaagctataaaaagattcttttcagaatcctggaatctctggaaagttaactaaaatgagacccaaacaaagaacagatcagggaaaaatgatccgcctttttgggaagtg

SEQ ID NO: 189162 - DNA, 601 bp, Human
ggctactcaagcgtgaatcttcaaaaaccttggcagaaatactcactccggctttcgtttcttgccagtttgctgggataacttttggtcgtttgtacatatggctctggaggtggcaaatcggaaatcggatggaagtagaatctgctttcccactcatctgggaagagaaacaagcagtatcttcagtgacagacaatgtgctatgaagacttacgtaacgaaaggcacagaatgaaagagagaaccacagacatcagtgctagtttttatgcctagaagtttacagaaaagctggaartgctacaaaggtcacgaattagtacactgacatatatacaggcctgcaaatcaaagcaaagtggttttagtgagagtgattaggatccagccagtccctcttaggagctgggggctaaggtatgggacacctttttccccattgataacaatggcagagataggcaacttagtatctgcaggccgtcaggcctcttacctacagtgaactgtttagaaatgtacataataagaagctataaaaagattcttttcagaatcctggaatctctggaaagttaactaaaatgagacccaaaca

SEQ ID NO: 189163 - DNA, 601 bp, Human
tctaccccactccaggcaagaagcctggactttctatatagcccgagtgtcactcaggctactcaagcgtgaatcttcaaaaaccttggcagaaatactcactccggctttcgtttcttgccagtttgctgggataacttttggtcgtttgtacatatggctctggaggtggcaaatcggaaatcggatggaagtagaatctgctttcccactcatctgggaagagaaacaagcagtatcttcagtgacagacaatgtgctatgaagacttacgtaacgaaaggcacagaatgaaagagaaaaccacagacatcagtgctagtttttatgcctagaagtttacagaaaagctggaagtgctacaaaggtcacgaattagtacactgacatatatacaggcctgcaaatcaaagcaaagtggttttagtgagagtgattaggatccagccagtccctcttaggagctgggggctaaggtatgggacacctttttccccattgataacaatggcagagataggcaacttagtatctgcaggccgtcaggcctcttacctacagtgaactgtttagaaatgtacataataagaagctataaaaa

SEQ ID NO: 189164 - DNA, 601 bp, Human
atcaaggcagttaaagggagtttttgttataattaatcagacattatgccaatttcaaaactagaaggaatagaagatggctctacttgtgctgtctcaggaagatgaaaacagaggaagacgtccaaagaagtaaaataataaaatttaatactagcaaaccacggtattttgagcttgtaatgacacattaaaataactgtttctcatatgcattctgggcatctgcaatttcctcactgcctgtggaaggggaatttactagaatgtagatggctccaaagggttctctaccccactscaggcaagaagcctggactttctatatagcccgagtgtcactcaggctactcaagcgtgaatcttcaaaaaccttggcagaaatactcactccggctttcgtttcttgccagtttgctgggataacttttggtcgtttgtacatatggctctggaggtggcaaatcggaaatcggatggaagtagaatctgctttcccactcatctgggaagagaaacaagcagtatcttcagtgacagacaatgtgctatgaagacttacgtaacgaaaggcacagaatgaaagagagaaccacagaca

SEQ ID NO: 189165 - DNA, 601 bp, Human
ttacctacattagcagaacaacagaaataatttaaatgtccatggtaatggtaaattactatatgctgaaataaaaaccatgtgataacatgggcactatttactaagcaatgttatgtaaaccccgccaaaaaactgtacatcgtcattataactacataaaaaaacagaattatatggataaaaaattggatgagaatctggtaaaatgaaaatatctattatgtggagagattatggatatatttacattttcatgtaatgctctgtaaagctatgattacaatacgtttaaaagatyaaggcagttaaagggagtttttgttataattaatcagacattatgccaatttcaaaactagaaggaatagaagatggctctacttgtgctgtctcaggaagatgaaaacagaggaagacgtccaaagaagtaaaataataaaatttaatactagcaaaccacggtattttgagcttgtaatgacacattaaaataactgtttctcatatgcattctgggcatctgcaatttcctcactgcctgtggaaggggaatttactagaatgtagatggctccaaagggttctctaccccactcca

SEQ ID NO: 189166 - DNA, 601 bp, Human
agtccactgtaactaggcttaaaacccattcacataaaaaaaattcatttactacacaaacatttgttgaggatttaacaggtgtttggcatgaggtcaggtgctcagatgttgtgaacaggtctaactggggcatgtgtcaatcaggtaggtctgctctaaccactgctctgagactcagtgggctggaactggcagattcctcaagtaggcatcttgatagggaccctactggtccacttagggatttctgagaaagaaccaaatttctgagcaaggaagggagttaggagaaaacacygaaagaagcacctcttcctctcaccatcccaaccaaatattttcttgggcaggcatctgagaaaagactcatctggatgtaaaccagacacctatcatggggccttgaccatcaactgacccgccacaagtggttagtagaatgagggctggccttgtccaaagctgtaattagagggcactccaagtgcattcggtactgctcagggctgtctgggtgcgctctcaggctgtgggcttggaggctgaggctgctgcagagcagaggaaaacttggtactcgacggtgccttatttattt

SEQ ID NO: 189167 - DNA, 601 bp, Human
atgagtcattttgtaacatcaaatttttaaaaaatctgtccttggaaaaattatctgtcatatttaattgcacccccaccatagcaacaagggtacttaaaagttaataaacactacttacaaacacatctcatgtatacacaaagtttttaaaacatctatgtgattgaaatagtctacatagtcaaggtatttacacgtgagtaagattctaaaaatcagataaaaggcatgtcaaatattagtcattactttatagattttcggggaaaaagaattagactctatctgtacttgtctmaattcagagaattactcacacaatttaaaatactgaccctactttcccctgcaatgaaatgaattcattaaactcttctataaagatgattaagcatgaataatcatttatgcctttaattatataactagttttcaaaggatttccctgcctttatcatttcagcctcagtaattatcaatcaaaacactagttattttaaaaacacaaagctttaccttaaacctatttcatctaaatctttattaatcgttatttataaatgtcatcactgaagtctgcaatttcctaaatgaccta

SEQ ID NO: 189168 - DNA, 601 bp, Human
actaactggcatatggccctagacaagtcacttctcccaaatttgcattctttataaaattgaagtttgatcaacaacggcagttttcaaactcaagaactgtctcctgtgcagaggggtaaaggccaagtgagccaggatacaggatcctcattcctgatttcacaaggagcagcctcacttccactcattttatttaaggttctacccatggggcaaaaagcttaaaacaaaacaaaacaaaacaaaatcacctgactagatcactgtaaaacatctctcacctctcaaatgatatgayttttctataatctttaataagaccaaacgaaacactggatacaaaatcacccaaagatacaaaatcaccaaagatcattcaataataaagaggagtcctcagtatttaagaaacttatgtcttgtaatctccatttcttcccagccatctccctgacaaaatatccaacccatatttggagtgcaataaagggaagctgagaagaaaaccagacttctctcccaccctcattgtatcccatactgttacttccatgtatactccccacacaagagaactttttatatgcagaaatgctct

SEQ ID NO: 189169 - DNA, 601 bp, Human
agttccccaaaatagtctacacatgctatttaaatttctccacctcttcacacttcgccccattacatcgagagttctatctccactattccactgaaaatgttctggcaaagggcattatatgaaatgctcactgtaaaatctaccagattccttcctcactttcattgaactttatgcaacatctggcattggtgaaatttctcattccactctgaaggtcccttcttcatctcctttgcctgccacttgaatgctggtgatctaatactttgtcttattttccccagacttccatacytacaccaaccacatcccaccagaaaatcaggcttctcttaatgaaagtcacatagacatccccaaatcaactcaccccaaaataagccgagttatctagctcaccttgtaccccatcagcaaaccagaaatgtggagatcaccccactcctccctttccttcgctgctctctccgctttgttgttgtcgttgagggtctcactctgtcacctaggctggagtgcagtggcccaatcagggctcagtgcaggcttgaactcccaggcacaatcaatcctcccacctcagcctccagagcag

SEQ ID NO: 189170 - DNA, 601 bp, Human
gatgaatatttgggtaagcttcaatggcttattatactaagcaatgtgtctcagtacatttttgttggataaaattctttgaagtgtaactaatgggtcaaaatgtatgtacacatttagtcattagtagacataaccaaactaatcctccaaaacaaaatacagcttttaagtgctcctctttgccaatccaagaagaaacaaacaaaaaagggtctagttgatttttaactttgcattcccttaataaaaggaccatttgttttgctttcatctgtgaattacgtattcatgttttctrccatctttttctattgtgctgttgatctatttctattacacttgtcttataaatttgtcttaaaaataatgatgaggataatttactacatcttataaataacactctaaaacccattagttatcaaatactaaagacaaatcactttatctaccagttagttgtgcttttaaaataaaaaagcagaggccaggtgcagtggctcacgcctgtaatcccagcactttgggaggccaaggtgggaggactgcatgagcctcggagttcaagaccagccctgacaacatggcgagaccccat

SEQ ID NO: 189171 - DNA, 601 bp, Human
aacctatttctcattgatgaatatttgggtaagcttcaatggcttattatactaagcaatgtgtctcagtacatttttgttggataaaattctttgaagtgtaactaatgggtcaaaatgtatgtacacatttagtcattagtagacataaccaaactaatcctccaaaacaaaatacagcttttaagtgctcctctttgccaatccaagaagaaacaaacaaaaaagggtctagttgatttttaactttgcattcccttaataaaaggaccatttgttttgctttcatctgtgaattacrtattcatgttttctaccatctttttctattgtgctgttgatctatttctattacacttgtcttataaatttgtcttaaaaataatgatgaggataatttactacatcttataaataacactctaaaacccattagttatcaaatactaaagacaaatcactttatctaccagttagttgtgcttttaaaataaaaaagcagaggccaggtgcagtggctcacgcctgtaatcccagcactttgggaggccaaggtgggaggactgcatgagcctcggagttcaagaccagccctgacaac

SEQ ID NO: 189172 - DNA, 601 bp, Human
agttccagaggacaagcaactgagaaagaagactttctttttaaatagctaaatattttaggttaaaaatatttcaataggctatatcagaggtctgcaaactgtgttctgcagaccaaatcctgtctgctgcctgtttttgtaaagttttatttgaacacagccatacttgttcatttatatattagctacagctgatttcctgatacaacagcacagttgactagttgcaacacagacaatacctaaatacacaaaacctaaaatatttactgtcatctgttcctttacagaaaaaaaagtttgctgttgacattgtggacaagatcattctttgttgttgggggccatcccatgcattgtgaaatgttctgcagcatccctacccactagatgtcaacagtatccccatttgtggcaaccaaaaacgtctccagacattgtcaaatatccccggagggctaaatcacccccagttgagaaccactgacataaactaactgtattcttcaggctgcctgatccttcaggaaggtgacctaacactagggggtgtccatacacaccacagtgccagggacaatctcagtttaactctgtg

SEQ ID NO: 189173 - DNA, 601 bp, Human
atgaactttaaagaattaaaagtaaggttggcagacatcaggtcataaagtggttaaataaaatctcatgattcattcatgtccttgcccttatagttccaaaatatgtctgcagagaaaataaaccactgaaatgacttacttactgacttgatcaaattaagtaaatgtgatacaatttacaagaaagttttactaaaagttaaaagagcatctatgtgttgaaacacacatatctgcaatcatttttaaaatctgagagaaaagtaaatttcataatcactactaaaaattagtagcytacctggttcaagtaataagcattcttgtggattatctgggttacaaacttttccagtactgtagatggtgctcattgtatttagaattgtgttcaactgcaaattaaagataataaacaatgttaacaatggaaattttgctgaagagaatgctaatataaagatatccttttgaccacatgattttttgattactcaaaatacagcaatttacttctttgccatgtatctttctgtatgtggagaaggaatagcccagttaagtttccccactgtcgactagcacaaagtactataag

SEQ ID NO: 189174 - DNA, 601 bp, Human
taaatgtgaacttgagctaaatcaatagaagtatagtgtctagaacaaaggtagtcatggtaccatgtctttctttatgttggtcaaacctcatctggagtaactgttcatctctaagcatgataattgaggagggacattgacaaagtacagctcattgaaaggagaacaattatagaaaagtgaggttttaaggaatggttgataatgtataagatatttaacttgacaaaagaaaatagggtaaacatgacaataacaataatagtcactaaaatgtattgcaccaggtactatgctrtatcttatatgatggttctttatgaatatctggaaggtcatcttgtagaataggaattgacattctgggtaacctcatagcatggaaatagggctaatgaatggaaggcatcagaggggtgttgcttaagttccacataaggtagaattgtattacattggttccatgtagcagtaaattagtctatattggaatgaagaaattatcccatcacaccagacaggtttaagcagaaactgaattactaaataatgcttgccattgacattgtaggaaggatttccatattactttagagtt

SEQ ID NO: 189175 - DNA, 601 bp, Human
tgttaaattgaaccctttatcattatgtaatgaccctctttgtccttttttactgttgttggtttaaagtctgttttatctgatacaagaatagcagccccctgctcttttttgttttctatttgcatgatagatctttctgcatcactttactttgagcccatgggtgtcattacacgtgagatgaatctcgaagacagtagaaggttaggttttgtttttctctccaatttgccactctctgtctgttaggtgaagcgttcctgtcatgctgttgttagctggttgctttgtagtctcsattgtgtagttgctttattgggtccatgggctatgtacttacttgtgttttgaggaacctagcacatttaaataattaaaccaaagtagtaataaagatgttacttaaaattgttttaaagattcttgtaatatttttaacactaataattttttaaatatgcaaaaatcccctcataatattcttgtttttactatccatagagattactggctggttacttagcaatgacaaactttggaatgagtgataccaaccagttgacaattctacatcttaccgcttaatggaaaactcagg

SEQ ID NO: 189176 - DNA, 601 bp, Human
gaaccgaaggtcattatattaagtgaaataagccaggcacagaaagacaaacattacttgttctcacttatttatggcatctaaaaatcaaaagagttgaactcatggacatacagagtggaaggatggttaccagaggctggaaagagtagtgggaaggtggcaggggcaggtgaggatggttaattggtacaaaaaaaacagaaagaatgaggctgtgtgatttgtgactttgggcaaatcatttacctgagcctcagtttcctcacctatagcatggagctgtcacaatacctatccygagtcagagatgacaatagaagagacgggtgtaaaaaccctttagaaagactaaaaatctacatcaagatggccctatactgctgctcaacttcaaagtggagctacaacagctacaagagtttagaggcccttgcagtttcactttttattctgcagtggacttttcccaggagtatgttatgtatgtgaagatgttcattgcattgcttcttacagatgtaaaactattaacaagcaaaggttcagcaatgcacaaatagtaaattatggtgcaattatctgaataaattttataagg

SEQ ID NO: 189177 - DNA, 601 bp, Human
tcagtagatgaatggataaagaaaatgtggtacacatacaaattggaatactattcagccataaaaaaacgaaatcctgccatttgcaacaacgtagatggaaccgaaggtcattatattaagtgaaataagccaggcacagaaagacaaacattacttgttctcacttatttatggcatctaaaaatcaaaagagttgaactcatggacatacagagtggaaggatggttaccagaggctggaaagagtagtgggaaggtggcaggggcaggtgaggatggttaattggtacaaaaaaaacagaaagaatgaggctgtgtgatttgtgactttgggcaaatcatttacctgagcctcagtttcctcacctatagcatggagctgtcacaatacctatcctgagtcagagatgacaatagaagagacgggtgtaaaaaccctttagaaagactaaaaatctacatcaagatggccctatactgctgctcaacttcaaagtggagctacaacagctacaagagtttagaggcccttgcagtttcactttttattctgcagtggacttttcccaggagtatgttatgtatgtgaagatgttca

SEQ ID NO: 189178 - DNA, 601 bp, Human
agctaccatatgatccaacaattccactgctgggtatatacccaaaagaaaggaaatcagtattttgaagagatatctgcactcccatgtttgttgcagcactattcacaataaccaagatttggaaacaacctaagtgtccatcagtagatgaatggataaagaaaatgtggtacacatacaaattggaatactattcagccataaaaaaacgaaatcctgccatttgcaacaacgtagatggaaccgaaggtcattatattaagtgaaataagccaggcacagaaagacaaacattacwtgttctcacttatttatggcatctaaaaatcaaaagagttgaactcatggacatacagagtggaaggatggttaccagaggctggaaagagtagtgggaaggtggcaggggcaggtgaggatggttaattggtacaaaaaaaacagaaagaatgaggctgtgtgatttgtgactttgggcaaatcatttacctgagcctcagtttcctcacctatagcatggagctgtcacaatacctatcctgagtcagagatgacaatagaagagacgggtgtaaaaaccctttagaaagactaaaaa

SEQ ID NO: 189179 - DNA, 601 bp, Human
agtacaaccactatggaaaacagtttggaggttcctcaaaaaagtaaaaatagagctaccatatgatccaacaattccactgctgggtatatacccaaaagaaaggaaatcagtattttgaagagatatctgcactcccatgtttgttgcagcactattcacaataaccaagatttggaaacaacctaagtgtccatcagtagatgaatggataaagaaaatgtggtacacatacaaattggaatactattcagccataaaaaaacgaaatcctgccatttgcaacaacgtagatggaacygaaggtcattatattaagtgaaataagccaggcacagaaagacaaacattacttgttctcacttatttatggcatctaaaaatcaaaagagttgaactcatggacatacagagtggaaggatggttaccagaggctggaaagagtagtgggaaggtggcaggggcaggtgaggatggttaattggtacaaaaaaaacagaaagaatgaggctgtgtgatttgtgactttgggcaaatcatttacctgagcctcagtttcctcacctatagcatggagctgtcacaatacctatcctgagt

SEQ ID NO: 189180 - DNA, 601 bp, Human
aaatgagtgaatgtaggcacagttccctagaagcaccaagaagggcatgactgaggatacaatgagcaatttggaccttaatcaatgtgcaggagtttgcccggtagatgacatggaagttgacgttctagtgctcaatgagaaaggcttaggggcaggggggtggaaatgtggcattcaggacactgcacgctgtttggtattgccaggatagagaaatagtagaaggggctgcaaattgaaacttgggaatcattagcatgtaagttgggaaatagatatgatgggccatggaacaggwatagaatgcaagaaaagaggaccaaagataaacctttagaaggtccaagtacctaaggagtggggagaggaagattattcaggggagacggagaaagtacaatcagagaggtcaaggaaatctggaaaagaatgacaatgtggaagtcggttaaaaaaaaaaagcatttgaaagacaacttgtaaatcttgtctaatgctgctatagcccagtgggataagaactgcatttggcaatgagatggtggtcctttttaacttagcaagagcattttcattcagatgggtgtaggggtcatac

SEQ ID NO: 189181 - DNA, 601 bp, Human
acttcatttatccctactttttgtcgttattagcacagctgtccacaaaccctagaagttaaacagaaacaagaaaactgtaatttaccgaatgaatgagtaatcattagaaacatggaacagagatgcggggtcacagtatgtttcatcatggggcacaggttccaccaccccaactatctctcgcctttggggagaaaagaaaacaatacattagctgtggatcacccatcacaagcatcacaagcaggtgggcataactagtgcagtttcatcaatcaaattttttttttttttttttgagacagggtctcactccgtcacccaggctgtagtgcagtggcacgatcttggctcactgcaacctccgcctcccaggttcaagcgattctcccatctcagcctcccaagtagcttggtttataggtgtgcaccaccacatctaactaatttgtgtatttttaatagagacagggtttcaccatgttggccaggctggtctcgaactcctggcctcaagtgatctgcccacctcggcctcccaaaatgctggaattacaggtgccaccgtgtccagccaatcaatggtatttacattaga

SEQ ID NO: 189182 - DNA, 601 bp, Human
aatgctgctggaccatgggccacactctgagtgaagccaggatacaggtgattgactaaaacaaaacaaactaaaaaaacctaactgtaccgcttctaaaaacaaactacctttcaaaatataaccatattctctttctagaataaaagtaatggtgacgagagtcaattgaaaggattggtatctgatatttaaggattgatacagatattttctcattgaagttcataacaccttcaaggcaataagaagtaggaatagcttatccaataaggaataggttactttaaaaacccaaagscaaaggccagaatctggaacttatagttttgaaaagaaccacatggcctctcttctttcagttcacactgaaatgggtttattgtgtcctatttaagtgaagactgtgcactcaaaaataatcaattcactgtccagaatactcactgctttatctccaagagctgattttaggcttatcctcactttgatgctttggtctgcatctgattaaagagaaatagcagactgctggttacagacaacagattgcccacatgtgcttatttccttttcctccaaagatcccactaaagtgata

SEQ ID NO: 189183 - DNA, 601 bp, Human
gaaaccatctgcaaggtcaatccattcttcgctcctgctgtctgttgtgggaaacaattgaggcaaattggacaaactgtttcttctaaacattcattgcaagtccctcacctagcatagaggccaagcaatatgtaaggaatcctgtacttgcctaccttgtttcaggatttgggcagttaaatgaatcctacatcaaagtcctgagagcaaatgatggcaatacctgtccacgtcccttctgcacttactattttccatgagttctagccagactttcttcaaccagcacctgctcccstttaccagagagcattctcagaccacaagatctgccctgcctgcagggctgaaatgctggggaattaatgccacctggaagcagttctcagccaataactgatgggaggtggtaaataaataccccagcttcctcagccctctgatgggacaattcaggtgcacattctacacagtctctccacatttcccagcaggactgagctctagttgcccatagtggtaacttgcttgataacatgtaatctatagtttttcttcccttttgtaagagcctacatctggcggaactcaaatcaag

SEQ ID NO: 189184 - DNA, 601 bp, Human; identical to SEQ ID NO: 32279

SEQ ID NO: 189185 - DNA, 601 bp, Human; identical to SEQ ID NO: 32280

SEQ ID NO: 189186 - DNA, 601 bp, Human; identical to SEQ ID NO: 32281

SEQ ID NO: 189187 - DNA, 601 bp, Human; identical to SEQ ID NO: 32282

SEQ ID NO: 189188 - DNA, 601 bp, Human; identical to SEQ ID NO: 32283

SEQ ID NO: 189189 - DNA, 601 bp, Human; identical to SEQ ID NO: 32284

SEQ ID NO: 189190 - DNA, 601 bp, Human; identical to SEQ ID NO: 32285

SEQ ID NO: 189191 - DNA, 601 bp, Human; identical to SEQ ID NO: 32286

SEQ ID NO: 189192 - DNA, 601 bp, Human; identical to SEQ ID NO: 32287

SEQ ID NO: 189193 - DNA, 601 bp, Human; identical to SEQ ID NO: 32288

SEQ ID NO: 189194 - DNA, 601 bp, Human; identical to SEQ ID NO: 32289

SEQ ID NO: 189195 - DNA, 601 bp, Human; identical to SEQ ID NO: 32290

SEQ ID NO: 189196 - DNA, 601 bp, Human; identical to SEQ ID NO: 32291

SEQ ID NO: 189197 - DNA, 601 bp, Human; identical to SEQ ID NO: 32292

SEQ ID NO: 189198 - DNA, 601 bp, Human; identical to SEQ ID NO: 32293

SEQ ID NO: 189199 - DNA, 601 bp, Human; identical to SEQ ID NO: 32294

SEQ ID NO: 189200 - DNA, 601 bp, Human; identical to SEQ ID NO: 32295

SEQ ID NO: 189201 - DNA, 601 bp, Human
gcagcgagctgagattgcatcactacactccagcctgggtgacagagtgagactccgtctcaaataaataaataaataaataaataaataaataaataaataaaacttcacagtgcccaggacacctgagacattcttggtgcttgtgctctttgaaagagctgagcaacctaaagaatatgacttatgtccaacaattcagtctcctttattataccatcagataaagtgatgttttacaaggaaaatggaaatattttaaaactcgaggagcccagcacatctaaaggatttctgtttyatgaacttacgaaaaagctggacagtcggaaaagtcttacttgcttcaaacaagtcagaccgttttctcctgttacctatgcttacagtcagattcccatttacctacaatctggccttgagatccaatatcaaggctggtggcagtaaaatggagccaaacactgtgatttctcccatgtaaatttggaatttgagaagttagaaaagtgctggctgccagacaaggtgacttcccactcacctccagctcagtgttcaacatttttaaatatcagcccccaccctcgccaggccacca

SEQ ID NO: 189202 - DNA, 601 bp, Human
atttcatgattgctacaggaaaaaaaaaaatcttcacagatacctagaactatcgtagaggcaatgctagtctaagctggaaaactggacaatcttcaaagctagaaagtgaaaactgggctgggggtggctggaggacaacctaggagcaaaattggcatcaccatccattctggaaaagaggtggttagaagaggggagggtgaggagaaagaaatacatatggaccaagtaccgaggaagaccatgaatttcttataataaataaaacattttatttcaaaaagtaaaaaaaaaaaaacaaaaaattcaaataccaccaccctaaaccattaccaccatgaatatgttttcacactacattttaattttaacaagaagaactttaacatttagaaacattatttcctcttagattttcttttcttaaaagttggggaaaaaagaaaactataaccaatattatatatctcattatcccttaccactcagtcatatctatgccaaaacttctgtttagctataggcaatcctttccttcatatcagaaataatttaattgagcgaggggtagggtggatataagttcagtatatgtagc

SEQ ID NO: 189203 - DNA, 601 bp, Human
aaactatgacccatgggccaaatctaacctgcagcctgtttttgtatggcctgttagctaagaacaattttttacattttccaatggttgaaacaattttttttttaatttcatgatgcaggaaaattacataaaattcaatttttagtgtccataaagttttatgggagcacagtcacaccttacatgatcttctctggctacttctccaacctcaacaactgcacttctggcctccactcaccccacctccagctgcaccggctccctggctaatacccagacatcgaagccaacttgstgcgcccaccatggccactgcactgatggttgcctctgtctctcttattaccttcaggactctgtagagacataactgaatcagaaaggtctcctctgatttattcagtactgtatccgctccccctacttgattttcttcatagcatttatcacacctgacatgttacacatttgcatattgtctgcctctacccatcacacttggaatgcaaattccaagagaattgaaacattgtcttatttcctgctgcattcccagcccctagacttatttcctgcttcattcccagcccctaga

SEQ ID NO: 189204 - DNA, 601 bp, Human
tctgtgctccactcaaatgcctctgttctcacttgacataactgtgcttaggatatgtgggggcagatgggtgtgggatgggcttgaatggcaagacaaccccagaccctctagaagtatgctctgaataaccccaaggggtttctgaggtctgttacagtctatcactgatctccaagatcaagggcccagtgtgccacccaaagcctttatggtgattaggctattgttaaaaacattttcatttccactcctgactctctgagggagggatatatttcccagccctactgaccaatargacattacaagacatgatgcaaggagaggcttgaaactcacatatgattgcacgtttttctatttccaccatcattgcaagcacatgctcctgctagcccactgatcaaaggaggatgagagacacctggggctgacctgcaccaaacctaagccttgagccttaatcctctgactcccagctgacttggagacataagtgagaataaggtagtgatgttttaagccactgaaatttggactgctttgttacacagcattattgtggcaatagctaactgctacagccctattccagcta

SEQ ID NO: 189205 - DNA, 601 bp, Human
taaaaaattttttaaaagacaactttcccagtgtcaaccaaagacaaactttttctctccaccttgcctccatctcctttttaaaatggttctaggaggtattttcagatagaagatgaattttaaggtatctgctcaggctttaaatgtctttagaagtgtgtaaagaaaaaaacaacccacattttacattttgatgttttgttattacggtctgactttaactagaacagatgacacctgatggtatagggtgtactaactagggcagggagaacgcacacttgctaataattattgytgtagctatggctgctgtggctgctcagatggaacctgccaagggtctgatcttgcttctctgaaatccagaaacctggccatttaaggttggggtgggctcatctttcatttcagaggcctcatgctaccattggtggttctggtggctcttttctttatgcaattctatatttaaatgaatatatatgaaatccaagttgtttaattaaacttagactgaggaaaggaactacaaatgcaggaaaagagtgtgtgtgtgaatgtatgtgtgtgtgcgtgtgcatttgtgtgagtgtgt

SEQ ID NO: 189206 - DNA, 601 bp, Human
tgtgtcctatgtgttggggtttagaagtctgtgttttagggcccctgatattccttagaagccggacaggtgagcttgaaaagagcaagacacggcaactccatagtaaataaacattaaaaaattttttaaaagacaactttcccagtgtcaaccaaagacaaactttttctctccaccttgcctccatctcctttttaaaatggttctaggaggtattttcagatagaagatgaattttaaggtatctgctcaggctttaaatgtctttagaagtgtgtaaagaaaaaaacaacccacwttttacattttgatgttttgttattacggtctgactttaactagaacagatgacacctgatggtatagggtgtactaactagggcagggagaacgcacacttgctaataattattgctgtagctatggctgctgtggctgctcagatggaacctgccaagggtctgatcttgcttctctgaaatccagaaacctggccatttaaggttggggtgggctcatctttcatttcagaggcctcatgctaccattggtggttctggtggctcttttctttatgcaattctatatttaaatgaat

SEQ ID NO: 189207 - DNA, 601 bp, Human
tctctactactaatttagggcatgagaaatgctgtttttaagttacaagacccaggttaactcctgaacttcatacaagtccactagtcttcaaacagtcgatgcatgctcagaaatagtcttagtctttaaatctatttgatgtataccttgggttcaaaatatttgtatgagtatcttgctgacctggatttgtaaatccttttcctatctcaagatacctgaccatttgcaggtcagctcccaacctgtacgactttttcaaggttgaagatcaacaatatcgcttttcaggctaaayagcatgatgaagttggctgccttatatgatgccatcctaaatgacagactaaattgcctctcaaattccccaaaagccaaaccaaccaatttttcaaaataaaattaaagataataggtactgctttaacctactgaattcaacaaaaaagtacaaattataatcttttcaaaaggcaacactgaaaggtatttgaaagaagatatgagaatataaatatacatgccaagtggaagaggctttggtttgggagtacctagccggttccaatgctggttttgagctgtaaggccatcagca

SEQ ID NO: 189208 - DNA, 601 bp, Human
acccattgtggaaattattggattaactgagccaaagtggttatgcgttctccatctatttagttagcactttgtatcgttatatacaatttacaatacatgtataacttgtagctataaacattttgtgccattaaagctctcacaaaaaaaaaaataataaagcaggcattcaaaatcttggcttcttcttgaatctacctgggaataagcttcaaagaaatactgatgctcgaatcttaaatctcacagattctcattttttgggtctgggctgcagctttgccatcaggattttttwaaaaaaaacttcccaggtgttagccttagaggaagataggtgagggctatataggaactctctatattgtctctctactactaatttagggcatgagaaatgctgtttttaagttacaagacccaggttaactcctgaacttcatacaagtccactagtcttcaaacagtcgatgcatgctcagaaatagtcttagtctttaaatctatttgatgtataccttgggttcaaaatatttgtatgagtatcttgctgacctggatttgtaaatccttttcctatctcaagatacctgaccat

SEQ ID NO: 189209 - DNA, 601 bp, Human
cgcaaacctagtggaccgatgggatgctgagcgagagtccatactggtaaaacttttgagcctcagcctgcatctccacagcttccagtcctcagagtgagtaattcgaagtagttcctccaaactagaagcagccctgatctgctgttcagatcgttctaatgtggactgagatgatcgcttaaaaaaacaaaaataccagtttaaaaacaagttactaaattttaaatttgtcataataatcttcatttctgacacttagaagtgtaaatacatctgtaattagagatactattgaaaygtatgccagtgcctaggaaaaaggatatcttctagtatttttggtttacattctgctcatttttgattgaatcagaggatttacttattcttcctgggttctcagaacacttacaaagaaaattgtagtgcattgaatggtgggcctcaaaatgatatgtccacatcctaacccacagaacctgtgaacattaccttaatttggacaaaggatctgtacagatgtaatgaagttaaggatcttaaaatgagatcctcctggattatctatgtggaccctaaatactgtacaatgacaagt

SEQ ID NO: 189210 - DNA, 601 bp, Human
caacatctttttacaaatgggaaaaaacaaatacaattttaggtagaaagaaaaaaatagttttggcctagtggttaatttgaattatgctatatatatagtcagttaccaggtaatcatgttaatcaaatctagaatgctagatcagcaatgctgtagcagcttcttgtgttgttttgacatgacatcaaaaaattaagtgcctaatcagaaaccacagaactttacttgacaagcattttattcattatgacagtacctactcacactggttttctttctttctttctttgtttttttkttttgttttgttttgtttttttgttttttaagatggagtttcactcttgttgcccaggttggagtgcaatggtgcaatcttggctcactgcaacctccgcctcctgggttcaagtgattctcctgcctcagcctcccaagtagttgggattacaggcatgcaccgccatgcctggctaattttgtatttttagtagagatgggttttcaccatgttggtcaggctggtctcgaactcctgacctcaggtgatccacctgcctcaacctcccaaagtgctgggattacaggtgtcatccac

SEQ ID NO: 189211 - DNA, 601 bp, Human
aacctatgaaaatattcccaatttaaaattctacttaaaggttgctttccatttgctttttctctttttataaaactaagttttgaaattggagtggtaagcttttaatcaaaatcatatgcaattatgaccaacatcactgattaaaggcttcataactctactattctttactgcttcccagcaggactgctctgcctcaggaaattaccttgaaatccacaagggagagttgataacaaattctaattggtgtaacatgctgatttcattattgactgcttctaacttagtaaataayttcagatgatcccctagaaattacgagataaattcatagggtttgcaaattccgtgatattttaatggttttctccttagaaaatgtcaatgtcattgactttttttagatcacctagtcttggttttatggtaacgttcatgttcatgaaatagctccaggttcacctcaggccttcagtcaggtaatctggttaaggcctttgacctctagatgaggtgccaaccctttgttctcatgaaggctatattaattcaccacatagaaacatctagagcttcaaatttctgtctgaagtga

SEQ ID NO: 189212 - DNA, 601 bp, Human
ggagaagctggttaatagggaagtaaatagaagcgtgtaaagaaataacatgtaaatattatttatcaagcaatttataggatacagctggatagcatttcttctgctttaaagccaggtgtaggtaggttttagcatcatcaagaaatatgtttctgttggttgcttaagtaactacagtaggatttaaacttggcaaatgcataaatggaaattgaagtgaaactaatccttactcaaatcagagttttctcatttgcaagtgcccgatactgatatttatgtaaatgatgaaataagyctgttcttattactggaatgagcaatcctttgaccatagttaatttgaaggtaacaaaaaaagaagcctatgggaataaaaaaattatatactttcttgtaaaacagtacttgcttttctctcataatttattttttaaattagattttgaccctttgatacttaatgctgcatagcctttctacaggtgttttgggggaaagattcaattttatgataaagacaacacaaagacttccttgtagcttgccatggaactgtagagtttatttattatgtgtggggttgtggtgctggtga

SEQ ID NO: 189213 - DNA, 601 bp, Human
tgctctttcccatttataccataccttgtagaatataagtattttatttccctttgaggtagaacaccatgtcctgtacataattacactgaatacatctggagaagctggttaatagggaagtaaatagaagcgtgtaaagaaataacatgtaaatattatttatcaagcaatttataggatacagctggatagcatttcttctgctttaaagccaggtgtaggtaggttttagcatcatcaagaaatatgtttctgttggttgcttaagtaactacagtaggatttaaacttggcaaaygcataaatggaaattgaagtgaaactaatccttactcaaatcagagttttctcatttgcaagtgcccgatactgatatttatgtaaatgatgaaataagtctgttcttattactggaatgagcaatcctttgaccatagttaatttgaaggtaacaaaaaaagaagcctatgggaataaaaaaattatatactttcttgtaaaacagtacttgcttttctctcataatttattttttaaattagattttgaccctttgatacttaatgctgcatagcctttctacaggtgttttggggga

SEQ ID NO: 189214 - DNA, 601 bp, Human
cctgcccctactccctgccaggctaagagttgacagtggccagtccagaaaccctcttctccgctttccctctgggttcccataactgctccctccccttgtctcctcagtcgaagggtggggaaatctcaccctttttgctagcttcaggtgcttcactgtcccatccctctttccccaattctgcccacaaccttcattaaatttttctcaatcactccatttgagcaacacagaacctgccatcagctatcttcattccttttaacatcctgtcctagtaacttccatatggttttcygagtcttgacatcatagcatcagagagacaataactgataagagttcaggctctggcctcccacagacctgggtttgaatcccagctctgctatttatcagccgtgtaaacttggataagtaagttacctctctgagcctcagtttcctcatctataaaggagcataaaataccctcttgatttgtttcaaagattaaatgcgattatgcacataaagcatttagtacagtgtttagcaacaaggttgttgtagctatcaacactattatcatcagggctttagagacggcaggcttgcc

SEQ ID NO: 189215 - DNA, 601 bp, Human
tttctaagaggtggtttgccaaatagtccataactttggggcgagagatagtttttaaaaaactactattaaaatgttcaaaaatgcatatttggaagaaaaactgctgtacacttacacttaagtacattgtatgaaattaatcatttgttgagtacagcagtcaaaataaagtactcaactatctattaagtggaagcaatccattaaggttgtgtttattctgacatctcaatatataatggaacttccatgagtctcagtgagagtgtttttgtagtgtttactttgcataaacttyatcttcttgcacaattttttggctatgctctagggaatcacatgatcatgaactaaaccctcttacgttatgcaagctttttttctactcagaattgatgcttagccctacttgggtcatttttttttcctaattgtcaaatagtagaggttaaaatacacacaagctccaagattctctaaaagaatttagaaaaagaaactctgcagtttaaaggatattttagagggtggaggaacaaaattaaggataagtaaatctattaacaaaacaaatcagcattaagaaaattacctaaca

SEQ ID NO: 189216 - DNA, 601 bp, Human
tgtctattcaatcaccattccatgtagtccttactacatagagtattcatttgttcactttgtttctaagaggtggtttgccaaatagtccataactttggggcgagagatagtttttaaaaaactactattaaaatgttcaaaaatgcatatttggaagaaaaactgctgtacacttacacttaagtacattgtatgaaattaatcatttgttgagtacagcagtcaaaataaagtactcaactatctattaagtggaagcaatccattaaggttgtgtttattctgacatctcaatatrtaatggaacttccatgagtctcagtgagagtgtttttgtagtgtttactttgcataaacttcatcttcttgcacaattttttggctatgctctagggaatcacatgatcatgaactaaaccctcttacgttatgcaagctttttttctactcagaattgatgcttagccctacttgggtcatttttttttcctaattgtcaaatagtagaggttaaaatacacacaagctccaagattctctaaaagaatttagaaaaagaaactctgcagtttaaaggatattttagagggtggaggaa

SEQ ID NO: 189217 - DNA, 601 bp, Human
caaatttgaactgtgcatgttttatggggcttgttttctcaaacttatgctatagccatgaaaagaacataatccggcaggcttgctggtccaagcgatgggaaacatagaagttgacttggactcacactgcagcttagagtcaagcccagctgaatccaccctaaactaactgaacctcagatacataagtgagagtaaatcattgttgtttggaaccactgagttttagtgtgtttgttacgtagcactgtgtattaatagctgactgatacaagatcatcatgcccaaacaaataaytatagctaacatgtatatcattctttctacgctttccgtaggccaggccctgttgtaagtgctttcatgttaactcatttaccccttataacaacattatggggtgggtttttattatccccatcttacaggtgaagaaacagatgtacagagagattacacaactttcttgagtggttctatgatgtgtggatgagtttgaagttgattttaatgcattgtctattcaatcaccattccatgtagtccttactacatagagtattcatttgttcactttgtttctaagaggtggtttgc

SEQ ID NO: 189218 - DNA, 601 bp, Human; identical to SEQ ID NO: 19058

SEQ ID NO: 189219 - DNA, 601 bp, Human; identical to SEQ ID NO: 19059

SEQ ID NO: 189220 - DNA, 601 bp, Human; identical to SEQ ID NO: 19060

SEQ ID NO: 189221 - DNA, 601 bp, Human; identical to SEQ ID NO: 19061

SEQ ID NO: 189222 - DNA, 601 bp, Human; identical to SEQ ID NO: 19062

SEQ ID NO: 189223 - DNA, 601 bp, Human; identical to SEQ ID NO: 19063

SEQ ID NO: 189224 - DNA, 601 bp, Human; identical to SEQ ID NO: 19064

SEQ ID NO: 189225 - DNA, 601 bp, Human; identical to SEQ ID NO: 19065

SEQ ID NO: 189226 - DNA, 601 bp, Human; identical to SEQ ID NO: 19066

SEQ ID NO: 189227 - DNA, 601 bp, Human; identical to SEQ ID NO: 19067

SEQ ID NO: 189228 - DNA, 601 bp, Human; identical to SEQ ID NO: 19068

SEQ ID NO: 189229 - DNA, 601 bp, Human; identical to SEQ ID NO: 19069

SEQ ID NO: 189230 - DNA, 601 bp, Human; identical to SEQ ID NO: 19070

SEQ ID NO: 189231 - DNA, 601 bp, Human; identical to SEQ ID NO: 19071

SEQ ID NO: 189232 - DNA, 601 bp, Human; identical to SEQ ID NO: 19072

SEQ ID NO: 189233 - DNA, 601 bp, Human; identical to SEQ ID NO: 19073

SEQ ID NO: 189234 - DNA, 601 bp, Human; identical to SEQ ID NO: 19074

SEQ ID NO: 189235 - DNA, 601 bp, Human; identical to SEQ ID NO: 19075

SEQ ID NO: 189236 - DNA, 601 bp, Human; identical to SEQ ID NO: 19076

SEQ ID NO: 189237 - DNA, 601 bp, Human; identical to SEQ ID NO: 19077

SEQ ID NO: 189238 - DNA, 601 bp, Human; identical to SEQ ID NO: 19078

SEQ ID NO: 189239 - DNA, 601 bp, Human; identical to SEQ ID NO: 19079

SEQ ID NO: 189240 - DNA, 601 bp, Human; identical to SEQ ID NO: 19080

SEQ ID NO: 189241 - DNA, 601 bp, Human; identical to SEQ ID NO: 19081

SEQ ID NO: 189242 - DNA, 601 bp, Human; identical to SEQ ID NO: 19082

SEQ ID NO: 189243 - DNA, 601 bp, Human; identical to SEQ ID NO: 19083

SEQ ID NO: 189244 - DNA, 601 bp, Human; identical to SEQ ID NO: 19084

SEQ ID NO: 189245 - DNA, 601 bp, Human; identical to SEQ ID NO: 19085

SEQ ID NO: 189246 - DNA, 601 bp, Human; identical to SEQ ID NO: 19086

SEQ ID NO: 189247 - DNA, 601 bp, Human; identical to SEQ ID NO: 19087

SEQ ID NO: 189248 - DNA, 601 bp, Human; identical to SEQ ID NO: 19088

SEQ ID NO: 189249 - DNA, 601 bp, Human; identical to SEQ ID NO: 19089

SEQ ID NO: 189250 - DNA, 601 bp, Human; identical to SEQ ID NO: 19090

SEQ ID NO: 189251 - DNA, 601 bp, Human; identical to SEQ ID NO: 19091

SEQ ID NO: 189252 - DNA, 601 bp, Human; identical to SEQ ID NO: 19092

SEQ ID NO: 189253 - DNA, 601 bp, Human; identical to SEQ ID NO: 19093

SEQ ID NO: 189254 - DNA, 601 bp, Human; identical to SEQ ID NO: 19094

SEQ ID NO: 189255 - DNA, 601 bp, Human; identical to SEQ ID NO: 19095

SEQ ID NO: 189256 - DNA, 601 bp, Human; identical to SEQ ID NO: 19096

SEQ ID NO: 189257 - DNA, 601 bp, Human; identical to SEQ ID NO: 19097

SEQ ID NO: 189258 - DNA, 601 bp, Human; identical to SEQ ID NO: 19058

SEQ ID NO: 189259 - DNA, 601 bp, Human; identical to SEQ ID NO: 19059

SEQ ID NO: 189260 - DNA, 601 bp, Human; identical to SEQ ID NO: 19060

SEQ ID NO: 189261 - DNA, 601 bp, Human; identical to SEQ ID NO: 19061

SEQ ID NO: 189262 - DNA, 601 bp, Human; identical to SEQ ID NO: 19062

SEQ ID NO: 189263 - DNA, 601 bp, Human; identical to SEQ ID NO: 19063

SEQ ID NO: 189264 - DNA, 601 bp, Human; identical to SEQ ID NO: 19064

SEQ ID NO: 189265 - DNA, 601 bp, Human; identical to SEQ ID NO: 19065

SEQ ID NO: 189266 - DNA, 601 bp, Human; identical to SEQ ID NO: 19066

SEQ ID NO: 189267 - DNA, 601 bp, Human; identical to SEQ ID NO: 19067

SEQ ID NO: 189268 - DNA, 601 bp, Human; identical to SEQ ID NO: 19068

SEQ ID NO: 189269 - DNA, 601 bp, Human; identical to SEQ ID NO: 19069

SEQ ID NO: 189270 - DNA, 601 bp, Human; identical to SEQ ID NO: 19070

SEQ ID NO: 189271 - DNA, 601 bp, Human; identical to SEQ ID NO: 19071

SEQ ID NO: 189272 - DNA, 601 bp, Human; identical to SEQ ID NO: 19072

SEQ ID NO: 189273 - DNA, 601 bp, Human; identical to SEQ ID NO: 19073

SEQ ID NO: 189274 - DNA, 601 bp, Human; identical to SEQ ID NO: 19074

SEQ ID NO: 189275 - DNA, 601 bp, Human; identical to SEQ ID NO: 19075

SEQ ID NO: 189276 - DNA, 601 bp, Human; identical to SEQ ID NO: 19076

SEQ ID NO: 189277 - DNA, 601 bp, Human; identical to SEQ ID NO: 19077

SEQ ID NO: 189278 - DNA, 601 bp, Human; identical to SEQ ID NO: 19078

SEQ ID NO: 189279 - DNA, 601 bp, Human; identical to SEQ ID NO: 19079

SEQ ID NO: 189280 - DNA, 601 bp, Human; identical to SEQ ID NO: 19080

SEQ ID NO: 189281 - DNA, 601 bp, Human; identical to SEQ ID NO: 19081

SEQ ID NO: 189282 - DNA, 601 bp, Human; identical to SEQ ID NO: 19082

SEQ ID NO: 189283 - DNA, 601 bp, Human; identical to SEQ ID NO: 19083

SEQ ID NO: 189284 - DNA, 601 bp, Human; identical to SEQ ID NO: 19084

SEQ ID NO: 189285 - DNA, 601 bp, Human; identical to SEQ ID NO: 19085

SEQ ID NO: 189286 - DNA, 601 bp, Human; identical to SEQ ID NO: 19086

SEQ ID NO: 189287 - DNA, 601 bp, Human; identical to SEQ ID NO: 19087

SEQ ID NO: 189288 - DNA, 601 bp, Human; identical to SEQ ID NO: 19088

SEQ ID NO: 189289 - DNA, 601 bp, Human; identical to SEQ ID NO: 19089

SEQ ID NO: 189290 - DNA, 601 bp, Human; identical to SEQ ID NO: 19090

SEQ ID NO: 189291 - DNA, 601 bp, Human; identical to SEQ ID NO: 19091

SEQ ID NO: 189292 - DNA, 601 bp, Human; identical to SEQ ID NO: 19092

SEQ ID NO: 189293 - DNA, 601 bp, Human; identical to SEQ ID NO: 19093

SEQ ID NO: 189294 - DNA, 601 bp, Human; identical to SEQ ID NO: 19094

SEQ ID NO: 189295 - DNA, 601 bp, Human; identical to SEQ ID NO: 19095

SEQ ID NO: 189296 - DNA, 601 bp, Human; identical to SEQ ID NO: 19096

SEQ ID NO: 189297 - DNA, 601 bp, Human; identical to SEQ ID NO: 19097

SEQ ID NO: 189298 - DNA, 601 bp, Human
cccggggtgacgcagaggcgctggggaagctttccgtctcgcaggtccacctggccaggcgaaggcgtcggaggcggggggaccactttctcccccctaggctgtgctccttcccctaactggcacctgcagaagccctgaacctctagcacctctgcgaccacccgaggcgacctcctgctcacggggggaagaaacgcgttctcctttgtgctgcattctatatgttctctgcagtgagccccagagaggcagggtggtgaggagcttaggttgcagttggctaaaagttgaggttatkgtgccctcgctacgaagttgaaacttttcctgggtgggatgagtaggtgcttaactgaacttatggttttctacttattatatggttaagaaaaaggattccaattggaattggaaggcccttctaggagagaccccaataaactcaaatcgagtattaaataacctgggtaatattttatttagaaatttaaacaggagttaaatattggagtattctccgacgttatcacactggaactattagccatcaggtatttttggacacagttgcccctctgccacggctgccactcagaat

SEQ ID NO: 189299 - DNA, 601 bp, Human
gaacctctagcacctctgcgaccacccgaggcgacctcctgctcacggggggaagaaacgcgttctcctttgtgctgcattctatatgttctctgcagtgagccccagagaggcagggtggtgaggagcttaggttgcagttggctaaaagttgaggttattgtgccctcgctacgaagttgaaacttttcctgggtgggatgagtaggtgcttaactgaacttatggttttctacttattatatggttaagaaaaaggattccaattggaattggaaggcccttctaggagagaccccartaaactcaaatcgagtattaaataacctgggtaatattttatttagaaatttaaacaggagttaaatattggagtattctccgacgttatcacactggaactattagccatcaggtatttttggacacagttgcccctctgccacggctgccactcagaatgatatgcctttgttcacaagaaaagtaaatatggggttatgttgttaaaggttattggaaactggcatttaaaaaagctcaaaaactcgtgatcatgtattaaacatttaataattgaccatagggagggattcttaaa

SEQ ID NO: 189300 - DNA, 601 bp, Human
cagtgagccccagagaggcagggtggtgaggagcttaggttgcagttggctaaaagttgaggttattgtgccctcgctacgaagttgaaacttttcctgggtgggatgagtaggtgcttaactgaacttatggttttctacttattatatggttaagaaaaaggattccaattggaattggaaggcccttctaggagagaccccaataaactcaaatcgagtattaaataacctgggtaatattttatttagaaatttaaacaggagttaaatattggagtattctccgacgttatcacastggaactattagccatcaggtatttttggacacagttgcccctctgccacggctgccactcagaatgatatgcctttgttcacaagaaaagtaaatatggggttatgttgttaaaggttattggaaactggcatttaaaaaagctcaaaaactcgtgatcatgtattaaacatttaataattgaccatagggagggattcttaaaacagcaattttttacattttttaggtgcctctttattttgaatgctctccatgttgatgaaattcattctttatcaagatgtaaaatatgtaatt

SEQ ID NO: 189301 - DNA, 601 bp, Human
agattttggcttcattgcttaatctttatgctttactactttggcaccacgcaagcaaatctgaaggccacttgcttgctgtgttaatttaaaaatctgctaaattctctgttttgattttaaaaaagacaactccgttaaaaaaaaaaatccagcccaacagtaacaggcttaaatttggagcattaaaaaaaaaccgttaaggtggtgacgtttgaacatacgaactttgattttactgaaagggaattaggttcagaggttaatcaggtgactcacggtcacttttggggcagaattygggacttaatttaactcagtgctgaattgtagtttatgacttggcagtccttttattaatacaaaatccctaagtgactgtatatttattcctgaagttaatgaagtttaaagaaagattctagtttttaaaaagaagattttatttttttagtaacagcattggtacttttttttttttgagacagaattttactcttgtccacaggcaggcagtgcaatggtgctatctcggctcactgcagtctgtgccacctgggttcaagtgattctgtgcctcagcctcccaattagctgggat

SEQ ID NO: 189302 - DNA, 601 bp, Human
gctcagtggctcacacctgtaatctcagcactttgggaaggccgagtgggtggatcacgaggtcaggagttcgagaccagcctgaccaacatggtgaaaccctgtctctactaaaaatacacaaaaaatttgtcaggcgtggtggtgtgcgcctgtaatcccagctactcaggaggccgaggcaggagaattgctcgaacccaggaggtggaggttacagtgagccaagattgtgccactgcactgcagccagggcgacagggaggctctgtctcaaaaaaacaaaaaaaacaaaacaaacaaaagaatgcctcttgttagaggactgatgcgtatagttgatgtatcattggtgctttgaaatacataattaggtgaacttagtttaagaatatttaagtatgttcacttgtgataaaatctctttttataaaatgagtctgtggttttattactggatttctctttaagtaaacttaaaaattccaaagttaaatatttaggtatatggcaataaaataatttacctctttcctcttttacctaataggtggccagcatcgaaatgttcagccttttagtgatgaagatgcatcaattg

SEQ ID NO: 189303 - DNA, 601 bp, Human
gagttcgagaccagcctgaccaacatggtgaaaccctgtctctactaaaaatacacaaaaaatttgtcaggcgtggtggtgtgcgcctgtaatcccagctactcaggaggccgaggcaggagaattgctcgaacccaggaggtggaggttacagtgagccaagattgtgccactgcactgcagccagggcgacagggaggctctgtctcaaaaaaacaaaaaaaacaaaacaaaaaaaagaatgcctcttgttagaggactgatgcgtatagttgatgtatcattggtgctttgaaatacrtaattaggtgaacttagtttaagaatatttaagtatgttcacttgtgataaaatctctttttataaaatgagtctgtggttttattactggatttctctttaagtaaacttaaaaattccaaagttaaatatttaggtatatggcaataaaataatttacctctttcctcttttacctaataggtggccagcatcgaaatgttcagccttttagtgatgaagatgcatcaattgaaacaatgagccattgcagtggttatagcgatccttccagttttgctgaagatggtatgagtttta

SEQ ID NO: 189304 - DNA, 601 bp, Human
ttacagtgagccaagattgtgccactgcactgcagccagggcgacagggaggctctgtctcaaaaaaacaaaaaaaacaaaacaaaaaaaagaatgcctcttgttagaggactgatgcgtatagttgatgtatcattggtgctttgaaatacataattaggtgaacttagtttaagaatatttaagtatgttcacttgtgataaaatctctttttataaaatgagtctgtggttttattactggatttctctttaagtaaacttaaaaattccaaagttaaatatttaggtatatggcaakaaaataatttacctctttcctcttttacctaataggtggccagcatcgaaatgttcagccttttagtgatgaagatgcatcaattgaaacaatgagccattgcagtggttatagcgatccttccagttttgctgaagatggtatgagttttaaatttaaatttgcaactttagataaaatgtttcaggtggaggaattcttgtagctaaagtatactattattccctgttttttttcttttaaattacgatggctgttttatattatttcttaggaccagaagtccttgatgaggaagga

SEQ ID NO: 189305 - DNA, 601 bp, Human; identical to SEQ ID NO: 22575

SEQ ID NO: 189306 - DNA, 601 bp, Human
cccaaacaaaaggcaattatatgattcccagcctcttttcagcataatccagaataagtgaaatctgagttaatgggattaattaattaattaggtgggaagtttgaagacaattatttacattttatgaaatttctgctcctgtgtgcttatttcttggaagctgatttcttttagaagttttcatagtagagtcttcataagaacaaaagaatatagttgtaacagcttaaaaaccaatggaattgtaatgtgttttaaaggctttttgatagagggtaggcttctttagctcatatgyctaagctttctatctttgaattacagttgaagtttaatgatctagtaagcacctgtaaagcatacagaaaggaaacaaggggatagttcaccctttcagaatgctttactgacatagactcataaaaatgattcaataatttaaattatagattatggagctgcaattgtttcagaaattatgtaattcttttgcatgcttttgattttgtggatcaataaaagaagactgaagaggaacagaatcactttgttaaagtcatgctgtgaatttagtagcagagcttgagctgaaacgcac

SEQ ID NO: 189307 - DNA, 601 bp, Human
agaatatagttgtaacagcttaaaaaccaatggaattgtaatgtgttttaaaggctttttgatagagggtaggcttctttagctcatatgtctaagctttctatctttgaattacagttgaagtttaatgatctagtaagcacctgtaaagcatacagaaaggaaacaaggggatagttcaccctttcagaatgctttactgacatagactcataaaaatgattcaataatttaaattatagattatggagctgcaattgtttcagaaattatgtaattcttttgcatgcttttgattttrtggatcaataaaagaagactgaagaggaacagaatcactttgttaaagtcatgctgtgaatttagtagcagagcttgagctgaaacgcacttcctttgatcttagttcaatattctttctctcctcacctcttttatgtataatgtttgggacctaatatattatgctgctgagaacattttcacgttgaattataaaagcaggaagatgtagaattaataagaaataaaatcattaatgtctatatatatatatttttttttttagtgtgcaacttgctttggtgtttgctgttttatt

SEQ ID NO: 189308 - DNA, 601 bp, Human
attgtttcagaaattatgtaattcttttgcatgcttttgattttgtggatcaataaaagaagactgaagaggaacagaatcactttgttaaagtcatgctgtgaatttagtagcagagcttgagctgaaacgcacttcctttgatcttagttcaatattctttctctcctcacctcttttatgtataatgtttgggacctaatatattatgctgctgagaacattttcacgttgaattataaaagcaggaagatgtagaattaataagaaataaaatcattaatgtctatatatatatatwtttttttttagtgtgcaacttgctttggtgtttgctgttttattgccacagatgacattactgtaagtaaaaaacctttgattctagttatctgcagttatttctaatttaagatggttatcttacttcatattcttatgcattaggaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatca

SEQ ID NO: 189309 - DNA, 601 bp, Human; identical to SEQ ID NO: 22576

SEQ ID NO: 189310 - DNA, 601 bp, Human; identical to SEQ ID NO: 22577

SEQ ID NO: 189311 - DNA, 601 bp, Human; identical to SEQ ID NO: 22578

SEQ ID NO: 189312 - DNA, 601 bp, Human; identical to SEQ ID NO: 22579

SEQ ID NO: 189313 - DNA, 601 bp, Human; identical to SEQ ID NO: 22580

SEQ ID NO: 189314 - DNA, 601 bp, Human; identical to SEQ ID NO: 22581

SEQ ID NO: 189315 - DNA, 601 bp, Human; identical to SEQ ID NO: 22582

SEQ ID NO: 189316 - DNA, 601 bp, Human; identical to SEQ ID NO: 22583

SEQ ID NO: 189317 - DNA, 601 bp, Human; identical to SEQ ID NO: 22584

SEQ ID NO: 189318 - DNA, 601 bp, Human; identical to SEQ ID NO: 22585

SEQ ID NO: 189319 - DNA, 601 bp, Human; identical to SEQ ID NO: 22586

SEQ ID NO: 189320 - DNA, 601 bp, Human; identical to SEQ ID NO: 22587

SEQ ID NO: 189321 - DNA, 601 bp, Human; identical to SEQ ID NO: 22588

SEQ ID NO: 189322 - DNA, 601 bp, Human; identical to SEQ ID NO: 22589

SEQ ID NO: 189323 - DNA, 601 bp, Human; identical to SEQ ID NO: 22590

SEQ ID NO: 189324 - DNA, 601 bp, Human; identical to SEQ ID NO: 22591

SEQ ID NO: 189325 - DNA, 601 bp, Human; identical to SEQ ID NO: 22592

SEQ ID NO: 189326 - DNA, 601 bp, Human; identical to SEQ ID NO: 22593

SEQ ID NO: 189327 - DNA, 601 bp, Human; identical to SEQ ID NO: 22594

SEQ ID NO: 189328 - DNA, 601 bp, Human; identical to SEQ ID NO: 22595

SEQ ID NO: 189329 - DNA, 601 bp, Human; identical to SEQ ID NO: 22596

SEQ ID NO: 189330 - DNA, 601 bp, Human; identical to SEQ ID NO: 22597

SEQ ID NO: 189331 - DNA, 601 bp, Human; identical to SEQ ID NO: 22598

SEQ ID NO: 189332 - DNA, 601 bp, Human; identical to SEQ ID NO: 22599

SEQ ID NO: 189333 - DNA, 601 bp, Human
ttttctctggggaataagctccagggaaaagaagagacgcaggaccgagaagtaagagtcctgggttggaggcctagtctggccattagcatcacagttgacccttgccctccctgagtctcagtttctctgtcactgaatgaggccatggtggtgaccatctctgaactgcctcctctcaaaattctcccaagttgtcccttgagggtgcatcacctcctcccactcccctgtgatatcagcccagttctgaaaatggtcctagagtctgcactgccagctgtccctgccctgcagctgygtccccccatagctcctgactcactctggccttgggcagaccctcatggccatggaccagggatggggaggtgagaatcctcttttgttccccatttccatacagggaagcatagttgtgaatctccgtgaatcccactcctccatcccagtagacctcctgacccttgccacaaccctggacatcacggttgtcctcagagtggactttccactgctttactacacatctttgtcaggaaaatcaacacaaaaaaagtgagctctacaggaaaataacttccgtgctcctcttagcatc

SEQ ID NO: 189334 - DNA, 601 bp, Human
ggacacggcactctacgtctcttcccatggcttatttacagctaggagctttgaaagtcaatttcaaaacacaaagaagtctcatttcctctgcatccaaagtgagaagttcacagaccttttctctggggaataagctccagggaaaagaagagacgcaggaccgagaagtaagagtcctgggttggaggcctagtctggccattagcatcacagttgacccttgccctccctgagtctcagtttctctgtcactgaatgaggccatggtggtgaccatctctgaactgcctcctctcaraattctcccaagttgtcccttgagggtgcatcacctcctcccactcccctgtgatatcagcccagttctgaaaatggtcctagagtctgcactgccagctgtccctgccctgcagctgcgtccccccatagctcctgactcactctggccttgggcagaccctcatggccatggaccagggatggggaggtgagaatcctcttttgttccccatttccatacagggaagcatagttgtgaatctccgtgaatcccactcctccatcccagtagacctcctgacccttgccacaaccctgg

SEQ ID NO: 189335 - DNA, 601 bp, Human
taagtcttgaccagcactttgaaaataaataaaatgtggttctcaagccagcagcatcagcattacccaggagtttattagaaatctgcagaatctcaggccccatcccagacctactgctgaaccagcatctgcatttcaacacggttcccagcagattcatgtgcacattaaaatctgagaagccctggtctggaataccgggaagccacaactgttagcgctgatctattaaatgaagtgcccaggaactctctcacatgtgaaggatgtgaacttcagcatgggcacccaaaatctsttcaagcttcccaaaggcccatttctcctgctttacacctccagggagtcacagagaggtgttatccctctccttgcaactctgaatataggacacggcactctacgtctcttcccatggcttatttacagctaggagctttgaaagtcaatttcaaaacacaaagaagtctcatttcctctgcatccaaagtgagaagttcacagaccttttctctggggaataagctccagggaaaagaagagacgcaggaccgagaagtaagagtcctgggttggaggcctagtctggccattagca

SEQ ID NO: 189336 - DNA, 601 bp, Human
tcagtcactgtggtctctccagcccctatagcaatgcttggcacatagtagctgctcaataaaaataaattgcttaaataagtgagttgagcaaagcagtgtggggtcacccccagggcctccttgcctgccccttctccagcccctgactcccaccccgaccccgactggacctctcttcccacagcaccccttttactctcttgctgaagaaactattgttcccaactaccaagcccatcaagtcaaaacccctctgtcctggtttcaagacccctcaaagtgcccctccccacctgaycaaagctatttcccaccacttcccaccacacccctgcagtttactgggtctagtgagctccaggagccacagagcctgaccagcctttagcaaccaaatcagaatgaacagctggcttctccctaccttgcaggatccccttgcaggaagaatgcaggaggcagttaaagtgcttggccagtaccctaaaaatgggagctatcatcacctgaggctagaggcagtttctcaaagcaaatgacagctgtggggtctgagggatgccggttcaaatcccagctccaccattttactggtagg

SEQ ID NO: 189337 - DNA, 601 bp, Human
tcccagctatatcacgtccactgcccttatctgtggacatagcgcttctttacatagtcactgaatccccaactagaatgtaagctccaggaggcacagactttgcctgtctcagtcactgtggtctctccagcccctatagcaatgcttggcacatagtagctgctcaataaaaataaattgcttaaataagtgagttgagcaaagcagtgtggggtcacccccagggcctccttgcctgccccttctccagcccctgactcccaccccgaccccgactggacctctcttcccacagcaycccttttactctcttgctgaagaaactattgttcccaactaccaagcccatcaagtcaaaacccctctgtcctggtttcaagacccctcaaagtgcccctccccacctgaccaaagctatttcccaccacttcccaccacacccctgcagtttactgggtctagtgagctccaggagccacagagcctgaccagcctttagcaaccaaatcagaatgaacagctggcttctccctaccttgcaggatccccttgcaggaagaatgcaggaggcagttaaagtgcttggccagtaccctaa

SEQ ID NO: 189338 - DNA, 601 bp, Human
accagcctggccaacatggtgaaaccccatctctactaaaaataaaaaaattagccaggcacagtggcacgtgcctgtaatcccaactacttgggaggctgagacgggagaatcacttgaaccccagaggtggaggttgcagtgagctgagatcaagctaccgcactccagcctgggtgactgagcaagacgccatctcaaaaaaaaaaaaaaaagtaaaaacatacaacaacaacagaaagcatagatgatgttgccaggccagctgtaaataatgtgacctaaatgacagtacctcagyttcatcatcagtgaaaccaaggatgatgaaaaaaattgtactgtccacacagggctgtcacaaggatgctttcagataacccatttaaaagcagcatctggcatgtggcatgtgctttttgacacacatagagctataaatgtcaattaggtaatacacgtaaaatgcgtggcacagggtccaacacctggtgggtattatctagggcgtcaatcaccctcaagaagtctccctgacccagttgccaggatgagagtaactggggctccccttcccaatgtaaggtgaatgtgggacttc

SEQ ID NO: 189339 - DNA, 601 bp, Human
gggagggattgagcccaagagttcacggatgcaatgagctatgatattgccactgcactccagcctgggcaacagagtgggaccctgtctcttaaaaaaaaaaaaagaagaagaagaagaagaagaagaaaaagaagaaggccgggcgtggtggctcatgcctgtaatcccagcactttgggaggccaaggcaggcagatcataaggtcaggagtttgagaccagcctggccaacatggtgaaaccccatctctactaaaaataaaaaaattagccaggcacagtggcacgtgcctgtaawcccaactacttgggaggctgagacgggagaatcacttgaaccccagaggtggaggttgcagtgagctgagatcaagctaccgcactccagcctgggtgactgagcaagacgccatctcaaaaaaaaaaaaaaaagtaaaaacatacaacaacaacagaaagcatagatgatgttgccaggccagctgtaaataatgtgacctaaatgacagtacctcagtttcatcatcagtgaaaccaaggatgatgaaaaaaattgtactgtccacacagggctgtcacaaggatgctttcagataac

SEQ ID NO: 189340 - DNA, 601 bp, Human
catgtgacaagacatgtcacctcaatagtcagggaaatgtaccatcagagaagaataagatatttaatagcaggagtgcagggaaaaggatgctttgctggtgaagataggaatttagagccgcgatgggagatgagtctggtgatacatgagacgccgaaagctgacttagtgtaaaatgtggaggccacacgatgggcagattcctgaggggtcgagggcaggcctccacagccagccagggcttccgcggctagggtgtcaaccgccaattgcattgtacctgaactcatattttttrtgtagttcccctagttcaccatattggaggcgtcagcctgaaaattcaaaactgtgattcctggcctgttgtggtggctgaggcctataattcccagcagtttgggaggcagaggagggaggatcatttgaaaccaggagtttgagaccaacctggacaacatagttagacccttgactctacaaacaaaaaatttttttttaattagccaggcatggtggtgcatgcttatagtctcagctactcagaaggctgaggagggagggattgagcccaagagttcacggatgcaatgagcta

SEQ ID NO: 189341 - DNA, 601 bp, Human
gctgccaggtgagatcccctgtggcacagcaaatccaccaataagcatgtgacaagacatgtcacctcaatagtcagggaaatgtaccatcagagaagaataagatatttaatagcaggagtgcagggaaaaggatgctttgctggtgaagataggaatttagagccgcgatgggagatgagtctggtgatacatgagacgccgaaagctgacttagtgtaaaatgtggaggccacacgatgggcagattcctgaggggtcgagggcaggcctccacagccagccagggcttccgcggctrgggtgtcaaccgccaattgcattgtacctgaactcatattttttgtgtagttcccctagttcaccatattggaggcgtcagcctgaaaattcaaaactgtgattcctggcctgttgtggtggctgaggcctataattcccagcagtttgggaggcagaggagggaggatcatttgaaaccaggagtttgagaccaacctggacaacatagttagacccttgactctacaaacaaaaaatttttttttaattagccaggcatggtggtgcatgcttatagtctcagctactcagaaggctg

SEQ ID NO: 189342 - DNA, 601 bp, Human
tacatgtctgaaattgccaaaaaaattatttaaggcaggaaaaaagaatacatgtgagaactggcctctgtggtactgcatgtgacaaagccatgtaactaagatcgaatggtcttatgctaagattggcaagtatcattggaaaagaaggtggagcccaggagcaagtaagtgttcatgcacgcacacacgcgtgcctatgtgtgtatgtatattttgtaaagttaatacatgacagaggcaggattttaattcagagggaaaggatagttaatctaatatggaaaaaaaaaaaaaaaaacctgactctccacctggaaaaaaatacatttgggtcctcacctcccaccattcacattcacaaaaatcaattgtaggtagattaaaggcataaagaatagaaaaatacaaatcttaatagaagtagaaatcaaaaaccaaatgcactcaataagagcagagaggacctcaaccatgacaggaaacgcagaggctgtaataaaaacgaaacacacatttgactacattaattttctgtgtttgctgcaaaagataccataaacaaaactaaaagagggtagatttcggggaaatatttgca

SEQ ID NO: 189343 - DNA, 601 bp, Human
tgagtaagagaaaagagtacatgtctgaaattgccaaaaaaattatttaaggcaggaaaaaagaatacatgtgagaactggcctctgtggtactgcatgtgacaaagccatgtaactaagatcgaatggtcttatgctaagattggcaagtatcattggaaaagaaggtggagcccaggagcaagtaagtgttcatgcacgcacacacgcgtgcctatgtgtgtatgtatattttgtaaagttaatacatgacagaggcaggattttaattcagagggaaaggatagttaatctaatatggaaaaaaaaaaaaaaaaacctgactctccacctggaaaaaaatacatttgggtcctcacctcccaccattcacattcacaaaaatcaattgtaggtagattaaaggcataaagaatagaaaaatacaaatcttaatagaagtagaaatcaaaaaccaaatgcactcaataagagcagagaggacctcaaccatgacaggaaacgcagaggctgtaataaaaacgaaacacacatttgactacattaattttctgtgtttgctgcaaaagataccataaacaaaactaaaagagggtagatt

SEQ ID NO: 189344 - DNA, 601 bp, Human
gaggaaaggtttcctttacttctattttgggacctaaaaatgagtaagagaaaagagtacatgtctgaaattgccaaaaaaattatttaaggcaggaaaaaagaatacatgtgagaactggcctctgtggtactgcatgtgacaaagccatgtaactaagatcgaatggtcttatgctaagattggcaagtatcattggaaaagaaggtggagcccaggagcaagtaagtgttcatgcacgcacacacgcgtgcctatgtgtgtatgtatattttgtaaagttaatacatgacagaggcargattttaattcagagggaaaggatagttaatctaatatggaaaaaaaaaaaaaaaaacctgactctccacctggaaaaaaatacatttgggtcctcacctcccaccattcacattcacaaaaatcaattgtaggtagattaaaggcataaagaatagaaaaatacaaatcttaatagaagtagaaatcaaaaaccaaatgcactcaataagagcagagaggacctcaaccatgacaggaaacgcagaggctgtaataaaaacgaaacacacatttgactacattaattttctgtgtttgc

SEQ ID NO: 189345 - DNA, 601 bp, Human
gtgttcagcagggctacgttacgacttcatgagcccttgacacatttgcctttgtgggcaaaaaatatttaaaatacactgagcgtggtggctcccacccgtaatcccagcactttgggaggccaaagtgggcagatcacttgagcccaggagtttgagaccagcctgagcaacttggtaaaaccccgtctctccaaaaatacaaaaaagaaaatttagccgggcatagtgatgcacacttgtggtcccagctacttgggaagctgaggtgggaggatcgcttgagcccgggaggtcacartgaaccatcattgcgccactgcactccagcctgggtgacagagtgagaccctgtatcaaaaaaatacataaatttaaatcctattttatgactgcactggtgtaaagactcagagctcactgggttcagttctacaggtaagaaagttgaggcagaagagagaagcaactgtccaaggccacaccttggcaatgataaagaccagaccagcctctgctcccttatactcaaagcaacacaggaaatgaacttaattttaacatttaaaacaaaggagatctgcatctttccttgttcatt

SEQ ID NO: 189346 - DNA, 601 bp, Human
ccccaccacctgttttccaatcattcattcaacaagtgtttaacgagaacctactatgtgccagcactggactaggcgtgctggagcacactgttatgtgtattcagcacctagaacagtgcctggaacacagtaggtgctcagaaaacacatgttgagtgagtacttgaatgactgaacaacccaatgaaaggggtgttactggccaggcgcggtggctcatgcctgtaatctcagcattttgggaggccgaggcgggcggatcacaaagtcaggagattcaaaccatcctggccaacayggtgaaaccccatctctactaaaaatacaaaaattagctgggcatggtggcatgcacctgtagtcccagctgctcgggaggctgaagcaggtgaatcgctcgaacccgggaagcagaggttgcagtgagccgagatcatgcgactgcactccagcctgggcgacagagcgagactccctctaaagaaaaaaaaaaaaaaaaaaggaagggatgttattgtttcccaaatgaggcagtgaggctcccagaggttaagtgactagcccacacgcatacaggcagcatggggcacagccgggc

SEQ ID NO: 189347 - DNA, 601 bp, Human
ttgttggtacctccccaccacctgttttccaatcattcattcaacaagtgtttaacgagaacctactatgtgccagcactggactaggcgtgctggagcacactgttatgtgtattcagcacctagaacagtgcctggaacacagtaggtgctcagaaaacacatgttgagtgagtacttgaatgactgaacaacccaatgaaaggggtgttactggccaggcgcggtggctcatgcctgtaatctcagcattttgggaggccgaggcgggcggatcacaaagtcaggagattcaaaccakcctggccaacatggtgaaaccccatctctactaaaaatacaaaaattagctgggcatggtggcatgcacctgtagtcccagctgctcgggaggctgaagcaggtgaatcgctcgaacccgggaagcagaggttgcagtgagccgagatcatgcgactgcactccagcctgggcgacagagcgagactccctctaaagaaaaaaaaaaaaaaaaaaggaagggatgttattgtttcccaaatgaggcagtgaggctcccagaggttaagtgactagcccacacgcatacaggcagcatggg

SEQ ID NO: 189348 - DNA, 601 bp, Human
ctcagacctagtttctggttaaaatcaaaagtcatattggaagtcaaggattttgctgttaccacccatttatacctcagtgtgaatgaatatttgatctttctctagttggttttttgttcagtaggggtagcgggtgggaggcaacaggatggaagtggatagaggagacaagggccacagataaagggaagagaaagcgagagagcagaacaggcccctacagctctgaaaacaagtggtcaaatggactcccttgctgaaggcctgctctagctaggaaccaccagatacacacgtwtgcagaggggcatctgcagtgctggaaatgagcatgattccccaaggaagacccctccatctccctccctgggccccccgggggtacttgggccatcctggcctaccagggttcccgcttagaggaaagcctgtgcgtttccctgacctgagctgggcgcacggtgccggaagtcgtccttggtgaggatgcagagggcgcgtccgttcatctcgaacccgtgctccgcggtgcatggcagagagtactcctgctctgcccagcgcagccagtgcagcacgtcctccctgctccacagtg

SEQ ID NO: 189349 - DNA, 601 bp, Human
tttgccaaatacactgtgggcttgcttggccaaaagacaaggaacacagaaaacatgagcgaattcttaagaaaaagacaccaaatcagcacaaacaaaagagccactgaaaacaagccacacaagactcagatgcgattctagaggttcctggaaggccctgctgcccgctaccactggccaccctccctcccaccaccagtccctccccacaaactccgtgctgctggaacaccatcatctgacattcattcctttgccctcagacctagtttctggttaaaatcaaaagtcatattgsaagtcaaggattttgctgttaccacccatttatacctcagtgtgaatgaatatttgatctttctctagttggttttttgttcagtaggggtagcgggtgggaggcaacaggatggaagtggatagaggagacaagggccacagataaagggaagagaaagcgagagagcagaacaggcccctacagctctgaaaacaagtggtcaaatggactcccttgctgaaggcctgctctagctaggaaccaccagatacacacgtatgcagaggggcatctgcagtgctggaaatgagcatgatt

SEQ ID NO: 189350 - DNA, 601 bp, Human
aaaagaacttgggatgtgacatgagactgggctgtatgtgttaggtataaacaggcaaatcagcagatttcagaacgtctctttgccaaatacactgtgggcttgcttggccaaaagacaaggaacacagaaaacatgagcgaattcttaagaaaaagacaccaaatcagcacaaacaaaagagccactgaaaacaagccacacaagactcagatgcgattctagaggttcctggaaggccctgctgcccgctaccactggccaccctccctcccaccaccagtccctccccacaaactcygtgctgctggaacaccatcatctgacattcattcctttgccctcagacctagtttctggttaaaatcaaaagtcatattggaagtcaaggattttgctgttaccacccatttatacctcagtgtgaatgaatatttgatctttctctagttggttttttgttcagtaggggtagcgggtgggaggcaacaggatggaagtggatagaggagacaagggccacagataaagggaagagaaagcgagagagcagaacaggcccctacagctctgaaaacaagtggtcaaatggactcccttg

SEQ ID NO: 189351 - DNA, 601 bp, Human
aaaaaaaaaaagaacttgggatgtgacatgagactgggctgtatgtgttaggtataaacaggcaaatcagcagatttcagaacgtctctttgccaaatacactgtgggcttgcttggccaaaagacaaggaacacagaaaacatgagcgaattcttaagaaaaagacaccaaatcagcacaaacaaaagagccactgaaaacaagccacacaagactcagatgcgattctagaggttcctggaaggccctgctgcccgctaccactggccaccctccctcccaccaccagtccctccccayaaactccgtgctgctggaacaccatcatctgacattcattcctttgccctcagacctagtttctggttaaaatcaaaagtcatattggaagtcaaggattttgctgttaccacccatttatacctcagtgtgaatgaatatttgatctttctctagttggttttttgttcagtaggggtagcgggtgggaggcaacaggatggaagtggatagaggagacaagggccacagataaagggaagagaaagcgagagagcagaacaggcccctacagctctgaaaacaagtggtcaaatggac

SEQ ID NO: 189352 - DNA, 601 bp, Human
atcccagcactttgggaagccaaggtgggcaaatcacctgaggttgggagtttgagaccagcctggccaacatggtaaaactccatctctaccaaaaatacaaaattagccgggcgtggtggcaggcgcctgtaatcccagctactcagaatgctgaggcaggggaatcgcttgaacctgggaggcagaggttgcagtgagccaggatcgcgccactacactccagcctgggcgacaaagtgagactccatctcaaaaaaaaaaaaaaaagaacttgggatgtgacatgagactgggctgyatgtgttaggtataaacaggcaaatcagcagatttcagaacgtctctttgccaaatacactgtgggcttgcttggccaaaagacaaggaacacagaaaacatgagcgaattcttaagaaaaagacaccaaatcagcacaaacaaaagagccactgaaaacaagccacacaagactcagatgcgattctagaggttcctggaaggccctgctgcccgctaccactggccaccctccctcccaccaccagtccctccccacaaactccgtgctgctggaacaccatcatctgacattcattc

SEQ ID NO: 189353 - DNA, 601 bp, Human
ctgtacctcacgttcctgggagcagagacagttctaaggctcatgggattccaagctttattgaaagtctgccctgccttctaaggagcaaagctgtcttagcctcttcctaaaaggcagaatgagtagctgcttcaataaatggttgaagaaaggaaaagccaggtgcggtggctcacacctgtaatcccaacactttaggaggctaaggcaggaggattgcttgagcccaggagtttgagaccagcctgggcaacatggatagaccctgtctctacaaaaattttaaaaatcagctggktatggtgcgcatatctgtggtcccagctacttgggaggctgaggcaggagaatcactggaacccaggaggttgaggcacaagtgagctgtgttcacgccaccaaactctagcctgggcaatagagtgagaccctgtctcaaaaaaaaaaaagccagaattgggctctgtccttggtcccagaaatctcctttgactcataccttgggctaaggtgctgatagtagggcaggaaagaggggatctgtgggtagagagccaatctggggatcccaggcagccagagggatacaatgtagaca

SEQ ID NO: 189354 - DNA, 601 bp, Human
aaggtcaggctgtttctcaaccctcgcacacacccttggctgagggcttgtgcacagtgcataaactgtgcaactgtacctcacgttcctgggagcagagacagttctaaggctcatgggattccaagctttattgaaagtctgccctgccttctaaggagcaaagctgtcttagcctcttcctaaaaggcagaatgagtagctgcttcaataaatggttgaagaaaggaaaagccaggtgcggtggctcacacctgtaatcccaacactttaggaggctaaggcaggaggattgcttgarcccaggagtttgagaccagcctgggcaacatggatagaccctgtctctacaaaaattttaaaaatcagctggttatggtgcgcatatctgtggtcccagctacttgggaggctgaggcaggagaatcactggaacccaggaggttgaggcacaagtgagctgtgttcacgccaccaaactctagcctgggcaatagagtgagaccctgtctcaaaaaaaaaaaagccagaattgggctctgtccttggtcccagaaatctcctttgactcataccttgggctaaggtgctgatagtaggg

SEQ ID NO: 189355 - DNA, 601 bp, Human
ggccacgtggggagggccagcctcatccccctgcagccacctgcctcagggcaagggctggcatgtcttgtcacagcttcatgccgatggcaaaggggttcctgctgcagctaacaggaggctgggctggcaatgggcagagatgctgctgctcccgtggtggatgaattttagaaagacatcctttcctgccggtacacgcagccgcctccacggcatgcagcttgcaaggtcaggctgtttctcaaccctcgcacacacccttggctgagggcttgtgcacagtgcataaactgtgcarctgtacctcacgttcctgggagcagagacagttctaaggctcatgggattccaagctttattgaaagtctgccctgccttctaaggagcaaagctgtcttagcctcttcctaaaaggcagaatgagtagctgcttcaataaatggttgaagaaaggaaaagccaggtgcggtggctcacacctgtaatcccaacactttaggaggctaaggcaggaggattgcttgagcccaggagtttgagaccagcctgggcaacatggatagaccctgtctctacaaaaattttaaaaatcagctgg

SEQ ID NO: 189356 - DNA, 601 bp, Human
tgatacaaacaactctttgctggagagagcagagaatggggaggtgggaggcatggagggtgcagcacagaggaagggcggccaggaacgccccagagcaggaggtgggggtggggcgggaggggagcttgcccacactggccacctctttcattgcttcgccttgaggatgtcctgccctcccagtgaggctgatttgagggaggtactccgagcaccacagagagcttcctcaccttccggggggactggagagtgctgggtgggcgtcttcagcctgaagatccctccaaaaaagggyccacacaccagggctcgccgctgggtcttgatgtactggagcagctcatacaggacgtcacctggaggtgggtgggagggagggcaggctgctgaacaggccacgtggggagggccagcctcatccccctgcagccacctgcctcagggcaagggctggcatgtcttgtcacagcttcatgccgatggcaaaggggttcctgctgcagctaacaggaggctgggctggcaatgggcagagatgctgctgctcccgtggtggatgaattttagaaagacatcctttcctgccggtacacgc

SEQ ID NO: 189357 - DNA, 601 bp, Human
tcaaaggctgcgagagaccacagtaaatcaggactgagagtggccatggaatggacatccttattttcaggtttctggagaccttgacaagtggtttccacggagggctgcagagaggaaattgagacatgatacaaacaactctttgctggagagagcagagaatggggaggtgggaggcatggagggtgcagcacagaggaagggcggccaggaacgccccagagcaggaggtgggggtggggcgggaggggagcttgcccacactggccacctctttcattgcttcgccttgaggatrtcctgccctcccagtgaggctgatttgagggaggtactccgagcaccacagagagcttcctcaccttccggggggactggagagtgctgggtgggcgtcttcagcctgaagatccctccaaaaaagggcccacacaccagggctcgccgctgggtcttgatgtactggagcagctcatacaggacgtcacctggaggtgggtgggagggagggcaggctgctgaacaggccacgtggggagggccagcctcatccccctgcagccacctgcctcagggcaagggctggcatgtcttgtca

SEQ ID NO: 189358 - DNA, 601 bp, Human
gcagatagggaaatctgggaaaggagcaggggttgccactttagagaggctgctcaggcctccctgacattagcatttgaacagacctgaaggaggtagaggagtgagctctgtgggtatctagagcagagaggggatgccaggcagagggaacagtaagtgcaaaggccctggggcaggagcgtctcagacttgtccagtgaacaagaaggcccgaaggcccgtgtgtctggagcagcaggagcacgggggagaaggctgggaggggaaggcaagggcaggagtcagcggaagaactgcrcttggactccgagtgagaagggagctgctggaagatgctgagcagacaagtgacgtgacctgacttctgaaactctctgtgctgtggagaatagatcataggaggtcaagagcagaagcaaggagaccagtgaggacgttctccagaggcaatgggggctggaatggggcagcaggagaggagtgagaagaggttggattctggacagatttgaaggtagggctgacaggatttatggacagttgggatgagtgggggtgggggtagaaatctaagatgacatctgagcaattggaaggg

SEQ ID NO: 189359 - DNA, 601 bp, Human
agcccctgccctcagggagcttatatgctagttgagagcaggggagatggacgattaaaataaaaaggaaacagaaacagtatacaatatgaggtgaaaaaaataaatcaccctaaggcagatagggaaatctgggaaaggagcaggggttgccactttagagaggctgctcaggcctccctgacattagcatttgaacagacctgaaggaggtagaggagtgagctctgtgggtatctagagcagagaggggatgccaggcagagggaacagtaagtgcaaaggccctggggcaggagcrtctcagacttgtccagtgaacaagaaggcccgaaggcccgtgtgtctggagcagcaggagcacgggggagaaggctgggaggggaaggcaagggcaggagtcagcggaagaactgcgcttggactccgagtgagaagggagctgctggaagatgctgagcagacaagtgacgtgacctgacttctgaaactctctgtgctgtggagaatagatcataggaggtcaagagcagaagcaaggagaccagtgaggacgttctccagaggcaatgggggctggaatggggcagcaggagaggag

SEQ ID NO: 189360 - DNA, 601 bp, Human
tggtgggcgcctgtaatcccagctacccaggaggctgaggcaggagaatcgcttgaacccgggaggcagaggatgcagtgagttgagatcatgccacagctctccagcctgggcaaaagagccagactcccgtctcaaaaaaagaaaagaaaagaaaagaaaaacttcctatcaagtactatgctgagtaccttggtgacaggattattcatacaccaaacctcagtggcacgcaatttacccatgtaacaaacctgcacatgcaccccctgaacctaaaataaaagttgaaaaaaaaaaagaataaatgcagtgtcactattatgactagaaaaacacccttcagcttatctgtcagtctgtctggttgtctgcctgttaatcctttaacaatgaatgcagagtggaagtgtatcatttggttagcgctcaggatctggagccagactgcctgggttcacatcacacctcaaccagtgctgtgtgatcttggagaagttacttaacctttctgtgcctcaatttccatatctgtgaaatggggctaataatagtaccaaactcaaaaggccattgtagaattaaataagggcttgggaac

SEQ ID NO: 189361 - DNA, 601 bp, Human
cgggagcaactgtgtgatctgaaatcccaggacctgggcctgtcggctgggccattgcaggcaagttacacaaccttctctgagccagcttccttgtatggggtggtgagagaattaggtaacataatagaccacaaaaccctcagcacagtgcctggtatactgtaagtgcacgaagaatgttaagcattataattgaagaattcagtaattgcaagaggctgaagtgggaggattccttgagcccaggaatttgaggcagcagtgagctatggtggcatcactgcactccagcctggcracagagtgagaccctgtctcttaaaaaaaaaaaaaaacccagtaattgtggatcattgtgtttgttattgatacataatatttatgcatgtttctggcgtccatgtgagatcttgttgcatgcatagagtgtgtaacgatcaagtcagggtacttagggcatccatcacctcaagtattcatcatttctatgtgttgggccaattgttttttagtgacttctagtcatttccaacccaaaagccaggcttctgcccactctgtggcttcatagaataaatgtggtgtggacataacaatg

SEQ ID NO: 189362 - DNA, 601 bp, Human
ccccctggacttctattaattataacatccaccccttcaagctccctaatggtgaggctcaggaaaaccaggcatgccattgggagggcaagtgggcatccgggagcaactgtgtgatctgaaatcccaggacctgggcctgtcggctgggccattgcaggcaagttacacaaccttctctgagccagcttccttgtatggggtggtgagagaattaggtaacataatagaccacaaaaccctcagcacagtgcctggtatactgtaagtgcacgaagaatgttaagcattataattgaaraattcagtaattgcaagaggctgaagtgggaggattccttgagcccaggaatttgaggcagcagtgagctatggtggcatcactgcactccagcctggcgacagagtgagaccctgtctcttaaaaaaaaaaaaaaacccagtaattgtggatcattgtgtttgttattgatacataatatttatgcatgtttctggcgtccatgtgagatcttgttgcatgcatagagtgtgtaacgatcaagtcagggtacttagggcatccatcacctcaagtattcatcatttctatgtgttgggc

SEQ ID NO: 189363 - DNA, 601 bp, Human
agtcctcccgaactttagtcatctgcatccttccagccaccagcactgctaagagcagtataatatagtgcagcacatggcctgggttcaactccctgttctgcctcttacatagcaggggatgggtaaacttggggcaagttgttagccctcactgagcctcagtctccacatccgacaacacctacttcacgagcttggtatgaggattaaatgaattagtacaagtggagccctcagggcagtgcctggcaatcaggcacattacatcttaggaaaggctataaatcgatgattatcrttatcgttaatagttttctttaaaagattttttttacttaaagaaacctatttattttaaaaggctacattccttatatcactgctgtaaatcatgagatggtcatggtagttacattttgtaatcctaattcaaaaataattatgaggatattaaaccacctaagatcatcttacagacacccatttaggtataggcattcctcatcatgggaatgctggcctcagtcatccccaggcctttccagccctgacatcagatgctcctgttgggcctgagacctgggtttctgtccagctc

SEQ ID NO: 189364 - DNA, 601 bp, Human
gtctgagagcttgtggccagctgggactagaatcctagttagcgttgtgtccacgtgaccctgataacaatagcaatatacacatattgagcacttcctatgttctaagagctctgcatacactaacttgtctagtcctcatgatatatgagtactactgcccccatgtcacagacaggaaactaaagcacagcaaggctcacagattagatggttagtcagtagcagagctggggtttcaatctcggcagcgaggctcccggtctgagcacatgaccatcagattgtcttgtctgatagmagcagctgggaaaaccaggggcccagctcagggcctggcagccaggctttgctgcaggatacctagattggagggcagacatttcaaagaatgatttcaaaatgttatgtacattttaagcccatccttctccagcaaacccctcccctatggcctccagccagggtgatcttgcccttggctctgaaccagccctgtggcaggcaaggatggatgtggctggagacccaaggtcaggggcagggagtttgctggctgaaaagctccttctctgttccctcctttttcccttccaccctc

SEQ ID NO: 189365 - DNA, 601 bp, Human
tgatacatactccctgtagaataatttgtaaatgcagataaggctggacgcagtggttcatgcctgtaatcccagcactttgggaggctgaggtggaaggatcctttgagcccaggagtttgagaccagatgtggcaacatagggagaccccatctctaaaaaagttttttaaattagccagacatgggcctggcgcagtggctcatgtctgtaatcccagcactctgggaggctgaggcgggcagatcatgaggtcaggagatcgagaccatcctggctaacaaggggaaaccccgtatstactaaaaatacaaaaaattagccaggcgtggtggcaggcgcctgtagtcccagctactcaggaggctgaggcaggagaatggcgtgaacccaggaggtggagcttgcagtgagctgagatcgcgccactgcactccagcctgggtgacagagcaagactctgtctcaaaaaaaagaaaaagaaaaatcccagctacttgagaggctgaggtgggagggttgagcctgggaggttgaggctgcagtgagctatgattgtgccactgtactccagcctgggtgacagagggagaccctaac

SEQ ID NO: 189366 - DNA, 601 bp, Human
aatacaaaaaattagccaggcgtggtggcaggcgcctgtagtcccagctactcaggaggctgaggcaggagaatggcgtgaacccaggaggtggagcttgcagtgagctgagatcgcgccactgcactccagcctgggtgacagagcaagactctgtctcaaaaaaaagaaaaagaaaaatcccagctacttgagaggctgaggtgggagggttgagcctgggaggttgaggctgcagtgagctatgattgtgccactgtactccagcctgggtgacagagggagaccctaactcaaaaamaaaaaaaaacaaaacaaaatgttgggtgggcatggtggctcacacctataatcccagcactttgggaggccatggcaggcggatcacctgagattaggagttcgagaccagcctggccaacgtggtcaaaccccatctctaccaaaaaatacaaaaattagccgggtgtggttcacgcctgtaatcccagctactcgggaggctgaggcaggaaaatcgcttgaacccaggaggtggaggttgcagtgagccaagactgtgccactgcactccagcctgagtgacagagtgagaccctgt

SEQ ID NO: 189367 - DNA, 601 bp, Human
aaaaaattagccaggcgtggtggcaggcgcctgtagtcccagctactcaggaggctgaggcaggagaatggcgtgaacccaggaggtggagcttgcagtgagctgagatcgcgccactgcactccagcctgggtgacagagcaagactctgtctcaaaaaaaagaaaaagaaaaatcccagctacttgagaggctgaggtgggagggttgagcctgggaggttgaggctgcagtgagctatgattgtgccactgtactccagcctgggtgacagagggagaccctaactcaaaaaaaaaamaaaacaaaacaaaatgttgggtgggcatggtggctcacacctataatcccagcactttgggaggccatggcaggcggatcacctgagattaggagttcgagaccagcctggccaacgtggtcaaaccccatctctaccaaaaaatacaaaaattagccgggtgtggttcacgcctgtaatcccagctactcgggaggctgaggcaggaaaatcgcttgaacccaggaggtggaggttgcagtgagccaagactgtgccactgcactccagcctgagtgacagagtgagaccctgtctcaa

SEQ ID NO: 189368 - DNA, 601 bp, Human
gcagtgagctatgattgtgccactgtactccagcctgggtgacagagggagaccctaactcaaaaaaaaaaaaaaacaaaacaaaatgttgggtgggcatggtggctcacacctataatcccagcactttgggaggccatggcaggcggatcacctgagattaggagttcgagaccagcctggccaacgtggtcaaaccccatctctaccaaaaaatacaaaaattagccgggtgtggttcacgcctgtaatcccagctactcgggaggctgaggcaggaaaatcgcttgaacccaggagktggaggttgcagtgagccaagactgtgccactgcactccagcctgagtgacagagtgagaccctgtctcaaaaaaaaaaaaaaaaaaaaaaatgtagataagcaaaatgatgaaaaattctaccactacgtggaaaatacattttggcacggcacacattaactgagtacctgtgtgtgcagggcaggcctttggtgagaagacgaggaaacagaaaagagtcactgggatgaaggctgagaagtccacatccatttgttgggtagggacccccctcagcctggcacgttggaaagctct

SEQ ID NO: 189369 - DNA, 601 bp, Human
agtgacagagtgagaccctgtctcaaaaaaaaaaaaaaaaaaaaaaatgtagataagcaaaatgatgaaaaattctaccactacgtggaaaatacattttggcacggcacacattaactgagtacctgtgtgtgcagggcaggcctttggtgagaagacgaggaaacagaaaagagtcactgggatgaaggctgagaagtccacatccatttgttgggtagggacccccctcagcctggcacgttggaaagctctccagagccctgagccctgaagaataagcctcctcctgagagcaggwggtggttaggcagggctggagcctggatgatcagttgccatggtgcccgggtgaagtgatggtggggtcgcaggaagggcagtctcagacccaccaggagagcaaggctaagccttaacctgccaccaagacctggaccagctgacccagatcctgaaagtgaccggggtgcctggcacggagtttgtgcagaagctgaacgacaaagcggtgggtggtaaatgggacctaggctggcctgggctgtgtgcttgcctgacgtgggcccagtgggctgcaggcctttgtggaagaaggctc

SEQ ID NO: 189370 - DNA, 601 bp, Human
catatcaacttaatggaatgctagatgaggttctctttctgtcctgacatggaactatttctaagactcagtgaaaaaggcagaccctaaaaaaaatagtaaggctgcactatatggaatatagaaccaatttccaaggtgcactgctaagtgtaaaaagcatcaaatactatttcattttttaaattgtttcaaatttactggctctacttcctactgaataaaaatgttagatatttaagtattttctcttgtaaattttttttttaatttgtggccaaattcaagtaaattttcaatrtatctcccaaatgactccacaaatcagtgttagagctgaattaattttactaccaaatgtatactaaatccataattatttaactgcaaataaagtgaaaattactgtccaaaccagcttcctaaggtaagtaataaaatcagtaagtatgaaatccattctggaattatgttccatagaaacaacttcaaaaacagacatataggtcaggcacggtagctcacacctgtaataccagcactatgagaggccaaggcaggtggatcactcgaggtcgagtttgagaccagcctggccaac

SEQ ID NO: 189371 - DNA, 601 bp, Human
tgggcgacagaacgagactctgtctcaaaaacaaaaaaaaaaaaaaatatatacacacacacacacacacacacacacacacacacacacacacacacgtttattaataaaaattaaaataaattatggttggctggacacagtggtatgtgcctgtaatcccagctactcgagaaactgagacaggagaatcgcttgaacccaggaggctgaggttgcagtgagctgagatctcaccactgcactccagactggatgacaagagcgaagactctgcctcaaataaataaataaataaatwaattaattaattaattaaattatggcatatcaacttaatggaatgctagatgaggttctctttctgtcctgacatggaactatttctaagactcagtgaaaaaggcagaccctaaaaaaaatagtaaggctgcactatatggaatatagaaccaatttccaaggtgcactgctaagtgtaaaaagcatcaaatactatttcattttttaaattgtttcaaatttactggctctacttcctactgaataaaaatgttagatatttaagtattttctcttgtaaattttttttttaatttgt

SEQ ID NO: 189372 - DNA, 601 bp, Human
gcggtggctcacgcctgtaagcctagcactttgggaggccgaggtgggcggatcatgaggtcaggagatggagaccattctggctaacacggtgaaatcccgtctctactaaaaatacaaaaaattagtggggcgtggtggcacacacctgtagtcccagctactctggaggctgaggcaggagaatcacttgaacccaggaggcggaggttgcagagagccgagattgcaccactgaactccagcctgggcgacagaacgagactctgtctcaaaaacaaaaaaaaaaaaaaatatatayacacacacacacacacacacacacacacacacacacacacacacgtttattaataaaaattaaaataaattatggttggctggacacagtggtatgtgcctgtaatcccagctactcgagaaactgagacaggagaatcgcttgaacccaggaggctgaggttgcagtgagctgagatctcaccactgcactccagactggatgacaagagcgaagactctgcctcaaataaataaataaataaattaattaattaattaattaaattatggcatatcaacttaatggaatgctagatga

SEQ ID NO: 189373 - DNA, 601 bp, Human
aaaaaaaaaaaaaagaaaaatcttgctggacaaaattttgacaaaatgaactaaaaatattttaaatgtatataccattcgaagtatttatcctaaggaaataatcactgatgtaagcaatgatttgtccaaaagattattcactatagctgtgaattaattgtgaaaaactggaaacagcccatagtggaatatttaatacacgaaaaatactcatgataatgttaactagggaaaagtatgcccagtgattccatttttgtctttaaaggtatatacaggccaggtgcggtggctcacrcctgtaagcctagcactttgggaggccgaggtgggcggatcatgaggtcaggagatggagaccattctggctaacacggtgaaatcccgtctctactaaaaatacaaaaaattagtggggcgtggtggcacacacctgtagtcccagctactctggaggctgaggcaggagaatcacttgaacccaggaggcggaggttgcagagagccgagattgcaccactgaactccagcctgggcgacagaacgagactctgtctcaaaaacaaaaaaaaaaaaaaatatatacacacacacacac

SEQ ID NO: 189374 - DNA, 601 bp, Human
ggagaatggcatgaacccgggagggggagcttgcagtgagccgagatcacgccactgcactccagcctggacgacagagcaagacaccgtctcaaaaaaaaaaaaaaaaaagaaaaatcttgctggacaaaattttgacaaaatgaactaaaaatattttaaatgtatataccattcgaagtatttatcctaaggaaataatcactgatgtaagcaatgatttgtccaaaagattattcactatagctgtgaattaattgtgaaaaactggaaacagcccatagtggaatatttaatacaygaaaaatactcatgataatgttaactagggaaaagtatgcccagtgattccatttttgtctttaaaggtatatacaggccaggtgcggtggctcacgcctgtaagcctagcactttgggaggccgaggtgggcggatcatgaggtcaggagatggagaccattctggctaacacggtgaaatcccgtctctactaaaaatacaaaaaattagtggggcgtggtggcacacacctgtagtcccagctactctggaggctgaggcaggagaatcacttgaacccaggaggcggaggttgcag

SEQ ID NO: 189375 - DNA, 601 bp, Human
gaggccaggcacagtggctcacgcctgtaattccaacactttgggaggccagggtaggtgatcacctgaagtcaggagtttgagatcagcctggacaacatggtgaaaccccgtctctactaaaaatataaaaattagccaggtgtggtggcacgcacctgtaatcccagctactcgggagcctgaggcaggagaattgcttgaacccaggaggcggaagttgcagtgagccaagatcatgccactgtactccagtctgggtgacagagcgagattccatctcaaaaaaagaaaaaaaaawaaaagagagagaaaaaagaaaaagcagaggaaaagacaaatttgccacggttttaaaaatcaatttatgtaaaaagcacactataagtgacatctgaaggacctataacaagctgagaaataaaagtctgccgcacaacaaaggatactttctctttttttttttttttttttttttgagatggagttttgctcttgtcgcccaggctggagtgcaatggcacgatctcggctcactgcaacctccacctcccaggttcaagcaattctcctgcctcagcctcccaagtagctgggatta

SEQ ID NO: 189376 - DNA, 601 bp, Human
ctgacaagagaagttctagaaattcaattttgcaagtaaatttatatttaagggaatcacacacaattaaaaatgcaaattttaaaaaagatataacagttgaccttgaggtaggagaatcacttgaattcacttgaatcactccaactcgggaggtggaggttgcagtgagccgagatcgcgccactacactcccacctgggcaacagaacaagaccccgtctcaaaaaaaagtaaaaagcaaaggaggccaggcacagtggctcacgcctgtaattccaacactttgggaggccagggyaggtgatcacctgaagtcaggagtttgagatcagcctggacaacatggtgaaaccccgtctctactaaaaatataaaaattagccaggtgtggtggcacgcacctgtaatcccagctactcgggagcctgaggcaggagaattgcttgaacccaggaggcggaagttgcagtgagccaagatcatgccactgtactccagtctgggtgacagagcgagattccatctcaaaaaaagaaaaaaaaataaaagagagagaaaaaagaaaaagcagaggaaaagacaaatttgccacggtttt

SEQ ID NO: 189377 - DNA, 601 bp, Human
aatcccaactactcaggaggctaaggcaggaggactgcttgaggccaagaattcaaggccagcttgagggcaacataatgagattccatcccttaaaaaaaataaaaaaataaaaaataaaaaatgagctgggcatggtggcatgtgcctgtaatcctagctacttgggagactgatgcaggaggaacgcatgcacccaggagttcgatgctgcagtgagctatgatagcaccactgcactccagcctgggcaacagtaccagaccccatctcccttaaacaaaaattattattgaggcargaccttataccagcaaaaagattatgactcactgagggctcagatgatccttaacattttttagcaataacgtatttttaaattaaggtctgtacatttttaaaagacatgacgctactgcaaagttaacagactacagtacagtgcaaacataacttttatatgcattgggaaacaaaaactttgtgtgactcgctttgaggtggtctggaactgaacgtgaacccatagtatctccaaagtatgcctgtaatactttagccaatttaaaaatatccccaaactagtaacagtgataga

SEQ ID NO: 189378 - DNA, 601 bp, Human
tagctgggtgcagtggttcacacccctaatcccaactactcaggaggctaaggcaggaggactgcttgaggccaagaattcaaggccagcttgagggcaacataatgagattccatcccttaaaaaaaataaaaaaataaaaaataaaaaatgagctgggcatggtggcatgtgcctgtaatcctagctacttgggagactgatgcaggaggaacgcatgcacccaggagttcgatgctgcagtgagctatgatagcaccactgcactccagcctgggcaacagtaccagaccccatctcycttaaacaaaaattattattgaggcaagaccttataccagcaaaaagattatgactcactgagggctcagatgatccttaacattttttagcaataacgtatttttaaattaaggtctgtacatttttaaaagacatgacgctactgcaaagttaacagactacagtacagtgcaaacataacttttatatgcattgggaaacaaaaactttgtgtgactcgctttgaggtggtctggaactgaacgtgaacccatagtatctccaaagtatgcctgtaatactttagccaatttaaaaa

SEQ ID NO: 189379 - DNA, 601 bp, Human
tttcttgagatggaatctactattggtaaagatgctgtgaacattgttgaaatgacaacaagggacttagaatataacataatcttaatttataaaacagtagcacagtttgaaaggactgactccaattttgaaataagttcctctgtgggttaaatactatcaaacatcatcgcatactacagaaaaatctttgggtaagggagggtcaataaatgcagcaaacttcattgtttaagaaattgccacagctactccaaccttgagcagccgccagatgagtcagcagccatcaatactraggcaagaccatagctgggtgcagtggttcacacccctaatcccaactactcaggaggctaaggcaggaggactgcttgaggccaagaattcaaggccagcttgagggcaacataatgagattccatcccttaaaaaaaataaaaaaataaaaaataaaaaatgagctgggcatggtggcatgtgcctgtaatcctagctacttgggagactgatgcaggaggaacgcatgcacccaggagttcgatgctgcagtgagctatgatagcaccactgcactccagcctgggcaacagtacca

SEQ ID NO: 189380 - DNA, 601 bp, Human
gtctcaaaataactgattagtttattaattaatttttttaaaaaataagtttctttcttttttgtttttaagagctaaggtctcactatgttgcccaggctggccttgaactcctgggcccaagcaatcctcccatctcggcctccgaagtagctaggaccacaggtgcatgccaccacacccagcagaaagcggtttcttgagatggaatctactattggtaaagatgctgtgaacattgttgaaatgacaacaagggacttagaatataacataatcttaatttataaaacagtagcasagtttgaaaggactgactccaattttgaaataagttcctctgtgggttaaatactatcaaacatcatcgcatactacagaaaaatctttgggtaagggagggtcaataaatgcagcaaacttcattgtttaagaaattgccacagctactccaaccttgagcagccgccagatgagtcagcagccatcaatactgaggcaagaccatagctgggtgcagtggttcacacccctaatcccaactactcaggaggctaaggcaggaggactgcttgaggccaagaattcaaggccagcttga

SEQ ID NO: 189381 - DNA, 601 bp, Human
caacaagagtgaaactctgtcacaaaaaaaagaaaaaaagtaaaataaaaaaataaaaaataaataaagtcgtgggctgggcactgtggctcacacctgtaattctagtaatttgggaggccaaggtggtgagaggatcccttgaggccaggagttcaagaccagcctggttagtacagcaagactccatctctacaaaagaaaagaaaaaaaaaattaaaaattaagggggcctggtggtgtagtcctagctactccagaggctgaggcagagggaatgcttgagcccaggagtttgagrttgcagtgacctatgatcacaccactgtactccagcctaggtgactgagaccttatctcaaataaagaacaaaaaacagacaaacaaaagttgtgaacactaaacaatctggagaatcacataaaaacaaagttctagcttctgttgaaaaagctgaagacgtggtaatagtggacccatcttctcacagggtaacaggagctaagaaaccttttcttctttagatataaaggaggaggcacacttcacacactctaataagcacagaaccattccctgttgtcttactcatagtatgct

SEQ ID NO: 189382 - DNA, 601 bp, Human
tacagcaaaggtctctggagtcaggagacttgagtttgatcctggctccacagtttaccagagctccaaaactctgaacaaactgttagtgtaagaagctctctgcgcctctcgccttatgtgtaaaatgaaggcagaaatgatgcctacctcatagggcatttgcgaggatatgttattcctgtggttaatacagtgcctgaacataaattttagcattgtaggtagaaaataaaagaaaagaaacaagcaagtatgtgttcatgtattcaacttagttttactgagtgtctgtagatawcccaggtacttttttctaggcactgggaatgcagctgtgagcaagtatagggtccctgccttcactgtgtttacattctagcatgaagtgacaaaaaatagccctaatttatctgaacctatccggttcttgagttttagctggtgaacagcagaagttgggacagcaaagtcctatctcagtctctccaggagatacatgctctacaatgtcaggctatgaagagagctatagagaaaaattaagtagggcaaggggacacagtgtgctcatgctattttaaatagtgttgtgacattt

SEQ ID NO: 189383 - DNA, 601 bp, Human
gctcatgcctgtaatcccagagctttgggaagccgaggcgggtgtatcacttgaggtcaggagttcgagaccagcctggccaacttggcaaaaccccatctctactaaaatacaaaaattagctgggcatggtagcgggcacctgtaaccccagcaactcgggaggctgaggtaggagaatcgcttgaacctgggaggcagaggttgcagtgagctgggatcgcaccactacattccagtctgggcgacagagcaagactccatcgcaaaaaaaaaataataataataaaaaaataaaaawaaataaaaagattcctttggtaaggtttgtaaaatgtaggggaaccagaaagcagagatgttggggaccactgcagagataatagttacagcaaaggtctctggagtcaggagacttgagtttgatcctggctccacagtttaccagagctccaaaactctgaacaaactgttagtgtaagaagctctctgcgcctctcgccttatgtgtaaaatgaaggcagaaatgatgcctacctcatagggcatttgcgaggatatgttattcctgtggttaatacagtgcctgaacataaatttt

SEQ ID NO: 189384 - DNA, 601 bp, Human
ttcctttggggccgggcacggtggctcatgcctgtaatcccagagctttgggaagccgaggcgggtgtatcacttgaggtcaggagttcgagaccagcctggccaacttggcaaaaccccatctctactaaaatacaaaaattagctgggcatggtagcgggcacctgtaaccccagcaactcgggaggctgaggtaggagaatcgcttgaacctgggaggcagaggttgcagtgagctgggatcgcaccactacattccagtctgggcgacagagcaagactccatcgcaaaaaaaaaawaataataataaaaaaataaaaaaaaataaaaagattcctttggtaaggtttgtaaaatgtaggggaaccagaaagcagagatgttggggaccactgcagagataatagttacagcaaaggtctctggagtcaggagacttgagtttgatcctggctccacagtttaccagagctccaaaactctgaacaaactgttagtgtaagaagctctctgcgcctctcgccttatgtgtaaaatgaaggcagaaatgatgcctacctcatagggcatttgcgaggatatgttattcctgtggttaa

SEQ ID NO: 189385 - DNA, 601 bp, Human
caaattagacacctaaatgtccaacaagaggtgggttgaatagatttattagctgcatagatcacctgtatgtttatttaaatttgattaccaatttgttcatgtaaggtaaaacctgtaattgctaaaaggatcatctatgcaggccaattgatcaatacattgcattatgaatgtttactatatttgaaaatgtatccatgcaatgaacttttaaagtatttataacagcacaattctcaattccaaagatatggaaccaacctaagtacccattgatcaacaaacagataaagaaaaatgtcgcatctatacaccatggaataccactctgccatgaaaaggaatgaaatgtcttttgcagcaacttggatggagctggaggccattattctaagcgaagtaaatcaggaatggagaaaagcaaatactgtatgttctcacttataagtgggagctaagcaatcaggacttatagatatacagagtgatataatggactctggtgacttaaggttggggagaagattggggggttagggataaaagactagatattgcgtaaagtgtacactgctcaggtgacaggtgcactaaaatc

SEQ ID NO: 189386 - DNA, 601 bp, Human
tgcatctattcatctctatcctttgtaatatcctttatttagaaaaaccagtaaacatgttgccctgagttctgtgagctcctctagcaaattaattcaacccaaggaggtgtcatgggaaacacaatttatagccagttgatcagaagcacaggtaaaacaacctgggcttgcaactggcactggaaacgggggagaggcagtcttgaggagtgaaccctcaatccgtggggtctccaagaagacactgtcagaactgaattgaatcagaggacatctagctggtatctgctgcagaacygattgggtggtgtatggcaggggaaaaagtctcatacatttggtcacaggagtctgtgttcattgttgtggtgtgagagcagacaacaaaacagtttgaagttttcctactcaaggtatattaaagttataaagtaatcaaaatagataataacaagtgttggtgaagaagtgaaaaaaactggaacccttacacatcgctggtgggaatgtaaaatggcacaaccactttggaaagtttgttaattcctcaaaatgctaaacattagaattaccatatgacctagcaattccacttcta

SEQ ID NO: 189387 - DNA, 601 bp, Human
catttctacacagttgaccatgctttgttcatgcctatccaatgaagtcttcatgaaaggcccaagagggtgaagtatggagagcttccagacagctgaataagtagagattcctggagggtggtacacccagagagggcatggaagctctgcattccttcccataccttaggccctatgcatctattcatctctatcctttgtaatatcctttatttagaaaaaccagtaaacatgttgccctgagttctgtgagctcctctagcaaattaattcaacccaaggaggtgtcatgggaaayacaatttatagccagttgatcagaagcacaggtaaaacaacctgggcttgcaactggcactggaaacgggggagaggcagtcttgaggagtgaaccctcaatccgtggggtctccaagaagacactgtcagaactgaattgaatcagaggacatctagctggtatctgctgcagaactgattgggtggtgtatggcaggggaaaaagtctcatacatttggtcacaggagtctgtgttcattgttgtggtgtgagagcagacaacaaaacagtttgaagttttcctactcaaggtatatt

SEQ ID NO: 189388 - DNA, 601 bp, Human
cactgcacagcagacagactggtatttatcttgcagggggcaaaaaaggaggcctattctctaaagaaaataaaataaactggaaagaacaaatgctgttagtgtggatgatgctaccccagagtaaacttttccagattctggcattcagtgggaccaaacatcacacaggtagcctcctatttactctaaagaaaaagctggccaggcacggtggctaatgcctatagtcccaggactttgggaggccgaggccaggagttcaagaccagcctggccaacatggtgaaaccccgtctcyactaaaaatacaaaaattagccaggcacagtggcatgcgcctgtaatcgcagctactcgggaggctgaggtgtgagaattgcttgaatccgggagacagaggttgcaatgagccgagatcatgccactgtgctccagcctgggcgacagagcgagactctgtctcaaataaaagaaaaaaaaagaaaagaaagaaaaagccttgctagggacgtagggctatcaatcaggtctctaatgcctcatccataaaaataaaaggtgactaaggatcatcgaacatttgaggaaagcccacggc

SEQ ID NO: 189389 - DNA, 601 bp, Human
ccagctactcggggaactgaggtgggaggaatgcttgaagctgcaaggttgcggctgcagtgagtcatgactgtgccactgcactccagcatgggcgacagagcaagaccttgtctcaaaaaaaaaaggggtgggggatgattaactgaaggcttgtataatggagttgacaccatacactgcacagcagacagactggtatttatcttgcagggggcaaaaaaggaggcctattctctaaagaaaataaaataaactggaaagaacaaatgctgttagtgtggatgatgctaccccagastaaacttttccagattctggcattcagtgggaccaaacatcacacaggtagcctcctatttactctaaagaaaaagctggccaggcacggtggctaatgcctatagtcccaggactttgggaggccgaggccaggagttcaagaccagcctggccaacatggtgaaaccccgtctctactaaaaatacaaaaattagccaggcacagtggcatgcgcctgtaatcgcagctactcgggaggctgaggtgtgagaattgcttgaatccgggagacagaggttgcaatgagccgagatcatg

SEQ ID NO: 189390 - DNA, 601 bp, Human
tgtgaggccaaggcgggcagatcccttgagcctaaaagttcaagaccagcctgggaaacatggtgaaacctcatcattaagaaaaacgcaaaaattaactgggcttggtggtgcgtgcctgtagtcccagctactcggggaactgaggtgggaggaatgcttgaagctgcaaggttgcggctgcagtgagtcatgactgtgccactgcactccagcatgggcgacagagcaagaccttgtctcaaaaaaaaaaggggtgggggatgattaactgaaggcttgtataatggagttgacaccrtacactgcacagcagacagactggtatttatcttgcagggggcaaaaaaggaggcctattctctaaagaaaataaaataaactggaaagaacaaatgctgttagtgtggatgatgctaccccagagtaaacttttccagattctggcattcagtgggaccaaacatcacacaggtagcctcctatttactctaaagaaaaagctggccaggcacggtggctaatgcctatagtcccaggactttgggaggccgaggccaggagttcaagaccagcctggccaacatggtgaaaccccgtc

SEQ ID NO: 189391 - DNA, 601 bp, Human
atgaaatggggccggttgcggtggctcacacctgtaatcccagcattttgtgaggccaaggcgggcagatcccttgagcctaaaagttcaagaccagcctgggaaacatggtgaaacctcatcattaagaaaaacgcaaaaattaactgggcttggtggtgcgtgcctgtagtcccagctactcggggaactgaggtgggaggaatgcttgaagctgcaaggttgcggctgcagtgagtcatgactgtgccactgcactccagcatgggcgacagagcaagaccttgtctcaaaaaaaaaaggggtgggggatgattaactgaaggcttgtataatggagttgacaccatacactgcacagcagacagactggtatttatcttgcagggggcaaaaaaggaggcctattctctaaagaaaataaaataaactggaaagaacaaatgctgttagtgtggatgatgctaccccagagtaaacttttccagattctggcattcagtgggaccaaacatcacacaggtagcctcctatttactctaaagaaaaagctggccaggcacggtggctaatgcctatagtcccaggactttgggaggcc

SEQ ID NO: 189392 - DNA, 601 bp, Human
aaaacattttaatagaaaaaccagttacatgctatgactgagctatttaagacataagaaataccttgatgcaactaatgatttagatttttggtggccattccaaccttcctcaattcttgattttctttttaatcccccagggtacacaaaattagctataaaactgcatgattcaatgttcattgtaactgaaaacatgtctttgggaaatttatttagtaatacactggcccactttcctaagtggaaataaggagtctgaatgaagaacaacattctccaatttgagattaagatrgaattctgaaacagattctctgattcaaacttaatgaaagtaaatgaaatggggccggttgcggtggctcacacctgtaatcccagcattttgtgaggccaaggcgggcagatcccttgagcctaaaagttcaagaccagcctgggaaacatggtgaaacctcatcattaagaaaaacgcaaaaattaactgggcttggtggtgcgtgcctgtagtcccagctactcggggaactgaggtgggaggaatgcttgaagctgcaaggttgcggctgcagtgagtcatgactgtgccactgca

SEQ ID NO: 189393 - DNA, 601 bp, Human
tgcctgtaatcccagcactttgggaagctgaggcaggtagatcatttgaggccaggggtttgagaccagcctggccaacataaagaaaccccatctctattaaaaatataaaaattagctgggtgtggtggcaggcacctgtaatcccagctacttgggaggctgaggcacaataatcacttgaactcaggaggcaaaggttacagtgagccgaaatcgcgtcgttgcactccaccctgggcaacagggcaagattctgtctaaaaacaacaacaacaacaacaacaacaacaacaacaaagacaacaacacaaaacaaaacaaaacaaaaaggcagggtacacagcattcctttcaatagctaaaggaaaatacatcttaattttaatttttcagtatttatttaccttttcatcaacctgtttcatcagattattttttcaaaagattcaattaacagaaaaacattttaatagaaaaaccagttacatgctatgactgagctatttaagacataagaaataccttgatgcaactaatgatttagatttttggtggccattccaaccttcctcaattcttgattttctttttaatcccc

SEQ ID NO: 189394 - DNA, 601 bp, Human
atggtggctcacatctgtaatcccagcactttgggaggccgaggtgggtggatcacctgaggtcaggagttcgaaaccagtctggccaatatggtgaaaccccatctctactaaggaaacaaaaaatttgcccagcgtggtggtgggcaccccacgctgtaatcccagctacttgagaggctgaggcaggagaattgcttgaacccgggaagtggaggctacggtgagacaagattgtgccattacactccagcctgggcaacaagagcgaaactctgtctcaaaaaaaaaaaaaaaaaaatcttaacatgcttcccttagaagtatcactgcttactttggcacattctgctcagctggacatttatttccaatttttcactactaaaaatatagttgttgaatacttttggataatctttattctgtaattagaattatttccctaaaattaaactactaagtaggggttaaaacattcctatttataaaaataacatgttaaatgtggaaaatttggaaaacacttgtttcaaggcatacctaatcagaacaactattaacattttggaatatttccttctagtcagtggccatgaat

SEQ ID NO: 189395 - DNA, 601 bp, Human
ttgcatctggctttttctattacaaacttttttcatttctatgaaatctcttaaatcttaacatggaggccaggcatggatggtggctcacatctgtaatcccagcactttgggaggccgaggtgggtggatcacctgaggtcaggagttcgaaaccagtctggccaatatggtgaaaccccatctctactaaggaaacaaaaaatttgcccagcgtggtggtgggcaccccacgctgtaatcccagctacttgagaggctgaggcaggagaattgcttgaacccgggaagtggaggctayggtgagacaagattgtgccattacactccagcctgggcaacaagagcgaaactctgtctcaaaaaaaaaaaaaaaaaaatcttaacatgcttcccttagaagtatcactgcttactttggcacattctgctcagctggacatttatttccaatttttcactactaaaaatatagttgttgaatacttttggataatctttattctgtaattagaattatttccctaaaattaaactactaagtaggggttaaaacattcctatttataaaaataacatgttaaatgtggaaaatttggaa

SEQ ID NO: 189396 - DNA, 601 bp, Human
cataaacaaatttgcatctggctttttctattacaaacttttttcatttctatgaaatctcttaaatcttaacatggaggccaggcatggatggtggctcacatctgtaatcccagcactttgggaggccgaggtgggtggatcacctgaggtcaggagttcgaaaccagtctggccaatatggtgaaaccccatctctactaaggaaacaaaaaatttgcccagcgtggtggtgggcaccccacgctgtaatcccagctacttgagaggctgaggcaggagaattgcttgaacccgggargtggaggctacggtgagacaagattgtgccattacactccagcctgggcaacaagagcgaaactctgtctcaaaaaaaaaaaaaaaaaaatcttaacatgcttcccttagaagtatcactgcttactttggcacattctgctcagctggacatttatttccaatttttcactactaaaaatatagttgttgaatacttttggataatctttattctgtaattagaattatttccctaaaattaaactactaagtaggggttaaaacattcctatttataaaaataacatgttaaatgtgg

SEQ ID NO: 189397 - DNA, 601 bp, Human
caatatccaaacataatcactgataaactactgactcttcttccattatgttgctgtatcttcataaaaatatttatctgtaatcacatactacataaacaaatttgcatctggctttttctattacaaacttttttcatttctatgaaatctcttaaatcttaacatggaggccaggcatggatggtggctcacatctgtaatcccagcactttgggaggccgaggtgggtggatcacctgaggtcaggagttcgaaaccagtctggccaatatggtgaaaccccatctctactaaggawacaaaaaatttgcccagcgtggtggtgggcaccccacgctgtaatcccagctacttgagaggctgaggcaggagaattgcttgaacccgggaagtggaggctacggtgagacaagattgtgccattacactccagcctgggcaacaagagcgaaactctgtctcaaaaaaaaaaaaaaaaaaatcttaacatgcttcccttagaagtatcactgcttactttggcacattctgctcagctggacatttatttccaatttttcactactaaaaatatagttgttgaatacttttggataat

SEQ ID NO: 189398 - DNA, 601 bp, Human
tctcaatatccaaacataatcactgataaactactgactcttcttccattatgttgctgtatcttcataaaaatatttatctgtaatcacatactacataaacaaatttgcatctggctttttctattacaaacttttttcatttctatgaaatctcttaaatcttaacatggaggccaggcatggatggtggctcacatctgtaatcccagcactttgggaggccgaggtgggtggatcacctgaggtcaggagttcgaaaccagtctggccaatatggtgaaaccccatctctactaargaaacaaaaaatttgcccagcgtggtggtgggcaccccacgctgtaatcccagctacttgagaggctgaggcaggagaattgcttgaacccgggaagtggaggctacggtgagacaagattgtgccattacactccagcctgggcaacaagagcgaaactctgtctcaaaaaaaaaaaaaaaaaaatcttaacatgcttcccttagaagtatcactgcttactttggcacattctgctcagctggacatttatttccaatttttcactactaaaaatatagttgttgaatacttttggat

SEQ ID NO: 189399 - DNA, 601 bp, Human
agataatatgaacagagtattaccaagtggcagcctaggaaaatattagctgtagttttacctcatgttagaaaaatactttttaaaaacttcagtacataataaataaaatctgaaaaatattaaaaagtacaaaggagaaaaattacttgaatctcaatatccaaacataatcactgataaactactgactcttcttccattatgttgctgtatcttcataaaaatatttatctgtaatcacatactacataaacaaatttgcatctggctttttctattacaaacttttttcatttcyatgaaatctcttaaatcttaacatggaggccaggcatggatggtggctcacatctgtaatcccagcactttgggaggccgaggtgggtggatcacctgaggtcaggagttcgaaaccagtctggccaatatggtgaaaccccatctctactaaggaaacaaaaaatttgcccagcgtggtggtgggcaccccacgctgtaatcccagctacttgagaggctgaggcaggagaattgcttgaacccgggaagtggaggctacggtgagacaagattgtgccattacactccagcctgggca

SEQ ID NO: 189400 - DNA, 601 bp, Human
tcgcttgaatccaggagtcagaggctgcagtgagctgagatcgtgccacagcactccagcctgggcagctctgtctcaaaaaaacaaaacaaaaaaacccccaaaaaaccagaaaacagaagaaggcctgaaaaggctgccaacagtggcaagaatcaaggtattttcatatttatctttgtcagctgagaataagaaggaccacattcttctagatggtatgatacattccattttgtgttcctacccaaagactctagaaagtctcatcaagaaacagaaaagattaacaggcaacctratgacaccatttaagtgtctgtcattccagtttaacttaacagccatcactatgagaaaaaaagtggtaagaaggtattttgtaaaaatctatatgccaaaatgttatcactggttatatgtggctgatagcattgcagaagtcttttactttcttttctgtttaacacagctctgaaattttctaaggtaaatatgtattataatttttaaagaggaaaaaggtaaaaacatttaatataaaattaggctttgataaattaagtcagactaagaacaaatactatttcctatgttttag

SEQ ID NO: 189401 - DNA, 601 bp, Human
tcaggagatcgagaccatcctggctaacacggtgaaaccctgtgtctactaaaaaaaaaaaaaaatacaaaaaattagccgggtatggtggcgggcgcctgtagtcccagctactcgggaggctgaggcaggagaatggcatgaacccgggaggcagagcttgcagtgagccgagatcgcgccaactgcactccagcctgggcgacagagcgagactccgcctcaaaaacaaaaaaacaaaaaatcccaaaaattagccaggcgtggtggtgggtgcctgaggcacaagaatcgcttgaayccaggagtcagaggctgcagtgagctgagatcgtgccacagcactccagcctgggcagctctgtctcaaaaaaacaaaacaaaaaaacccccaaaaaaccagaaaacagaagaaggcctgaaaaggctgccaacagtggcaagaatcaaggtattttcatatttatctttgtcagctgagaataagaaggaccacattcttctagatggtatgatacattccattttgtgttcctacccaaagactctagaaagtctcatcaagaaacagaaaagattaacaggcaacctaatgacacca

SEQ ID NO: 189402 - DNA, 601 bp, Human
cacaaggtcaggagatcgagaccatcctggctaacacggtgaaaccctgtgtctactaaaaaaaaaaaaaaatacaaaaaattagccgggtatggtggcgggcgcctgtagtcccagctactcgggaggctgaggcaggagaatggcatgaacccgggaggcagagcttgcagtgagccgagatcgcgccaactgcactccagcctgggcgacagagcgagactccgcctcaaaaacaaaaaaacaaaaaatcccaaaaattagccaggcgtggtggtgggtgcctgaggcacaagaatcrcttgaatccaggagtcagaggctgcagtgagctgagatcgtgccacagcactccagcctgggcagctctgtctcaaaaaaacaaaacaaaaaaacccccaaaaaaccagaaaacagaagaaggcctgaaaaggctgccaacagtggcaagaatcaaggtattttcatatttatctttgtcagctgagaataagaaggaccacattcttctagatggtatgatacattccattttgtgttcctacccaaagactctagaaagtctcatcaagaaacagaaaagattaacaggcaacctaat

SEQ ID NO: 189403 - DNA, 601 bp, Human
gttgatttacttttgggtaggtacaaggctccttatcttgtcacaaacggacattctgaaaagtactgtcttaagccagatgcagtggcttgtgcctgtaaccccagctactctggaggctaaggcagatcacttgaggccaggagttgaaaataaaaaagaaaactactgccatagaaatctcctggtgcaacattctcactttatgaataaaaaatctgagactcagaaagaaaaaaatggtaacatggaggacataccggggtaaaggcgacctaaacccaggttttctaattctgartttaagttccttctaccacactggcatattcctaatttaaaacagaactaaaaatacatttttgatagaatttatctcagtttccaggtataaatggaatcagtaaatacagtatttttatattatgtattctataacatatttgaaaaacaacaaaaaagatgctatacatttatttacacaactttccttttaaccatagtaggaaaaaaaaacattatgacagtagctacctggcctgtaaaacatgctcagtgaatatttttattcatttgaaaggtttttttttggttcatgcgt

SEQ ID NO: 189404 - DNA, 601 bp, Human
agctcaccgcacgtcactttgatacctgtgaagaaaatcagctatggttcctttcaattctacagttctaaaacatccagataaaaacataaaacaagtcagtttttcattataatagaatgtgaacaattacacccttttagactctaaacataaactacattcacagcctcttcaaagttgaggcttagtataataaatacaatcataccttaaattgttcatccagtttctttcttcctttctttttctttctctctttttctctttcttttagacagtatcttttttttttttttttagacagagtctggctctgtcccccacgctggagtgcagtgggctcaatctcggctcactgcaacctctgcctccccagttcaagtgattctccagcctcagcctctccagtagctgggattacaggagcctgccaccatgcccagctaatttttgtattttggtagaaacagagtttcaccatgttcgccaggtgggtcttgaactcctgacctcaggtgatccacctgcctcggcctcccaaagtgctgggattacaggcttgagccaccgtgcccggcctactcagtatttttcataa

SEQ ID NO: 189405 - DNA, 601 bp, Human
attttatgttatgtgtattttaccacaataaagaaaaaattagaccaaagaggaagaagaacaagaacaataagaacaaccagtagtagcagtagtagtagtagcagtagtagtagtagcaatagtagtagtagtactagtagtagtagtagtagtagtagtagtagtagtagtagtagtagcagcagcagcagaagaagaagaagacaaaaagaaaataaagcacaagacatttggtgagattgaaacactgactagagaaacttgtgactaagaaactggtcacaatttttttttttttggtataataattgcattcaggttatctttttatttaacaaatctttttgtcagagaatgcatcttgttgtgccacccacactggagtacagtggcactatcatagctcactgcagcctcaaactcccaggctcgagtgaccctgctgcttcagcctcccaagtagctgggactacaggcatgagctaccatgcctggctagtatttttttatttttgtagagacagggtcttgctatgttacccaggctggtcttgaacacctcagctttgcaaggtgctgggattataggcatgagcca

SEQ ID NO: 189406 - DNA, 601 bp, Human
ccatttaacaggtatagagcttcagttttacaagatgaaaagttatgaagatggatgatggtaatgactgcacaattttatgttatgtgtattttaccacaataaagaaaaaattagaccaaagaggaagaagaacaagaacaataagaacaaccagtagtagcagtagtagtagtagcagtagtagtagtagcaatagtagtagtagtactagtagtagtagtagtagtagtagtagtagtagtagtagtagtagcagcagcagcagaagaagaagaagacaaaaagaaaataaagcacragacatttggtgagattgaaacactgactagagaaacttgtgactaagaaactggtcacaatttttttttttttggtataataattgcattcaggttatctttttatttaacaaatctttttgtcagagaatgcatcttgttgtgccacccacactggagtacagtggcactatcatagctcactgcagcctcaaactcccaggctcgagtgaccctgctgcttcagcctcccaagtagctgggactacaggcatgagctaccatgcctggctagtatttttttatttttgtagagacag

SEQ ID NO: 189407 - DNA, 601 bp, Human
aggacttaacacaataaaccaatgagatctaatagccatttaacaggtatagagcttcagttttacaagatgaaaagttatgaagatggatgatggtaatgactgcacaattttatgttatgtgtattttaccacaataaagaaaaaattagaccaaagaggaagaagaacaagaacaataagaacaaccagtagtagcagtagtagtagtagcagtagtagtagtagcaatagtagtagtagtactagtagtagtagtagtagtagtagtagtagtagtagtagtagtagcagcagcagmagaagaagaagaagacaaaaagaaaataaagcacaagacatttggtgagattgaaacactgactagagaaacttgtgactaagaaactggtcacaatttttttttttttggtataataattgcattcaggttatctttttatttaacaaatctttttgtcagagaatgcatcttgttgtgccacccacactggagtacagtggcactatcatagctcactgcagcctcaaactcccaggctcgagtgaccctgctgcttcagcctcccaagtagctgggactacaggcatgagctaccat

SEQ ID NO: 189408 - DNA, 601 bp, Human
taagcaaggcaatagaggacttaacacaataaaccaatgagatctaatagccatttaacaggtatagagcttcagttttacaagatgaaaagttatgaagatggatgatggtaatgactgcacaattttatgttatgtgtattttaccacaataaagaaaaaattagaccaaagaggaagaagaacaagaacaataagaacaaccagtagtagcagtagtagtagtagcagtagtagtagtagcaatagtagtagtagtactagtagtagtagtagtagtagtagtagtagtagtagtagyagtagcagcagcagcagaagaagaagaagacaaaaagaaaataaagcacaagacatttggtgagattgaaacactgactagagaaacttgtgactaagaaactggtcacaatttttttttttttggtataataattgcattcaggttatctttttatttaacaaatctttttgtcagagaatgcatcttgttgtgccacccacactggagtacagtggcactatcatagctcactgcagcctcaaactcccaggctcgagtgaccctgctgcttcagcctcccaagtagctgggactaca

SEQ ID NO: 189409 - DNA, 601 bp, Human
atttacatacttattaaaagaccaccaaactatataaaacaaaaactgacagaattaaagggagaaatagttctacaataatagttggagattttaatgccacactctcaataatgtatagaacaagcagacagaagataagcaaggcaatagaggacttaacacaataaaccaatgagatctaatagccatttaacaggtatagagcttcagttttacaagatgaaaagttatgaagatggatgatggtaatgactgcacaattttatgttatgtgtattttaccacaataaagaaaaarttagaccaaagaggaagaagaacaagaacaataagaacaaccagtagtagcagtagtagtagtagcagtagtagtagtagcaatagtagtagtagtactagtagtagtagtagtagtagtagtagtagtagtagtagtagtagcagcagcagcagaagaagaagaagacaaaaagaaaataaagcacaagacatttggtgagattgaaacactgactagagaaacttgtgactaagaaactggtcacaatttttttttttttggtataataattgcattcaggttatctttttatttaac

SEQ ID NO: 189410 - DNA, 601 bp, Human
atcccatgtaaacagaagctgaacgagttcattaccagatgtgccctggaaatggtcaagggagtcctataaggtgaaatgaaaagacactaaacaataacacaaagccaggcatccatatgaagaaataaagattatcaatgaaggtaaatacttgagcaattataaaagctaatattgtaataatggtttataactcctctttttgttttctacatgatttaaaaaaccaatatgtcaaaaaataattagtctaaaagctagtatgattataactttggtttggtagaatacacatattgatatagatatagatatagatatagatatagatatagatatagatatagatccaactatatgctgtctacaagagactcactttagatccaaagacacaaacagattaaagtgaaaggctgaagaaaagattccatgcaaatagtaaccaaacgaaatcaggggtggctatactaatatcagacaaaatagattttcaatcagaaaaagttataagagataaagaaggacattatctatattaataaaaggttcaacataccaccaagaagatataacaattatagacatttacatactt

SEQ ID NO: 189411 - DNA, 601 bp, Human
acttactaccaccaatgataagcacaaattcacaccatgtgccttctaatgcaatatactaatatgcattcgaatgcatattctaatgcaataatccatgtactatgcttgacaaacacggttaacctgaatttaatcatgaggaaacaatcaaacaaatccaaactaaggtggcataaaacaactagcctggattcttaaattaaaaaaaaaaaaaaaaaaaaaaggcaatgtcataaatgttccaaactacgtaagattaaaagcacatgacaaccacaaacacagatcaaaattacartaagatagcatctcaaactaataaatgactaaaataaaaaaactaaacatcaccaaatgtaggtgaggttgtggaacaattagaactcttgtattatgctagtagaagtctaaaatggtacaagcactttggaaaactgcttggcaaattcttaaatataaaacctatgacaggtcgggcatggtggctcatgcctgtaatcctagcactttgggaggccgagacagatagatcccttgagcccaggagttcaagaagaccagcctgggcaacaaggtgaaaccctgtctctacaagaaa

SEQ ID NO: 189412 - DNA, 601 bp, Human
ttggaacaccttgctgttctaacaaataaaagaacctgtcaggaagaaacaggaaccatcttgaaaaggatgtcaccagccaacatggagacttcttttttttttttttttttgagacagagtcttggctctgttgcccaggctggagtgcagtggcactatctcagctcactgcaacctctgcctctcggcactacaggtgtgtaccaccacgctgggctaatttttgtatttttagtacagatggggtttcaccatattggccaggctggtcttgaactcctgacctcataatctaccygccttggcctcccaaagtgctgggattacaagcgtgagccactgcgcccggccagaccactataaaggataaaattatgagttaatatatgaattaaaaacagaacaagtccacactgatctgaaagtaagtgtggaggcaggaggaagagaaacatcttctttagagaagaaagccaaataataaatacataagggattacagaaatagaaaatcaccatttttacaatcactatagtatactattactgattcaggtaagaatcagtgaatactaaaacaactatgtgaaagactgtc

SEQ ID NO: 189413 - DNA, 601 bp, Human
gattccagtgccaccatgtgttgtccttatgtatgaacaacctgatgacaccacacagcaggaatactctgagtctaaaattgtgcagggcactacagagattttagtagtatcttgatgtcttccacccccactggcttctacatgcaagttaagacatacatatatagtaatggtctagtgctcagactttaacattctccattaaaggaaagcctgagctccttggaaaaatggccaaatccaaggtaggaaaaataacagggtaaacttggaacaccttgctgttctaacaaataaragaacctgtcaggaagaaacaggaaccatcttgaaaaggatgtcaccagccaacatggagacttcttttttttttttttttttgagacagagtcttggctctgttgcccaggctggagtgcagtggcactatctcagctcactgcaacctctgcctctcggcactacaggtgtgtaccaccacgctgggctaatttttgtatttttagtacagatggggtttcaccatattggccaggctggtcttgaactcctgacctcataatctacctgccttggcctcccaaagtgctgggattac

SEQ ID NO: 189414 - DNA, 601 bp, Human
tttaacttctaatgatagcgaagtccctaaaagaaaatacacctgcagatccggaaggcggaggagctccagatcgctgccattctgttgcttctgcagccagcctccgaatgtactgctcattcactgacaataagatgttctctggtttaatgtcagtgtggatgatacggcacttggtatgtaaataatcaagaccctgtaacacctgaatggaaatagagtggcagacttgcaaacacaaaatacaggctttctggagaagtaagagattataacatgacattaaaaaaaaaaaaaagatatgatagcgttttctatagagaataaaagcaccttttaaaaaagcacaaataaactttctcagaaagattaaactatgaaaaaggcaagaaattatttacaataaaaaattcttcaatgttttacaaagctgattctatttggagatattcttcaactatgtacaatgcaaagactgagaataaacttcaacacacacacaccctctaagtgttgtaatgtaggtgctgacagacatttagatatctttaattcaaatttcctcactgaggaagaattgaggtctcttgctgcccag

SEQ ID NO: 189415 - DNA, 601 bp, Human
acaggcatgagccactgtgcctggtcccgcaatttatttggtatataatattgtgtggcacactactaactgctttaccatttaatcccaataattcgcagttgagggaaaataaagtaaaataactcagctaaggtttctcagtctaggatgaagcccaaattcaaaccaagtctgtctactccagtgtttaaacctaaactattaatagcaatgttatcttgtccctctacagactaccagtcctataaatgagcatgtgtgatcacagttagaggtaaacacttcaaaaatcatcaamtcataagaaaaaatatttttaaacaatacacaccagcttttataacatacaacacaaagacacaatatctagttttctccttcccctatggaagtaacagtgagaatgtctcttggaagctgataatgtttcttaaatatgttattgttgaaatggattgagtggtgtttaattccctggtaacagaataaaaatagaaatttctttttaacttctaatgatagcgaagtccctaaaagaaaatacacctgcagatccggaaggcggaggagctccagatcgctgccattctgttgcttc

SEQ ID NO: 189416 - DNA, 601 bp, Human
caaccaactccccatttcccccttctttagtcttcctttttaaagaagtgtataactaataactcaacttgaggatcaagcaagttcctaaaaaatgacacactactaaaactaaaatctgtatctcaaaagaaaaaaaatcataaagcagcctttatttatttatttaattttatgtcttagacagggtctcactttgttgcctatgctcgagtgcagtggtactatcacaactcgtggcagccttgacttcctaggctcaagcaatcatcctgccccagcctcctgagtaaatggactmcaggcacgcatcactatgcctggctaatttttttaatttttgtagagacagggtcttactgtgttgcctaggctggtctcaaacttctgggcccaaatcatccacccacctcaacctcccaaagtgttgcgttacaggcatgagccactgtgcctggtcccgcaatttatttggtatataatattgtgtggcacactactaactgctttaccatttaatcccaataattcgcagttgagggaaaataaagtaaaataactcagctaaggtttctcagtctaggatgaagcccaaattcaa

SEQ ID NO: 189417 - DNA, 601 bp, Human
ttaaagaaaataatgaatagaaattgccaaacttaaaaaaaagggataaataaaattcttcctccccaggtaaactaaagttgctaaaaatcacctattttccattcccatgcactgcttaaaatagaatgggacaagcaacaacctcttcacctcaaatgctacccagaatctgtcagttttaaaaggggagtctaggtgacatcaagagctatagtaatttgctctacagcatgtcatggataacagtgtagcttagctggaaggtaggatcttcagtcttcctctttttaaaatattmgtataataactgtggttaacaaaaaacacataataaaaatttatactctagataagtgtacattcagtggttttaacactattcacactgttgtataacaggatctgtagaatgttttcatcttgtaaaacagaaactacatccatttaacaaccaactccccatttcccccttctttagtcttcctttttaaagaagtgtataactaataactcaacttgaggatcaagcaagttcctaaaaaatgacacactactaaaactaaaatctgtatctcaaaagaaaaaaaatcataaagca

SEQ ID NO: 189418 - DNA, 601 bp, Human
aacagaagaacccatgcccatagtccatagatcaaaattaaatataaaaacaccttatacttactggtttaggctggggagcagtactgactgaaaagaaaagaaaaccaagtaagaattctggcattcatcaggcaatataaactaaggctcagataaaacactctaccagaatgaaaagtctttcttatgtagtctacattgcagagaaaactattgtttttaaatgacttaagtagaagctatattattaccatttttaaagaaaataatgaatagaaattgccaaacttaaaaaaaagggataaataaaattcttcctccccaggtaaactaaagttgctaaaaatcacctattttccattcccatgcactgcttaaaatagaatgggacaagcaacaacctcttcacctcaaatgctacccagaatctgtcagttttaaaaggggagtctaggtgacatcaagagctatagtaatttgctctacagcatgtcatggataacagtgtagcttagctggaaggtaggatcttcagtcttcctctttttaaaatattagtataataactgtggttaacaaaaaacacataataaaaatt

SEQ ID NO: 189419 - DNA, 601 bp, Human
aaaacaccattaaggcaagtttaacttaccacccaacaagcatttccaaggtcagcaatcttcaccttgagcttttctgcattttttggctcaaggggattaacaagaaaatttccagccgtggattttcctacagacaacaggcatcatcaataagactgttcaatgaacagagaaatactcaatgagtaataaagctctccaaggtaagagtaatacagtcagcaatacccaagtgacaacttacattttctgagacaaaaagagcacagcaacgccttgagtttccagaattaaaaayctctgccctcacagcaacaaatgaagtgctgtgtactcagtacatgatggataaagttagctacagattacaatttaaacgtaacttagacacacctgttgtaaagctatagttacaaaaacaatcatacttttagtctagaaatctgtgaatgtgttgtgcagggaaggagtgttgaggaagtatagctgcataggtacctttgttgtccagtggtccgttatgttcttgctcttgttcatcttcacagggtatctctgcccgaatgctttcttgaagttggctaatgtgttgttcact

SEQ ID NO: 189420 - DNA, 601 bp, Human
gtgtctgaaagttaataatgatatatatattaaaaacaagattggccaggagttgacattactgaatctgggtgatgggtatctggagtggggtggggtaacagaaggacttttcatgatcacgattaccattctactttcgtaagtatatttaaacttttccatagtaaaaggtttttttaaatgtaaaaaaatattcactgaagtgttgtatcaatctgggtacagaattatggatgttttgcataactaagtccaaattctcattcatcctcccagtcacttcaaaacaccattaagrcaagtttaacttaccacccaacaagcatttccaaggtcagcaatcttcaccttgagcttttctgcattttttggctcaaggggattaacaagaaaatttccagccgtggattttcctacagacaacaggcatcatcaataagactgttcaatgaacagagaaatactcaatgagtaataaagctctccaaggtaagagtaatacagtcagcaatacccaagtgacaacttacattttctgagacaaaaagagcacagcaacgccttgagtttccagaattaaaaacctctgccctcacag

SEQ ID NO: 189421 - DNA, 601 bp, Human
gttacaatttataagttagtcatcaattttgaaaatgggagtaggggagtatgaacataggcactgagtgtctgaaagttaataatgatatatatattaaaaacaagattggccaggagttgacattactgaatctgggtgatgggtatctggagtggggtggggtaacagaaggacttttcatgatcacgattaccattctactttcgtaagtatatttaaacttttccatagtaaaaggtttttttaaatgtaaaaaaatattcactgaagtgttgtatcaatctgggtacagaattayggatgttttgcataactaagtccaaattctcattcatcctcccagtcacttcaaaacaccattaaggcaagtttaacttaccacccaacaagcatttccaaggtcagcaatcttcaccttgagcttttctgcattttttggctcaaggggattaacaagaaaatttccagccgtggattttcctacagacaacaggcatcatcaataagactgttcaatgaacagagaaatactcaatgagtaataaagctctccaaggtaagagtaatacagtcagcaatacccaagtgacaacttaca

SEQ ID NO: 189422 - DNA, 601 bp, Human
gtgtacacatggaggtatagtgtggaatgatcgacaatgaagactcagagggtggggtgaaagggtggatgaagggatgttacttggtggttacaatgtgcactgttccagtgatggatccattgaaggccctgacttcaccacaatgcaatatatcaacctagcaaaactgcacttatacctcatgaacatatacaaattaaaaaaaaaagtatcactctgatagatgtgttgccaatagtctacggggagcaagggcagcagaagggagaaagtgaagaagctattgcagtcactactraagtcatccagggtgacctggaccagatgatagcgtagtggagtaattctaattacttggaaagctgctccacattcttattagtcagtgctaagctggctttgttttttctaaaaggttatcacaatattctacaatcaatatgggaagtaagatccttctgaggtctgaaccatgtcccatttaaaagcatatggctctttgagtactgtcatttatgtgtgaatcattctattataaattttaaaaagatgtccattaaaaataaccttggtcaggtatggtggctcatgcctgtag

SEQ ID NO: 189423 - DNA, 601 bp, Human
aggagtagataaagaaaatgtggtatggaatgaacacaatactattcagccataaaaaagaatgaaatcatgtgttttgcagcaacatggatggaactggatgccattatcttaattgaaacaactcaaagaaaggtaaataccacatgttctcacttataagtgggagctgcataatgtgtacacatggaggtatagtgtggaatgatcgacaatgaagactcagagggtggggtgaaagggtggatgaagggatgttacttggtggttacaatgtgcactgttccagtgatggatccaytgaaggccctgacttcaccacaatgcaatatatcaacctagcaaaactgcacttatacctcatgaacatatacaaattaaaaaaaaaagtatcactctgatagatgtgttgccaatagtctacggggagcaagggcagcagaagggagaaagtgaagaagctattgcagtcactactgaagtcatccagggtgacctggaccagatgatagcgtagtggagtaattctaattacttggaaagctgctccacattcttattagtcagtgctaagctggctttgttttttctaaaaggttat

SEQ ID NO: 189424 - DNA, 601 bp, Human
cggaatcaacccaagtgtctaggagtagataaagaaaatgtggtatggaatgaacacaatactattcagccataaaaaagaatgaaatcatgtgttttgcagcaacatggatggaactggatgccattatcttaattgaaacaactcaaagaaaggtaaataccacatgttctcacttataagtgggagctgcataatgtgtacacatggaggtatagtgtggaatgatcgacaatgaagactcagagggtggggtgaaagggtggatgaagggatgttacttggtggttacaatgtgcaytgttccagtgatggatccattgaaggccctgacttcaccacaatgcaatatatcaacctagcaaaactgcacttatacctcatgaacatatacaaattaaaaaaaaaagtatcactctgatagatgtgttgccaatagtctacggggagcaagggcagcagaagggagaaagtgaagaagctattgcagtcactactgaagtcatccagggtgacctggaccagatgatagcgtagtggagtaattctaattacttggaaagctgctccacattcttattagtcagtgctaagctggctt

SEQ ID NO: 189425 - DNA, 601 bp, Human
tgggtatctgcacaaaggaaaataaatcatatcaaaaatatacctatacttgtatgtttatcacagcactattcataattacaactacggaatcaacccaagtgtctaggagtagataaagaaaatgtggtatggaatgaacacaatactattcagccataaaaaagaatgaaatcatgtgttttgcagcaacatggatggaactggatgccattatcttaattgaaacaactcaaagaaaggtaaataccacatgttctcacttataagtgggagctgcataatgtgtacacatggaggyatagtgtggaatgatcgacaatgaagactcagagggtggggtgaaagggtggatgaagggatgttacttggtggttacaatgtgcactgttccagtgatggatccattgaaggccctgacttcaccacaatgcaatatatcaacctagcaaaactgcacttatacctcatgaacatatacaaattaaaaaaaaaagtatcactctgatagatgtgttgccaatagtctacggggagcaagggcagcagaagggagaaagtgaagaagctattgcagtcactactgaagtcatccagggtg

SEQ ID NO: 189426 - DNA, 601 bp, Human
taaggacacgaatagggatttttcaaaagaagacaaatggccaacaaataaatgaaaaaatgtccactatcactaaccagcagagaaatacaaattaaaaccacaatgaggtatctttcaccaatcagagtggctattactaaaaatacaaaaaataataacatgttggagaggatgtggagaaaagggacttcttacacactcttggtgggaatgaaaatcagcaccatctctatagaaaatagtatgaatggccgggcgcggtggctcatgcctctaatcccagcactttgggaggccraggtaggcagatcacaaggtcaggagatcgagaccatcctggccaacatggtgaaaccccgtctctactaaaaatacaaaaaattagccggctgtggcggcacgtgcctgtagtcccagctacgcgggaagggtgaggcaggagaattgcttgaacctgggaggcagaggctgcagtgagcagagatcgcaccactgcactccagcctgggcaatagagcgagactccatttaaaaaaaaagaaaaagaaagaaggaaaatagtatgaaaatttctcaaagaactaaaaataaaactacc

SEQ ID NO: 189427 - DNA, 601 bp, Human
aaactggactgccatatgcagacgaataaaagatccctatcactcactgtatacaaaaatcaacccaagaccaattaaagacatgaatataagacctgaaactcatgactaagacctcaggcaacaaaaataaaaatagacaaatgggacttaaacaaaaaagcttctgcacagcaaaagaaataatcaagagtcaacaggcaacctacaaaatgggagaaaaaaatctgcaaactatatgacccaacaggggactaacatctagaatttacaagaaactcaactcaattaaaaaaaaaamcaaataatcccattaaaaggtagactaaggacacgaatagggatttttcaaaagaagacaaatggccaacaaataaatgaaaaaatgtccactatcactaaccagcagagaaatacaaattaaaaccacaatgaggtatctttcaccaatcagagtggctattactaaaaatacaaaaaataataacatgttggagaggatgtggagaaaagggacttcttacacactcttggtgggaatgaaaatcagcaccatctctatagaaaatagtatgaatggccgggcgcggtggctcatgcc

SEQ ID NO: 189428 - DNA, 601 bp, Human
catgatgtgattatttcacattgcatgcctgtatcaaaacatctcagataccccacgaatacatacacctactatgtacccattaaaaattaaaaattaaaaaaaattttaaaacaatcacactatccaaagcaatctacaggttcaatgcaattcttttcaaaatactaatgtcattttttcacagaattacaaaaaacaattctaaaattcatatggaataaaaaaagaacctaaatagccaaaagaatcctaagcaaaaagaaaaaagctagaggcattacactgtctgacctaaaaytatacaaggttacagcaaccaaaacagcatgtattagtattaaaatagatacacagatcaatggaacagaatagagaacctagaaataaagccatatacttaacagcaaactgatctttgaaaagtcaacaagcacattcactgggaaaaagacatccttttcaataaatggttctaggaaaactggactgccatatgcagacgaataaaagatccctatcactcactgtatacaaaaatcaacccaagaccaattaaagacatgaatataagacctgaaactcatgactaagacctcag

SEQ ID NO: 189429 - DNA, 601 bp, Human
ggatcacatgaagttaaacagcttctgcacagcaaagaaaacaatcaacaaagtgaagagacaacccacagaatgggagaaaatatttgcaaattacccatctgataggggattaataaccagaatatataaggagctcaagcaactctataggaaaaaaaaaaaatctaataatctgatcaaaaaatgggccaaagatttgaatagacatttctcaaaagaagacatacaaatggcaaagaggcatatgaaaaggtgctcaacatcactgaccatcagagaaaggcaaatcaaagctacragagcatctcaccccagttaaaatggcttacgtccaaaagataggcagtaacaaatgctggcaaggatgtggagaaaagggaaccctcctgcactgatgataggaatataaactggttacaaccaccatggagaacagtttggaggtccctcagaaaactagagctaccatattatccagcaatcccactgctgcgtatataatcaaacgaaaggaaatctgtatataaaaaagatgtctgcactccgatgtttgttgtagcactattcacaatatttaagatttggaagcaacctaagt

SEQ ID NO: 189430 - DNA, 601 bp, Human
gcggcttcagctgggtgccattttgacagccttgataccagggatctgaagatgcagctgctgtcactccactgctctgaggaggaagaggggaggctaggcactctcatgcactcctgggagggtccctatcaccctgccatgggctgccggtgagaccaagatgtgagtggaccacattccccacagcttcttccccatgctgctggcctaagagggaccctccccgctctggtcccaggcataaagtgctattttgagaggttaatgctaggttgcgccttgccctttcgggctgacstggctgcagctgccacttggctgaggagggacaggaaaaccaggctctcctatgcatacctaagacaacaggcttttttgagactgagacttgagtgtactgtaactccccacagtttcttgcccatgctgttcatttgagagggaacctaccctctcagtcacaggccaacagctggcaccattttgagagtttaaagctgggctatgcgcttgcccttgggcgacacggctgcaactgccacccagctgggagaggaacagcagagaccaagcttctctaagcacacttaggaaaata

SEQ ID NO: 189431 - DNA, 601 bp, Human
tgactagacacaggtagtatgtgcctcatccacagaaaggaaccagaacagtcagaagatacccacattttgaacagattgtccaggaaggaatgctaagattcaccagagaagtgataggaagcaccagaaggaaagggtctgaggaagctggcatgggcatacagtaagagagaaatccccagcatcccacattctgaaaatgggttttatgatcttggttatgggagaaaccctgaaccaactagggcctcgggcctgacatgcagaactgcctaaagattggacagatgttgctccraacagggaacccacagagaatcccacaggcatctgagtctaagcggcttcagctgggtgccattttgacagccttgataccagggatctgaagatgcagctgctgtcactccactgctctgaggaggaagaggggaggctaggcactctcatgcactcctgggagggtccctatcaccctgccatgggctgccggtgagaccaagatgtgagtggaccacattccccacagcttcttccccatgctgctggcctaagagggaccctccccgctctggtcccaggcataaagtgctatttt

SEQ ID NO: 189432 - DNA, 601 bp, Human
atagagaaaacaataaatctccaggatgatggtgaagggaaatcccaaatgacgtaatgtagcagacctatagggcaacccaatcagatcaatacagattagaagactccaggttctaggacacagcgctttagaaagataatagtagaaagaacactcaatgtatctgtacatattaaagtgtatttacaacactgggtaaaagtatgggattgaattaagtgatcaacagtacaaagaaaactaagcaagtgaaacatgttatgtagaaaggaaaaggaaccataatatatgctcagtycagctgaggatagccttagagtctcaatgatataaacatggtatgatcatgtagccaaaaattagattacattggggaaatgaggaattcgtgctgtggtgctagataagccccattttccgggaggaaaaaaataatatgtaacactgaaaacaaaattggattaatataacctgttatttattagtgatataaaggtaaatactgttaaggggagtgaaaaactggtgaaagaagtaggcagatttttaaataaaagcttatataactgtctcccccactgtgtacacgcatgattga

SEQ ID NO: 189433 - DNA, 601 bp, Human
tgaattttgtttcctgtatatgactcatactaagcttctttttgtccttcattattcatttattttttatcatggaaaatttcaaatatatacaaaagtagaaagaatcatgaaccccatgccatttattatactagtgtcacctagcaattaccactcattgccagtctattttcaactgtatcccaaccctgccaccacacctacaccagattttgaagtacatactagacattttcttttcattcataaatatggctttctgaaagatcattctttttaactgtgacactttgtcacctaaaaaaaaaaaattaagatgcaaaaccaaagaatcagagtttcaatgttgaaagtgcacatcaaatttttagtataagaggtgaaaacaggctgagtgaggcatatcactatgaaattatcttacagacttccactgggggaaaagtttcatataaagatcaagaatcagaatggcatcggtctttagtaccatcaaaactggaaactataaaacaatggagcaacgacattctgaaagaaaatgttttctaacctagaattctctacaaagccaactgagagtgaaagcagaataaag

SEQ ID NO: 189434 - DNA, 601 bp, Human
agtaacaagtcaatactgcttaataatggagatgaaaataaactctctgaagtttttcccaaaccaaagttctcactttgcttatttcttaaacagcatttttatgttattagctccaacaatcctttgccttacacacagctactccaaattatttttacaaacaaatgagcctaaacttaatatacacaggtctaggaaacaacaacagcttttttctttttaaaaattgttttagtaaagatggggtctcgctatgttacccatgctggactcaaactcctgggctcaagtgatccayccaccttggcctcccaaagtgctgggattacaggcgtgagctaccacaccaaggaatccaaactctttaaccttgcaatttactatacttgtctttaataagtatctttctgtgcctttattgggatgttgatgttctacctagagtattttttgctcttttggtcaaatttcatctagtaccctttgaagccctggtgtatactagttttctacctgaagttttctctgagtaatttcctcttttcacaaatactgttccctgtttttaaatttcaataggattagagaattgtcttcc

SEQ ID NO: 189435 - DNA, 601 bp, Human
ggtgacacacatcaatgtgccaggagggtgaaagtcctgaggacacagaagcttcacatttagtacgctctcagactttcccctatgtgtcctgatttgtattctttataataaaactatagcaagcttagcactttctgagggggtaatgcaaacctcttaatttgtagccagttgattagaagtgcaggtggcttgtggatcctgaggcttgtggttagtgtctgaagtgagggcaatcttgtgaggaaccatgctcttaacctatgaagtctgtgataactctgggtagttagcatcrgaattacattgtaagcaatcacccaaaatgtgtcaggcaatgaatccagacagttatacataacagccatgattcctgacaatatggggcttacaacatagaagagaaacaagtaaacaaacacgattagaaattgtggtgattaaagatattaaggagtataatacattttaagaaacaatgtaacacattccaacatgaggatattagtaggaaatcatttatcatcaactaaatctgaccactggaacagttgcttgccagaggcaaaatagccatttatgaatctatgaatgattg

SEQ ID NO: 189436 - DNA, 601 bp, Human
cagctaatttttgtatttttagtagagacagggtttctccatgttggctaggctagtctcgaactcctggcctcaagtaatctgcctgcctcagcctcccaaagtgctggaattacaagtataagccactacacctgggcccccttttccctttttataactgcccttctaactattcctcaatcatcaatgtagaggcaatctcaacttgttccatctcattacctctcagagagggtcctaatctttccatcaattaattacattggatgcaggatgatccatctcttcaggcacttcygatattccagaatttttgctctatgatcaaatttaaagcaacattttgtttttctatgtcgactggcaaaataaaaacttgaggatcaaatggggctcaatttttcatgatattgtctcatgtcaggtaagtacttccattccttggtcaagaaaattctgacatgtgagtgggtccagaactatgaggtgagattaattacgcctttatctttcagccttacttcttaagcctgacattagaaatactttattaaatatcaagcaggatctactgccccccaaacaaaacagaaatgtg

SEQ ID NO: 189437 - DNA, 601 bp, Human
ccagcattcggagattgttttttttttttttgagacagagtctcactgttgtgttcttcacaaatattttcccctttcccccttttttttgtttttttgaaatggagtcttgctctgttgcccaggctggggtgcagtggtgtgatctcagctcactgcagcctctgcctcccaggttcaaacaattcttgtgtctcagcctcctgagtagctgaggttacaggcatgtgccaccatggccagctaatttttgtatttttagtagagacagggtttctccatgttggctaggctagtctcraactcctggcctcaagtaatctgcctgcctcagcctcccaaagtgctggaattacaagtataagccactacacctgggcccccttttccctttttataactgcccttctaactattcctcaatcatcaatgtagaggcaatctcaacttgttccatctcattacctctcagagagggtcctaatctttccatcaattaattacattggatgcaggatgatccatctcttcaggcacttccgatattccagaatttttgctctatgatcaaatttaaagcaacattttgtttttctatgtc

SEQ ID NO: 189438 - DNA, 601 bp, Human
tgtataggataaggaaattgtacaaaaagaactcaaaatattacttactaaaatggcattcaaaatccagcctccagtgacttactgctgttgaataaaggtgacaatctttggtgaaatctaaagagctattgtgcatagtgctagaagttataaccacctgcagacatttctgccgtttcattcgggcagctcagattgggaattggtgatgatggagaaagagctcttgggtcaaattactacactttggattttgatagtttaaggattttagtagccttaagagttctagacagasaagacagttatggataaacccctttggatcccatttctgaaagattcactcccttactgaaacacctgaccaagaattaagttagtcagccctgggtgtctgcaggttccacatgctcagattcaactgactgtagattgaaaatattcagaaacagcaacaacaacagcacaataaaaatacaagtaaaggacaggcacagtgactcatgcctgtaattccagtgctttgggaggctgaggtaggatgatcgtttgaagctaggagtttgagaccagtctgtgcaacatagcaagacct

SEQ ID NO: 189439 - DNA, 601 bp, Human
cactatgtgataatgtaacatgaagggagaaaaacagaagcagagaaaggaaattaggaggtcactgtattgatccatttgcgaaatgatgatggcatgggctataatgagttaatggaaaaagtaaaaagtggttggtattggattttttttttcttttttttttgagacagggtctcactctgtcacccaggctgtggtgcagtcttggctcactgcaatctctgcctcctgggttctagcgattctcgtgcctcagcctcctgagtagctgggatttcagttgcacgccaccaccccrgctaacttttgtatttttggtagagacagggtttcaccaggttggccagcctggtcttgaactccagatatcaggtgatccacccacctcagcctcccaaagtgctgagattacaggcatgagctattgtgcccagccggtattggatatattctgaaggtagaacacatagaaacagctgatggactaggtgtagacaaaggaaaaagaattaagaattaacctaaaaggttcaggttctaagcttttagtctgaatggctgggtgaacagggggataatttacaaaaacaggatgtgt

SEQ ID NO: 189440 - DNA, 601 bp, Human
ggagaaagcacatccaaaggtccaaggtaagtatgagcttcacaagactagggaaagaaaataggattttgagtggaatagatgcaattaaaggatttaaaacggggaagtaatatgatttgattaacacttaagaccactcaggccactatgtgataatgtaacatgaagggagaaaaacagaagcagagaaaggaaattaggaggtcactgtattgatccatttgcgaaatgatgatggcatgggctataatgagttaatggaaaaagtaaaaagtggttggtattggattttttttttcttttttttttgagacagggtctcactctgtcacccaggctgtggtgcagtcttggctcactgcaatctctgcctcctgggttctagcgattctcgtgcctcagcctcctgagtagctgggatttcagttgcacgccaccaccccagctaacttttgtatttttggtagagacagggtttcaccaggttggccagcctggtcttgaactccagatatcaggtgatccacccacctcagcctcccaaagtgctgagattacaggcatgagctattgtgcccagccggtattggatatattc

SEQ ID NO: 189441 - DNA, 601 bp, Human
ttctctgcctcatatagaaagcaaacaacaacaaaaaaaaccccatgtatctcagggagtgacaagttctatgtgacaaagaaaagtgataaagtgggggttatttcaaataaagtagtcaggaagacatctctaaagagattatgttgaacaaagacctgcattaggtgaaggagaaagcacatccaaaggtccaaggtaagtatgagcttcacaagactagggaaagaaaataggattttgagtggaatagatgcaattaaaggatttaaaacggggaagtaatatgatttgattaacrcttaagaccactcaggccactatgtgataatgtaacatgaagggagaaaaacagaagcagagaaaggaaattaggaggtcactgtattgatccatttgcgaaatgatgatggcatgggctataatgagttaatggaaaaagtaaaaagtggttggtattggattttttttttcttttttttttgagacagggtctcactctgtcacccaggctgtggtgcagtcttggctcactgcaatctctgcctcctgggttctagcgattctcgtgcctcagcctcctgagtagctgggatttcag

SEQ ID NO: 189442 - DNA, 601 bp, Human
tttcctatttaagaatcatagacaatttctctgcctcatatagaaagcaaacaacaacaaaaaaaaccccatgtatctcagggagtgacaagttctatgtgacaaagaaaagtgataaagtgggggttatttcaaataaagtagtcaggaagacatctctaaagagattatgttgaacaaagacctgcattaggtgaaggagaaagcacatccaaaggtccaaggtaagtatgagcttcacaagactagggaaagaaaataggattttgagtggaatagatgcaattaaaggatttaaaayggggaagtaatatgatttgattaacacttaagaccactcaggccactatgtgataatgtaacatgaagggagaaaaacagaagcagagaaaggaaattaggaggtcactgtattgatccatttgcgaaatgatgatggcatgggctataatgagttaatggaaaaagtaaaaagtggttggtattggattttttttttcttttttttttgagacagggtctcactctgtcacccaggctgtggtgcagtcttggctcactgcaatctctgcctcctgggttctagcgattctcgtgcctc

SEQ ID NO: 189443 - DNA, 601 bp, Human
gaatacagaatgggaaaaggatagtctcttcaataaatggtgttggaaaaactggatataaaaagaatgaaactggaccaccctcatctcactccgaatacaaaaatcgaaatggatgaaagacttaataagacctgaaactgaaaaactaccagaagaaacagggggaaacccacatgacattggtctgagcaatgatttttttggatttgaccccaaaagcccagggagcaaaagtgaatacagacaaatgggataacatcaaactaaaaaacttctgtacagcaaaggaaacaatagygtgaagagataacctatgggttgggaaaaaatatttgcatgctatacatttgataggggttaatatccaaaataatatggaactcaactcaatagcaagaaaacaaacaaacaaacccaattaaaaaacaggcaaaggacctaaataaacatttctgaaaagaagacacacaaatggccaacagatctattaaaaaaaaagctcaacatcactaatcattagggaaatgcaaattaaaaccaaaatgagatatcatttcatatctgtcagaatggctgttatcacaaagacgaaatattt

SEQ ID NO: 189444 - DNA, 601 bp, Human
gaggctgaagtgggcagatcactggagctcaggagttttgagaccagcctgggcaacacagggagaccccacctctacaaaaaatacaaaaatagttggatgtggtggggcacacctgtagtcccagctatttgggaggctgagatgggaggatcacttcagcccaggaagcggaggctgaagagagctgtgattgcgccactgcactccagcctgagtgacagtatgagactctgtctcaaaacaagaacaaagctggaggcatcaaaccacctgatttcaaactatactacaaagctayagtaattaaaacagcatggtcctggcaaaaaaagcagacgcatagaccaaaggaacaatatagagagcccagaaatgaacccacgcatgtatggtcaagtgatctttgacaaaattgccaagaatacagaatgggaaaaggatagtctcttcaataaatggtgttggaaaaactggatataaaaagaatgaaactggaccaccctcatctcactccgaatacaaaaatcgaaatggatgaaagacttaataagacctgaaactgaaaaactaccagaagaaacagggggaaacccacatg

SEQ ID NO: 189445 - DNA, 601 bp, Human
aaaaaatctaaagatatgttgtataaaaatttgaatataggccaggcgcagtggctcatgcctgtaatcccagcactttgggaggctgaggcaggtggatcactcatgctcaggagttcgagaccagcctgggcaacatggtgaatcccgtctctaccaaaaatacaaaaaaattagctaggcatggtggcacatgcctgtggtcccagctactcaggagggtgagccgagattgtactactgcactccaacctgcgtcctgcatgacagagtgagactgtgtctccaaaaaaaaaaaaaagactaaaaaaatcagaaatgaagaaatgaaagaggagacattataatgaataccacagaactacaaaggataagagactactatgcacaatcatatggcaacagattggataacccagaaaaaaatggaaaaattccttgacaatataacctacaaagattgaaccatgaagaaatagaaacaagagattagatctgtaataagaagtctcccatcaaagaaaagcccaggacctgatggcttcactgctgaattctaccaaacatataacgaagaagtaacagcaatctgtctcaaact

SEQ ID NO: 189446 - DNA, 601 bp, Human
gatcccatctcttaagaaaaaaaaaaaatctaaagatatgttgtataaaaatttgaatataggccaggcgcagtggctcatgcctgtaatcccagcactttgggaggctgaggcaggtggatcactcatgctcaggagttcgagaccagcctgggcaacatggtgaatcccgtctctaccaaaaatacaaaaaaattagctaggcatggtggcacatgcctgtggtcccagctactcaggagggtgagccgagattgtactactgcactccaacctgcgtcctgcatgacagagtgagacygtgtctccaaaaaaaaaaaaaagactaaaaaaatcagaaatgaagaaatgaaagaggagacattataatgaataccacagaactacaaaggataagagactactatgcacaatcatatggcaacagattggataacccagaaaaaaatggaaaaattccttgacaatataacctacaaagattgaaccatgaagaaatagaaacaagagattagatctgtaataagaagtctcccatcaaagaaaagcccaggacctgatggcttcactgctgaattctaccaaacatataacgaagaag

SEQ ID NO: 189447 - DNA, 601 bp, Human
tttcttcaatggtatatagagtttcagtttagaaagataaaaaatttctaaagaggccaggtagggtggcttacacctgtagtcccagcactttgggaggccaagacgggaggattgcttgagcccaggagttcaagaccagcctgggaaatacagtgagatcccatctcttaagaaaaaaaaaaaatctaaagatatgttgtataaaaatttgaatataggccaggcgcagtggctcatgcctgtaatcccagcactttgggaggctgaggcaggtggatcactcatgctcaggagttcragaccagcctgggcaacatggtgaatcccgtctctaccaaaaatacaaaaaaattagctaggcatggtggcacatgcctgtggtcccagctactcaggagggtgagccgagattgtactactgcactccaacctgcgtcctgcatgacagagtgagactgtgtctccaaaaaaaaaaaaaagactaaaaaaatcagaaatgaagaaatgaaagaggagacattataatgaataccacagaactacaaaggataagagactactatgcacaatcatatggcaacagattggataacccaga

SEQ ID NO: 189448 - DNA, 601 bp, Human
aaacacggagtttttcttcaatggtatatagagtttcagtttagaaagataaaaaatttctaaagaggccaggtagggtggcttacacctgtagtcccagcactttgggaggccaagacgggaggattgcttgagcccaggagttcaagaccagcctgggaaatacagtgagatcccatctcttaagaaaaaaaaaaaatctaaagatatgttgtataaaaatttgaatataggccaggcgcagtggctcatgcctgtaatcccagcactttgggaggctgaggcaggtggatcactcatrctcaggagttcgagaccagcctgggcaacatggtgaatcccgtctctaccaaaaatacaaaaaaattagctaggcatggtggcacatgcctgtggtcccagctactcaggagggtgagccgagattgtactactgcactccaacctgcgtcctgcatgacagagtgagactgtgtctccaaaaaaaaaaaaaagactaaaaaaatcagaaatgaagaaatgaaagaggagacattataatgaataccacagaactacaaaggataagagactactatgcacaatcatatggcaacagatt

SEQ ID NO: 189449 - DNA, 601 bp, Human
atttaaacagactaattacattcagatccagaagtaaattgcaaactccaggtagcagaaaggaatactgacacagcttgaggggcaatctagcatttcataagcaatatggttgtgtgtggtcagaatgccaaggagtgattaccaaacagaaaatgaggagtttcaggtaagagctgtttctataaagtaacatgtccatcatctgtatcaatgggctggccaatggctgtctcaaagtgaggaagacaagtcagagtcctgatgcttggccttctgcagagatgcaggtgtgctcaakgtattaacttaagggcccttatcttgaccccaggtttgaccacattaagaaaggctgaagtgctggaaatgttattttagaaaaaaggaattaacagatgattcaaatttcctgtcttcaacaatccataccaaagggaagtaaaattccagagcagggctggaggctggaacaataaagtctgttttaaatttaaaaggttgccaaagaataggggaaaagggaaacacggagtttttcttcaatggtatatagagtttcagtttagaaagataaaaaatttctaaagaggccaggtag

SEQ ID NO: 189450 - DNA, 601 bp, Human
agtcataggtcaattttgattaaatcaatggtactaagcagtccaaacaacctcaagaactgtagagtccaggacttagttggggcatattctcaatttagacccaagtttaggtcctggtggctcaccagtgtcagtttctgcagtttcatgacagaacagcctttctcaaaactgtactaccgtccagagggagaccacaaaaccagaagtttcaggataggtttaggaatcaaatactatctctaaatgtcagcagtgctatggcttcttgcttggcattgcttattttacatttcakttgtttattaagaaactgaaccacagtgatagagcagatacttgttctaccctgagttgttccgaggtttatagtcccaaagcaacagagaaacaaatcatgattcttgttcaccaaaacttgtcaatcattcctgataccagtactttaaaaaaaaatctcatggtctcatatatagagttcagtaaaaatactgaaattaaagttaaaaaaaacaaaaaacaaaaaacacagagccagccgcggcagtgctatacgcctgtggtcccagctattcaggaggctagaaaatgaaatact

SEQ ID NO: 189451 - DNA, 601 bp, Human
ctacaggtgcccgccaccaagcccggctaattttttgtatttttagtaggacagggtttcaccatgttagccaggatggtctcgatctcctgacctcgtgatccgcctgcctcggcctcccaaagtgctgggatcacaggtgtgagccaccacgcctggccaacagcagttttaaaaaatgaccttattgatagggaagcacagttataaaataagcgctagtcataggtcaattttgattaaatcaatggtactaagcagtccaaacaacctcaagaactgtagagtccaggacttagtyggggcatattctcaatttagacccaagtttaggtcctggtggctcaccagtgtcagtttctgcagtttcatgacagaacagcctttctcaaaactgtactaccgtccagagggagaccacaaaaccagaagtttcaggataggtttaggaatcaaatactatctctaaatgtcagcagtgctatggcttcttgcttggcattgcttattttacatttcagttgtttattaagaaactgaaccacagtgatagagcagatacttgttctaccctgagttgttccgaggtttatagtcccaa

SEQ ID NO: 189452 - DNA, 601 bp, Human
tttttttttggatggagtctcgctctgtcgcccaggctggagtgcagtggcacaatctcggctcactgcaagctccgcctcccaggttcatgtcattctcctgcctcagcctccccagtaggtgggactacaggtgcccgccaccaagcccggctaattttttgtatttttagtaggacagggtttcaccatgttagccaggatggtctcgatctcctgacctcgtgatccgcctgcctcggcctcccaaagtgctgggatcacaggtgtgagccaccacgcctggccaacagcagttttwaaaaatgaccttattgatagggaagcacagttataaaataagcgctagtcataggtcaattttgattaaatcaatggtactaagcagtccaaacaacctcaagaactgtagagtccaggacttagttggggcatattctcaatttagacccaagtttaggtcctggtggctcaccagtgtcagtttctgcagtttcatgacagaacagcctttctcaaaactgtactaccgtccagagggagaccacaaaaccagaagtttcaggataggtttaggaatcaaatactatctctaaatgtc

SEQ ID NO: 189453 - DNA, 601 bp, Human
aatcagaagattaagtgtaaagggagtcaggagcctagcctatgtgactggcaagtcagcactccctaattaggaaaagaaaagcctgtctcctttaatagaaaaacctcttacagtgctcgagagtgtcttaggaaatgatatccttgggaataagtgccatgcagaatgaaaagcagggctacataaatcctcactgattacaaatggagttttaaaaattagtacacaacagcagttttttttttttttttttggatggagtctcgctctgtcgcccaggctggagtgcagtggcacratctcggctcactgcaagctccgcctcccaggttcatgtcattctcctgcctcagcctccccagtaggtgggactacaggtgcccgccaccaagcccggctaattttttgtatttttagtaggacagggtttcaccatgttagccaggatggtctcgatctcctgacctcgtgatccgcctgcctcggcctcccaaagtgctgggatcacaggtgtgagccaccacgcctggccaacagcagttttaaaaaatgaccttattgatagggaagcacagttataaaataagcgctagtcata

SEQ ID NO: 189454 - DNA, 601 bp, Human
acaggcgtgagccaccatgcctggccaattcgtaggtctttagaaaatcagaagattaagtgtaaagggagtcaggagcctagcctatgtgactggcaagtcagcactccctaattaggaaaagaaaagcctgtctcctttaatagaaaaacctcttacagtgctcgagagtgtcttaggaaatgatatccttgggaataagtgccatgcagaatgaaaagcagggctacataaatcctcactgattacaaatggagttttaaaaattagtacacaacagcagttttttttttttttttttggatggagtctcgctctgtcgcccaggctggagtgcagtggcacaatctcggctcactgcaagctccgcctcccaggttcatgtcattctcctgcctcagcctccccagtaggtgggactacaggtgcccgccaccaagcccggctaattttttgtatttttagtaggacagggtttcaccatgttagccaggatggtctcgatctcctgacctcgtgatccgcctgcctcggcctcccaaagtgctgggatcacaggtgtgagccaccacgcctggccaacagcagttttaaaaaatga

SEQ ID NO: 189455 - DNA, 601 bp, Human
gactacaggtgcatgccaccacgcccagctaatttttgtatttttagtagagatggggttttaccatgttggccaggatggtctcaatctcttgacctcatgatccacccgcctctgcctcccaaagtgctgggattacaggcgtgagccaccatgcctggccaattcgtaggtctttagaaaatcagaagattaagtgtaaagggagtcaggagcctagcctatgtgactggcaagtcagcactccctaattaggaaaagaaaagcctgtctcctttaatagaaaaacctcttacagtgytcgagagtgtcttaggaaatgatatccttgggaataagtgccatgcagaatgaaaagcagggctacataaatcctcactgattacaaatggagttttaaaaattagtacacaacagcagttttttttttttttttttggatggagtctcgctctgtcgcccaggctggagtgcagtggcacaatctcggctcactgcaagctccgcctcccaggttcatgtcattctcctgcctcagcctccccagtaggtgggactacaggtgcccgccaccaagcccggctaattttttgtattttta

SEQ ID NO: 189456 - DNA, 601 bp, Human
tctcggctcactgcaagctccgcctcctgggttcacaccattctcctgcctcagcctcccgagtagctgggactacaggtgcccaccaccacgcccagctaattttttgtatttttagtagagatggggtttcactgcgttagccaggatgttctcaatctcctgacctcgtgatctgccaaccttggcctcccaaagtgctgggattacaggtgtgagccaccacgcccagcccaggtctttcttacattataatcacacatggctagaaattgagattctgtaccaaacaaaaaaaatcaaaaaaaaaaaaaaattcagacttctacttatgactctttagtgtttgacaagtacatcattaacttttgcataggaagtactccctagattgtcccagatgggaagttcctgattcctaggtcctttgtttttgagatggaatcttgctctgccggccagactggagtgcactggcatgatctcagctcactgcaacttctgcctcctgggttcaagtgattctcctgcctcagcctccggagtagctgggactacaggtgcatgccaccacgcccagctaatttttgtatttttagta

SEQ ID NO: 189457 - DNA, 601 bp, Human
acaggtcttttttttttttttttgagacggagtctcactctgttgcttaggctggagtgcagtggcacggtctcggctcactgcaagctccgcctcctgggttcacaccattctcctgcctcagcctcccgagtagctgggactacaggtgcccaccaccacgcccagctaattttttgtatttttagtagagatggggtttcactgcgttagccaggatgttctcaatctcctgacctcgtgatctgccaaccttggcctcccaaagtgctgggattacaggtgtgagccaccacgcccrgcccaggtctttcttacattataatcacacatggctagaaattgagattctgtaccaaacaaaaaaaatcaaaaaaaaaaaaaaattcagacttctacttatgactctttagtgtttgacaagtacatcattaacttttgcataggaagtactccctagattgtcccagatgggaagttcctgattcctaggtcctttgtttttgagatggaatcttgctctgccggccagactggagtgcactggcatgatctcagctcactgcaacttctgcctcctgggttcaagtgattctcctgc

SEQ ID NO: 189458 - DNA, 601 bp, Human
catgtgggttatttcatgcccaaacctccccaccctaaaccctagcaattcagccctcctgagtttcccttttttggccggaaaggggcatacctggatattaaggtgattctaagttattattcatgagaagaacaggtcttttttttttttttttgagacggagtctcactctgttgcttaggctggagtgcagtggcacggtctcggctcactgcaagctccgcctcctgggttcacaccattctcctgcctcagcctcccgagtagctgggactacaggtgcccaccaccacgcccrgctaattttttgtatttttagtagagatggggtttcactgcgttagccaggatgttctcaatctcctgacctcgtgatctgccaaccttggcctcccaaagtgctgggattacaggtgtgagccaccacgcccagcccaggtctttcttacattataatcacacatggctagaaattgagattctgtaccaaacaaaaaaaatcaaaaaaaaaaaaaaattcagacttctacttatgactctttagtgtttgacaagtacatcattaacttttgcataggaagtactccctagattgtcc

SEQ ID NO: 189459 - DNA, 601 bp, Human
aaaaaaaaaaacaaaaacttaagattattcctaaagcattccttccacatccctatcttaataaaatggagaaaacagcaaagactcagtaaatactaacatgtgggttatttcatgcccaaacctccccaccctaaaccctagcaattcagccctcctgagtttcccttttttggccggaaaggggcatacctggatattaaggtgattctaagttattattcatgagaagaacaggtcttttttttttttttttgagacggagtctcactctgttgcttaggctggagtgcagtggcayggtctcggctcactgcaagctccgcctcctgggttcacaccattctcctgcctcagcctcccgagtagctgggactacaggtgcccaccaccacgcccagctaattttttgtatttttagtagagatggggtttcactgcgttagccaggatgttctcaatctcctgacctcgtgatctgccaaccttggcctcccaaagtgctgggattacaggtgtgagccaccacgcccagcccaggtctttcttacattataatcacacatggctagaaattgagattctgtaccaaacaaaaaaa

SEQ ID NO: 189460 - DNA, 601 bp, Human
tggccagttcaaaggcctaaaaaaaaaagaggacagtatatgaaagcacaaaagaaaagaaggcctttggaaagctgattgctatttggctcaatatgaagtaactcttgttcccttgggaaaacttatagatcattaaaaaaaaaaaaaaaacaaaaacttaagattattcctaaagcattccttccacatccctatcttaataaaatggagaaaacagcaaagactcagtaaatactaacatgtgggttatttcatgcccaaacctccccaccctaaaccctagcaattcagccctccygagtttcccttttttggccggaaaggggcatacctggatattaaggtgattctaagttattattcatgagaagaacaggtcttttttttttttttttgagacggagtctcactctgttgcttaggctggagtgcagtggcacggtctcggctcactgcaagctccgcctcctgggttcacaccattctcctgcctcagcctcccgagtagctgggactacaggtgcccaccaccacgcccagctaattttttgtatttttagtagagatggggtttcactgcgttagccaggatgttctc

SEQ ID NO: 189461 - DNA, 601 bp, Human
tgttttgcacactaacaagactaaggctcttcggtactaacaaatgatgttagcttaatgtggaaagtgtaaataccacgcacacacatccatggttaaggggactcaccttcatctcgagtgtactcttcccctgaatgaggttcaaacaaatagtcacctgtggccagttcaaaggcctaaaaaaaaaagaggacagtatatgaaagcacaaaagaaaagaaggcctttggaaagctgattgctatttggctcaatatgaagtaactcttgttcccttgggaaaacttatagatcattwaaaaaaaaaaaaaaacaaaaacttaagattattcctaaagcattccttccacatccctatcttaataaaatggagaaaacagcaaagactcagtaaatactaacatgtgggttatttcatgcccaaacctccccaccctaaaccctagcaattcagccctcctgagtttcccttttttggccggaaaggggcatacctggatattaaggtgattctaagttattattcatgagaagaacaggtcttttttttttttttttgagacggagtctcactctgttgcttaggctggagtgcagt

SEQ ID NO: 189462 - DNA, 601 bp, Human
gggcttatatatacaaaatatgtccaaactctacccacttaaataggcattcatgggaattacatagcatagcattttccaaatggtattcattaggaatattagcaggtcctactaacattacctattaatatcccagaagaccacattttgagaaacaaagagcactcttggttccatacagcatgaaatatgcattcccaaagattcaaggaaagcacaaaaagtaaagaacatgctctacattgggagggtagatgctgtagtgatatctcaaaataatcctcattaatcctacaamtaaaacataagctgcctcaactgtataaaacattttcttggctgagcgtgatggctcacgcctgtaatcccagcactttgggaggctgaagtgggtggaccacgaggtcaagagacagagaccatcctggccaacatggtgaaaccccgtctctactaaaaatacaaaaattagctgggcatggtggcacaagcccgtagtcccagctactcgagaggccgaggcaggagaatcgcttgaacgagggaagtggaggttgtagtgagccgagatcgcaccaccgcactccagcctggcgac

SEQ ID NO: 189463 - DNA, 601 bp, Human
aacagcatcggtggggctgatgtttgacctaaggactattagtactaactggtataggatggaataaattagaatttaaacatctagggaagatggtttttccttgtccccttatttgggactctgcatatgtattaaaattttcaggtttggtagcataaggtaacacccgatataattctagccactatatgtgttctgtaccacacactaccatttatggagaatctagggaagtaaaggggaaaaaaattaattaccctcccaaacaaacatagtaggtagtctctaggcctataaycccaaacactgtaagcctataaccctaaacctataacccagaaaaatagcaagcagagagtaggtaaaatcaagtagtaattatagtatcctctaacatggggcttatatatacaaaatatgtccaaactctacccacttaaataggcattcatgggaattacatagcatagcattttccaaatggtattcattaggaatattagcaggtcctactaacattacctattaatatcccagaagaccacattttgagaaacaaagagcactcttggttccatacagcatgaaatatgcattc

SEQ ID NO: 189464 - DNA, 601 bp, Human
agaactattatttgtgatcattctgtctcagcctccccagtggctgggatttcaggcatgtgccaccacacctggctgacttaaaacattttttgtagagatgaggtcttggcatactgccaagctggtctcaaactcctgggctcaagcaatcctcctgccttggcctcccgaagtgttgggattacaggcctgagccaccacctggctgataccccattttaaagatgagaaaatagaacttcaaaaagcatgaatggcctaacttgaaacttcagggctaatatgagctaaaactcaratgaaaaccaatgatcttatgtcttgtctaaagcttttaatttcttcctaaaatcactttttaaaagtaaagattagcacaaacattttaaagtatagctgcttgatgatctgtaaacatcacagtatgaatatggaccatgagcacaaccagggaggcatgcagcctcttaaccaggaggtgagtctgggaccaaccagtacacacacctcaggtagatctactgcccccccccttttttttttctctctgcaggtgacagaaattaagaatataaaacttttttttttttttgagatg

SEQ ID NO: 189465 - DNA, 601 bp, Human
tctggcaagtcccattctggattttggaggcttatcttcatctttagttctattttgtctatatatctaggttcaggtaggttctttaggtaagataaaaaactgtccaaatatgtgttaggcattctagaactattatttgtgatcattctgtctcagcctccccagtggctgggatttcaggcatgtgccaccacacctggctgacttaaaacattttttgtagagatgaggtcttggcatactgccaagctggtctcaaactcctgggctcaagcaatcctcctgccttggcctcccsaagtgttgggattacaggcctgagccaccacctggctgataccccattttaaagatgagaaaatagaacttcaaaaagcatgaatggcctaacttgaaacttcagggctaatatgagctaaaactcagatgaaaaccaatgatcttatgtcttgtctaaagcttttaatttcttcctaaaatcactttttaaaagtaaagattagcacaaacattttaaagtatagctgcttgatgatctgtaaacatcacagtatgaatatggaccatgagcacaaccagggaggcatgcagcctctta

SEQ ID NO: 189466 - DNA, 601 bp, Human
tctgtgactgaagaagtcttgtgaatatttcccactgagggaaaagcgtcttggaattctgcctatcagctctataatgtgcacaatgtggtctaaaatagaagggtaagaagaacagatcaaggacaagctgtaaaagaggtttttctatgaatagctttttcaaggactagctgtttaaaagtaactacaaataaaaccaaggatactgaaggaagactgactgggaaggccaagaattatttcaggtggttggtcacccgatagtgtctggcaagtcccattctggattttggaggcytatcttcatctttagttctattttgtctatatatctaggttcaggtaggttctttaggtaagataaaaaactgtccaaatatgtgttaggcattctagaactattatttgtgatcattctgtctcagcctccccagtggctgggatttcaggcatgtgccaccacacctggctgacttaaaacattttttgtagagatgaggtcttggcatactgccaagctggtctcaaactcctgggctcaagcaatcctcctgccttggcctcccgaagtgttgggattacaggcctgagccaccac

SEQ ID NO: 189467 - DNA, 601 bp, Human
aaaaccagaccatttcctagatgcttctaggtcaggttttcacatttcaggttttttttgcaatgcttaagaaatatattatcaagtcaaaaattggaagttttgtttttgtggttttttttgtaataacaaatacataaaactaaaaagtgtgaagttcgtttgtatgactaatgtacttcgagtgactgtgttaggtgtcactgggatgcaaagatgagtgagatgtagtccctgcccttatgtaagaagcttaaattacctgccctttggtagaggcagttcttagaccaaacgccarcaaaaaatttgcccatttttcagaagtgctatagaagtaatcaaccaactgcatgcaggcactatacatattaactgttagtaagaagtatactttattattatctccattaagaaatcagcaaactgaggcacagttagatcctgtcaaaggtcacatggctagtggagtagccaggatttgacagtctggctccagtctctgctcttttttttccccgagacaggatcttgctctgttgcccatgctggagtgcagtggcaatcatggctcactgcagccttgacctcccaggctcaa

SEQ ID NO: 189468 - DNA, 601 bp, Human
tatctccaaaccaccccccaacccccccatccattgaaaaactgtcttccacaaaaccagtccctggtgccaaaaagattggggaccgctgctctacactatactggagtatcaacctaattgcttctttgaagtgacaactttttaaaagatagtcaattattaatagctaaggcaaatgctgctttaaaattttaagttggccaggcacagtggctcatgcctgtaattccagcactttgggaggctgagtcgggtggatcacttgagctcaggagttcaagaccagcctgggcaacayagtgaaaccctgcctctaccaaaaatacaaaaaaattagctgtgtatggtggcacatgcctgtggtcctagctacttgggaggttgaggcaggaggatcatttgaacctgggaggtggaggttgcagtgagccaagatcgtgccactgtactccagcctgggtgacagagtgataccctgtctcaataataataataataataataataataataattttttttaaacataaaaattttaagtctcttttgtgagcagtgagtgcctatttgattacctacctggtaaacacacatgcct

SEQ ID NO: 189469 - DNA, 601 bp, Human
gcccaatggctgtggggatctccacagggtcaagtaagcaaacccaaatgaacatgttggattaaaaaaaaaacaagatctagaaactcttgaaggaagagcttcaccctgaaaagggaagaggaaaatgcttgaaggggaagggcggagggtcagtgtgtgatctctgctgtggtgctgggcaggggcttaggagttaagccaagggtgccggagacactcggcggcagtggctctcttctcagggatcagctccaacatgggcagtaagaaatctgtgaagccagctgcctcttcctgmgaccactcatacttctccactagaacctcaaaaaggccccaaggtttcagcttcgtgatatgtttcaggtcacctgcagtgaagacagtacagaaaaagccactgatcaacacagacaaatgacaaggtactcttgtggaaacccacaaactaacccatgtagtctatgaggaatcaaattttgcaatcagaatctaatccttcattcacaaagcatttcttttctgacatatgcctcagaaagaagtgcctctattcttcatacggctccaaaaatttaaggtaatttgttttctcccc

SEQ ID NO: 189470 - DNA, 601 bp, Human
gccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagag

SEQ ID NO: 189471 - DNA, 601 bp, Human
gggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgarcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgc

SEQ ID NO: 189472 - DNA, 601 bp, Human
ggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctrtttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacagga

SEQ ID NO: 189473 - DNA, 601 bp, Human
gtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcrcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgcc

SEQ ID NO: 189474 - DNA, 601 bp, Human
gtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggyaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccc

SEQ ID NO: 189475 - DNA, 601 bp, Human
gctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagayccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagc

SEQ ID NO: 189476 - DNA, 601 bp, Human
aaaacagaagatttaaaggccgttcttgtcagtggacagcctttttctgaaaggattttaatgatggtacctctagctcctctgatttttatttttaacacactgtatctttttacttctggatgagttaagtaaagaagtattgatggttgtcagtgatcaaatagtaagtgggtctaaaattatgtatttgtctttgaactctaaatgaagcaattctgacctgtagatttttgagacaagcataggcatatgtttgttgcctgactagctaatgaaaacagcattttccccaattataaaaaaaaggtatatacttactattggaaaaaaaatccagatgatgaagaaaatatagagaaacacccaaaattttgccatccaccctaagtcagctactttcattgttgtggtgtatattgttccagtcttttctgcctgcctgtgagtgtgtgtatttttataaaaccgagatgattatacttgttattctacagcctgccttttccaacaatatattgtagagagatctccatgcctataagtattgatctgtatcatttttcttggctgcgtagtattttattgaaagaatgaggtt

SEQ ID NO: 189477 - DNA, 601 bp, Human
aactaatttcgggttgcttaaaatatgtaactgccacgtgcatagcttttcataacttgtaaatgatacatacttattaatcctcatagtaactttctgaggtgaacaaaataaaaagtttttttaatttgcaagtaaggaaatggaggttgtttgatattaaaagatatccataagtcatatacttggtgagtattgaggctgagactagttttctgactcaagtttagtatttttgttaacaatatttcccagaagggcctgataaaataaagaagagtgggtgtgggtgtgggtgtgkgtgtgtgtgtgtgtgtgtgtgtgtgtaagtgtctgtctgtttcggttttcatggtctgagaaatttttccccaagggaaacattaagactaaattttttttgtaacaaatacagagatgtttgaagtaaagtgattccccttgatgtttctgctttccagtctcatctcacttagggaaccactgctcatggtttgctgtatatctttccaaatggttctctgtgattattgatagaaatgtataaacgtaaaataggattttttctttttttgtattttatagaaaaagatcatgctat

SEQ ID NO: 189478 - DNA, 601 bp, Human
tagagcttgctggtttattttttctttctttttctttccctgcgtacattcctagtagtaagtggagaatccagtgaaatttcccctaacagtgtcatgaaaacaagtactcttaattccgctaatactaattctcccttttcgggttaattatcattggaattcattacggtatcctttcccttttattgatagagttaacattagtgtttcaaaagattattttacatatttttttaaacttcatttggcaataaatttttttttttttttttttgagatagggtcttgctctgttgcmtaggctggagtacagtggcatgatctcggctcactacagcctcaactccctgggctcaagtgatcctctcacctcagcctctcccaagtagctggaactacaggcacgtgccaccacagctggctagttttctttattttttgtaaagatgaggtctcactgtgttgcccagggtggtctcaaactcctggactcaagcagtcctcccacattggcctaccaaagtgctgggattacaggcatgagccagcacagccagcctaataattttaaacatacagaaaagttgcagaagtatta

SEQ ID NO: 189479 - DNA, 601 bp, Human
ttaggcatgaatatcccattctggatcaatttgtggccactatttccccctccactccctgaaagatttgttttgcttagctaagcaaatccaatcgtgttggacaaaattattcaggaacatgagaagggagaagctagtctgtttatctttaacataattgctgatatgtttgagtttaaatctgccgtctttcgtgtttcatctatttttttttatcctccattcttgccttcttttagatgtattccagttcatcctaggatttgcttattagttacacattctttaaaaaattccrtttagtaggccagtcatggtggctcacgcctgtaatcccagcactttgggagaccgaggcgggcagatcacgaggtctggagattgagaccatcctggctaacacggtgaaaacctgtaactactaaaaatacaaaaagaaattagctgggcgtggtggtgggcgcctgtagtcccagctactcaggaggctgaggcaggagaatggtgtgaacctgggaggtggagcttgcagtgagccaagatcctgccactgcactccaggctgggcgacagagcaagactccgtttccaaaaaaaa

SEQ ID NO: 189480 - DNA, 601 bp, Human
tgagtttaaatctgccgtctttcgtgtttcatctatttttttttatcctccattcttgccttcttttagatgtattccagttcatcctaggatttgcttattagttacacattctttaaaaaattccatttagtaggccagtcatggtggctcacgcctgtaatcccagcactttgggagaccgaggcgggcagatcacgaggtctggagattgagaccatcctggctaacacggtgaaaacctgtaactactaaaaatacaaaaagaaattagctgggcgtggtggtgggcgcctgtagwcccagctactcaggaggctgaggcaggagaatggtgtgaacctgggaggtggagcttgcagtgagccaagatcctgccactgcactccaggctgggcgacagagcaagactccgtttccaaaaaaaaaaaaaaaaaaaattccatttagtaaaaaggaaaaaatttagtggttaccctgagaaaatgaaaatttttcagtcttaaggccctttttttttttttttttcttttccactttcaaccctgagaagctaagtatcataatcttaatataaccttttggttttatatatgctgtt

SEQ ID NO: 189481 - DNA, 601 bp, Human
tttttttttttttttttcttttccactttcaaccctgagaagctaagtatcataatcttaatataaccttttggttttatatatgctgtttttaagatatgaaattactttttataaagttagattgtcaatcttttttcttttctttgtgggaggactttgatatcataccaagctcttccactcaaggttacatagttacctgtattttctcctaacacttttatgttttgattcttttttttttttttggagaaaatacatttgaatgatataacttacgatgatggtataatagttygttgaatttggccattttgtatatagtataatagctttgttgaatttggtcattttgtatatagtaggccacagtaattggtgagagttttgaagtgtgaagatgtgtgatttctaatatgtaattacaattaaaagtataaaaccaagaagagagtcttttgcaaatttggagaatggggatttatcttttctgtctctacaactatctagctatgcaccctaaacaatgtgcttaaagttttttttgcacctacaatttcctcagccctaaattaatcttgtttttaggtctcaatgc

SEQ ID NO: 189482 - DNA, 601 bp, Human
tggccattttgtatatagtataatagctttgttgaatttggtcattttgtatatagtaggccacagtaattggtgagagttttgaagtgtgaagatgtgtgatttctaatatgtaattacaattaaaagtataaaaccaagaagagagtcttttgcaaatttggagaatggggatttatcttttctgtctctacaactatctagctatgcaccctaaacaatgtgcttaaagttttttttgcacctacaatttcctcagccctaaattaatcttgtttttaggtctcaatgcttttgagtytcaatgagtcctgctttgagggtgatgaaaacgtgagaaacatgtaagaacacattgaagattatgtcagatgcggtcatattcctattgataatatcattaagaggagctgtttttataggagttaatatttaatgataaattgtagtatattggggttgcagattgctgactatagtttatcagaaggtgggaggaattctcttagtttccttcttcctcattcataaagaaactgggtagtttttattttaggaagagctctctagtttggtcagctggctgttatgtgaacttatc

SEQ ID NO: 189483 - DNA, 601 bp, Human
attaaaataaacagggaatagtagttcacctgaattgatgaattatatatttaatgattgctttctacatacaggtttactcagtgtttattgaacatgtgtcactgaggatatagcagaaaaagaaatctcatagaatttgtattctagtaaaaacctatttttttttaatagagaaataaaatagagtaagtagagagcaacaaggaatattggttagaaatgtctctgtgaggaaggatgtttgagcagccgtgcttggagagagaatatctgagggaagaacattccaggcaatgasaacagcaaagactaggagggaatgttcttagtgagtgcagctgggttagaataagccagtagaaaactagaggaaaattaagaggtttgtaggaggcatatcatgtgaggactttggactttgacttgtgggaattcattggaagattttgagtacaagagtgatttgttcttttttccaaaggatctctcttagttgctgtatggagaagagattgtataaaagggacaagagaagccaaaataccgattagaaattatgcattaatgcatggtagtggtaaattggactagagtagag

SEQ ID NO: 189484 - DNA, 601 bp, Human
gacatataaaattgaaacctcaaggatgaaaataggcattcatagctgggcgtggtggctcaggcctctaatcccagcattttgagaggctgaggtgggtggatcacgaggtcaggaattcaagaccagcctggccaacatggtgaaaccccatctctactaaaatacaaaaattagctgggtgtggtggcacatgcctgtaatcccagctacttgggaggctgaggcaggagaatcgcttgaaccagggagtcagaggttgcagtgagctgagatagtgccactgcactccagtgtctcaaaaaaaaaaaaagggacattcaccatacagaggggttggattagagtgaaaagtgttcccaaaccaacgaaaagagtatgtgaagatctagaagtagaagtctttgaatggatcctttggagatgagggaggcgggcagagttgaaagagtagtggaagtcaacgtaagggtcttgtgaggcatggtaaacagttgttttgaaagtaaggcctgggctgggtgtggtggctcatgcctgtaatcccagcactttgggaggccgaggtgggtggatcacctgaggttgggagtttgagatc

SEQ ID NO: 189485 - DNA, 601 bp, Human
agtaaaagttatcctggcaaaaaggaaaatttaataattaatataattttagtgagtcatataaaagtgatgctatatattgctaattataatttatatcttggtctagagcagtgattctgagtctttttttgtggcaggttcctcaaagtattaagaattgtacccaaggccgggcacggtggctcatgcctgtaatcccagcagtttgggaggccgaggcgggcggatcacctgaggttgggagttcgagaccagcctgaccaacatggagaaaccccgtctctactaaacatacgawattaactgggcatggtggcgcatgtctgtaatcccagctactcgggaggctgaggcaggagaatcgcttgaacccgggaggcggaggttgtggtgagccgagatcatgccattgcactccaccctgggcaacaagagcgaaactccgtctcaaaaaaaaaaaaaaattgacccaaagctgagaaaattaatttaaaaatccaaatattttatgtgatccatcagagaaccctcaaagaaatgagtataggatgttgacatatgactaaaaggatggtggtaatttggaaggttgagagaa

SEQ ID NO: 189486 - DNA, 601 bp, Human
tgattacacatagtagctacataaacagggaataaataggcaacggaactatgaaactggggggaaatgctcaatatataaaccttaccttaaatagattattatttggctatagaaatgggatatatgtacttaattacctttatacataaatgttctatcaacatcagcagatcaaacactgacagtgtgttgtatagtggattcacagagggagaagactagaaaacgtaagacgtgaccccacctgtgtgtctagtgcagcttacactgtagttataaacacaccttaaatgatcamaatatttcgtatagcttggtaacaaataaatgacaaaatccagaatgtgaccattgccatgtgacttggacagtgattgctgtaaaagttcagctgcttaagcagggggaaagtcagcttcttagagaaaagatagtatttgaagaatgatttgaatggtagaaatgacatgaggatgatgacctttcaagtggactagagaggcaaggacaaagtataagatatcttcaaaagaaaggacatcttttttggctaaagcagagaactgttgtggtgaaaaataagaatttaggttgcaga

SEQ ID NO: 189487 - DNA, 601 bp, Human
tacctttatacataaatgttctatcaacatcagcagatcaaacactgacagtgtgttgtatagtggattcacagagggagaagactagaaaacgtaagacgtgaccccacctgtgtgtctagtgcagcttacactgtagttataaacacaccttaaatgatcaaaatatttcgtatagcttggtaacaaataaatgacaaaatccagaatgtgaccattgccatgtgacttggacagtgattgctgtaaaagttcagctgcttaagcagggggaaagtcagcttcttagagaaaagatagkatttgaagaatgatttgaatggtagaaatgacatgaggatgatgacctttcaagtggactagagaggcaaggacaaagtataagatatcttcaaaagaaaggacatcttttttggctaaagcagagaactgttgtggtgaaaaataagaatttaggttgcagaggtacttgctaagagaccagccttttgaacatcattttagggtaatggaccaccttatgtttagagcataagaatgatagattcaaaaaaatatctgtggtattttaatctgttagaaacatttaccatattagatt

SEQ ID NO: 189488 - DNA, 601 bp, Human
atcattacatagatatgtggattaaaggaactttccttgtttactgtgaaaactgactttacagcctagaattttaaatggggaaatattatatgcctttcacaataatcactaacttagaaaaatgttgaactataattgcaagtagcagaaatgtgctgaaaaataccgcagaaggagagagaatgaagaaaatacagacgtgattaaattctgagctcttaacttgacccactgtagcaaaaagctagccgcaaaggtgctccataaatgcttcttaacagtgtggatgatgtcgccrggagctggatgttaacttgcggggtgggaaagatgaaagtatgctagaattacagaagaggagaaagttggaaggtattataaaaattaagtttttttaaataacaaaaattatttttgtttagatatttaaacaaagaattctagccagagttaaatcagagggtttctttagactcctgaatgtctgctttatgtcggagagaattgttctgttgtaaatgattataagtagtaccactagaaatagggattcattcatttttcttataattaagacatcttttaaataaatattttt

SEQ ID NO: 189489 - DNA, 601 bp, Human
acggtgaaagctcagtaaatattttttgaataggaaatatttgtatttattcatttctagtaattttcttaaggctgtccttaagtcatatatttaaaaattaatttgaggttactaattggtatgaaagtctgtatttatagagttttatactttcatgcaaaaagttcttcccttgaaaaagactcataatgcttttgaattagtatgccactgatcaagtagttgcacaagttggtaattttccaagggtaaagttgagcaggggggtgacctgtatttacccagctcctacttgtgycaggccccttatttatacacacacagagtcataggtaatcttctcagcacccttcttttacacatgagacttacagagatgaggtagtttgcacaggtcacaaagctaaataaatcatgcagccagaatttgaattagtctgactcctattctctttacattattccatgtggcctctttaaggtagagattatgtatgtctgtaccccacctgtgtctaccatgcaggaaaaatcatttcccattcttttgtaaatatcatgtttatcagtcttaagatactctattttattgattgag

SEQ ID NO: 189490 - DNA, 601 bp, Human
aattttttgtattttttgtagggatagggtctcgcttcattgccagggctagtcttgaactcctgggctcaagttatcttcctacctcagcctcccaaagttctgggattacagacgtgagccactgcatccaaccacaagataatctgtttttaatggtaaatattttataaagttgttgaaaggaatgagttaagcccaattccttgtcagttatttttcacttaaatacacatatttatcttaatccaaaaacggtttaaggcattttgatcttagagaagggaaggaaaaacaggayagattagtctctttttgagcccaaaagaatctctgtattgttttcagattattaaattttgcatgcatttttctgttttactttaaacggataaatgcaatacccatagctgcttttacatttttatatcacagtttttagaactatgtgaatattagttttttcatatttactttttattcacttgtcaaagcattgctatggagaagacctatactgtttgaaaatgcaggccgggcgcggtggctcatgcctgtaatgccagcactttgggagggcgaggcaggaggatcacgaggt

SEQ ID NO: 189491 - DNA, 601 bp, Human
aggaggatcacgaggtcaggagatcaagaccatcctggctaacatggtgaaaccccgtctctactaaaaatacaaaaaaaacaaaattagccaggcgtggtggtgggcgcctgtagtctcagctactcgggaggttggggcaggagaatggtgtgaacctgggaggtggagcttgcggtgagccaagattgcaccactgcactccagcctgggcaacagagtgggactctgtctaaaaaaaaaaaaaaaaaaaaaaaaaaaaaagagagagagagagaaaatgcactaacattagtcactrtgtttttaaggtatgattgacataacacttacctttgctatgtggtcttgaccattcaaatgacactgtctaaaattattcattaaatttgacatgattcttcaagtaacatgtaatttattagagtcttcattagtcatcaattgtatcacattttgtcatactggagaatttttagtttaaaaatttttttgtctgacaagcagcacgtaggacttcataagaaacatttttactagtgtttactttttctctactgttataagtagtcattttaagaattttggttatgggccgggc

SEQ ID NO: 189492 - DNA, 601 bp, Human
atagtaaaagcttaaaaactagggtggatgggagatgtcctgaattctcatctcagtaattgccttcaatttactttacagaataattgtaaacatcccagctgatatgatagtttaatcaacataactagtgttctatagttttattaattttactatattaaggaaatataaacttcaatatgaaataacctgtggtgttctataataatttcaccaatatttctttagtaagagtcttacctgtatgaggtacttcctatgcaaaaaaggtcactcgccataatgtattcaacagagygcaaagatagacattgatgttaattatacctgtgcacaaatcagagccctgccatttactaagattgtcaccgtgacaaataacttaaatctctctgagctttagtttcatcacttataaaaatgataactggaatccttactttgtagggtacctgtgaggattcagtaagattatgtatataaagttcttagcacaaatattatttttccttccttagatggtaggaggacatagaatggaatatgaaattgtctttactctaaaagagtttgcagtctaagtggagagtcttgtgaa

SEQ ID NO: 189493 - DNA, 601 bp, Human
caatatttctttagtaagagtcttacctgtatgaggtacttcctatgcaaaaaaggtcactcgccataatgtattcaacagagcgcaaagatagacattgatgttaattatacctgtgcacaaatcagagccctgccatttactaagattgtcaccgtgacaaataacttaaatctctctgagctttagtttcatcacttataaaaatgataactggaatccttactttgtagggtacctgtgaggattcagtaagattatgtatataaagttcttagcacaaatattatttttccttccytagatggtaggaggacatagaatggaatatgaaattgtctttactctaaaagagtttgcagtctaagtggagagtcttgtgaaccgttgcaaggtagagttaattgctataatagatgtgtaaaaataggtgtgctatatcaactgtacgagttcagataaagaaagtgcaggaacctagataataggtttctcttctaatattaatgaaagcccatgagagagttacataacagtgtttggaaaaatcaaatataatggctgcggaagaggtttcagtcctctattgtctatccagagt

SEQ ID NO: 189494 - DNA, 601 bp, Human
gcaaaaaaggtcactcgccataatgtattcaacagagcgcaaagatagacattgatgttaattatacctgtgcacaaatcagagccctgccatttactaagattgtcaccgtgacaaataacttaaatctctctgagctttagtttcatcacttataaaaatgataactggaatccttactttgtagggtacctgtgaggattcagtaagattatgtatataaagttcttagcacaaatattatttttccttccttagatggtaggaggacatagaatggaatatgaaattgtctttactytaaaagagtttgcagtctaagtggagagtcttgtgaaccgttgcaaggtagagttaattgctataatagatgtgtaaaaataggtgtgctatatcaactgtacgagttcagataaagaaagtgcaggaacctagataataggtttctcttctaatattaatgaaagcccatgagagagttacataacagtgtttggaaaaatcaaatataatggctgcggaagaggtttcagtcctctattgtctatccagagtgatgagaaaatgtaatttgccataagataaaatgacttttaagtgt

SEQ ID NO: 189495 - DNA, 601 bp, Human
gtatttttacatatgctaacatgaacagatacacagacgtatatgtatccaaaaagcatgggccatacacagtatcatcttttttttttttttttggagatggagtcttgctctgtcgcctaggctggagtgcagtgggtgtgatcttggctcactgcaacctccacctcctgagttcaagcaattctcctgcctcagcctcccgagtagctgagattactgatgcacacacaccatacctggctaatttttgtatttttagtagagatggggtttcaccatgttggtcaggctgatctcraactgctgacctcaggtgatccacccatctcagcctcccaaagtgctgcgattacaggcatgagctactgtgcccggcccagtatcatccattttttgccatgaggatacttccccgccccatccccaccaccaccccgtctgaggcaggaaaacaagcactttttttttctttttcttttctttttttttttttttttgagatagagtctcactttgtcacccaggctggagtgcagtggtgcgatctcgggtcactgcaacctccgccctccgagttcaagcgattctcctgcctcag

SEQ ID NO: 189496 - DNA, 601 bp, Human
cgggtggttccgccgaggcgcacgcagcgcccatgcaacaccccacagtatcgggccacctcggccgacccaaggcgacttgaccacgactccgcgggcggactgcgcctggccactagtggctccaaccgcggggtcaccctgcgggcacacagcgctctcctctccccactgctatctcctcgtccacgctgtcgtctgccgcccccacccagaagggatacaattttcgcccaacagggaccgtgggaatcccttgggaggggcgcagacggcttgtagcgcgcggtttcccgagacycgccgcgcatcccccagcgactggaaacccgccccaagcgccacgcggtcctcccactcttacccgaagtgtcccacaggctcaactctattctttgtgtgtcgatttcaaaactggccgtgtaattctcaaacactgtaggaacgtaattctggatagacaaaatgggcaaaagaggaaggaaagagggcaaagaggttacgtttaaacgcacgacacccattgaacacccttcccctccccgctccccagttaagaaagaaaaccttcacacatcagaccacacactaagcacatgga

SEQ ID NO: 189497 - DNA, 601 bp, Human
acctgatgaaatgcttggtttcctgcaatttcacagttgatattcaaatcccaagcatccatgcttctctggctccttcataaattcttaacctcttcctttctccaagaacgttaatttaagttataattctcagcttccagaatcttgttttatctgagagccactaaatgtaagcgagtttccacgtggaagaaacgttaaaaacttcttagaacttagtcaacttctagaaaggaagggaattgtggtgggcctcaatgaccattaagtcatgagttagggagcctgggctgccctkgtggccttcaagaactctttggatcttgttgctccttgaaaaatccaggtttagaacctccgggctcaccatcctataaacaggtattacagcactagacaggaggaagtctttctatgtcctctgtttgtcctgtgggtattcaaagaaggttgtcagggaagaaggatgtctttaccctgttcaaatctcagtctactggcatctcctctcacctaaacacctgacacttaatccgggcttctcatttgatttcttttgttagtttgggaaagcctgaatattttaaattttattgtc

SEQ ID NO: 189498 - DNA, 601 bp, Human
gtgtaagactgtttagttcttgtttcaagtagtctgcacaacaaataccatgcctgcaaatatgcaacaaacactcccaggaagaatatgtttgtttcttccatggattcaggtaataggaactatgaacagatcttataaaattttgtgggcatttatgtgttgctattaaaatggaataaagattttctatttctgggggcaatgtagatacaaaattagaaagtcagacaggtagatatgtttggcctttaaataaagtttagctttaaactcctaatcttattgaggtacttaaaaatatgtaagaatcaaaatattttactgacagtggaaccatggttaagtcaagagctttagggaaaagagtatatgtatatgaatatgcctaaaagtaaatagggataatggattcaagtttttgtttcatatgatatctaagaatcagatttcttggagtagaatcccatgagtgaattcatctttccacaaactatgtcatcaggctcatttttcaaaaccaatgtgcacaacacctggtcaaacttctgcgtcaactacattccgtgtcaataaaatgtttgctttgccaagggagact

SEQ ID NO: 189499 - DNA, 601 bp, Human
tctttttcagcatgtggaataggcttcatgcatatggaaattctcagatgcagcatttctctggtactatatgaaacttttaagctcgcaaccctattccaaggtcctttttaagtaacctgccacacctctgaaggaaaaacttagggaaactctatattgtaaagaaacaactacactatatatgcaaaatgtgtaccccgctcacccagaaaatatagttgaaaggctttgctgggggtagattggaacaagtgtacacttggggttctctgagttgctcaagtttggcaaacatcarcaaagttctagagagcttttgaaatttcagatctacccatctttgtattcaagatcattaattctgggtgagagcaaaatttccagccaaagaatagtcacaacgtgcctcacccagaaactaattcttcagacacatacctgcctgctgaagtcaccctttcgcaaatatagaacacaccatatatgtacataattaaatgtatatgtaagaagattcatgcccaaaaggaaggctttatggaaccttttgcaaagtaccagtttaaacactgtgaggctttagaggagttggagaact

SEQ ID NO: 189500 - DNA, 601 bp, Human
tctaaatatctgcaaaatttagactctggcctgattttaaaatgaaacggagttctccagttaaaccagattttcagggaagtttgtatctgcttttgtttttatccggttaacagtataagtgaaaatacatatgtagtgcaaaggtttatgagaaataaaccaccgtgcttgtggaggtagacaggtaatttttaagaggtttaacatgatctaattagggatgacactttgatcccattctattacttttgctaatgaacagtgctgcttttagatcaacacgagtgtccaaaggtamtagtaaaactgattcccatatttcttagttataagcataatttgactgccaatgacaagagtaatttatttaaaataacaagaccatttattcactatatttttgataggttaagtttatcttgtcttagatagaaatatctattgtctctatttattcacagtgaaaaatattgatatagaattatcaagaactgtcccaccaggaaagatgtaagtcatcagctcagcaggactttcaggataaaaaaaaaaacaaagcaaaacaaaaaacaaaaacactcacacacaaaaacacctc

SEQ ID NO: 189501 - DNA, 601 bp, Human
ccctgtggagagcttccagtacaagcagacctggtatctttagagaactgttccaggtgcctaccagctcctttcaggatacgatttgtatgatgttagagtactcactgctaattccagatgtaatactgctctatgacaatggagaccatcttttccaaataaaaaaattaggaaaagcgattgaagaaatacaaagaggataaaagagtttaattaaaattgagactgccaggaaaatcctgaggaatggtttcaacattcaggccaccacatgactgctgggaatacccctcccccstttgtggactatgtttcccgtcccccacccattttatggccacaaaggagatctggctttgtgctcagccctgagtcacctgctggagactgctacctactaaaatcaagtgggctggcttctgtgcttagtgcatatatctaaatatctgcaaaatttagactctggcctgattttaaaatgaaacggagttctccagttaaaccagattttcagggaagtttgtatctgcttttgtttttatccggttaacagtataagtgaaaatacatatgtagtgcaaaggtttatgagaaataa

SEQ ID NO: 189502 - DNA, 601 bp, Human
gctgtaaacatttgaatgactctttccaaacaggcagtcagaaaattctagatcatagagtggagctccaaatactggacatataaatgagagtttcctctactcctcaaagtccgcgagagacaacctgatcccagacccaggaaggcaaagctgccaacagttaggattgtcagaaacctaacgaggcttcagagatctcctttcccagaaatcactcacattaggaaaaaccactctctccctgtggagagcttccagtacaagcagacctggtatctttagagaactgttccaggtrcctaccagctcctttcaggatacgatttgtatgatgttagagtactcactgctaattccagatgtaatactgctctatgacaatggagaccatcttttccaaataaaaaaattaggaaaagcgattgaagaaatacaaagaggataaaagagtttaattaaaattgagactgccaggaaaatcctgaggaatggtttcaacattcaggccaccacatgactgctgggaatacccctcccccctttgtggactatgtttcccgtcccccacccattttatggccacaaaggagatctggct

SEQ ID NO: 189503 - DNA, 601 bp, Human
ataaattcaagaagagggccaggatcttaagtgaaatctgtatggttcaaagactagggcctgaagttacctgggtgaagtagggaagcacctggggccaggtggtcttgtgtgtaaacctgcctccaccactaaaaagggagggggcaaggtagctttaggaccctgtgcctctgattcttcactcataaaatgaagatgctgacaacatacatacctgagattaagtaaacccaggcagggcctggcttttagtaagggatcaatacgtattaactatgggcattatggttgtattacygctgttaaaagctgagtggtagcaagaaccataaactgaactacttcttgggaaagagaccaaaactcaagatcaattctgacagcaggataggggtgaatgagggagagaggaagaggaagggttcaactatgcaaagagaaaccacatcagtgttacccatctccaagatgtaagtttacataggccattgacctttgagcttgcttattttaacttatcgccaaaccctatatagattttcttcctgttacaatcaagaatgtaataaatgtcgtataggatcatgtcgctttttta

SEQ ID NO: 189504 - DNA, 601 bp, Human
gagtctcaactgctgaaggtcaagaaacgccccttcctcccactggcctccctagttcctgtgacccatcctgtaataggtcctcttcctcttgatctccccctggttccttccaaccatagcttccttagttaggttcctacggaacctgacttacctttgcctccataaactatgtgtacattataatatataacatgtttacaagcactgcttccatattactagaaagatacctggtcataattactagacagatacctgatcatcagacaattcacattggacacatccctattcmtcctacactagttccatttctgtttctaataacaccataactaaaacacagcttctttgttaaaatagccattattgcattcctttcactatctgacttgaggtcaaatgtaaatctgtaaactaagatgcaatctgttgagtcactgaaagaaggaaggaacacatgaatatgatagtaatcaaatataactgttgttagctgtaccatttttctcccaaaggacaaacatgaaggcccttaaaaggtattttgtttcagagcttcatgaaataaaatttcaagcaagttcatcatcaa

SEQ ID NO: 189505 - DNA, 601 bp, Human
tgagtctcaactgctgaaggtcaagaaacgccccttcctcccactggcctccctagttcctgtgacccatcctgtaataggtcctcttcctcttgatctccccctggttccttccaaccatagcttccttagttaggttcctacggaacctgacttacctttgcctccataaactatgtgtacattataatatataacatgtttacaagcactgcttccatattactagaaagatacctggtcataattactagacagatacctgatcatcagacaattcacattggacacatccctattyctcctacactagttccatttctgtttctaataacaccataactaaaacacagcttctttgttaaaatagccattattgcattcctttcactatctgacttgaggtcaaatgtaaatctgtaaactaagatgcaatctgttgagtcactgaaagaaggaaggaacacatgaatatgatagtaatcaaatataactgttgttagctgtaccatttttctcccaaaggacaaacatgaaggcccttaaaaggtattttgtttcagagcttcatgaaataaaatttcaagcaagttcatcatca

SEQ ID NO: 189506 - DNA, 601 bp, Human
ataaggcagaggcaacactagcacaagtatgcattccctgatcccatcatgaaacactgaagcatgccaccacgagctgaggctctattttaagtacctgagatagttaataaaacagaacatcctgccttgaaggagtttctgttcacatggttgcatcaacacagaccatgacatttgcaaaggaacatctcttgggtcatcgggaaggcagctggtcctgtagctcatatgccttcaagttagtttaaaactatttcaatctattccaatttgtctagttgtttcatgatctaacaakaattattagaaccttcagcaatgcctggcttggaattccaactgtcctctttaagaacaagcaagcagctttttgtggcttcatttcctcaagcttgagctctgcaacagcatgggagtcaagagttcagggcggtcacaggagatctttggcctttgagggcagggcctagagaggctgagatggggaagtggcgcctgactcttcccacccacattcacaaatatgtaagtgttctactaagtactgtggcagtgacaatgatgactaagacatagctgtgtcttctggaaggaaatt

SEQ ID NO: 189507 - DNA, 601 bp, Human
gaaatgtatgtgattgtgtcttacttagggccgaaatgcgttgaggaaaggaataatactattgtaacatctgttactttatgaaacacaacatatgtaatttctaagtgtgaaccataccaccaacgtacacaacaataagcatgtgcacattaaccaaaactacttatttaaaataccaaattttttgctaatgagaaatggaagactaagaagactgcggtatttaaaatgatgattcttaataaaattttggtatttcaacatgaactctctttagaatctggttgtaggttttatragaatgagcttttgaaactgattctcatttctaaatacttgggggaaatgcttacagaaatgaagactctctgaaagatggtgttatggagtgttccactttactggcaacagccttattattgtactgccgactgtaaaatcagattacccctcttaaagagtattactgattttgaccacattctctcttaaacctatttaactttaaacctactgggaggtgcagaaatatacaaggttagcatatcaactgtttatgtacccgaatatcatgtaattacactaataaatgacagca

SEQ ID NO: 189508 - DNA, 601 bp, Human
tctggtctgctaggcatgtgtgaaatccgctttgtggctctctgtgatttgttccgcttaacgtttttatttgtcttatttacacatgccaaggtggcaacgtgaaaaatgtctctgacgctattttccgactgtaaagctgagcattcgatataagtagctgctccaatctgtttggccatatttgccccctgagaagcaaaagaagggattttaaccagcaataagactttgggggaaagttagctagcatcttctaataccacaaaataataacacattgcaaaacgtttgctgataygttaactgaattttccaagtgtcattgcaaaaaaaaaaagttgttaaaatgtaaactgccttatttattacttcataactatttgcagtcaagagcccatccctaagatgcccaactctcatggctcattagaggtgttagagctctgaataaatgctaaaggctgatcttaacaaaggaagaccctggttatcaaacacttaacatgaggtgattcaaagaagtgtagagtggagctaacgaagtgattcatcttcactatcaactgcaagcaagagttaactggttattcaggttttc

SEQ ID NO: 189509 - DNA, 601 bp, Human; identical to SEQ ID NO: 20276

SEQ ID NO: 189510 - DNA, 601 bp, Human; identical to SEQ ID NO: 20277

SEQ ID NO: 189511 - DNA, 601 bp, Human; identical to SEQ ID NO: 20278

SEQ ID NO: 189512 - DNA, 601 bp, Human; identical to SEQ ID NO: 20279

SEQ ID NO: 189513 - DNA, 601 bp, Human; identical to SEQ ID NO: 20280

SEQ ID NO: 189514 - DNA, 601 bp, Human; identical to SEQ ID NO: 20281

SEQ ID NO: 189515 - DNA, 601 bp, Human; identical to SEQ ID NO: 20282

SEQ ID NO: 189516 - DNA, 601 bp, Human; identical to SEQ ID NO: 20283

SEQ ID NO: 189517 - DNA, 601 bp, Human; identical to SEQ ID NO: 20284

SEQ ID NO: 189518 - DNA, 601 bp, Human; identical to SEQ ID NO: 20285

SEQ ID NO: 189519 - DNA, 601 bp, Human; identical to SEQ ID NO: 20286

SEQ ID NO: 189520 - DNA, 601 bp, Human; identical to SEQ ID NO: 20287

SEQ ID NO: 189521 - DNA, 601 bp, Human; identical to SEQ ID NO: 20288

SEQ ID NO: 189522 - DNA, 601 bp, Human; identical to SEQ ID NO: 20289

SEQ ID NO: 189523 - DNA, 601 bp, Human; identical to SEQ ID NO: 20290

SEQ ID NO: 189524 - DNA, 601 bp, Human; identical to SEQ ID NO: 20291

SEQ ID NO: 189525 - DNA, 601 bp, Human; identical to SEQ ID NO: 20292

SEQ ID NO: 189526 - DNA, 601 bp, Human; identical to SEQ ID NO: 20293

SEQ ID NO: 189527 - DNA, 601 bp, Human; identical to SEQ ID NO: 20294

SEQ ID NO: 189528 - DNA, 601 bp, Human; identical to SEQ ID NO: 20295

SEQ ID NO: 189529 - DNA, 601 bp, Human; identical to SEQ ID NO: 20296

SEQ ID NO: 189530 - DNA, 601 bp, Human; identical to SEQ ID NO: 20297

SEQ ID NO: 189531 - DNA, 601 bp, Human; identical to SEQ ID NO: 20298

SEQ ID NO: 189532 - DNA, 601 bp, Human; identical to SEQ ID NO: 20299

SEQ ID NO: 189533 - DNA, 601 bp, Human; identical to SEQ ID NO: 20300

SEQ ID NO: 189534 - DNA, 601 bp, Human; identical to SEQ ID NO: 20279

SEQ ID NO: 189535 - DNA, 601 bp, Human; identical to SEQ ID NO: 20280

SEQ ID NO: 189536 - DNA, 601 bp, Human; identical to SEQ ID NO: 20281

SEQ ID NO: 189537 - DNA, 601 bp, Human; identical to SEQ ID NO: 20282

SEQ ID NO: 189538 - DNA, 601 bp, Human; identical to SEQ ID NO: 20283

SEQ ID NO: 189539 - DNA, 601 bp, Human; identical to SEQ ID NO: 20284

SEQ ID NO: 189540 - DNA, 601 bp, Human; identical to SEQ ID NO: 20285

SEQ ID NO: 189541 - DNA, 601 bp, Human; identical to SEQ ID NO: 20286

SEQ ID NO: 189542 - DNA, 601 bp, Human; identical to SEQ ID NO: 20287

SEQ ID NO: 189543 - DNA, 601 bp, Human; identical to SEQ ID NO: 20288

SEQ ID NO: 189544 - DNA, 601 bp, Human; identical to SEQ ID NO: 20289

SEQ ID NO: 189545 - DNA, 601 bp, Human; identical to SEQ ID NO: 20290

SEQ ID NO: 189546 - DNA, 601 bp, Human; identical to SEQ ID NO: 20291

SEQ ID NO: 189547 - DNA, 601 bp, Human; identical to SEQ ID NO: 20292

SEQ ID NO: 189548 - DNA, 601 bp, Human; identical to SEQ ID NO: 20293

SEQ ID NO: 189549 - DNA, 601 bp, Human; identical to SEQ ID NO: 20294

SEQ ID NO: 189550 - DNA, 601 bp, Human; identical to SEQ ID NO: 20295

SEQ ID NO: 189551 - DNA, 601 bp, Human; identical to SEQ ID NO: 20296

SEQ ID NO: 189552 - DNA, 601 bp, Human; identical to SEQ ID NO: 20297

SEQ ID NO: 189553 - DNA, 601 bp, Human; identical to SEQ ID NO: 20279

SEQ ID NO: 189554 - DNA, 601 bp, Human; identical to SEQ ID NO: 20280

SEQ ID NO: 189555 - DNA, 601 bp, Human; identical to SEQ ID NO: 20281

SEQ ID NO: 189556 - DNA, 601 bp, Human; identical to SEQ ID NO: 20282

SEQ ID NO: 189557 - DNA, 601 bp, Human; identical to SEQ ID NO: 20283

SEQ ID NO: 189558 - DNA, 601 bp, Human; identical to SEQ ID NO: 20284

SEQ ID NO: 189559 - DNA, 601 bp, Human; identical to SEQ ID NO: 20285

SEQ ID NO: 189560 - DNA, 601 bp, Human; identical to SEQ ID NO: 20286

SEQ ID NO: 189561 - DNA, 601 bp, Human; identical to SEQ ID NO: 20287

SEQ ID NO: 189562 - DNA, 601 bp, Human; identical to SEQ ID NO: 20288

SEQ ID NO: 189563 - DNA, 601 bp, Human; identical to SEQ ID NO: 20289

SEQ ID NO: 189564 - DNA, 601 bp, Human; identical to SEQ ID NO: 20290

SEQ ID NO: 189565 - DNA, 601 bp, Human; identical to SEQ ID NO: 20291

SEQ ID NO: 189566 - DNA, 601 bp, Human; identical to SEQ ID NO: 20292

SEQ ID NO: 189567 - DNA, 601 bp, Human; identical to SEQ ID NO: 20293

SEQ ID NO: 189568 - DNA, 601 bp, Human; identical to SEQ ID NO: 20294

SEQ ID NO: 189569 - DNA, 601 bp, Human; identical to SEQ ID NO: 20295

SEQ ID NO: 189570 - DNA, 601 bp, Human; identical to SEQ ID NO: 20296

SEQ ID NO: 189571 - DNA, 601 bp, Human; identical to SEQ ID NO: 20297

SEQ ID NO: 189572 - DNA, 601 bp, Human
ctgtcctggccacagggagagtagaatattgtctaactggagttaactgtcgtttttcactattcccactggggaagtaccgggtgatctttttgtgtggctaacactggacgtctttaggaggtttagagcaaaatggctgggaccgccaaaaaggctacaagctatttcctgagtgtgaaatgtgggcggtgagcacaatggagtgggtttttgtgtgtttggtgtatatgagagaatgtggttatatacaagaaattctaatcttacagcttttactattggtttaagcctgatgtcygtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttccca

SEQ ID NO: 189573 - DNA, 601 bp, Human
tgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgrtacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatct

SEQ ID NO: 189574 - DNA, 601 bp, Human
ttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacayggcactgagagagagaatcttcttcttcttataaggccacagtcctatcagattagtgccccactttaatgacctcatttaactttaattacctcctaaagactgtatctctcgatatagtaatatttggggttagggcttcaacatacgaattttggaggacacagtttaggccataaattcacagtttgcttatccacttacctattgaagcacatcttggttgcttccaacttttggcaattatatataaaactgctgaaaacatttgtgtgcaggtttttgtgtggacatgcattt

SEQ ID NO: 189575 - DNA, 601 bp, Human
tgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacatggcactgagagagagaatcttcttcttcttataaggccacagtcctatcagattagtgccccactttaatgacctcatttaactttaattacctcctaaagacwgtatctctcgatatagtaatatttggggttagggcttcaacatacgaattttggaggacacagtttaggccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagt

SEQ ID NO: 189576 - DNA, 601 bp, Human
ggaaatttattttctcccagttctggaggttagagttcaagatcaagatggccgcaccttcaggttctggttagggctctcttcctggcttgcatgcacatggctgccttcttcttgtgtcctcacatggcactgagagagagaatcttcttcttcttataaggccacagtcctatcagattagtgccccactttaatgacctcatttaactttaattacctcctaaagactgtatctctcgatatagtaatatttggggttagggcttcaacatacgaattttggaggacacagtttagkccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacat

SEQ ID NO: 189577 - DNA, 601 bp, Human
ttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttctgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgyctccattgtccttcactgctattctcctttcctcctccctaaaaatatctaagttgaaatctcattttgtcacaatatcccatcctctacctctcctgattcctggatcactctctttcacttttctttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttt

SEQ ID NO: 189578 - DNA, 601 bp, Human
aatatctaagttgaaatctcattttgtcacaatatcccatcctctacctctcctgattcctggatcactctctttcacttttctttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcytcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagattttgccatgtttccagtgtctctca

SEQ ID NO: 189579 - DNA, 601 bp, Human; identical to SEQ ID NO: 36257

SEQ ID NO: 189580 - DNA, 601 bp, Human; identical to SEQ ID NO: 36258

SEQ ID NO: 189581 - DNA, 601 bp, Human; identical to SEQ ID NO: 36259

SEQ ID NO: 189582 - DNA, 601 bp, Human; identical to SEQ ID NO: 36260

SEQ ID NO: 189583 - DNA, 601 bp, Human; identical to SEQ ID NO: 36261

SEQ ID NO: 189584 - DNA, 601 bp, Human; identical to SEQ ID NO: 36262

SEQ ID NO: 189585 - DNA, 601 bp, Human; identical to SEQ ID NO: 36263

SEQ ID NO: 189586 - DNA, 601 bp, Human; identical to SEQ ID NO: 36264

SEQ ID NO: 189587 - DNA, 601 bp, Human; identical to SEQ ID NO: 36265

SEQ ID NO: 189588 - DNA, 601 bp, Human; identical to SEQ ID NO: 36266

SEQ ID NO: 189589 - DNA, 601 bp, Human; identical to SEQ ID NO: 36267

SEQ ID NO: 189590 - DNA, 601 bp, Human; identical to SEQ ID NO: 36268

SEQ ID NO: 189591 - DNA, 601 bp, Human; identical to SEQ ID NO: 36269

SEQ ID NO: 189592 - DNA, 601 bp, Human; identical to SEQ ID NO: 36270

SEQ ID NO: 189593 - DNA, 601 bp, Human; identical to SEQ ID NO: 36271

SEQ ID NO: 189594 - DNA, 601 bp, Human; identical to SEQ ID NO: 36272

SEQ ID NO: 189595 - DNA, 601 bp, Human; identical to SEQ ID NO: 36273

SEQ ID NO: 189596 - DNA, 601 bp, Human; identical to SEQ ID NO: 36274

SEQ ID NO: 189597 - DNA, 601 bp, Human
aatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtatggtgaaagaattgtaatccaccaaaaaaaaaaaaatcatatcagtttttttgtggctttgtaatgctgacatggcttctttttctaccttttttagttcttttgtttggctggtttcactctccagaggcctgctacagccataagtagcgtttttagcataccatattctgcaaactgcattaaatgccacattttctgttatgaaacagtttgcctggttcaaattatatcttactcttcctgtcttttgctggtaaatctgttttgtttaactcttggagacctcacctaagttttcaagaaatatggtttgtttttggc

SEQ ID NO: 189598 - DNA, 601 bp, Human
aattaaggtagcagatagttttaagtcatgagggacaaaggtttagaaagattgaccttatttgaataatttggtggtatcaaatgaaacctgtagcaaaaataatcagatccatatttcattatatagtagtcattattgtgctatgtcgttgtgccaattaaattaagtgtatctatttagcatcagccccagaattattttgtttttggattggatgagacctttagaggactaatgaagtggctttaaacttttttgtacacagtccacagtaagaaatgtatttaacctctctttytctcttatactcaatctcatgaaacaactcttactaaatataatgcaccctttttcttttattctgtcctgtgcttttctgtcaaattgtttttgaaggctgtggtgatttactaaattgataaacctgatattgggttataataatgtcataagcactattctggtctaactctctctttttactaatatgtaaatacaccctacaaggtgacgtgatttatttttatttttatttttagattttccaattaattcattgcaatgctgggccaagaattaaggactcctaacttccaat

SEQ ID NO: 189599 - DNA, 601 bp, Human
attttcatttaatgacttaaattactattacttttatttagttgcatcaagtatttcttttctttctttttttttttttgagatggagtttcacttttgttgcccaggctggagtgcaatggtgtgatctcggctcaccacaacctctgcctcccaggttcaagcaattctcctgcctcagcctcccgagtagctgggattacaggcatgcaccaccactcccagctaatttttttgtatttttagtagagatgggttttttccatgttgaggctggtctcgaactcctgacctcaggtgrtccgcccgccttggcctcccaaagtgctgggattacaggcgtgagccaccgcgcccggcctccatcaagtatttctgaagacacgtgaagcagtggagtcattaactgaaataacaggaaaccattttgaggctcctttgaagatccctgtgttcaggacttgggtccctctattcttcaagaggctgtgcccatggtgtggctttgctgagagcatctggtgcatacttctgcttttacctctcttttggttgttctttatcttcattcagaagatgagattggtagggtttccccatc

SEQ ID NO: 189600 - DNA, 601 bp, Human
tcatttcttagcaacatcacagaaacaaggctttagtcaattttattaataaaaagagactataataacttacagtgtttatcaatcaataaggtttttagttttaaaaaccttattgattgataattaaattgataattaaattaaaacaagctgggccagcactttgagaggctgaagcaggaggattgtttgagcccaggagttcaagaccagcctgggcaacatagagagatcctatctctacaaaaaaataaactagccaggcacggtagcatgcacctgtagtcccagctactgrggagcctgaggctggaggatctgttgaacctgtgaggttgaggctgcagtaagctgcaattgtgccactgcactccagcctgggtgacagagtgagattctttctcaaaaaattaaattaaattaaactaaaaacaaaatgtggacgtacttgaaactttgactcttacattgattcaaccttcaaaggaacttgtccatttgtgaaagttttccttttatataagtctttcttacagtcaaataagtgtttactaagtgaaatactacattttatagtgcagtggcactcaaaggaaac

SEQ ID NO: 189601 - DNA, 601 bp, Human
tgatcagaagcaggacctggccagctgttcgcttatttcagtctgtatgaaatcatctgatatgcccataagagagatgtgtcaattggctaatgggtcagagtattgattttatgttttcagattgctgacagagagattaggcttccagatacaagcagttccacaagtctctgttttcagacaggcacataattaaagtaaccacacagttctctgaggttagagttccatgctgtgatgcaagcctctctatttggtatttaaaagcagtttgaagctgttgtgtaagtatcactgracttggagtcaactgacctaagttctagccttggcccttctactgtcttaacagtggattaaatgatgaggcttattttaaagaatcttgaaaactatagtaatttcaacaagaggagattaattgaatatattatgaaacatcaagataattgaaaatctgtgctgccattattgcatgtcaaaggtcattttgatacactgtatgtgcaaaagcagtttaccaaacagaattacatacagtgtaatcctttttttcttatataggaaaatacccacttccccccacttaaaaaaatac

SEQ ID NO: 189602 - DNA, 601 bp, Human
tgtaatataggttggcgctttttatgcacttaattttgccacctctctcacttccccaaagaaattagactaatgtataacaataggcttcataacttaatttagaaaacataacaaaaataatttcgctcagtaagtttctgttgtagtagatattgttggtattaaacaaaaaagtaggatcagatgtggtttggctttcaaggtataaaatctaggtggggaaagagagagagagttaacattcttgaaacaattgagagcattagagtgttccagtatatcctccaaattctaaggktataagatgttcagagaaaataaaaaatcagggtgggttagaataattgagttcaaatggaccttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgttttt

SEQ ID NO: 189603 - DNA, 601 bp, Human; identical to SEQ ID NO: 36275

SEQ ID NO: 189604 - DNA, 601 bp, Human; identical to SEQ ID NO: 36276

SEQ ID NO: 189605 - DNA, 601 bp, Human; identical to SEQ ID NO: 36277

SEQ ID NO: 189606 - DNA, 601 bp, Human
gttcagtgtatcttgtatatgtggggagtgtgcctgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagcaatcttagggtacctctctgatgtagmttttgtgggatttgttaactggtataatgtgggacatgaggaagaaaagagggaagttaaggataattcaaaaatttctaccttgagggaccgaatggtggtgctgtcatcggaggaagcaaacatagacagatggatagttttatgaagaaagacaatagtttttattttaagtataggaagtttgtggcactgactagatattgagaattaacattatagataggtaggtagactgacagacagataatgttagtggtgtagatgagattatccaaggagaacaagtagaggaaggaa

SEQ ID NO: 189607 - DNA, 601 bp, Human
aagtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagaygtagaaagctgaatttggcaattatcaggtcagttgtaatcttggaaagcagatttagtaggggtaggcatgaagtctgtattaaaattggttgagaaattgaaaggagttaaaattgaatgatctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatga

SEQ ID NO: 189608 - DNA, 601 bp, Human
gtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagatgyagaaagctgaatttggcaattatcaggtcagttgtaatcttggaaagcagatttagtaggggtaggcatgaagtctgtattaaaattggttgagaaattgaaaggagttaaaattgaatgatctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatgaag

SEQ ID NO: 189609 - DNA, 601 bp, Human
tcctccaagttactttccttcaaattcttaatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagarttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactg

SEQ ID NO: 189610 - DNA, 601 bp, Human
agaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttatttattttctttctctccctggaggtatttttatctcttttgttttccagtgcttagaacagtggctggcacatagtagttactcaataaatacttgtagtatgaatgaatgtctccctcacccaattagtaggaattatat

SEQ ID NO: 189611 - DNA, 601 bp, Human
tttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttayttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaata

SEQ ID NO: 189612 - DNA, 601 bp, Human
tcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaagctaaatgggagagacgcatagggtaaggtataggggaagagtgcagagctttcatgccctctccaggtgcaccaccctcctagtacctccttgtgtttgctaacctggaagctctccaaattycattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacctcattagcataaactcaggtccagctggaaggggcttattacggataacaaaagatgctcttcttaccccctatcactcaggaaattccaagggttttaggagctctgt

SEQ ID NO: 189613 - DNA, 601 bp, Human
atgatcttctctggtccgggagtctgccagaggagcaggaacttcccagttgaaccttattagtaaccacctggaagatatttattgaacaagtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagarcagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggactt

SEQ ID NO: 189614 - DNA, 601 bp, Human
agtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagaacagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggacttataagggttaatttttctgaccttatcgatattttgtggatagtaaagaagtcatctagctatttttggcataggattcaaggagctggcc

SEQ ID NO: 189615 - DNA, 601 bp, Human
tgacagtgcttttaccctgtttttgttctgggttaatgctgcgccctcactaggtctggaatctttatagtttgagacatcagacttggatgaggaagggtaaatcatgctactagtgggccagttactctgtggttttcttatgagactgtgctttaaggaaaaggtaaccacggagcatatggcattgagtttgagtcatgtggaactggttagaagtaaaatgtttctattccagcattctctgagtttgtcagcttttcattattttataggaagaattctagcttcttatcctgaratgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttactgaatctggaattgcaggagggtaacagagccaaaggc

SEQ ID NO: 189616 - DNA, 601 bp, Human
cattattttataggaagaattctagcttcttatcctgagatgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttaytgaatctggaattgcaggagggtaacagagccaaaggcagtcctttcctcaaatagtcttaacgtattcatgtttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctacttttt

SEQ ID NO: 189617 - DNA, 601 bp, Human
tgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttactgaatctggaattgcaggagggtaacagagccaaaggcagtcctttcctcaaatagtcttaacgtattcatstttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctactttttccccacacttcattgttgtaatgaagggaaaggcagctgaaaccagaaacctacatcccttgccaacttaag

SEQ ID NO: 189618 - DNA, 601 bp, Human
agttttttctgcgtgttgtattaagccattatttatcaaatactaattacgttttatgcactaaatactagtccaagtattctatttgatatatggattaattcatttgttcctcctagtgccatgaggcaggtattattattcctgatttacagatgaggaaaccgaagacacagctaatatgtggcagagatcagaatcacaatctgcctctggagccttggcttaatcactgacagagcaacagccactcaggcagagaaaaaggagttggcatttacagttagaggagttaggactytagtaactctgcccgtttccctaaagcttaggattggctgtgataggggaaagtagcttatgaattgactggattgatgtaagtataacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgct

SEQ ID NO: 189619 - DNA, 601 bp, Human
aacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgcttaagacaacagcagttattattttggtaaagaaatctgcaaattgggcagagttcaggacagacagttcttctttgcctccgtggartgttagctggggtggcttaggttggaggacccactttcagattggctcattcacatggccagtaagttggtgacggctttcagctgggacctgagcctgggatgtgggccagggttcttggtttttcttcatttggacctctccacagctgcatgggtttcctcacagtttagtgtctgggttccaagaataagcatcatctattagaatagtgcttgctttataattgcttattgaatgaatgaaagaatctcaggttgttttcttgctcatgttggcccatttggcaaatagccactg

SEQ ID NO: 189620 - DNA, 601 bp, Human
gcccaccttggcttcacaaaattccgggattacaggtgtgagccactgttccctgccaggactgtagttttaaatggtgatcactgtaaggcaggtgtttgagccaaggcttaaaggagaggagagggttagccatatggatatctgaggaagaacagcattcttggcagaggaaacagccattgcagggatcctggggtggaaatgtgtcttgcatgttcaaggaaaaacaaggtggctttgctaaagagagagtagtaggagatgatgtcagagaggtgagatacagggagaggtcaawtgaggtaagacttctgtcgttttaaagatttgggcttttaccatgatagaaatgggaagccatcagaaggttttgagcagaggtgacataataatctgacctagattttaaaaggatcactttagttactatgttgccactagcctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttaga

SEQ ID NO: 189621 - DNA, 601 bp, Human
ctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacrtaatttcagctttttgtgtgtggctctccaagccacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaa

SEQ ID NO: 189622 - DNA, 601 bp, Human
ctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacgtaatttcagctttttgtgtgtggctctccaagycacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaataaatgaaaaagtaaggtaacaattcttataat

SEQ ID NO: 189623 - DNA, 601 bp, Human
agtacttccaccaaacaggaacattagtatatggatatttcactaataacaatagcggggtcagtaggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttctkaaatactcatcagggtgacttttcttaagtttagacagacattccactaggtctcttacctcatttgtggcaaggtttatattgatgtgtgactgctcaggtaaacctttagtctgaatgatacagctatgacaaaatatagcctcagttgtagcaaaattaaatgttacacaatggctttaattggtggtacacctttgaagagtttgcagtatgcccaagtgctaaagcataccatgtgagaatcactgggtagcaatgatttctgggggtgaagaattgaggagaatggaaaatata

SEQ ID NO: 189624 - DNA, 601 bp, Human
gatattagggagggtagggagaaagaatagaagtttttacatataaatacaaatagaagtatttaaaaaatttttttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaarcatatagaacactactattgtttaaacagtttataaataaggtacttttatacttagaaaaattgtttttgatatgtgcaggttaccatgctaaggatttgaacaccttcagtaccctatttgtacttgcgtctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgt

SEQ ID NO: 189625 - DNA, 601 bp, Human
tttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaaacatatagaacactactattgtttaaacagtttataaataaggtacttttatacttagaaaaattgtttttgatrtgtgcaggttaccatgctaaggatttgaacaccttcagtaccctatttgtacttgcgtctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtatta

SEQ ID NO: 189626 - DNA, 601 bp, Human
atttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaaacatatagaacactactattgtttaaacagtttataaataaggtacttttatacttagaaaaattgtttttgatatgtgcaggttaccatgctaaggatttgaacaccttcagtaccctatttgtacttgcktctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatt

SEQ ID NO: 189627 - DNA, 601 bp, Human
gtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctgggttactggtcttggggaaaaaaaaaaaccaaaaaacaacccaggaaagattatggattcttgattccatgcaagtcctttgaaatatttttcagcaacttgagagatttaaataaatgtcagtccattaatttgatgttcttgmttttatcagtataaatactgaataaaagataccaaaaaatgtttgtgaaacatttgaaagcacctaatattactttgttctgtgttctgaactgaattttagatgttttatctattttcagccgtgatacctatacattttttttaatgcagcttactttatgtttctttttctaaggagagctatgagacatggttcaaataaaaaatgagtagattctaatcccatagtttataatattgtattagcctatcatttagtaattaactgcttatattttttcagtcatagaaatgtgtg

SEQ ID NO: 189628 - DNA, 601 bp, Human
gatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagatatgatgaaccatgtgttattgtatcgcttattccaaattaattgctcaataaatggtgattagacaaatgtgaattaccatcctgtctctgt

SEQ ID NO: 189629 - DNA, 601 bp, Human
acatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagatatgatgaaccatgtgttattgtatcgcttattccaaattaattgctcaataaatggtgattagacaaatgtgaattaccatcctgtctctgtagaaaatcagaaaatgacat

SEQ ID NO: 189630 - DNA, 601 bp, Human
atcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagatatgatgaaccatgtgttattgtatcgcttattccaaattaattgctcaataaatggtgattagacaaatgtgaattaccatcctgtctctgtagaaaatcagaaaatgacattt

SEQ ID NO: 189631 - DNA, 601 bp, Human
ttccacatctgaagcaagtgcatcttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatgctttttttttggccttatcattagatggaacttgtcatgtttttctttcctagtcattaaatgaatagagcatttactgtgraaggggtgcttggtattctttattcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgt

SEQ ID NO: 189632 - DNA, 601 bp, Human
cttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatgctttttttttggccttatcattagatggaacttgtcatgtttttctttcctagtcattaaatgaatagagcatttactgtggaaggggtgcttggtattctttawtcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagatt

SEQ ID NO: 189633 - DNA, 601 bp, Human
aagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagattttaaaaaaattctgtttcttrgtgtaaagagcctgtaactgctctcctttttcttttctcatttcaacctttttttcttccggttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaa

SEQ ID NO: 189634 - DNA, 601 bp, Human
ataacaaagcttcaacgtacacaaagcaaaaagtgacagaacttgagaaaaagatctacagcataactggagattttaacatcctctcatttctgtgtaaatgcctctcacatttttgtcaattatgatcttttgctaaacccatacagctgaaaatgcaaaagctcatgactagtttttcagaggttccttagttaattggtataaatcttggataggtaaacggaatatctgttttctgtttgcctgatatctctgtaacttggcttttcctaaggcctacccattgctttctgagackagggaaataagtctggcttctttcaaacttctttgctcatttcatatgggccaaagtagcactaatcatttaaaattcaccagttaatctgttcattttcaaccttatatttatcaactagctataatttagttttggttttatttactacttactggataactatgccagtaagtatagtattttattatttaactgtgttcttcttttcattttattggtgatttttttcatttgttgttaaacagagcatttattgaacacctacaatatacaagacccacattagatttttataaa

SEQ ID NO: 189635 - DNA, 601 bp, Human
gtattttattatttaactgtgttcttcttttcattttattggtgatttttttcatttgttgttaaacagagcatttattgaacacctacaatatacaagacccacattagatttttataaaatgagatccttgacttgttacagagccagaagtgggaacccctatattcatctctgcatattggttccatccaccaaacaaaattgtttccttttcttttctcccttaaacttctgtacatgcttctgttttagcgcttatcgcattgtattgttttcctatatctgtcttcccagttaractgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtaatatgcccttgaagtctgataccctgacaaaccgcttctgaaaatcagcttacataactaccagggagaataaaaaggcatagtgcaaagcaaatgctgtgtgaaagacaggtttccagtgta

SEQ ID NO: 189636 - DNA, 601 bp, Human
atttgttctcatctatgagttttatattagtcatatactctaagatatatatatatatgtatatatatatataacatactactgagcagttggaataaagccagataatttcaaaagttcaactctcccaaatcccttaaatacaaatttagtcagaatgctgttccatcataattttgatgaaaatcttgaatacccatagctttcttgcccttgatttgcatctgtttcatgaacctagggaagggaatgttattttttgagtgctctgtaccaggtgtcctgctgagtgttttacatrtattttatctttaaatccatgtaataactaaaagtttattttatatatagaaaaactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcag

SEQ ID NO: 189637 - DNA, 601 bp, Human
aactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcagagttcaaattataactctacctcttactttgtgggctcaagcagattacatgcmattgaagttttctcatctacaaaatgctggctgcacagagttgatataatggttaaattagataatatatttagagcacttagcatggtacataagtgccccccaaaatggtaaatgataatgatgtgatgtcattgacaacagtatcactgaagtgaaatttgaggatctcagcttctatctgtagctctaccacacatttgcagttcacttatatgaatttaacatttacttagaatatactgtgtgccagtgttctaggcactgagaaaaaaatatagatagatagatagatagtaa

SEQ ID NO: 189638 - DNA, 601 bp, Human
catatttttgtgctttttgttggtaattttgctgtttgaaatggccccgaggcatattgctgaattgctgtctagtgttgctaagccgaagcgggctgtgatgtgctgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctrtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtccta

SEQ ID NO: 189639 - DNA, 601 bp, Human
ttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacttataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctc

SEQ ID NO: 189640 - DNA, 601 bp, Human
tcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctctattttctgatactttcattatttttacatgctttgcaatgtacttgaccatctagtacattttagagccttgattcagaaatcagaattttagcataagtgaatgggttcttataaaatatcctgatccttgggctttacaaaataktgttataaaaattactgccaaagtgcaactaatattttggttgagagagattcttagaattcagacatagccttagaatgggaagtattttgggaaaacaggaaactttttattttagtaataccttatatttttcttactttagcaggaactcagggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagt

SEQ ID NO: 189641 - DNA, 601 bp, Human
gacttgagtatgtacagatttggagttatacaggcggctctgtaaccagtcctccacatatacagagggatgagtgtctatactaacaatagaatgagcaaattcattctctgattattaccactcactgtcactgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccrtagcgtctcatgatcactgccttttcacaaaattccctgtgttcaccttactctatcagacataactggtatgtttctgtacaggaccagcctcaaagtttcttttcagcagcaagggggcagctgagaacaatgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatatt

SEQ ID NO: 189642 - DNA, 601 bp, Human
tgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccatagcgtctcatgatcactgccttttcacaaaattccctgtgttcaccttactctatcagacataactggtatgtttctgtacaggaccagcctcaaagtttcttttcagcagcaagggggcagctgagaacaawgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacactcaaatagacagtttttctgaggttcaggataattactgtattatttgatcaaaacagtataacagatattagaagtaacacttgtcaagccatggatt

SEQ ID NO: 189643 - DNA, 601 bp, Human
ccctgtgttcaccttactctatcagacataactggtatgtttctgtacaggaccagcctcaaagtttcttttcagcagcaagggggcagctgagaacaatgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacaytcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccatcttggcttactacaacctccacctcccaggttcaagtgattctcttgcctcagcctcctgaatagc

SEQ ID NO: 189644 - DNA, 601 bp, Human
tgggtgttaaaatgattgtgttgaagtatattttatggaagttactgtaggagaatgtttttaacactcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccaycttggcttactacaacctccacctcccaggttcaagtgattctcttgcctcagcctcctgaatagctgggactatagccgcatgccaccatgcctggctaatttttgtgtttttagtagagacggggtttcaccatgttggccaggatggtctccatctcctgaccttgtgatccacccgcctcggcctcccagagtgctggaattacaggcatgagccaccgcgcccaaccaatcctagctttaaacagactgtatttttataaaagacagtgaatggcggtttaaaaaatatatatgc

SEQ ID NO: 189645 - DNA, 601 bp, Human
ttgtttgtttgttttaagagacaaggtctctgttgcccaggatggagtgcagtggtacaattatagttcacttcagcctccaactcctgagctcaaacagttctcctgtgtcagtctccagagtatctgggactacaggagagtgccaccacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttkggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggcgggagaatggcgtgaacctgggagacggagcttgcagtgagccgagatcgcgccactgcactccagcctgggtgacagagtgagactccatctcaaaaaaaaaatgcttttgtatgatagtctatttagggagggagggaggaggttgattaa

SEQ ID NO: 189646 - DNA, 601 bp, Human
accacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttgggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggygggagaatggcgtgaacctgggagacggagcttgcagtgagccgagatcgcgccactgcactccagcctgggtgacagagtgagactccatctcaaaaaaaaaatgcttttgtatgatagtctatttagggagggagggaggaggttgattaaataatataacaaaattaattcaagagctaagacagaaacaaatactcaggaaagctcaaataaagttaagaagaagatgattttaaaagggcagaaaagaaacattgagaagaaagattgggaaatgatattaatttattatttcaa

SEQ ID NO: 189647 - DNA, 601 bp, Human
atccaaataatccctctgtgcttgtgcttcattgggtggaatgtatactagtcttcatggagaattggaatagtggtttattgtcatttctgatttgacagcagctccagtgattccactttagtcttttttttacactttactgattcatactcctcaaacacaaagatctgattgggtagttctggtcaccatctcttacgcagagaattactatggcagctttggcttatgatccacagttattcatttgtgacaagagaaaaacctggggccactcttctgagaaaatgactttggyaggcactgggagcttcataaactactataccacacagcctgttttttttaattattattcttttttccccgttcttagtaagtgtgcattaaattctttcttgtattggttcctaattgtttgatctaaaaggcccatcttctcatctatatgataagccttttgaaggcaggaaatatcgtatgcttttgtgactacccctgacactcagcaatgcctaccactgagtgcttactgaacagaatggttttagacatgagccattgagagaagtcacagtgatggaagtttgttgttttt

SEQ ID NO: 189648 - DNA, 601 bp, Human
tggcctttgagccaaattctagctggaaaaaaaagtgaatagatgagtttggaaagatacttgcattttagaaaagggtcttatctcagaagagagatgttttaaaaaaccttcttttagaaggctttttaaaattaatttttagctttaaaatatattctcattcaggtctaaagcacattataaaaaaatagagcagagttgactgagtaccctaggttaataaacttaacctagatttatttaatcattatgccaataatgttctttttatatgtccattttctatttcactttattrtatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaata

SEQ ID NO: 189649 - DNA, 601 bp, Human
acttaacctagatttatttaatcattatgccaataatgttctttttatatgtccattttctatttcactttattatatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttca

SEQ ID NO: 189650 - DNA, 601 bp, Human
atcattatgccaataatgttctttttatatgtccattttctatttcactttattatatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgtkgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttcagatttcaagtcagggaatag

SEQ ID NO: 189651 - DNA, 601 bp, Human
agttttgaaaaacagccataacaaaaacaacaaaatgtgaagttacaaggtggggctataaattaatgagtttgttttttgaatagctggcagttttgtaatttatttaataacacttatacagaacacaatacgataatctttaatctttataattgagataggtgcagttatcatcattttacagatgaagaacctgaggcagtcgtgtccattgtgaactccaataagaaagattaaaaagaaggaagaaaaagtccgctgtagaaatgaaaaaacaaatttatccattgtgacatcrtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcgggatcattttccagagactaagacaaagccctgtggaaaaccaagccacatgttactcaaagtaatagtgtaggaggaacaagagccagcagggaaacacagaggaaattattagaaatataggagaattgga

SEQ ID NO: 189652 - DNA, 601 bp, Human
cagttatcatcattttacagatgaagaacctgaggcagtcgtgtccattgtgaactccaataagaaagattaaaaagaaggaagaaaaagtccgctgtagaaatgaaaaaacaaatttatccattgtgacatcgtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcrggatcattttccagagactaagacaaagccctgtggaaaaccaagccacatgttactcaaagtaatagtgtaggaggaacaagagccagcagggaaacacagaggaaattattagaaatataggagaattggaagagtacagatgaaggaaaataaatcaacttgtttatgttattttaaaacctagaggtcaaggaagagttcagaaaacgaggctgtcagtggtatcagatgttatagcgctccctaagaatgagaaatgaaagaaactcatttgtcttgtgtaaacattaaaatcat

SEQ ID NO: 189653 - DNA, 601 bp, Human
gtgcttatcttgggtatctgcccttattactttctgaggagctgccctttatagcaatcagggaactataccacttggaagactaattgtctttatacaaaaataaaatccttgtgttcagatttctgtcttgagtggctggtttgaatctaattttctgttatatgaagcaaagatttattatttaacatagtttcaaaattaaaattgatagtgaaattttatgtgccatgcaatgtcatgtgtgttcttttaaggtgaagattcattttttaatagctttattgaggtataattgacmtataataaactgcacatatttaacaccacattttatgtgtgatatgtatgtgtgtgtgtgtgtgtgtgtgtatatatgtatatacttatataggtgaaatcatcaccatagtcaaaataatcagcatccccatcagtcccaaaagttttgtttctcatgcccctttgtaatttttccctgccctctcaccagtcaactgatctttctgttactacaaattagtttatagttttaaaaattgtatataaagggatcttaattatatatattttccttccagcagaattattttgagattaa

SEQ ID NO: 189654 - DNA, 601 bp, Human
atcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattatarcaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagataat

SEQ ID NO: 189655 - DNA, 601 bp, Human
agcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaaytccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaat

SEQ ID NO: 189656 - DNA, 601 bp, Human
catccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacayagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctc

SEQ ID NO: 189657 - DNA, 601 bp, Human
atttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcmggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgagga

SEQ ID NO: 189658 - DNA, 601 bp, Human
gagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagca

SEQ ID NO: 189659 - DNA, 601 bp, Human
agtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagacyctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacc

SEQ ID NO: 189660 - DNA, 601 bp, Human
tgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatkttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaac

SEQ ID NO: 189661 - DNA, 535 bp, Human
gacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataatraacttaggaactggtgttacaatatggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttga

SEQ ID NO: 189662 - DNA, 510 bp, Human
aatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataataaacttaggaactggtgttacaatayggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttga

SEQ ID NO: 189663 - DNA, 601 bp, Human
agggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacmcagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaat

SEQ ID NO: 189664 - DNA, 601 bp, Human
aaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttmcttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaac

SEQ ID NO: 189665 - DNA, 601 bp, Human
ctgtgtgaaactgaaaaatgaaaactttgattaaaaaaagtattttcaaatataggatagtacatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctaktctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattt

SEQ ID NO: 189666 - DNA, 601 bp, Human
ataatagctctcctttagctagtttacattataaatcgtttgtggttacctactatatgaaaggttgtagtagatcctggggattcaccaatgaacaaaacagatgaaaatgtctgctgttatggagctcatggagctcatttataaagggtaacgatatataataggtgttagagagaaaagtaaagcagagaaaggaaaggaggtgtgtttggtgggaatgtgtgtgtacaatttaactaaggtggctaggaaagacctcactgagaaattgacatttgaatgaagatctgaagtgggrgcaggtaaaggtgtgtgcctctacaaaggccacagctgaggccgcccttctttatctacctcttttcatctttccaacttccagaccttttttttctgctgataactcataccttttaattaaactttaatttaatttaatttaatttagtttcttccaactctgctctccaccacttccttgcccctagcacacacacaattaatcagcacttacaaaaacaaaaatttacctctttacaaaaggtacagggatagagtagaggctttgaatacttgtgcttcaattatttttctcctg

SEQ ID NO: 189667 - DNA, 601 bp, Human
aaaaaaaaattattgaacacttataagtgttgaaatactaacttgtctaatctttataaacaatcggtgcaataggtgttgttactgtccctattttactaaagagaaaatgaggacacagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttamtagtgaaaaattctggcccacctcagacttaccatgtaagaaattgtttttcaagagttgaggaatgtgggtatttatattataaaatcctgcaggtgattctgatatgtatcttttgttaagaacttctgttttagaaggacctaccattggcactgtttttgcttctgatcccagcttcctatgattaaatgctttctgaaagatacatagttagtacagaacttaatactattatactattctatactattttaccccagtttgacttttaagctgttaccacctgaaatttaaatg

SEQ ID NO: 189668 - DNA, 601 bp, Human
ccattggcactgtttttgcttctgatcccagcttcctatgattaaatgctttctgaaagatacatagttagtacagaacttaatactattatactattctatactattttaccccagtttgacttttaagctgttaccacctgaaatttaaatgaaatcctttttagaacaatacttgaccaaacaatttaaaaattgtatttcctacaaatgcatcataccttaaaaatgcactttaaaactgaatggaagccaggtatggtgactcacgcctgtaatcccagcactttgggaggctgargtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactga

SEQ ID NO: 189669 - DNA, 601 bp, Human
tttctccccgccccctcccctccatgtttctctaactttttctgggaataagagtaacaatacattgattataatatttgtccacatgatttcattccagaggaaatcctatagtatctaagccctacggaaagcctcataaagacatttcaggagtccattcgaagatgtcttaaaattaatgacattgttttgagtgacagtgccgaaatatatttctttctatggcaacattcttattctactatcctttttatttttaagtagtttcatttttgtcactgttgggttattttaaacratttaattggagggaaagaaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaa

SEQ ID NO: 189670 - DNA, 601 bp, Human
caagatatgattcttctttttcataaatcatacctagtttttagctttctgctgcaaaagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaarcagtattttaatgataggaattaagctatgtataactttcatggcttgaagatcagcaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcat

SEQ ID NO: 189671 - DNA, 601 bp, Human
aagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaagcagtattttaatgataggaattaagctatgtataactttcatggcttgaagatcagmaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcatgtatatcaatttcaatttgtttttcactttttagatttttttcttagttttgctgat

SEQ ID NO: 189672 - DNA, 601 bp, Human
tgctacttgctggatatgtatcattgggcaagttaattaacttttctgtacctcagcttcctcatctgtaaaagaagatattagtaataccttcctctaagagttgatgtgagaatgaaatgagtaaaaaagctttaaatagtacctgactattttggggttagctgctgttttactgcaataatcatcattgccattgtccttaagacatcattgccaacttctaaggtaatttcttccttttggaccctgactcctagcacttctcacagtgctcaaagactttactctgcatttatamcattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctcccgagcagctcctgaacacaggcacattccactcccagctaatttttaaattgtttgtagagacagagtctccctatgttgcccaggctggtcttgaactcctaggctcaagtga

SEQ ID NO: 189673 - DNA, 601 bp, Human
tcattgccattgtccttaagacatcattgccaacttctaaggtaatttcttccttttggaccctgactcctagcacttctcacagtgctcaaagactttactctgcatttataacattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctccygagcagctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttac

SEQ ID NO: 189674 - DNA, 601 bp, Human
ccattgtccttaagacatcattgccaacttctaaggtaatttcttccttttggaccctgactcctagcacttctcacagtgctcaaagactttactctgcatttataacattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctcccgagcasctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttacctctga

SEQ ID NO: 189675 - DNA, 601 bp, Human
ttctaggctttcatgataccatgacttgtctaggtttcctcctgtatctcctcagtcagcttatccagcttctcctcttctgtcaggatggaatcttgtttgttatgttcgccacttaccaccatatccccagcccctggaacagtacctggtgtaggaaaccttgaaagatgaggcactttcatttacattaactcatgtcatgctgagctgccagttaagtgcaggctaactgttctttattcaaatgctgggatcatgtggtgtgaatccattggtcaaaaaggaaagataagaaggmcaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccgagt

SEQ ID NO: 189676 - DNA, 601 bp, Human
aggacaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccragtagctgggactacaggcgcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttg

SEQ ID NO: 189677 - DNA, 601 bp, Human
cagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccgagtagctgggactacaggygcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttggagcaatttggatttcaga

SEQ ID NO: 189678 - DNA, 601 bp, Human
actttggaacaatctcaagatgaggtgattcaaagcttggaatgggaagaaaggaaaaatttccaaagaaattccaaaggaaaaatctatagcatttggcagctgatgatttataaaggagagagaaggaaaagctgattccatgattttgagaccagaccactgagagactagtactgccattcaaagaaatggataaaatgggagggacagtgtgagatttatgcatcttgaattagagatgtcattggtgggtatttttgtgtatctcttgtaacagattggtgtgtatttctgtgtrtctcttgtaacggaataccaagtaattcttgactgatgaatttcattttctttcctttttgttagatactaccagccccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgttttttctctgctttgccttgggcatgat

SEQ ID NO: 189679 - DNA, 601 bp, Human
ttttgtgtatctcttgtaacagattggtgtgtatttctgtgtatctcttgtaacggaataccaagtaattcttgactgatgaatttcattttctttcctttttgttagatactaccagccccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgttttttctctgctttgccttgggcatgattgggattactgagattattcctcttgtctatattgttgcattagtattttaactggtgtccctaatttattatttttccatcttaattcctacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattac

SEQ ID NO: 189680 - DNA, 601 bp, Human
cctttatgcctaatgctggagataccaacatagaataaggtacccatgatttgtactttactgtagcctctaagtgcaagagacagaagaaaacaaaaaaaaattaacaacccaaacaaaacaattgcagcttatgacagtttgggagaaagaaagaaatatggtcccttcatgaaatatggtgggagtcaggggtagagaagacctttttgattgggtaatgaggggataacagttaaaccaagatctgaaggatgagaagaatcaactgtgaagagtcaaggggcagaagattccaagmagagggagcaacaagagagcagaggccctgaggctggaaagaatgtgttcgttttaggatttgtcagaagaccagtaaggctagagtaggacccagtagggagaggaaggaatgatacgagatcagatcgggaaggtaaacaggggccacatcagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttgg

SEQ ID NO: 189681 - DNA, 601 bp, Human
cagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacmtccttaatgtaaccacctctcatttatggctttatctaacactactcaaagataattaccttgaaggtggtggtgctttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactct

SEQ ID NO: 189682 - DNA, 601 bp, Human
gggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacatccttaatgtaaccacctctcatttatggctttatctaacactactcaaagataattaccttgaaggtggtggtgytttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactcttcccaaaccattagattttctcccacttagcagagcctcttctgaactctctactataaggtaaacctggaaataa

SEQ ID NO: 189683 - DNA, 601 bp, Human
ttttattttttaatgttaagctcctcctaatggatttatctttgtacggggaaatcaagaaccttgcactttgtcagaagatgagccacttcatataatctcaagtttctatgttttagaagaattgcttagtaagcacaggttcgactgctctgcgttctctcttttgcagttacaccaactggaaacattggggatcataactttctgtggagtgttacataggtgtgtcagcagttacatgatactttctttgttatttaagacatctgcaagctgaggatggccagtgtcatttcasagatgtacatgccaaagacatggtagttttcattgacattgggaaatactccttctcttgagcttttacaaataaaagttagagagtgctaagaaatccacatatttaaaaaaatctagaatcttgacattgaaaatataaatgcagattgttaattatatgttcctgtgttaagaaagcattcttgctttggggatcttgagtacatcagacaaaagttgcctttgaactcaaccaagtatccatagagatatttgcctctatatgtattattaattttacagaaacaaatgcctagct

SEQ ID NO: 189684 - DNA, 601 bp, Human
ggccaagtgaatgaggcattctgagcatagggaacagtataagtagggatatcagagaaagaaaagtacttagtccatttggggaattaaagttggactaaagtgcacatggatcaaggtacagatgaagctgcagaggcaagcagaagccagttcatcatggccttgtgtaggacatgatacagagtttgacttaagcctctgagtaatggggaactattaaaatattttgagcagggaagaggcacaaacagagttacatttcaaaagatttccccagcagcaacataaaagatagatkagaggggattatgcttttatagggacaacagttagaaagttatcatctaggcaatagatgatgggtagttcatatttaaaaaaggattctttctgtatactatctattgtgtgtaacaaattactccaaaacctagcagctgaaagaaaacaaacattatctcagacagtttctgagggtcaggaatctagggccagcttagcagggtgattctgcttccggatctctcttgagattgaagtcaagctgttgactggggctgaagacttgattgggtctcagggatgtgcctccacattc

SEQ ID NO: 189685 - DNA, 601 bp, Human
ttacttagaccaaccctcgtacattgtgggaggggactgtacaagggtatgaataccagaaagtggggatcatttgggggcatcctagaggctgccttccatgctgcttgtcaaagaatgtaaagagtaagtctacaagtccataatattttgatggcttatggagataagagggcagaacactccacctagaaactatcctattacctagagcaggtaaataaagtcatttgcttgactgaaaggtaagagggttaaaacccaccattctaaatgtcaagtaatagttacgttgcagtctgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccagcccagctac

SEQ ID NO: 189686 - DNA, 601 bp, Human
gttgcagtctgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccarcccagctactgacagagctgagaccagatctcagacctttaggtctgtaggcaagcattttatttaaatataaaatgtaatttgtttacgataccaagaacattcttttttaaatataatgtaaaaaacatttatagagacagggtctcacggtgttgcccaggctggtctcaaactcctgggctcaagcaatcctcctgcctcagcctcttaaagtgctgggattacaagcgtgagccaccacaccaggccaagaacattgtctgaggacttaaatcatttttctatttgaaatcagaa

SEQ ID NO: 189687 - DNA, 601 bp, Human
atcctcctgcctcagcctcttaaagtgctgggattacaagcgtgagccaccacaccaggccaagaacattgtctgaggacttaaatcatttttctatttgaaatcagaatgacttagtatttgatgtggggaaaggcaagacataaatgtgttagaagacatttctgtcttctcttgaaagaccaactcatcctgtcactgattactgtgtgactttgagctaaattacaacacattagtaaatacagaagaaaataatgagcaatgccacatcccttgcattttttaaagcaaggaccascctaattgacagtgagatctttatattaattttcccatttaaaatagataatattcagtgttcgatgaagaaagaattatggggtagattatgaaataataattggaatactattactgttaatagtaaaaaatgtctgaactatactgttggaataataagagtagaaatgagtaaaattaagtatttacaaggtttaaagtattttggagttttgtttccttttttaaaaacaaaatgctttttaactgttcattgcctatattaccaaatagttttaagttgtacattcaggttcag

SEQ ID NO: 189688 - DNA, 601 bp, Human
tgttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagccttttttttwaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcat

SEQ ID NO: 189689 - DNA, 601 bp, Human
gttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagcctttttttttaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcata

SEQ ID NO: 189690 - DNA, 601 bp, Human
gccatggctggcccttgcaactagataccactccttctaggccttctagggccacccttctttccagaagagtctcctttgcagtctggagctggtgcatctgtgtggcagagcctaggccatatgcctgtaccctagttacaaggaagtctgggaaataaattatctggtactttatacacttaactagtaggaggtcagctctatctcacaagataggaggttctgtaaacctaggtatgcagtcaggcactaagtggccaaaaacttctatcagcagcattttgaataatcagagaarattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcagcccacatttggagtcaaagccttttgttct

SEQ ID NO: 189691 - DNA, 601 bp, Human
ctatcagcagcattttgaataatcagagaagattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcarcccacatttggagtcaaagccttttgttcttaccctgcgcagcccttaaccagatgtgtgacctgtaagcaaggagttcagttagtatcctcatctataaaatgagaaggttgaggtaggtgatctttaaagttcccccttggctctaaagttctatactttgtacatgataggccagtgacaactaatgtttttactcaagccgattgtatgttttagaaggcaaataaattatgagcttattttttgatgacagtacattttcataaacccaaaataattaaatctccacctcccact

SEQ ID NO: 189692 - DNA, 601 bp, Human
tcttataattaacataatctgatattgttacttaagtctttgaagaaatagagaaaaactggctaacatcccttatgactgcatgtttttatatattaaatagcagtatcgaattgccttccactatctttttcagacgaaataatatatatttaaaccttgcaagccttatccttttttatacttcttttttctagaacagctttattgagttataattcacataccatacatttcacccatttaaaatctataactcagtggtttttagtacaattttagaacatatcaccccaaaagaaacccatccccattagcagtgactcctcattcacccctttccccactccagtaatgctgagcatctttttatgtgttactggccatttgtatatcttctttggagaactgtctattcaaaacatttgcccattttttattggataatttatctttttattgaattataaaaattatatcttctaggtacaagtcacttatgagatatatgacttgcaaatatttttactcattctgtgagtttgtcttttcactttcttgagcaagccttatcttgagcaagccttattcttaactctgg

SEQ ID NO: 189693 - DNA, 601 bp, Human
tttgattagctactattaagaatttagctgatctacttcattaaaatgttatattagctcaatgaataattatatatttctgtgtaacaaattacccccaaaactttaatggcttaaagcagcatttgttatttcacagtttctttggtttaggaatccaagtagagtttagcaatgtggttctgctctaggtctctcatgaggtttaagtcaggctgctggctggtgctgcagtctcatttttggggaggatctatgtgcaagctcactcgtatggttgttgggaggattcagttccttktgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccatattctactcattagaagcaaactattatgttcagcccactctctatagaagggaaataccaagggtatgaacaccaaaatatggagcttactg

SEQ ID NO: 189694 - DNA, 601 bp, Human
taagtcaggctgctggctggtgctgcagtctcatttttggggaggatctatgtgcaagctcactcgtatggttgttgggaggattcagttccttgtgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccrtattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacgttgatatgtacagttccatcctgcaaacaagtgataattttatctgaaaatatataaggaagtctctccatcctaaaatatgcatatgtgtatatgtattatttttaaagcatctt

SEQ ID NO: 189695 - DNA, 601 bp, Human
cagcacatgacatggcctctggctctgtcacaatagcaacacaagagagtgtccaagatggaagccatagtatctttgtaacctaatctcagagttgatatatcatcacttttcccatattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacrttgatatgtacagttccatcctgcaaacaagtgataattttatctgaaaatatataaggaagtctctccatcctaaaatatgcatatgtgtatatgtattatttttaaagcatctttagtctgcatatacatttgctacttattaatctgttttatcaagagacaacattaaagttgtaagacacaattagaatagaaaattttatgtgtaactttatgttctccccttgacttataaagattgctattgaattttagtattggaaaactttggccaatgtaaagatgattttaatttga

SEQ ID NO: 189696 - DNA, 601 bp, Human
aattttatgtgtaactttatgttctccccttgacttataaagattgctattgaattttagtattggaaaactttggccaatgtaaagatgattttaatttgaacatgtacaacatgcaaaagaatattttttctccttaaatcatactttagaagtcaaccctaatttaacaaaataggtgatcctgaatggactttaattcatttattcagcaaggcttattgaattactcttctaactcatcatgagttacactcataataaaagtctgcactcctaattttggcctcccatagctcartcaatctctgtctatgtttccagtttcatttcctattgccatctcccttaaccttccactccagcacagtttttcttgctcctccccatgttgatgctcatgcatgcctcagggcttttccatcttcctgaaaacctcttacccagatcgttacatggctcgcttcacttcatttacttctctgctccagcatcactaccataaagaagcatcccaccagcactcttcacaatacagcagggaccatcaaaaagcaagagacacaataaaaatgatagttgaaaagattaatctcatgac

SEQ ID NO: 189697 - DNA, 601 bp, Human
tcaaagtgacatagcagctgtgtgctgttgtgcctgagactccttccaatcctagatgtttcctagtggtgctggcaaagcttctgttggctgtaccacattctttcccaatccaactccctctatgtaaagtctcataattctaaggatcctgggttcaaatgtaagtttcttccgtagtagttaccatttgggtgtttctgcttcttctaaactcccttctaattgtttttcctcttgtttttaagctagtgattttttcccctgtattttacatatgcttatggaaagaacagatatrttttcatggcacttagcatgttataaatgcattgttttccatggagtaagatcattctaccactgagagcattaaatccatgttcctaaggtaacccatgttttcctagaaacaggggaagagtcatgaccaactttcacattgtctgctttgttcttggggtatcatccattgtgataaccattcccaagaagtttcctccccaaaacagaattacttctctgcctacccttgattcaagtgacctttcattacagataatctggttttatagggaaatctagtaggttctgcactcag

SEQ ID NO: 189698 - DNA, 601 bp, Human
acttttctctgttgtaattttctcatatgagactgtaggaaagaatgatttaatatattctataaagtgcctagtaatataataggtccagcatatgaaagcattcataataggttctcagtaaagagtggcaatgctcgagcatttctaaagaaacggaattgattatattccattcctttttcagacagttataaatgttagaaatttctttctgttactgctccagaatctgtgcttttcaattattggttctaattcagtatttttaggcctcagagaaaaagccttaatgccgtcytcacgtggtaggctaccaggtctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaatt

SEQ ID NO: 189699 - DNA, 601 bp, Human
tctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttrtgggtacatagtaggtgtatatatttatggggtatgtgacatgttttgatacaggtgtgcaacatgaaataattacatcatgaagaatgcagtatccatcccttcaaggatttatccattgagttgcaaacaatccaattattacactctttaagttattttaaaatgttacagatgtttttcaaacatgtctctgttctaccctatctctctcatcatatatttgtatgggattttacattttgacatattaaatttcatcttgttggagtttgctcgttttcttcttacctatgaagc

SEQ ID NO: 189700 - DNA, 601 bp, Human
gaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttgtgggtacatagtaggtgtatatatttatggggtatgtgacatgttttgatacaggtgtgcaacatgaaataattacatcatgaagaatgcartatccatcccttcaaggatttatccattgagttgcaaacaatccaattattacactctttaagttattttaaaatgttacagatgtttttcaaacatgtctctgttctaccctatctctctcatcatatatttgtatgggattttacattttgacatattaaatttcatcttgttggagtttgctcgttttcttcttacctatgaagctgttttgggaccctaactatgacagtaagtcacttggctatgcacttaatcagcatgtgtttaatatccacactcacatttttataaatatt

SEQ ID NO: 189701 - DNA, 601 bp, Human
tttgacttgtcaaacttacacttgactaaaacctacagatgtttttctttttaattttttttaatttttaatttttgtgggtacatagtaggtgtatatatttatggggtatgtgacatgttttgatacaggtgtgcaacatgaaataattacatcatgaagaatgcagtatccatcccttcaaggatttatccattgagttgcaaacaatccaattattacactctttaagttattttaaaatgttacagatgtttttcaaacatgtctctgttctaccctatctctctcatcatatatwtgtatgggattttacattttgacatattaaatttcatcttgttggagtttgctcgttttcttcttacctatgaagctgttttgggaccctaactatgacagtaagtcacttggctatgcacttaatcagcatgtgtttaatatccacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttcca

SEQ ID NO: 189702 - DNA, 601 bp, Human
ataattacatcatgaagaatgcagtatccatcccttcaaggatttatccattgagttgcaaacaatccaattattacactctttaagttattttaaaatgttacagatgtttttcaaacatgtctctgttctaccctatctctctcatcatatatttgtatgggattttacattttgacatattaaatttcatcttgttggagtttgctcgttttcttcttacctatgaagctgttttgggaccctaactatgacagtaagtcacttggctatgcacttaatcagcatgtgtttaatatcyacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctagtcacagtgaagcatatccgtccttcacattgcacagccaaaaaccttccttgcagtcatccttgacccattttgtttcctcccacatcccatatctaatccctcagcaaac

SEQ ID NO: 189703 - DNA, 601 bp, Human
ttcatcttgttggagtttgctcgttttcttcttacctatgaagctgttttgggaccctaactatgacagtaagtcacttggctatgcacttaatcagcatgtgtttaatatccacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctrgtcacagtgaagcatatccgtccttcacattgcacagccaaaaaccttccttgcagtcatccttgacccattttgtttcctcccacatcccatatctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaa

SEQ ID NO: 189704 - DNA, 601 bp, Human
ctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcrgaggttgcagtaagcagagattgtgccactgcactccagcctgggcgacagagtgagactccctctcagttaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcatgaaggcagagccctcatgaatggaattactgctcttataaaaagac

SEQ ID NO: 189705 - DNA, 601 bp, Human
gaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcggaggttgcagtaagcagagattgtgccactgcactccagcctgggcgacagagtgagactccctctcagttaaaaaaaaaaaaaaaaaaaaaaaacaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcatgaaggcagagccctcatgaatggaattactgctcttataaaaagacaaaggactttgcagggacgtggatgaagctggaaaccatcattctcagcaaactaacccaggaacagaaaaccgaacactgcatgttctcactca

SEQ ID NO: 189706 - DNA, 601 bp, Human
gctactcgggaggctgagttgggagaatcacgtgaacccaggcagcggaggttgcagtaagcagagattgtgccactgcactccagcctgggcgacagagtgagactccctctcagttaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcaygaaggcagagccctcatgaatggaattactgctcttataaaaagacaaaggactttgcagggacgtggatgaagctggaaaccatcattctcagcaaactaacccaggaacagaaaaccgaacactgcatgttctcactcataagtgggagttgaacaatgagaacacacggacacagggaggggaacatcacacatcggggcctttcggggggtgggggacaaggtgagggatagcattaggagaaatacctaatgtagatgacaggttgatgggtgcagcaaaccaccatggcacatg

SEQ ID NO: 189707 - DNA, 601 bp, Human
gctactaatagaaattatagggctcttttggctagtgtcaagtatagatttgcgttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccaraaatgtaaggcaggcaagaagttagtagaagaaagtcatcacactgtaacaattattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaa

SEQ ID NO: 189708 - DNA, 601 bp, Human
gttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccagaaatgtaaggcaggcaagaagttagtagaagaaagtcatcacactgtaacaawtattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaacttttcattgcagtgggtttgataataatagtgctcacttttaaaaaattccc

SEQ ID NO: 189709 - DNA, 601 bp, Human
gcctaaacaagatgaaagttgatttctttttcctataaaagtgtgggagcttgtccaagactgataggatagcttgttagtactggagacccacgctctttctttcctgcactctgctgttctcaacatgctgtctccatcttctggtcccagatggctgcttcagcccctgcatcctgtcagtattctaaccagcaggaagaagaagataggaagtgagaacgtatcccttccctttaggactcagaagttaaacatgtttcatctgctctcatttcattggccagaactgagtcacatsatgataacttgctgaagagaatttaggaaatatagtctttaggtaggtagctatggcttccagctaaaatggagcagttcttttactagaggaaaaagagcgtgatggattttggaggacagggagcagtttctgctgcacatggctttaaatactatctatgagctaatgtctcccagatttgtagctatttcctgagttcaggactctttcctcagctgcctccctaacattctcgaacacctgcctgttcaaaattgaactcttcacttttctccccaaactcctacccatcttagg

SEQ ID NO: 189710 - DNA, 601 bp, Human
ttaccaccaatgacttattttaataaaatacatatccccatcctgtttcttacttccttaaaaccttcctctgtctccttattgcctttgggataaattctaaaccctgtgtgaaccaactctttctatctctctggcctcattttcccattttccacttatattttgtatttcagtactacctagcacaacacacctcatgacttgatgtatttactaatgcttatccctctgtagaatttcccccacctcagacctggctgaagaatcccttagtctcaagtgtcacctccttcagatytttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccacacccagctaattttttttgtttttttttagtagagacagggtttcaccatgttggccaggatggcctcgatctcttgaccttgtgatccgcccacctcggcctcccaaagtgctgggattacaggcgtgagccaccgtgcctgg

SEQ ID NO: 189711 - DNA, 601 bp, Human
acttatattttgtatttcagtactacctagcacaacacacctcatgacttgatgtatttactaatgcttatccctctgtagaatttcccccacctcagacctggctgaagaatcccttagtctcaagtgtcacctccttcagatctttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccayacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgcaccatatgcatacccgtatcacacctatcctggatgataccagtttacatagctgcctcttttcctagatgcaagtgccttggtc

SEQ ID NO: 189712 - DNA, 601 bp, Human
gggactacaggcatgtgccaccacacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgcaccatatgcatacccgtatcacacctatcctggatgataccagtttacatagctgcctcttytcctagatgcaagtgccttggtcaggggcaagggcttactcatctctcagtgcccaacacataatagctgctaagtaaatatttatgtaattgaatcatattgatcatgggaacaaactcccattgggagagcatcacctctgccttacatatctgagaaaagcccttgtttattgtaccctatcaactgaatctgctgggctatatattaaagtgggtattttaggccctgcttaaaaaataaaggttaaattgagcatattcattgctctgttaggattacataatgcctgatagtgc

SEQ ID NO: 189713 - DNA, 601 bp, Human
aagtcatagaactgaaaagactctgggtaatgttttcaaaataaagccacattgtttccaatacaacagctttctctgggttctttcactgcctccttaatgtaagtcttaatcacacttgtattaacagtagaaacactctgcagtatctcgtttcatacagtggtgttagaagcattaactcctcagccctcataccatcacaggaaaacagcaatcattgttaacccccatccattggggagatgaagaaaatgagcaaactatgaagaatgcagtttatttcgtctccataagactrtgaggcagtggaaggtaagggctagaccccaggatggctgattcctagggctcttttcctgtgctccagaatgcagtgacacctttcagttgttgctgtattcagaggtgtgtgttgcatgtgataggtacagtacttgacattattaactcttgcaaccaccctatgggttaggtattaatatccccatgttatagatgaagtctgtgattccaaagcctgatgtctctccactgtgccacacacactgactccacacaataacaattactcccatttcatatcacttgacatcctgaa

SEQ ID NO: 189714 - DNA, 601 bp, Human
tccttaagaactttggaaatatcagtgattatcacacactttgaaataagcaagtcactaatcaatgtgatcttattaaaatttaagtcagttcatgatgctactactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccrcctccagggttcaagtgattatcctgcctcagcctcccaagtagctgggattacaggcatgcgccgtgacacccggctaatttttgtatttttagtagagacgtggtttcaccatgttggccatgctggtcatgatttcctgacctcgtgatccgcccacctcggcctcccaaaatgtgggaattacaggcatgagctaccacacccagccccaaaacctcatcttgaattataattcccacatgtcaagattgagaccaggtggaggtaattcgatcatgggggctgtttcccccatgc

SEQ ID NO: 189715 - DNA, 601 bp, Human
tcatcttgaattataattcccacatgtcaagattgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttmttcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtca

SEQ ID NO: 189716 - DNA, 601 bp, Human
actcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacarggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtc

SEQ ID NO: 189717 - DNA, 601 bp, Human
ccaatgccctcagtcaccttcttattccattcccatttgctccagtaggaattaatctctttatttctccttacccttgagcacttttatatatctgcacttgggttaaaggcagttctattaatttctttgtttggacagaagtttccttaatttaccataatcatcactgttgtcactatgccagtccagtatgtttggacttcacagataagtcttgcagtttccaaaacaccatcccatccttactgcgtttattcttgaatgacttttcactgggagatagtatacttatcttttwcaacaaaactacaaatgggatcctaataacaagtttactgtttgttaatttgtgttagatataggcatactgtcatattttcctgtaatttttcatatctggtcttgtgaactgttactagtatttttcttccatatgtattttacctaccaacttgattgtaaactgcttaaagatagaagctatgttatataagcatttcacgcatgctggctcaatgaatcacaaataattgggaatttggttagacatctcatctgaacagtccctgccctgataccaccctgggacattcagccc

SEQ ID NO: 189718 - DNA, 601 bp, Human
ggctgtagtgcggtggctagatctcagctttctgcagcctcaacctcccaagctcaggtgttagcctcctgagtagctgggactacagacacaaaccatcatgcccagctaatttttgtatttttcatagagacaggagtactccatgttgccccagctgctctcgaactcctgggctcaagcagtctgcctgctttggcctcccgaagtgctgggattgcaggcgtcagccactacacctggcccctgcagagtctttatcaaacagaagtgaatattaggaggagcctggggaagaatyctctttgatttaccttggtgttaacactccagcgatacaactatggatcctccagaaagactatgtttttgctgtatcagtgccacctattaggaattgttccataaaagagcatgagaaactctctggagttcaaaaagtcaaaatgacatccttgctaaaaaatctctttatggtttgagttccatagttacaaccaggaatctctgggaatttggtctccaagctcttctcagagcatgtgttgcatacattctgcaaagcccttgggggatggagcaggcctagtttttggttttc

SEQ ID NO: 189719 - DNA, 601 bp, Human
tgattagagttagtttaatgagagtctttgtcacctgctgaaaagaattcgtttttatggctcagaataatagtgtaatcatagcaagagatgacttgtctatgtccattttataataattcaaaaatctcaataatttctgaaaaaaagaagcatttgttatcagagtcataaatgttgctatttatatgcttaagtagtagtatatcagaattcacagaaaggaacaattatttagtgtgcaagatagtatattccaaattatttcatattatagaaataaaaaatattccatagtccytaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgggattataggtgtgcgccaccacatctggctaattttgtatttttagtagagacagggcttcgccacattggtcaggctggtctcgaactcctgacctcaagtgatccacccccccgtcagcctcccaaagtaccttaagc

SEQ ID NO: 189720 - DNA, 601 bp, Human
tatcagagtcataaatgttgctatttatatgcttaagtagtagtatatcagaattcacagaaaggaacaattatttagtgtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgkgattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccactactagttgttcaatcatgaatcctccagtactttttatctgaataatatggagat

SEQ ID NO: 189721 - DNA, 601 bp, Human
acaacctctgcctcccaagttcaagtgattctcctgtctcagcctcccgagtagctgggattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccmctactagttgttcaatcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtct

SEQ ID NO: 189722 - DNA, 601 bp, Human
tcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtctcttaagcaagactttwaaaaaatcctactgttgtccccacctttatttttgaaagataaacttaaaatttacatttttaaaaatttttaaaaagtaaaattttaaatgactcaacaggtgattagattccatctaaggatgagattgaattcacgatctcagattctcaacatatatttggccttacctattgttaatgaaacttgcctgcaaggagggctgcatgttgcagaacttaaacggagcaataaaactatttataaatccagacacctttatgaggatgtttccttggtttcacttatgtaagccgaca

SEQ ID NO: 189723 - DNA, 601 bp, Human
attgttaatgaaacttgcctgcaaggagggctgcatgttgcagaacttaaacggagcaataaaactatttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttstcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtgg

SEQ ID NO: 189724 - DNA, 601 bp, Human
atctctcctgccatttgccagctgagtggctagtcacgtgatgtctccatgtttcatttcctcatctacaacataggaataataataattcttcctcatttaggagcttgttacaagaattagatgagcagtgtttagcacacagaaacactaagtgtttcttaagtaaattattattcagtagcttcgttcctggaaatttagggtatattaaactcatgtaaaagtactttatatttaaatttaaaacagtgagcttctagactaatttagtaataatcaagtttctttttaacctacrtgaattatatgagatataagacagttgtcatatgggactgtcctgtgtgtcacagaacggccagcatccctgacccctgctcactaaattttagtaatacccttcaatcatcatgaccacttagagtgcctggaaggttggtggtttttacatacactgttctagcgaggcctatacatttgttttgtgacatcattatagatcatctaactagacaagctctccctatctgaatcctcattgcccagtgtccacaatacccttatcacagtgaacaaattctgctatgtcacagctgaa

SEQ ID NO: 189725 - DNA, 601 bp, Human
tttgttgaagaggtctctcgtggtccatgagtgagtggatatttatttaccttccatgcctccacacttgtgtaccccacaccccaggggattcaggcacatatacagcagcactacctgtcaccagcctagtttacacagagaaagctacctctttttagggttagtgtttgattctgaatagaaatctcattatttatgcttctttgcaaagtactggtgaagtcttatcactttttaatattaaacttcatgtaaatgttttggatatttaattgtttatgatcaaggtgtctggctwgtgtgttagtcatctcccagctaacagtctcttggcaggccatgcttaattcagttattgcatgttaacaggctgttcaaaattccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaa

SEQ ID NO: 189726 - DNA, 601 bp, Human
ccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaaagcccagaacataagatttgaaccatttgtgcagtgcccaaatgtgtgctgatggaagagtgaacctttaatgttttgactcccrtactatttggttctatttttcctaaataagtcatggtcttttttcattaagtatacatttacaaaaatggttcagtctttgcacataactcagctctcacaattccctaatctaatgttgaccatgttctattttgtcataaaacccatgattttactgctttctctttactagagccctgcatattagcagtgaagacctggtccttaatgaaagtgtggggtccatcctcagtgtctcatatccctgcctgtgttttccttcaggagaccttcctttccttcctatctaagccagagt

SEQ ID NO: 189727 - DNA, 601 bp, Human
cttcccaggggtggccagaactcaaagtcttaaagtaaagggtagcaggagcttcatctgccatgattaagaggagttctgggggctctctgctgctcctgggtgcatactatataaacagatgcccagccacccaggggagggacctacaaagatcatgagttaccacgagctgtttccagtttgtcctcctttaattaaaataattagagcctcgtcagtaatgacgagattgcctcactaactgtccaagggtgttagtactaagccacccaaagaacctttttataatgtctcatasagtagaccagagaatgttgctgtgactcctttatcatttatagagatgtggctatgttgggactcctaatggcatgttaccccaaatgctgaactatccagcttgtcactcagaaggagcttcctgacttcagcttcaggcattcacatgctatctggtagagtcgtcttctagcaatgctgatagtttccttggtccagaatttgttaccttcagaagaagagtgtgaggaagagatcccgttctaaagccacctagaccaaacctagcctgagtctccttctggttgggcttaagatg

SEQ ID NO: 189728 - DNA, 601 bp, Human
gatgagaaacattggctaacttatagactttcagatttatttctgtaaagataagtaatagccattgcaaagcagccgtacttgtgaaattggagttaagcttccataacagcggtcttaaagaataggtagggttagttaatacacagcagcaaccagctgttcttcctccctgctgagactgggaaagaaggaaattaacttcaactataatggaagagattttcaaaactggtaatgggaaatttatcatcaatgaagactattttaaacattggaacaaatgagtgaccaacagaartggaggaattatgtattctattggatttaaaatagaatatatcatctgctcaagacacttagaattggtagattagatctgtctaataatttttaactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgt

SEQ ID NO: 189729 - DNA, 601 bp, Human
aactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgttgccggcagttcttccccagccccacaccccgctctggattcatggatgaaaatgcaaactcagatgccatattaagtactcagaattctcccatgttcacacatctttttactgtattgctgtgattgttcagttgggcttgaaaaatattatttattttc

SEQ ID NO: 189730 - DNA, 601 bp, Human
cctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgtygccggcagttcttccccagccccacaccccgctctggattcatggatgaaaatgcaaactcagatgccatattaagtactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtct

SEQ ID NO: 189731 - DNA, 601 bp, Human
aacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgttgccggcagttcttccccagccccacaccccgctctggattcatggatgaaaatgcaaactcagatgccatattaastactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccatt

SEQ ID NO: 189732 - DNA, 601 bp, Human
aaataaagatcgcctcaatatggaagggaagtgatctctggaaaagagcataattgtcagatgtctataacttgtcagttttcactgtacctcacactcctaatggcaaacctttaaattcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaascccttctgttccagttgctccaatcagagtaatacactgcacagaaagcatacaagatatacgatgtctgtggacagatgctctgtggcattattaaccctggcagttgctttagctgttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcaga

SEQ ID NO: 189733 - DNA, 601 bp, Human
attcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaaccccttctgttccagttgctccaatcagagtaatacactgcacagaaagcatacaagatatacgatgtctgtggacagatgctctgtggcattattaaccctggcagttgctttagcygttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccag

SEQ ID NO: 189734 - DNA, 601 bp, Human; identical to SEQ ID NO: 36278

SEQ ID NO: 189735 - DNA, 601 bp, Human
cagcgcgggcagccgagcacacgccgaggagcctcccgctcgcccgcagacacacaccccagcccgtgcgccccgcagtcgcaccccatcctccgccaccccgcgagagggtgtgtgggctgggcagccgggtggatggcggggccagggatggaatgagcgcgccccagatggactgggggcgttgtgggaggaggtctgggccagtgtctgagtccgagggggtcgtgtaggcgtgtggggttgggagtggggcctctcccgggtgggcagtagagacctcgaggctctcaggctaggrccttgtggacagttataccaagtgtgggggcctgtagtgggacaggagatcgttggcactgtcaggtggaagcgagttggtgtgtcttgaatatatgaggaaaagatttgagaggtctgacaaagacaggggatacatttggaggacaggacagtgggacaaaacctgtttgcttgccacttttttctttcttttttttggtttggtttgccatgatactggtagtgagagagaattgaaatttctgggtttcccctctcttggccaagcagaaggatggtattggagggctgagcacac

SEQ ID NO: 189736 - DNA, 601 bp, Human
ttcaactttttcagatttcggttgtcaaaataaaaatccatatcttttaactcttctgttaattgctgcttaccattacacgtgcctctaaacatcgttaatgggaaacatgctactatttttgtggcatgaaggtgcttatatctgcctcaaataaatataatagatgaattgtgcttgtccaaaactcaagtatggtcgttacattatgaacattatacaacatgtagatgaacacatgttaccagtggtttacgcccagatatcaaagtttaacctatgaggtacccttttttttttwatttttattttttgagacggagagtctcactctgtcgccaggctggagttcagtggcgtgatgtcggcttactacaacctccgcctccccggttcaggcgattctcctgcctcagcctcctgagtagctgggactacaggcgcgtgccaccatgcccagctaatttttgtatttttagtggagatggggtttcaccatgttggccagaatggtctccatctcttgacctcatgatccgcccgcctcggcctcccaaagtactggaattacaggcgtgagccaccgcgcccggccctatga

SEQ ID NO: 189737 - DNA, 601 bp, Human
gattacaggtgtgagctaccatgcctggcctctaatcttatctatgtagtctgcccaacccttaacacatggctagattgtgcctgtttgtgaactttctagacagcacctatctcctgttgcatttgtctgtattgggcaagtagattaaatatttccccattttcttattttttagcactatgaagtttaacattttactatattatcacagaatatagctctttagaaaacatttgtcttattcactgattgttatatgtgtattgcttgtctctttaaggaggatccaagtttttartgagtagagaaaatagatgtgttattgcttctttgcagaagttgctaatgaaatgaaatgtatttttccttattataggttgttctgtcttcctgaatatttcattatactgactacaacaacacatgatagtatttctatcattagagatacaaggaaaacatttaaatattaagcagtcaggtgttctttcagtggtagcttagtggtcagaggactaatacagagacaactaagtgtggtagagagtgtgaaccatgtcatcaggctgcctgggttcctgtcccagctccactcacc

SEQ ID NO: 189738 - DNA, 601 bp, Human
atgagtagagaaaatagatgtgttattgcttctttgcagaagttgctaatgaaatgaaatgtatttttccttattataggttgttctgtcttcctgaatatttcattatactgactacaacaacacatgatagtatttctatcattagagatacaaggaaaacatttaaatattaagcagtcaggtgttctttcagtggtagcttagtggtcagaggactaatacagagacaactaagtgtggtagagagtgtgaaccatgtcatcaggctgcctgggttcctgtcccagctccactcacyggttaggttacttagcctctctgcctgtcttctcagctgtaaaagagtggtaataatagtgcctatgccatagtgttgttgaaaattaaacaagaccatgaaggtaaagtacttagaagtgcctggtacatattattgtcttacaggtttgatctcttacaaatattgagtgatggaaaagcagaagttaatttttttaacatcgttttgaaatattcttatttttagaggggaaaaaagccctcaattttggaggttggattttgacatgccattaattacttttctcttttaggttta

SEQ ID NO: 189739 - DNA, 601 bp, Human
gaatgagaacttgggcaaatactttccttagctttttaagacattattttattgcaaaaataatattgaaataacagattgcccataatctcatcaaagctatatttttatttgctcacattaccacccagtacttgattgtgtacatatttttttgtttctttgtggttttttttgagacagcctcgctttgttgcccaggctggagtgcagtggtgtgatcctcactcactgcaacttcgcctcttaggcttaagcaatactcctgcctcagcttcccgagtagctgggattacaggtkcgtaccaccatgcccggctaagtttttggtatttttagtagagatggggtttcaccatgttggccagactggtctcgaactcctgacctcaagtgatccgcccacctgggcttctccaagtactgcgattacaggtatgagccaccgtgcccgggcagattgtatatatatttgatttcatagatgtgtagtaatactatacatacaatcttatagtctatatttacaacatggctatttttattttgttttccactctttggcatccccttaccccctgtaaaaagaaagattactggc

SEQ ID NO: 189740 - DNA, 601 bp, Human
tctgtactaaaaatacaaaaaattagccaggtgtggtggcaggtgcttgtagtcccagctactcgggaggctgaggcaggaggatggtgtaaacccaggaggcggagcttgcagtgagccaagatcgtgccactgtactccagcctggttgacagagcgagactccgtctcaaaaaaaaaaaaaaaatacttattttagagaaattggaaaatactaaaaattacaaaggaaaaaatactaatctctctgattccaccatacagagatactcactagtaatattttacagtcttttctttaacacacacacatatgcatatattgggattgtgtatagttttgtagcctgcacaagaatttatcatgaaaaatgtcaaggatattttgaaacaaatatttagtggcaaatttagtatagtgaacccccacataagcccccttgattaaaaattatgaaagttttgctccttttgctttctctctccctcttttttttcccctttgctgcagtattttaaggcaaatcccaaacatcatgttatttttatcctcatatagtttggtatctatgtctaaatatatgggtgttttcttactaat

SEQ ID NO: 189741 - DNA, 601 bp, Human
ccagccctagaaatgtgtcagtctggctttctttttttttttttttttctaacttctgatttttttgtttgtttgtttgttttttgaggcggagtctcactccgttgcccaggctggagtgcaatggcatgatctcggctcactgcaacctctgcctcccaggttcaagccattctcctgtctcagcctccccagtagctgagattataggcgcctgccaccacacccagccaatttttgtatttttagtagagacgggggtttcaacatgttggcccggctggtcttgaactcctgacckcaagtgatttgcctgccttggcctcccaagtgctggaattacaggtgtgagccactgcacctggccgctttttaaaatttcaatttcagttttgcctgtgttgagttcccttgtgtaggaaaattattaacccttatgtcttatcatggagagatagaaagggtgatacagtgttgaacttttcagtgtttttcagtatttctgcagaggtagctttaggatagaaatttataatttcctaattgtcacatgggtttaaatacatttatatttagttaacatttttcaggtaggtgctgt

SEQ ID NO: 189742 - DNA, 601 bp, Human
gaaaggttccctgttccctttaaatttcttcatctcagtttttgttatatagtggtttatgggtcttgcttaaggcacatacaaactcagaatggctgttaaaaatttcagtgtttgggaagttttggagaatgttggctcttcttgctcaacagttttttcatttaggatggtgggtaagacagactaaaaaaaaaaggcagcacaacctctggtggcagggtggtgtggtggtgaagaggccctggagtcaggtcctaatcctgattcacatttactagctatgtgaccctgggcgagrctcttaacttctctgagttcattatctctaaagtggtgaaaattacacagtaactgcctcttagattatagttactattttgggttctattttggtacacctgattttatgttcttattttcaaactctgatgaggtacaattaaatgctatggagttaatgaggacaattctggttttagggaaggaagaaagaagatttaactctcaggtagctaaggtcagcttcatatcaaaggtgaaaattatgaaaatacataatgtgctgttgggtttttaaattgaaaaaatagcaggaata

SEQ ID NO: 189743 - DNA, 601 bp, Human
caacctctgcctcctaggttcaagcaattctcatgcctcagcctcctgagtagctgggattacaggcatgcaccaccatgcctggctaatttttgtatttttagtagagatggagtttcgccatgttggccagcctggtgtggtctggaactcctggcttcatgtgatctgcctgtctcgtagttttatgtttttgtattttgttttttttttttgagtctcgctctgtcacccaggctggagtgcagtggcgcgatctcggctcactgcaacctccgccttctgggttcaagcaattctyctgtttcagcctacaggtgtgtgccaccatgcctggctaatttttatatttttagtagagacaggtttcgctatgttggccagactgctctcaaactcctgacctcaggtgatccacctgccgcggcctcccaaagtgctggagtgagccactgtccagccaattttatgttttaacaaatgtatactcatgtaactaccatcccaatcaacataagcacatttccatcaccatacaaagacttctgatgccctttgcaggtgataccccaagcgcattctgttgagttgggtttcaaac

SEQ ID NO: 189744 - DNA, 601 bp, Human
attattgcttgatagatgaccactattgacttaataagcaatatatactcaccgccaacttttacattcctgactgagtaccttaaagtactcagtgagctctctgcatctagaaactcatattttcaggtaccaggttatttagctctcccacacccatgcgcctcttccgcatacacaccaggtgaaagctgcactgacttctgtgctatgggccatacttgtgtcctcagcctctactagtatgctgtattctcaggttctcaggggctccaccttggtcagtgttagttccttccctttttttttttttttttttttttttttttttgagacagggtctgtctcggtcacccaggctggagtgcagtagtgcagtcttagctgaccgtcacctttgccttctggtctcaagccatcctcctacctcagcctccccagtagctgggaatacaggcacctgccaccatgcctggctaatttttttttctttttgagagggagtcttactttgtccccaggctggagtgcagtggcgcgatttcggcccactgcaacccctgcctcccgggttcaagcggttctcctgcctcagcctcct

SEQ ID NO: 189745 - DNA, 601 bp, Human
agaagtcaaaccaagtttattagggtgatttgaatattttagaaccatttatctctctaaagtaactaaacggtcccacacccactttttttcttaaattggcaagacttgattctagatgtaatgttgtatacttatcacaggtaagagtttaaactatgtgaggaggatttgtaagtacttcggaaagtggtcatcactagacctgggttggattcattaatatcaaattgtgttcaatcagattaacccaacttttttcctgtgacaaagttattggagtaggtaaggaaaatgtggwagaaataacagatttagacttcctaagtcaggtgacaaggtatcttacgatgttctttcgaataagatagaaatatgcaagttgggcataaggacaattaaagaggtgaataactgcttgaatgaccacacacagactgatactaagttggagggaggtttgtaatgatatgtaatgagtctgttcttggcattgtacttttcaacacgtttttagttgtataggtgatggcatgtctttatggtagcaaaaaatatatatattatagctagaaataaaatagacagcaaacatgcaaac

SEQ ID NO: 189746 - DNA, 601 bp, Human
ttgtaagtacttcggaaagtggtcatcactagacctgggttggattcattaatatcaaattgtgttcaatcagattaacccaacttttttcctgtgacaaagttattggagtaggtaaggaaaatgtggtagaaataacagatttagacttcctaagtcaggtgacaaggtatcttacgatgttctttcgaataagatagaaatatgcaagttgggcataaggacaattaaagaggtgaataactgcttgaatgaccacacacagactgatactaagttggagggaggtttgtaatgataygtaatgagtctgttcttggcattgtacttttcaacacgtttttagttgtataggtgatggcatgtctttatggtagcaaaaaatatatatattatagctagaaataaaatagacagcaaacatgcaaacctttaaaaacactttggaagacctaaaaatactgatataaacattactagaagtctgtataggtatccattctcatcaaaaacagtgtaataaaagcccagtcaaaatctcagtgagactattttggggacacttgacagaatgattgcaaagtttagaataaacatgtaa

SEQ ID NO: 189747 - DNA, 601 bp, Human
tgttattttggactcagcttttctctcagctcactgcaacctctgcctactgggttcaagtgatcctcctgctcagcctcccaagtagctgggattacaggcatgtgccaccacacctggctaatttaccatgttggccaggctggtctcttaactcctgacctcaagtgatccacctgccttggcctcccggagtgctgggattataggtgtaagctactgtgcctggccctggactcagtttttctggattaaacttatgaaatattgagtacaccttttaagtttatactgtatatctttttttttttttctgagataagagtctttctcttgttgccccagctggagcgcaatggcgcaatcttggctcactgcaatctctgcctcccaggttcaagtgattctgctgcctcagcctcctgaatcgctgggattacagtgcctaccaccatgcctggctaatttttttttttaattttcagtagagatggggtttcaccatgttggccaggctggtcttgaactcctgacctcagatgatacacccacctcagcctcccaaagtgctgagattataggtgtgagctaccacgcccgt

SEQ ID NO: 189748 - DNA, 601 bp, Human
catattcttaattttccctctgattttagtataccctcttttctcagctccccatcagcccagagccattgataaattatcacatcactggttttcagaattatttttttgaagtatagaatcacttatttcaaacaaaattgagtatacaaaacagataaatatgggtgggttttctaattaaagttggagtgggaggctagtgacctgcctgctctaaacccctttacctcctactcaggtccctgaaacacaaggaaaatgccaaaattaaagaaatgcttttttcaaatgaaatatygggcaatagaaaatgagagacaaaatgcctaacttaggtcttttgtcttgtgaatcccagagaaatttcattttatttattatgaaagtaattgaggtggttaaggataaattaaataaaaagtacaagatacatgggggatgttgactcctgatgtaattattcccactccaatgtgatttactctgtgctagatatatgtatatgatggaatttctagcccaaggtttagttaggtgataaataggaaggaaataatatacctcatttccagttggaaagtgcctgtcaaggtatata

SEQ ID NO: 189749 - DNA, 601 bp, Human
ggcttgagccactacgccccgccttggtctcctgtaaagttgttaaagtcatttattttggatgagaaactgaaaaggttaagataaagagttgtctcgttttgtatttaggatatcttcttactgccctgtgaatagatgtttcagtaaacatgtttttagattatatagctctctataaagatcacatttgatgttgagatgcttgtctcagaatttgacgagtgcaaaaatgagaaagacaaataagctgtataaagttaatgcgtggtggctcatgcctgtaattccagcagtttgrgaggctgaggcgggtggatgacttgaggccaaggagttggataccagcctggccaacatggtgaaaccctgtctctactaacagtacaaaaattaggtgggcgtggtggtgcatgcctgaagtcccagctactcaggaggctgaggtgagagaatctcttgaacccaggaggagaggttgcagtgagctgagattgtgccactgcactccagcctgggtgacagagtgagactccgtctcaaaaaaataaataaataaaatgaaattaatctttccatttctaaatcattttttttgcct

SEQ ID NO: 189750 - DNA, 601 bp, Human
aagatacaaaaagctttaaacattattcttactcttttgtttaatatcccccatcgcccagtttacttcattttagccatttatagaataattaaagtgaaatcaaagtttggctttaaatgataccatgcactgaaaaagagttcctgcgtaatccttagcaccaaaggatgaccttacacagctgaagaacatcatgtaattgtgagagatgaaaaggaagtatattatgtaaaagagggaagaagcaactaggaggtattctgaaagaatggaaacaaccatgctgagttttgactcsatattatttttatttctcaccttaatgcttactgaatagtgttagctaccaaaaggatgcatggctaaagaattgtggggcagtaggtttattgggctaatttgcttatatcctgagattttacatttggtgatggtagcttctgttttccctccttcagggcatccaattttgtttactgaagttcactccttagtttcttggggtatctttgtggtagtagaatggaagttacatattcaggccagctgtatatgtgtttcttgggttcacaaccaccttctgttcctgctacactga

SEQ ID NO: 189751 - DNA, 601 bp, Human
atgtaattgtgagagatgaaaaggaagtatattatgtaaaagagggaagaagcaactaggaggtattctgaaagaatggaaacaaccatgctgagttttgactcgatattatttttatttctcaccttaatgcttactgaatagtgttagctaccaaaaggatgcatggctaaagaattgtggggcagtaggtttattgggctaatttgcttatatcctgagattttacatttggtgatggtagcttctgttttccctccttcagggcatccaattttgtttactgaagttcactccttartttcttggggtatctttgtggtagtagaatggaagttacatattcaggccagctgtatatgtgtttcttgggttcacaaccaccttctgttcctgctacactgaatccttcaggggtttaggtgggactgggctatatacatcttaatggggtgggccctcattttttcctttttttttcctcggcatgcctactcaagattcatttggttttgtatgactttgagttgccccagaaggtctggactagacctcttgagctcttgtggtagaatctggcatgtatgtagagaggtgtgtg

SEQ ID NO: 189752 - DNA, 601 bp, Human
tttttttaattgttgctatttgctgttttattttaaaggtctctttttcagtcatgcaggagtcagtcgaagtgtggccataataactgcttttctcatgaagactgaccaacttccctttgaaaaagcctatgaaaagctccagattctcaaaccagaggctaagtgggttctttttttatagtaataattatgcttttgtgatataattttaagaaaatgaaactttatatttctttatcattacaggatgaatgaggggtttgagtggcaactgaaattataccaggcaatgggataygaagtggatacctctagtgcaatttataagcaatatcgtttacaaaaggttacagagaagtatccaggtaagtaataattgctagtgtgtaatgggctttctagatgacatttactttagcattgtatgctttaccttacttccagcaatccctgagaaactattgtttctttttgaaactgatttagccagaaataacctattcaaaatcacatggtttataaatggcagggtcaggatttgaattcaggcagcccgtgcccagaacctaagcacttaaatcactgtcctctcctacct

SEQ ID NO: 189753 - DNA, 601 bp, Human
aacctattcaaaatcacatggtttataaatggcagggtcaggatttgaattcaggcagcccgtgcccagaacctaagcacttaaatcactgtcctctcctaccttagcctgatttctcaacactggaatttgatttttttttttttttaatttttgaggttagcacttgttgcctcaatttgacattaactgaatttatctgaaaatgcagagttgattttgacaaataaatacattttaattatgtcatatagaattgcagaatttacctcaagaactctttgctgttgacccaactacygtttcacaaggattgaaagatgaggttctctacaagtgtagaaagtgcaggtaaactattttatatcctttggatattttatcttgtctcagtagctgaaaagtacttaatgttttattttcttaaatttctgtaggaagattttgtttaattgaaatttttagttcagatctgttttcagaaagaatataaattcttaaaaagagaaataatcagattgtaagggttattgaaaatttaagtagtgtaatcaatgttacattattttgttctctaagcaatattgcacattttgctggg

SEQ ID NO: 189754 - DNA, 601 bp, Human
gaacctaagcacttaaatcactgtcctctcctaccttagcctgatttctcaacactggaatttgatttttttttttttttaatttttgaggttagcacttgttgcctcaatttgacattaactgaatttatctgaaaatgcagagttgattttgacaaataaatacattttaattatgtcatatagaattgcagaatttacctcaagaactctttgctgttgacccaactaccgtttcacaaggattgaaagatgaggttctctacaagtgtagaaagtgcaggtaaactattttatatcmtttggatattttatcttgtctcagtagctgaaaagtacttaatgttttattttcttaaatttctgtaggaagattttgtttaattgaaatttttagttcagatctgttttcagaaagaatataaattcttaaaaagagaaataatcagattgtaagggttattgaaaatttaagtagtgtaatcaatgttacattattttgttctctaagcaatattgcacattttgctgggcgcagtggctcacgcctgtaaccccagcactttgggaggccgaggcaggcagatcacctgagattggg

SEQ ID NO: 189755 - DNA, 601 bp, Human
ttctctacaagtgtagaaagtgcaggtaaactattttatatcctttggatattttatcttgtctcagtagctgaaaagtacttaatgttttattttcttaaatttctgtaggaagattttgtttaattgaaatttttagttcagatctgttttcagaaagaatataaattcttaaaaagagaaataatcagattgtaagggttattgaaaatttaagtagtgtaatcaatgttacattattttgttctctaagcaatattgcacattttgctgggcgcagtggctcacgcctgtaaccccrgcactttgggaggccgaggcaggcagatcacctgagattgggaatttgagaccagcctggccaacatggtgaaaccccgtctctattaaaaatacaaaaattagttgggcatggtggctggtgcctgtaatcccagctactcaggaggctgaggcaggagaattggttgaacccaggaggcggaggttgcagtgagccatgatcacgccactgcactctagcatgggcgacagagtgagactctgtctcaaaaaaaaaaaaagaaataccgcacatttcatccatgttttcatccttttg

SEQ ID NO: 189756 - DNA, 601 bp, Human
ttgcaaccatcgtgtattagtctattttcacactgccataaagatagtacgtgagactgggtaatttataaaggaaggaggtttaattgactcatggttctgcatggttggggaggcctcaggaaacttattatcatggcagaagggaaagcaggccacttcttcacaaggcggcaggagagagaagcatatgtgaaggaggaactgtcaaacacttataaaaccatcagatcttatgagtgctcattcactatcacgagaacagcatgggggtatctgcctccatgatccaatcacctcycttcttccacacttggggattacaatttgagatgagatttggatggggacacagaaccaaaccgtatcacatcacaattcacattcccactcttcccattctttttttttgagacggagtttcactcttgttgcccaggctggagtacaatggcacaatcttggctcaccacaacctctgcctcccgggttcaagtgattctcctgcttcagcctcctgagtagctgggattacagggatgcgccaccacgcctggctaattttgtatttttagtagagacggggtttttccatgttggt

SEQ ID NO: 189757 - DNA, 601 bp, Human
cacaattcacattcccactcttcccattctttttttttgagacggagtttcactcttgttgcccaggctggagtacaatggcacaatcttggctcaccacaacctctgcctcccgggttcaagtgattctcctgcttcagcctcctgagtagctgggattacagggatgcgccaccacgcctggctaattttgtatttttagtagagacggggtttttccatgttggtcaggctggtctcgaactcctgacctcaggtaatccacctgcctcagcctcccaaagtgctgggattacaggcrtgagccaccatgcccagctgcaattcccattcttgatggtattatttgtagcagttagagattttaattttgatggtatctaatttatcagtttttcttttttgtggcttgtgattctggctttctaattttacttaacctgggaaacacacacacacactccagccaagttaaatacatttttatgtaagattctaaatcctgtgcatacttatttgtatacatatttgatttttttctgtagaatatgtacctagaagtggaattcctggctcgaagaatgtattttaaatattagtg

SEQ ID NO: 189758 - DNA, 601 bp, Human
tttgtctctttcttactcatttgtaggacctctatatattctagatgttaatagttcatctaatatattgcaactattttcttcagtctattgcttatcagattttttatgttttgtcatattaaaatgaaggatatttacataataaaatttgttagtttttttatttatggcttctgaatttcttttttttgagacggagtcttgctctgttgcccaggctggagtgcagtggtgtgatcttggctcactgcaacctccgccttctgggttcaaatattctcctgcttcagcctcccargtagctgtgattacaggcatccgccaccatgcccaactaatttttgtgtttttagtagagacggggtttcaccatgttgaccaggctggtctcaaactcctgacctcaggtgatctgcccgccttggcctcccaaagtgctgggaattacaggtatgagccaccacactcagcctgcttctgagttttatgtctagttttctatagctcaagattaaaaataaaaactcttaccttataccatgcataaatcaaagagctaaacataaaaattaatgctataactaactacattagaaga

SEQ ID NO: 189759 - DNA, 601 bp, Human; identical to SEQ ID NO: 26572

SEQ ID NO: 189760 - DNA, 601 bp, Human; identical to SEQ ID NO: 26573

SEQ ID NO: 189761 - DNA, 601 bp, Human; identical to SEQ ID NO: 26574

SEQ ID NO: 189762 - DNA, 601 bp, Human; identical to SEQ ID NO: 26575

SEQ ID NO: 189763 - DNA, 601 bp, Human; identical to SEQ ID NO: 26576

SEQ ID NO: 189764 - DNA, 601 bp, Human; identical to SEQ ID NO: 26577

SEQ ID NO: 189765 - DNA, 601 bp, Human; identical to SEQ ID NO: 26578

SEQ ID NO: 189766 - DNA, 601 bp, Human; identical to SEQ ID NO: 26579

SEQ ID NO: 189767 - DNA, 601 bp, Human; identical to SEQ ID NO: 26580

SEQ ID NO: 189768 - DNA, 601 bp, Human; identical to SEQ ID NO: 26581

SEQ ID NO: 189769 - DNA, 601 bp, Human; identical to SEQ ID NO: 26582

SEQ ID NO: 189770 - DNA, 601 bp, Human; identical to SEQ ID NO: 26583

SEQ ID NO: 189771 - DNA, 601 bp, Human; identical to SEQ ID NO: 26584

SEQ ID NO: 189772 - DNA, 601 bp, Human; identical to SEQ ID NO: 26585

SEQ ID NO: 189773 - DNA, 601 bp, Human; identical to SEQ ID NO: 26586

SEQ ID NO: 189774 - DNA, 601 bp, Human; identical to SEQ ID NO: 26587

SEQ ID NO: 189775 - DNA, 601 bp, Human; identical to SEQ ID NO: 26588

SEQ ID NO: 189776 - DNA, 601 bp, Human; identical to SEQ ID NO: 26589

SEQ ID NO: 189777 - DNA, 601 bp, Human; identical to SEQ ID NO: 26590

SEQ ID NO: 189778 - DNA, 601 bp, Human; identical to SEQ ID NO: 26591

SEQ ID NO: 189779 - DNA, 601 bp, Human; identical to SEQ ID NO: 26592

SEQ ID NO: 189780 - DNA, 601 bp, Human; identical to SEQ ID NO: 26593

SEQ ID NO: 189781 - DNA, 601 bp, Human; identical to SEQ ID NO: 26594

SEQ ID NO: 189782 - DNA, 601 bp, Human; identical to SEQ ID NO: 26595

SEQ ID NO: 189783 - DNA, 601 bp, Human; identical to SEQ ID NO: 23628

SEQ ID NO: 189784 - DNA, 601 bp, Human; identical to SEQ ID NO: 82192

SEQ ID NO: 189785 - DNA, 601 bp, Human; identical to SEQ ID NO: 82193

SEQ ID NO: 189786 - DNA, 601 bp, Human; identical to SEQ ID NO: 82194

SEQ ID NO: 189787 - DNA, 601 bp, Human; identical to SEQ ID NO: 82195

SEQ ID NO: 189788 - DNA, 601 bp, Human; identical to SEQ ID NO: 82196

SEQ ID NO: 189789 - DNA, 601 bp, Human; identical to SEQ ID NO: 82197

SEQ ID NO: 189790 - DNA, 601 bp, Human; identical to SEQ ID NO: 82198

SEQ ID NO: 189791 - DNA, 601 bp, Human; identical to SEQ ID NO: 82199

SEQ ID NO: 189792 - DNA, 601 bp, Human; identical to SEQ ID NO: 82200

SEQ ID NO: 189793 - DNA, 601 bp, Human; identical to SEQ ID NO: 82201

SEQ ID NO: 189794 - DNA, 601 bp, Human; identical to SEQ ID NO: 82202

SEQ ID NO: 189795 - DNA, 601 bp, Human; identical to SEQ ID NO: 82203

SEQ ID NO: 189796 - DNA, 601 bp, Human; identical to SEQ ID NO: 82204

SEQ ID NO: 189797 - DNA, 601 bp, Human; identical to SEQ ID NO: 82205

SEQ ID NO: 189798 - DNA, 601 bp, Human; identical to SEQ ID NO: 82206

SEQ ID NO: 189799 - DNA, 601 bp, Human; identical to SEQ ID NO: 82207

SEQ ID NO: 189800 - DNA, 601 bp, Human; identical to SEQ ID NO: 82208

SEQ ID NO: 189801 - DNA, 601 bp, Human; identical to SEQ ID NO: 82209

SEQ ID NO: 189802 - DNA, 601 bp, Human; identical to SEQ ID NO: 82210

SEQ ID NO: 189803 - DNA, 601 bp, Human; identical to SEQ ID NO: 82211

SEQ ID NO: 189804 - DNA, 601 bp, Human; identical to SEQ ID NO: 82212

SEQ ID NO: 189805 - DNA, 601 bp, Human; identical to SEQ ID NO: 82213

SEQ ID NO: 189806 - DNA, 601 bp, Human
tgtactgcgagagagatcttgaatgcatcactttggtatcctaagaagtgtaatttttttccctcgtcatactgggctgtgtttagacctcgtataatacataatgaatagaaacagagaagcactgttcggtcagcgatgggacagatagaactgtctggtacagttaaattcgggacgtgtcagttaccattgaaagtaacacggggacaccacaatcatgtatatttcaagatgtaatttattagtggaggtctcagttttttctctttgttactgagtttgactgaaaaaaaaaaawaaatgctgccctacaagttttaaagaacggtaattatttacgtgtaaaatcaatgatggctagtatgcatttttggtcaaattttgttttccttaatacgggagagcaaaattttgacagaaaatggttcgctagaattgagcttagattctttttatttttaaagagaaactagaagaatgcttctcttcttgaatgcagtatattgctgtaggagtatcttcgttttggtgcctgtgaaacagttatggaaaatggcaacatgaaaacgagaacaactaatgtctgaaataagtgttt

SEQ ID NO: 189807 - DNA, 601 bp, Human
aggactaggtatgtttggagaattaaataactatttcacagccagacaacactacagacagctgcaaatagagaaaagaaggaaaacttttaagatacgtggatgtaagctttcattcttacatcaatggaagtgatgatagcagtcagcaggtcagttcgatgctcagtgataagaaataacagggttatttcaaggtaaggtaatcaggctctaagttgccaagaacagtaattcatgtacttgctggtttcagttcagaagttgcataacattcaaatatttcttaccttgtcacttkaataattcagtggaattatcttaatttagtgtgctatgttaccattactaaattggggatgttacatgatggtgatcttcaattaaacttaggaatgttgcagacattttcttcatcattgacctgttgtttttccttttcataattcagatttatttgatataccaataaatgttggctatatcactgatcattttattattcatagtcttgataacattatagtttattatgactcatatataatgattcattgcagctgataaaatgttgttagggattgtattgtgagattttatt

SEQ ID NO: 189808 - DNA, 601 bp, Human
ctgataggccttatggccaaaaagatgacttcctccagggatacttactgtctgtgttagattcagtaatgggagtctcggtctttaaggaatccatgatacatttttcagtctggttgggaaagataagacacatgaggtagagaagattgtcctagaaatgttggtatataaataagcatgtaacattgtttcataagtattaaggatgagctataaaataactaggttgtagctcatacttctacttgcttaattgtgtattacatgataaattacccgattctagagatatgcactraccactctcattagctttctttgggaaaagtctgcaccaaagataaatagtgatttcaaaataagttttaatcatgaacttgattattttggctgtatctcttgaaacactttaccatatagcctatgtgaaataattaatcataatgacaatacatgatttatgagaaaccataatttatgctgtaagacctgccattttattacattcttatttttatttttcatgcagcagtattttcgtttattgtgttttgtgcttttcttttattctctatgtaatttgtgtgcctttataagc

SEQ ID NO: 189809 - DNA, 601 bp, Human
taaggaatcacaaaatccaactggacttcacaagaactattaatactattagtctgagacctgtgataaacaactcagatgttaaaggtctaattcagactgtcaacagatgaaaaataagtgtcagtctgaaatcttcggatagtatatcggcaagtgtcagtcttccaaaatattatttagaactgtgaatataatttttcacagaagcaacattaatccataaatctcccgtcctgtagtgtaactatagtatatcagttccatgggaaaatagtcctgctctaagctactcaacagmagggactttatctttctacaggacttaaatcttgacctccagtggttctacataccttaagtgaatgaatgagtttgaattctagttttgaacaccttcacctgctactcttggataatcgtgtctgtttgtgcctagtacctatcctctgtccttttgtaaactggtctgagaccctgataccatttatcctgcatgtttcaaaggaaaaaactatttagactttaaaaaaatgcttttctaatacaacttgctagataaataattcattataccaaattccttagtaaagaaattaac

SEQ ID NO: 189810 - DNA, 601 bp, Human
tatttctccaatcttattcatagttacaaaatcaggacaatttatttcttctattaaatgccgtttattgaactaagcattatttcaaagaaaaaagaactagtcattgaaaagtaattccttttttagatacctcattaaacttaacaatggcatttaaacacttctgattattgaaaaattaaacatgcctaaattatttggtctcattctactcatagccaaaatttaaatatagcttatcaagtggtttctgaaaggtatagagtaaaaatgcattcttcctcagctctttttctgyaccaaaaagcgctatctaggaagcttagcacagaactgaaagtgaatcaataggaagatgttggttaaagaatatataattagttagattgaaagaatgagatcaaggaatctattgcacagcatggtgaatatcgttaatgataatatatttttgaaatatgctgagagtggatgttaggggttctcaccacaaaaatgacagctatgttaagtaatgcatttgttaataagctggatttaacattccacatgtatgtatacttcaacatcgtgctgtacacaataaatacatacaatt

SEQ ID NO: 189811 - DNA, 601 bp, Human
gcgtggtggctcacgcctgtaatcccaacactttgggaggccgaggcgggcagatcatgaggtcaggagatcgagaccatcctggctaacacggtgaaaccctgtctctactaaaaaaatacaaaaaaaattggcctagggcagtggcaggcgcctataatcccagctactcgggaggctgaggcaggagaatggtgggaacctgggaggtggagcttgcagtgagcagagatcaagccactgcactccagcctgggacacagagcgaggctccatctcaaaaaaaaaaaaaaaaaaaaargaattaaaaactatcttcaggctgaccatatcagtttttatgtcttttcaaccaaattgggtcagatagagaaaaggaaaagatctgcatactcattgcaacctatgcttttcctgtgaagaagccagtcatctaattttttaaaagcagtgaaaaaaaggctacagactatagcatagatttatgttaaatgttacaagcatgaaatgttaaaatatatccatttacaacagagtaaacagacaacgtacagaatgggagaaaatatttgcaaactatgaatctgacaaaggtctaata

SEQ ID NO: 189812 - DNA, 601 bp, Human
agagggggcggaaaaggtaactctggggtattggacttaattcctgggtgatgaaataatatgtacaacataccccagcgatataagtttacctacataaccttcacatgtacccctgaacctaaaagtttaaaatacatatatatccatttaaagcaattcagattgtatcttagcttattttttgctttgaagctagcttatgaaattttaaaatcaggtaaaatttgtgtggcttgcaaggtcagcattaaaaaacctaaggaaaggggaggactctgatttttcactggttatgaarcaaggtgatactaaatgaattatatttattatatgcattacagaataaaatttctgtgtttactgggtattttttcattttaattcccaaagtaaaactacaactcaaagatgaccagaacaattgttttacttctttcatcctcatagtcattaacaagttttaacagaagctactcgacgacagatattctgcgttttacacgtttgctgcccctagaggtctgagcaaagacagagggaagctccgaaagtacaagactctggctgacttgaagctgccacataggtgaaaacaatc

SEQ ID NO: 189813 - DNA, 601 bp, Human
acttagaatattaaagcagctattttcctttcagaggaccagtacactgaatctttttagatgcaatcaggaaatcattggggtgtgttgtaggtacacatgcgattgtatcttagtaactgaatttcaaaaataggattttacttttatattcatgttattggttttcatccacatgtacagcgaaaaatgtgctgggatgtcatatgattcctttcctgcacttttgaattgggggctcatcctctgatgatttttaagttttattttatttttttagagaccagtctcactcttgccsagcccggagtgcagtggtgtgagtatagctcactgcaaccttgacctcctgggttcaagtgatcatctcgtctcagcctcccaagtagctgggactacaggcatacaccaccctgcctggctaattttttatttttttttagagacagaatttggctgtgttgccaaggttagtcttgaacttctgacctcaagtgatcctcccacctctgcctcccaaagtgttgagattataggtgtgagccactgtactcagcccctgaagattttatttgaaataaaatagtctcagattagagac

SEQ ID NO: 189814 - DNA, 601 bp, Human
acaagaacgtgcacagttgcacattttttctttttctttttttttttttttttttgagacggagtctcgctctgtcgcccaggccggactgcggactgcagtggcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcgtgatccacccacctyggcctcccaaagtgctgggattacaggcgtgagccaccgcgcccggcctgcacattttttcaaagcctcttgaatccgtgctaactcagcgtcatttccacttgtccttgagaactgaagcattgaggctctgctgttgcaagtgtccgttgctgtcctgatttggtgaatgtgttagagatgtttatggttccaggttatatgcatgttgttgtctattcttaggaagtatttctcctttgtttgcatactctgaacttttaataactaaaatgcctggttcctgttgaatatacacgt

SEQ ID NO: 189815 - DNA, 601 bp, Human
tccccaagtgccagatctttaaaaagaaaaagaaaaccatttgatgaggtcactttcctacctgaatgacttaactgttgctctgtgatagactgaaagcctcaccgtggtctacaaggccttttgtggcccacccttctctataattagaatgtcccaagtgacagcctggcctgtatacaaggccagatttgcagctactcttaaaacaatagtcattgtttattaagcacttactgtatggcaggcactattccacacattttatgtgaattaactggtttaatcacaacaactctayaagccaattattattagccctgttttacagacgaaaacacggaaacacgtaacagttaagtcattcagaagtacgtaggaaatggcagtgctggaatctcatccaacccacttaaccctagacccacgttactatctgagatgagattggctctccatgtaacctataacaccactgttcataatttcatatttgtcgaattatttgaagcctccccaagactctaagctgcatgaaccgtgcatgtttagagcccattacaagcacctgaagtgtactgggtggtcagtgtgtatttgt

SEQ ID NO: 189816 - DNA, 601 bp, Human
ccaagtgccagatctttaaaaagaaaaagaaaaccatttgatgaggtcactttcctacctgaatgacttaactgttgctctgtgatagactgaaagcctcaccgtggtctacaaggccttttgtggcccacccttctctataattagaatgtcccaagtgacagcctggcctgtatacaaggccagatttgcagctactcttaaaacaatagtcattgtttattaagcacttactgtatggcaggcactattccacacattttatgtgaattaactggtttaatcacaacaactctacaarccaattattattagccctgttttacagacgaaaacacggaaacacgtaacagttaagtcattcagaagtacgtaggaaatggcagtgctggaatctcatccaacccacttaaccctagacccacgttactatctgagatgagattggctctccatgtaacctataacaccactgttcataatttcatatttgtcgaattatttgaagcctccccaagactctaagctgcatgaaccgtgcatgtttagagcccattacaagcacctgaagtgtactgggtggtcagtgtgtatttgttga

SEQ ID NO: 189817 - DNA, 601 bp, Human
aaaaccatttgatgaggtcactttcctacctgaatgacttaactgttgctctgtgatagactgaaagcctcaccgtggtctacaaggccttttgtggcccacccttctctataattagaatgtcccaagtgacagcctggcctgtatacaaggccagatttgcagctactcttaaaacaatagtcattgtttattaagcacttactgtatggcaggcactattccacacattttatgtgaattaactggtttaatcacaacaactctacaagccaattattattagccctgttttacagaygaaaacacggaaacacgtaacagttaagtcattcagaagtacgtaggaaatggcagtgctggaatctcatccaacccacttaaccctagacccacgttactatctgagatgagattggctctccatgtaacctataacaccactgttcataatttcatatttgtcgaattatttgaagcctccccaagactctaagctgcatgaaccgtgcatgtttagagcccattacaagcacctgaagtgtactgggtggtcagtgtgtatttgttgaatgaatgaaaatgatttgatgtgatgaat

SEQ ID NO: 189818 - DNA, 601 bp, Human
gcagtgctggaatctcatccaacccacttaaccctagacccacgttactatctgagatgagattggctctccatgtaacctataacaccactgttcataatttcatatttgtcgaattatttgaagcctccccaagactctaagctgcatgaaccgtgcatgtttagagcccattacaagcacctgaagtgtactgggtggtcagtgtgtatttgttgaatgaatgaaaatgatttgatgtgatgaatcactgagcttaaacatgagaatagggtctcttttataaacaaaacatttaacsctttagttcattgtcatttgtaaaatgggagaatgatactgaaatttctgtatgcctactggattctaatacaaaaaaaagtgtaacttcataatggctgaagatttgtttttgttttgtttttatctcaagtataagaatagacattaattagtttatgttcagtaacacccatccttaatgtcaataattaaaatacattggcatatgtaatctaattaaggttatgtttacagtaaattgttattttgttgaaaaccttttaaatagcagttgttaccaaacaaaaatacacattct

SEQ ID NO: 189819 - DNA, 601 bp, Human
tgtttcctatgtgaatatatgtggatatgatataaggagaaaattgtattatattgtatgaggtatagagacaatattaattgtatcttgcaaagtagaattgttttcctttgagattgttactagagtaataaatcatgttgaagtgaagaaatttacacagcatatgactgaatattttccactgtatcaaatttaatgggttttgggaaaacgtatagtttggtagcagtatagaactgagtttttggtaaaactgagtatttaaaggacgaaactttgaaggactttgagacccatwagacctacagatattattcagctttctgagcagtattctagtttactaagaatgtggaaggtaatgtgtggtggtgaggcaaggggtgttgagaacacagtgacctacattccaaatacaactcttctaaactataaggcagagaatagactaagtaaggcataataagttaggacctgccacatggcaaactgattttgggaagcagtctagaaagatgcttgaaaaatgtactgatgtgtaatgccagcagcaggccattgtcatggtatggaataatggtgactgaaagtcattctc

SEQ ID NO: 189820 - DNA, 601 bp, Human
taaatttaaataaacacatgctgaaagaacttgaaggtaaaaatagtttctgcaaatactattccacactttttctttataccactttgaatgctgagtaaggacattgtactggaccattgcccagcatagttctggcttatagagacttgatggtgaaagaaagactgagagagagagagagagagaagagagagaagggggagggagggaggaaggaagggaggaaggaaaaagatttgacaagggaatgtgttttttaagagaagctctttggggaataaatatagtcttgaaatayaccatgtaaaataagtttagtagaaaactatggagatatgcctaaatcataaatgaaaatattgattcgtttcttcagttgtggaattattcatttctgatttctttgcacaggatcaagctatattctaggtagaccctttatgtttttcaatctgttccacctatatccacaaatttattactgccacctactaaattatttataaccattgtatgatctgatttttgtatacatgtgttgctaagtaagtttcacattgtcatgaaaccaaattataaaaaaaattggaggcaaggg

SEQ ID NO: 189821 - DNA, 601 bp, Human
cctatatccacaaatttattactgccacctactaaattatttataaccattgtatgatctgatttttgtatacatgtgttgctaagtaagtttcacattgtcatgaaaccaaattataaaaaaaattggaggcaaggggtgaaagatctaggtagtgtatgaaagtttaacaagtatttgttgagcctactatgtgctggggcatcctctttaacacttcctaggcgccataccctgactaaagttccttcagcttctcatcaacacttttccgcatttccttctgagatgactcttcatytgtttttattctgactgttgaagcttttccagaaatggtgccttgctaaattcccatatataccatgtgctctttttttatgtttattatgccccttgtattgtcccactacctctaaataatgtggggaagcagtcacagagaagagagatcattgccaaccctgttttgattctgtttgacactcactgtctcacttacatgcagatatcctttcaccagtaggtttatggtaggcagctttaagatagcctccagtgatcccacctcctggaatccatgccttagtgtaatctctgt

SEQ ID NO: 189822 - DNA, 601 bp, Human
ccaggctggagtacagtgaagcaagtatggctcactgcagcttcgacctcccaggctcaagcaacccctcatgtcagccaccctagtagctagaggtgaagtagatggagcacaggtgcgcatcaccatgctggagtaatttttaaatgttttgtagagatgatgtctcgctatcttggcagggctggtctcaaacctctaggctgaaatagtcctcctatcacagtctcccaaagtgctgggattacaggcttgacccactgcaccgggcccctttttttaactttatagttttactttrtacaatttggctctcttgcacctggagtctacgttgtgtcactgccctgattgaaaaaaaaaatctaatggcctcagttgcccacagagtgaaacaaggcatcacagggaataggaaactcctcagaatctatctcacaccttccccctgttcagatattcccatattcttataaaaataagaaaccgaaaaagcaagttatgcgaagttaattttttttagctgaggaatcatctttgtcttaatctcagttgcttcctctccactggttgcttctccttaagtatcttctgtctcctc

SEQ ID NO: 189823 - DNA, 601 bp, Human
atataagcctgcagatggcaatggcctctatttttcttccacaagtttcttccaattcagagcccgtgccttccttcagccacagagcgcacaacagcatggatgagattgagtcagccctcttacattgttggcctacagctatggagctacctttgcagagttgtccactttggggtttgagcatgggaagtaaattcagagatgcaagtatgtgggagagggcatgaactcgtgagaaagtcctcatattctgagctcctatgacagttttgcctttagaagctatctcgtctcttakcagctttgttttgggcagaatgaatagcagaggggcaggaaagacccagaatcttgatgcccagcctccctgcttttactctgctgcttgatactgcctctaatgaaggagccgttcttatagagcagttactttgaggcctgagaaacccagaaaaatttatcatgactgctagacctgggcacaggtggattttagattagacttggcagggacaacaggcatcttggaaactccctaaggaagggtccagatcaacaacactgcaaacaccatattcccttcaggcaggcatcccta

SEQ ID NO: 189824 - DNA, 601 bp, Human
cttagaattattttaaccccaccacccaaactgcctttttgtcttttaattgtatacacaattctgaaagcactttgttcagttgtattacctcatgatgtgttactttaggacagtgcttgtcaaccttgaatgtataccacaatcacctggatagattgctaaaaacaggttgctgggctctgtacccagagtttctgattcagtaggtctggagcattgctgatggtgctggaccatactttgagactactgttttaggatttctggtaaattctggcttttttttttttttttttttgagtaatgagtttgagatataagaaaacataggaaacgtttgccatagattttatagttcacaaaatttaaagttcctttttaacttccctttcttgttgttctcataatattgcatttttcttactttgatttaaatgtatttagtgctgacaatgtgacttgtattacttgataaatgaccaatgtacatttgctactttaataatttgagaggtcatgaagggagcattccaatgacttttatactgtcaacattgcgttattaggaagtcaatataaacaagttcctatgaagtac

SEQ ID NO: 189825 - DNA, 601 bp, Human
tgaaaacttgattgatccaactttgaatatctgagaattatctgatttattgatctttactatttctttgcttctcattcttgtagtcctgaggatggttgtctcactggcaatttagcccttctattaggaagagaggagacaagttaaacataaaactaagttttcacttttctcttgttagtagtacttaattatttactagaataggtagtattaacttaaaagttctttgagggttgattcaggttcatttattcaagctggccttatgatcttctaaatatccttaaaaaaaaaaccaactttattacctaatctggaatataaatgtatcgcaaatcagatactacttttatatccttcttgcaaattcacaggaatttccaatactctgttactgcattctaacaaagtttattatgagagttctgaagatactgaatatgttgaaatatctttagtgcttcattttccaactatttcagtgcaatttcagtgatgttttgtctgtttttgatggctgtcctgtgcttagataatggataagagttacggtagattgccaagccatctgtttgtatcagtcttcacaaagatg

SEQ ID NO: 189826 - DNA, 601 bp, Human
aactaagttttcacttttctcttgttagtagtacttaattatttactagaataggtagtattaacttaaaagttctttgagggttgattcaggttcatttattcaagctggccttatgatcttctaaatatccttaaaaaaaaaaccaactttattacctaatctggaatataaatgtatcgcaaatcagatactacttttatatccttcttgcaaattcacaggaatttccaatactctgttactgcattctaacaaagtttattatgagagttctgaagatactgaatatgttgaaatmtctttagtgcttcattttccaactatttcagtgcaatttcagtgatgttttgtctgtttttgatggctgtcctgtgcttagataatggataagagttacggtagattgccaagccatctgtttgtatcagtcttcacaaagatgcttcttccaaaggagaaaatggacagaagagcttaatagtgttttcaggtggaaattaagagttctattcctgttctggcactgatagcatgctatagaataattctgttctgctcctgcttacttcatgaggatgttgtaagagttgatttaata

SEQ ID NO: 189827 - DNA, 601 bp, Human
ggcttcctgacagaagtgcttcttgactgattgtgtatttggtacaagggcttctttggtgatagtttctactctctttaaatactgttctgttatttttgaaatctgatcaagaattgacacaataaatctctttgatatttatacttatgcctacttttaaccttttaggaaaactttatgaattggaatattctaaaatcctgaaataatttggaatattctaaaattctgaagagaatatgaacggattgttggaatggaacttttacccgattccctcagactagagtgttcataygacattttgccaagaagttcctatagaggcaatatcacttttaggatggatgggtctaaaaggatcatatttagtttctggttattcatggttgcactcactttagaggatgtgttcctattaggttgctgctactatttgtctctcctaaataacagtatggaattatagaaagaaaggttgggagaatagtcgtgtgattctcctggtcagcataaagcctgttccatccagccactgactattttgttctttcttttgctttgaaggccaagatgacatttccattacttcgatgtt

SEQ ID NO: 189828 - DNA, 601 bp, Human
ttttgtaatagtttataattgacatataggtagaaaattgataccaagaaacccagctgttcctagagtactagtagtaactcagaaagagtagagaattgtactgtaaaatgagcagattgccttttcactttctttttctactccatcaaagtgccagcttgctccatctttgctaaacgttagattaaatgtcttatttatcatgatacctctgatgttcaaaattacatatgttgctgtaattcttatgaattgtgagcatacattcttctgcgtaaacagatggtactgttgacayaggctttataatcctagtaggctggacatcaaaattttatatttctaccattaccttaattgtagagaggttctggggtgactgtggaaagtcatctaacatgtgttctctttctttgcactgctgggtttctaaatatttattaatcattatttatactctgtaatgccatactttattggtgaatgtaccatctttgggaggtcattagatattctttagtatctaagagaaatatctacctatcagtgaatttcaaattatagtttatggtcttcagattaatgaaaagcaagttcc

SEQ ID NO: 189829 - DNA, 601 bp, Human
ttcagattaatgaaaagcaagttcccacccccaccaaaaattaaaatgacacaaaaatgcatcttgggaacatcacaatattttaaactgagaatactaattttttgagatttgattatatcacatatgacttagattctgatagattatgaatttgtaatcagttcaattttgtatactgaaattatctttgcactctgaataaatgaagtatcaagcaaaattttaagagtaacaatattttaagagatataaacacagttaaaatctttgaggtattttaccactcacttttagaatkatcaaatgctgctttgatcttttcatcaaatcagaacagatatctatatttttattggcaacaataaaaacagtctgtgaggaaatgaaacaatccagtctttcattttcttgctcatttaatctgaacaggtgatgtttcagtatattgagacataagacaatcaagactttttgagacataagacaatcaagactttgttaacagctttctagattattggtggaattatagctctgatttatagggtcacattaaaagtactcctttgtgtacactaggtctggaggtgatgatata

SEQ ID NO: 189830 - DNA, 601 bp, Human
ctgtgccccccatttggggacaagcagatgcagagggaccccttccaaatttacacctagattttgcccgagatttctttagtgattgatctctaccactgcatctgctctacttttctgtcaccattcctcattcttcaaagtgcagctcaattcctgttgtgccagaccacagagtggtaggggaaggcctctgtgagcctgagtatggtgaaggaggaaccctggagagagctgggcaggagggagcatgcagagctctgccgaaactcacgtcaggggctgagcgcggtggctcacwcctgaaatctcagcactttgggagaccaaggcgagcggatcacctgaggtcaggagctcaagaccagctggccaacatggcaaaaccccatatctactaaaactacaaaaattagctgggcgtggtggcacacacctgtaatcccagctacttgggaggctgaggcaggagaatcacttgaacccaggaggcggaggttgcagtgagccaagattgcgccactgtactccagcctcggggggagagtgaaattctgtctcaaaaaaaaaaagttaagttggtgctctttattttctgtac

SEQ ID NO: 189831 - DNA, 601 bp, Human
gagaaagggagagccctgctaaccaattaggaataaattttcaaaattaaacatttttgatttgcagttttatttttgtacaagctttcatgtagaatatgattatttaccttcctctgactatgaaatggcatttaaattttacacatgaagtagaagcacatgcaaacacaggctagtcatgaaagataccctactctgaatcagcccattgggtgtttaagaaaaaaaaaatgctgagtaaaccattttgtcctcaaaatgggtagtattaaagccagcaagaatggtatggcatgartcataactcagttttttaaagtgttatggtatatcttgtctagagagtatttctggttgcttagagcatatttgaagataattctattacatatgcatttggatgcagctatgctcttgggatgactggactagaaacacacaaactattattattttaatgaggcaggctttattttaaaatatacaaaattggaataattgcctaagttatttctatatatcatttggaatactaaactcgtatatcttggttcttggatttgaaattgcactttaggtgaaatggaaataaactgcc

SEQ ID NO: 189832 - DNA, 601 bp, Human
cacaaaaattagccaggcgtggtgtcatacgtctgtaatcccagctactcaggaggctgaggcaggagaattacttaaacccaggaagcagaggttgcagtgagccaagatcgtgccattgcactccagcctgggtgacagagtgagacgctgtctcaaaaaaaaaaattgcaaattactcaatgcatcattgcttaaatcagcattattcagagactttaaacatgtataaaatcaatttttctgatgttataattcaaaactgttgactttgctttttttgcctgtgctttcagtaaartaacttataaattaacgtctgtcctaaaatggacatgttttaggctaattgttgtataacccagatgggggaatttatctgtgcaaccaaagtaccagagtgtacagtataccaaggtcatttccatgtgagtgttcatgaaataagcatgaaaaaacagctaaaacttgcacctggcctggagtaggctgggctttttttctggaaaatcatttattcatttactttcaaactaagttgtcaagaaatttaagcctggtatggtgatgtgcatctgtagtcccagcctacttgagagtc

SEQ ID NO: 189833 - DNA, 601 bp, Human
cgtctgtaatcccagctactcaggaggctgaggcaggagaattacttaaacccaggaagcagaggttgcagtgagccaagatcgtgccattgcactccagcctgggtgacagagtgagacgctgtctcaaaaaaaaaaattgcaaattactcaatgcatcattgcttaaatcagcattattcagagactttaaacatgtataaaatcaatttttctgatgttataattcaaaactgttgactttgctttttttgcctgtgctttcagtaaagtaacttataaattaacgtctgtcctaaamtggacatgttttaggctaattgttgtataacccagatgggggaatttatctgtgcaaccaaagtaccagagtgtacagtataccaaggtcatttccatgtgagtgttcatgaaataagcatgaaaaaacagctaaaacttgcacctggcctggagtaggctgggctttttttctggaaaatcatttattcatttactttcaaactaagttgtcaagaaatttaagcctggtatggtgatgtgcatctgtagtcccagcctacttgagagtctgagggctcaaaaattatttgagcccagg

SEQ ID NO: 189834 - DNA, 601 bp, Human
taatcctaacactttgagagtctgaggtgggaagattgcttgaggccaggagttcaagaccagcctggctaacatactgagaccctgtctgtacagaaaatttaaaaatgggctgggcatgatagtgtgtgcctatagtcctacctattagagaggctgaggtggcaggatcgtgtgacctaggagttcaaggctgtagtgagctatgattgtgccactgtactccagcctgggtgacagagtgagaatccatctttttttttttttttttatacacatgagggtctctggttaataaatrttgagatgtagggttaggtgagattaaacaggttctttttttcatgatttctcggagtctttatgatgctccacaccagtgcttctcaaagctgactgtgtatacaaaacactggggatctgacccacatgtaaagtctgatttctttggtctggggcaggcctgaaattctgcatttcttacaagttccaaagtgcagcctgcacaactggcacacagattacactttaagtaacaagattcttagggattttttaagaggaaccatgttctgccacatttcccagacttgctaaccat

SEQ ID NO: 189835 - DNA, 601 bp, Human
tggttaataaatgttgagatgtagggttaggtgagattaaacaggttctttttttcatgatttctcggagtctttatgatgctccacaccagtgcttctcaaagctgactgtgtatacaaaacactggggatctgacccacatgtaaagtctgatttctttggtctggggcaggcctgaaattctgcatttcttacaagttccaaagtgcagcctgcacaactggcacacagattacactttaagtaacaagattcttagggattttttaagaggaaccatgttctgccacatttcccagrcttgctaaccataggaacctcattttgagatgctggaagttgtccgtggagcacactttgagaattttaaattgaatctttaaaattacacatgaattaatgtataatttaaatagaaatctcatgcagatcttctaggttatgattggccgaacagccccgtgtaaatcccaagacactgaaaaaatcatttagctagttcatgtagaaagaaaaaccagtatgggctaaaaagacaaccactaggtaagatagcaagtacactggattatatacttttctttttttttttttttttta

SEQ ID NO: 189836 - DNA, 601 bp, Human
atttctagactgactaattttcttatcttaaaaatgagaaaatgccttttctattatttcatggagttgtgagttggagaaaagttgaaatttatgctcatcttgcctcttcatccagttcccctccatcagagttttaattacattcttaactctattgattacctccatcctatctttgtatacccttaacattccaggtataactctgaatttgtcatgattttcatttcgtctcctcctagcatctatggtgctataaaggatcctgaatcctcagaaagaaaaaaaaaatgaaccygtagtacttttcaaaaagattttccttttttccttctttcctctatataagaagtaagatattttggggaaatgttgaaaatgcccatgtgtaattcgtgtttatcaagatagaatttccagttttcattaaccattttgcagtgctttccttgtgttataggggcaagtcaatgctgcataaggccagaggagcaccactcacataagacacagtgtgagcagcccagggtgccaacagtgttgactctggtgttatatgttaaccgtgtgttttattttcaaaaatcgttattgaatg

SEQ ID NO: 189837 - DNA, 601 bp, Human
cttttctattatttcatggagttgtgagttggagaaaagttgaaatttatgctcatcttgcctcttcatccagttcccctccatcagagttttaattacattcttaactctattgattacctccatcctatctttgtatacccttaacattccaggtataactctgaatttgtcatgattttcatttcgtctcctcctagcatctatggtgctataaaggatcctgaatcctcagaaagaaaaaaaaaatgaacccgtagtacttttcaaaaagattttccttttttccttctttcctctrtataagaagtaagatattttggggaaatgttgaaaatgcccatgtgtaattcgtgtttatcaagatagaatttccagttttcattaaccattttgcagtgctttccttgtgttataggggcaagtcaatgctgcataaggccagaggagcaccactcacataagacacagtgtgagcagcccagggtgccaacagtgttgactctggtgttatatgttaaccgtgtgttttattttcaaaaatcgttattgaatgttatacagggctgagggtattatattttgcaactttaacctctta

SEQ ID NO: 189838 - DNA, 601 bp, Human
catcttgcctcttcatccagttcccctccatcagagttttaattacattcttaactctattgattacctccatcctatctttgtatacccttaacattccaggtataactctgaatttgtcatgattttcatttcgtctcctcctagcatctatggtgctataaaggatcctgaatcctcagaaagaaaaaaaaaatgaacccgtagtacttttcaaaaagattttccttttttccttctttcctctatataagaagtaagatattttggggaaatgttgaaaatgcccatgtgtaattcrtgtttatcaagatagaatttccagttttcattaaccattttgcagtgctttccttgtgttataggggcaagtcaatgctgcataaggccagaggagcaccactcacataagacacagtgtgagcagcccagggtgccaacagtgttgactctggtgttatatgttaaccgtgtgttttattttcaaaaatcgttattgaatgttatacagggctgagggtattatattttgcaactttaacctcttattattgaagtggattccttctaggcatttatacatcgtaaaattatatttagt

SEQ ID NO: 189839 - DNA, 601 bp, Human
ctaaatactattctatttatcatcactgaaatattctaaattatttgatttataaacttcgtctaatactgtatcatgtttattccgctatattattctttttccattctgtgagaaaactatgaaagtacataaaatatacatacaattaaaaatattgaaaagcaagcacatctatgtaagtgccgcccatgtcgggctagcactttagaagttcttcatgtgcctctctgagatcacagccccctctctccacagaggtagccactcctctgactttggtggtggtcatttccttgcyacctatgcatgcgttcttagtaagcagagttttattttgcctattgttgaagtttacataaatggaatcccactgtttgtgttcttttgcaccttgcttcttttattcagtattacggttgacagtcatccttgttttatagagctttggttcattcatttattgctgaaagtgaaacacattgaatgaatatattacattgtatttatccattcttctgttaatagtcacttgagttgttagcaacctatcgccttcacaaagagtgctgccttgaacatatttctgtaactctccaga

SEQ ID NO: 189840 - DNA, 601 bp, Human
taactgcaaaaagtttatctgatactccttttagaattctagactcgataccatatgctcctgaagatgtttaacttttcaggcaaattcttaatttcctagtacttcattcttctgcaatatctgttccagtttcattataagtaaaacaaagaggaacttatgtttgctatatgatgatactcctagcaattttttctacttattattgttaaaatattttgttcatctaatgcttattttctacacttttatctgacattagtatctttacattttgaatcaaatttaaatattcacrctttctttaacctttattttttattaatttgttcttaggcatcattattttgtcatatcagttttgaaattgtgtttctcatcaacatttttctgagtgttcataatgacaactatatgttatattccagacagctaactcaagaaaggaaaaataactggagtccaacttattttactaaaaaggtgaaataaagtgtacttggtatgctttcaccaaaaattattagtaaggcgagtagaagggaattaagtagagaaaaatccagtatttagttgatttgccatctctggaagattt

SEQ ID NO: 189841 - DNA, 601 bp, Human
agtaaggcgagtagaagggaattaagtagagaaaaatccagtatttagttgatttgccatctctggaagatttaagacagatgattttgtggactattatcagctctggtaaaagagattacatatatattgaataataggttacacctatatattacatctataatatgccaagaaaaccttcagaagtcatactagagtatatgtggtctgcagccttgagcagaaaaattgcctgttaatcactgatagttgaatataagattaagatacatacatgcatacacaattatactgccartttcacatatgagcctctttgtgttcaataaagattgtgatgaaaatgcacagctgtccatagtgaaccctcctctaaaacatgttttagaagcctcaaaagaattcagtctaatggtatgattttaaaaaaagagacctggagggggaggagccaagatggccgaataggaacagctccggtctacagctcccagcgtgagcgacgcagaagacgggtgatttctgcatttccatctgaggtaccgggttcatctctctagggagtgccagacagtgggcgcaggccagtgggtgtgcg

SEQ ID NO: 189842 - DNA, 601 bp, Human
ataatagtagagtagtttgcaagagaaaactgaagaatgttgagaaaaatatttatagtctcagatgtccctatttgaatatacagagtgacacatctaaacagatagggtctctcgggcatcttaagacttggcgggatttgcctaatgactggaatgagactgaaaatatatcatccttcattcatgtattcatttatttagcaaacattaattgaataccatttaatgtgccaggcactaggctagtttcatggtatgataaagactgtactcactagaagacagagagactgatgtrtaaatgagttattaaaattttaataacattttacgctaatcatcgtttccccctattttccaaaactgtaggaagtccatatcaggtcagtaagtcttttgacaaacacactgctctcactatgtgttgtcttaggaaaggcattccatctgctgccaagaacctattcttctatcataagctatgggcctaaaaaatagattttcttttcaacaccacattcctagttattgttatctttgaataatcagattcttctaaagaaaccaagctagctataggactccaccaagggtgacc

SEQ ID NO: 189843 - DNA, 601 bp, Human
atgcacgcaaagctgtgtaaagcatagttctcagtgctgacttttctatcaggactctggcaacctgaggcctgtaatagcgttaggtattttgaacattttaacataggtagtatataggattgtctctgtgatttttggataaaggctatatttgtgtgtttgtctaaatttaagtatattcattttgtgagctaatgttctaaaacttgtcgaactgtgccagtttgcttcaatgtcatgtttatgttgatttttttaaggcattaatactctttatccttcaaactcaagtaacctyctatattaggtcttatcagttgtgcttagagaaattggaattctgcgattttaatttcttaagatttcaaagcttaataaggtaaatgtaaatttaaagctccagggatggtttttttgtttttttttccctgcttcttctctccaaaacaacattatgtgtcccctgtgagggttattttgttgaaataatctaagattaagtttttttaaaacatcttataattaagccactagatgtttttttctcaagataggtaatgttgtatttgctgggatattcctttgaaagtcagtatca

SEQ ID NO: 189844 - DNA, 601 bp, Human
atcaggactctggcaacctgaggcctgtaatagcgttaggtattttgaacattttaacataggtagtatataggattgtctctgtgatttttggataaaggctatatttgtgtgtttgtctaaatttaagtatattcattttgtgagctaatgttctaaaacttgtcgaactgtgccagtttgcttcaatgtcatgtttatgttgatttttttaaggcattaatactctttatccttcaaactcaagtaaccttctatattaggtcttatcagttgtgcttagagaaattggaattctgcrattttaatttcttaagatttcaaagcttaataaggtaaatgtaaatttaaagctccagggatggtttttttgtttttttttccctgcttcttctctccaaaacaacattatgtgtcccctgtgagggttattttgttgaaataatctaagattaagtttttttaaaacatcttataattaagccactagatgtttttttctcaagataggtaatgttgtatttgctgggatattcctttgaaagtcagtatcagtaactcaaatgatgaatgatgacgaagattgaggaaacatttatta

SEQ ID NO: 189845 - DNA, 601 bp, Human
ttggacattgatagcagaagacaaactttgaatattgagcactgtttatgctgtgacagtagtttacttatgcagacactaaactttaaaaacttcatattgatctcacaaaaactgtatacataaacatacaattttatgtatatgttatgagaaagagcatataaaaataagttttatgaacatgctaatttattgcaaccccaaacataatgtcaaggcacttggttaaggaattgcaaagtagtatcttataaaattaacctgaattttgagaggaaaagtctgggttcttcagtaragtatatctaagccagtaaaatacctcacacatactccccttgggcaattcatggtaagtggtaggaaaggaaatggcaagcaaccaatagcagtcttgttaacaaaccgttagtctattaaatatctgaaattggacatagagtgtcataaaacagtgaaatctttcttcactgggctatgctttccctagaatcctccagtgccagaagctagctgttccttgttctttggcataatgctagaatttataatgtcttttatgaagtgataacctctcacagtggtatcagtcatgtgg

SEQ ID NO: 189846 - DNA, 601 bp, Human
tcaaggcacttggttaaggaattgcaaagtagtatcttataaaattaacctgaattttgagaggaaaagtctgggttcttcagtagagtatatctaagccagtaaaatacctcacacatactccccttgggcaattcatggtaagtggtaggaaaggaaatggcaagcaaccaatagcagtcttgttaacaaaccgttagtctattaaatatctgaaattggacatagagtgtcataaaacagtgaaatctttcttcactgggctatgctttccctagaatcctccagtgccagaagctarctgttccttgttctttggcataatgctagaatttataatgtcttttatgaagtgataacctctcacagtggtatcagtcatgtggatgcgtacctgcgaaggtacagaaaaatccttgctccttgacagaaagaatccttgctacttgtgttcaaacgctgcgtttttgatgaaacatacccagcctgaagtcaaatctctctcctgatctcttttagcactttatactactgccatgactcttaatagtatgcttctttggatttatataatcagttacctgaggatagagccgtgttt

SEQ ID NO: 189847 - DNA, 601 bp, Human
ttataaaattaacctgaattttgagaggaaaagtctgggttcttcagtagagtatatctaagccagtaaaatacctcacacatactccccttgggcaattcatggtaagtggtaggaaaggaaatggcaagcaaccaatagcagtcttgttaacaaaccgttagtctattaaatatctgaaattggacatagagtgtcataaaacagtgaaatctttcttcactgggctatgctttccctagaatcctccagtgccagaagctagctgttccttgttctttggcataatgctagaatttayaatgtcttttatgaagtgataacctctcacagtggtatcagtcatgtggatgcgtacctgcgaaggtacagaaaaatccttgctccttgacagaaagaatccttgctacttgtgttcaaacgctgcgtttttgatgaaacatacccagcctgaagtcaaatctctctcctgatctcttttagcactttatactactgccatgactcttaatagtatgcttctttggatttatataatcagttacctgaggatagagccgtgttttaggccttgttttatacctgtgttacaggttgctcc

SEQ ID NO: 189848 - DNA, 601 bp, Human
aattcaatctttgcttagtacaaaataaaattttatttcatatctatggtcaaataatgacataggtgtcataactttcatctcccgtctgtccaatttagtcgaaagttaagtttagggaataaaaggatgtggttatcttggtgatgtcacaaaatatccaccagtgttatgtgtatcaggtgatacgggtaactactaaagaaatgttaagaattatgctttaagagaaataaaaagtcaatccatgggaataacaaagtaatgtgattctgaaattacaggaagtatcagaacttcrgccaccacctggctgtaattaggatcatcctttagcagattctactgttcagctcaactcctaataagaatccaggagtccatgatgaatacagatgtaggaaaggaggaatctcctaatagttttcaaaaatgtctgacaaacttgatactggttagtgcctagcttactctcttagttgtaataactagataaatacagcgctgggcatggtggttcatgcctgtaatcctagcactttgggaggctgaggtgggcagatggcttgagctcaggagttcaaggccagcctgggcaaca

SEQ ID NO: 189849 - DNA, 601 bp, Human
ctttgcttagtacaaaataaaattttatttcatatctatggtcaaataatgacataggtgtcataactttcatctcccgtctgtccaatttagtcgaaagttaagtttagggaataaaaggatgtggttatcttggtgatgtcacaaaatatccaccagtgttatgtgtatcaggtgatacgggtaactactaaagaaatgttaagaattatgctttaagagaaataaaaagtcaatccatgggaataacaaagtaatgtgattctgaaattacaggaagtatcagaacttcagccaccasctggctgtaattaggatcatcctttagcagattctactgttcagctcaactcctaataagaatccaggagtccatgatgaatacagatgtaggaaaggaggaatctcctaatagttttcaaaaatgtctgacaaacttgatactggttagtgcctagcttactctcttagttgtaataactagataaatacagcgctgggcatggtggttcatgcctgtaatcctagcactttgggaggctgaggtgggcagatggcttgagctcaggagttcaaggccagcctgggcaacatgacaaaa

SEQ ID NO: 189850 - DNA, 601 bp, Human
gacttccatgcctggctttaccatgcttcctcctctctcctgacattcagtagccttctggcactcactgtcattcgctgaagattcagctcatggccaccttctccagttcacctcctgctgtgggtctccaggtgacttcagtatctacctagacagcccatccagtctctggtagggcagtcccttggctttctcatcttgcatttcctttagacattatattcttaggccacaaactcctgtccttcagttcactttcttagtattcactcagaaataattattattattattattwttttttttttttgagacggagtctagctctgttgcccaggctggagtgcagtggtgcaatcttggctcactgcaagctccgccttccaggttcacaccattctcctgtctcagcctcccgagtagctgggactacaggtgcccgccaccatgccaggctaattttttgtatttttagtaaagacggggtttcaccgtgttagccaggatggtctcgatctcctgacctcgtgatccgcctgcgtcagcctcccaaagtgctgggattgcaggcgtgagccactgcgccctgccagaaatg

SEQ ID NO: 189851 - DNA, 601 bp, Human
ctcatcttgcatttcctttagacattatattcttaggccacaaactcctgtccttcagttcactttcttagtattcactcagaaataattattattattattatttttttttttttttgagacggagtctagctctgttgcccaggctggagtgcagtggtgcaatcttggctcactgcaagctccgccttccaggttcacaccattctcctgtctcagcctcccgagtagctgggactacaggtgcccgccaccatgccaggctaattttttgtatttttagtaaagacggggtttcacygtgttagccaggatggtctcgatctcctgacctcgtgatccgcctgcgtcagcctcccaaagtgctgggattgcaggcgtgagccactgcgccctgccagaaatgattcttcatcaaaaattgctatccattggtcttgccactttctctatacctcaagcaaccctactcttaatataccaaactcttacggcccaagaatagggaaggtagtttctttagataaaaatcaaaatgccacacctagaagaaaggtacaaagatgttaggtagcaagaacaacaggggtccactacataa

SEQ ID NO: 189852 - DNA, 601 bp, Human
atggtgttgccttgttgaaccaatggggaatggatgccaagccctgtggtctcatcagcaccatgcagtttgtttatgttcactgactttctaggtgcctacttttatttggcatcttaaaacagggatttgttttgacccttcagcttgaatgttttaatccaattccctgacttccttgaagagaaacttcatatctaatttagaccacctctgctctgtggccccaggccgacttcccaggttacatgagtgctcgtcgcactttgttatgattgtggagcgcaggcactggtgttgyctctgcttttccctctttctctctacccatcgcagtgtttaaacaaatgaatgtataatcaagtcagtctttttttttttttaatttaagttctagggtacatgtgcacaacatgctggtttgttacataggtatacatgtgacatgttggtttgctgcatccatcaacattaggtatttctcccaatgccatccctccccacagccccccaccccccgacaggccccggtgtgtgatgctccccgccctgtgtccaagtgttctcataatcaagtcagtcgtttaaattacagaagaaa

SEQ ID NO: 189853 - DNA, 601 bp, Human
tctttttttggtaaacagggagtatgcagatattcaataagggtaacgaaaaataaaattgcttttatatataggtggaaggagccaaatgttagggagaaagcaggagagtcggagaaaaacagggacatcaaatatggaagcacaaggaacagagcacttgtggacccaaagactgaaatcagggctttattctggatgtgtatgcactgaggttggacgtagcctgtagctagatgtgcctgagctctcctacagctttaatattccttataggttagatatggcttatggttatcartaatacattgatctttcttaaccttctttccgaagaagcccacgataatttctggaagtttagaaaggagtgatgatattattgaaaccatacagataacatgaaaaaagttaagacaaaaattttgaacacttgtacctcttgagccagctacccagcattcccaaggaaccatttaattgactagggcataactaataaatatgttttctaattctagtacccctgccacccacacacacattaagccacagaatatctgcggacaattgtaaaagtaaacctagtatagtcttaaga

SEQ ID NO: 189854 - DNA, 601 bp, Human
cttaatgagtttttgcagtagtctaaattaatgtgaacctgaaggaatagtgaggaaggaaatggattcagcctatgctaaagatgtgaactgacagaatttgggaaatcacttaatgtgcaaggaatgggataagagaaagggaggaaatgacaaaaggatgaggacacttacagtttgagcctgaatgaaagagggatggtggttccattagcacagtggttttcaaccttccgtgtgcatgagaatctcctggaggacttgtttaaacaggtttctggctgggcatggtggctcacayctgtaatcccagcattttgggaggccgaggcagcagatcacctgaggtcaggagttcaagaccagcctggccaacatggtgaaaccccttctctactaaaaatacaaaaaatatatagctgggtgtggtggcacacacctgtaatctcagctacttgggaagctgaggcaggagaatcacttgaacccgggaggcagaggttgcagtgagctgagatcgtgccattgcactccagcctgggcaacaagagctaaactccatctacgaaagaaagaaaaacacaggtttctaaaccccacc

SEQ ID NO: 189855 - DNA, 601 bp, Human
cgtgccattgcactccagcctgggcaacaagagctaaactccatctacgaaagaaagaaaaacacaggtttctaaaccccacccctctgactttaagaagttcccaggtggtgctgatgttgctggttcagggaccacactttgagaactactccgtgcagaaatagacaacacagtaggtggggaagtatgggagaggagagaggtgtgtctgggtaaggccatggtttacccatcatttaggtgtagctacatagcagaccactgaaaattcaattagagatagtgaatttggacattrccactgtacatggacccgtgtgatggtcatattgtcaagtgagaggctgaagagccaagggcaagttactcagtgagtcactgttgagtagacagtcttttaagaagccatcggttcacacctgtaatcccagcactttgggaggctgaggcaggtggatcacctgaggtctggagttcacaaccagcctggccaacatagtgaaaccccatctctactaaaaataaaaaattagccaggcttggtggcacatacctgtaatcccaactactcaggaggctgaggcacaataatcgcttg

SEQ ID NO: 189856 - DNA, 601 bp, Human
caagatttagaatctcctgggcagcatttcccaaatctacttgacccggaacccttcctttaagggaatatctgttaacatcctgtaggacactggtgttctcagtttgagaaacataatttatctttgattcttaatttccttttaacaaaggaagctagccagtacaatgatgattgacatcatatgcccagcatttctataattaattatacattgatttagggactaccaagtagacataataatggtttatcagttattaagtaaattgtggtagatggtcaggacatttgattayctctgtcaaatttgctggttatcttaaggatgagaagttcaaggacctttgtaaatatgactactttggtttttgcaccagcctaggttacaggacaatatttaggatgtttttgggggatttcttggtagttcttaaatatttgtttgtaaaatagtttcctaaacttggcccaaagatatgatcatgaccataattgactcatctttttgatgtgggaaatggggagaaatgctatagcatgtcctgggaacaggacataaacctgcccaatcccctctatcttaaaaatctagtcag

SEQ ID NO: 189857 - DNA, 601 bp, Human
tcaaatattgatatcccactcatacatcttggtgccattcacatgtgcgtgtgttcaacttgtattcttaggaggaatagtaatagttttgcaagaaagcatattttttctttgtaaacatttacaggtgttaagtcacttttacaaattcagtgctttatagcttcttgatattctgcttttggcactttaatgaagtactacttgtgagaagttgtgggcacgtaataggttgaatggttttgataaaagtagccagtgatgttcagtattatgggctctgcatccagtagggatatartgtggacttaattcagtccataagaatgttaaaggaattgccctacttttaaataaaaagtgtagctacatcatgcatgtataggctttcctagcaactcaagaactgtaaattgtttctgtgggtacgtcaatcaaagtttctagttgtaagatacagaaactaacatggctaattaagcagaaaaggaattcattaagggattattagtgaattcccacatttgttacaggtactggagaacaagacttgagactaagattccaggaacggtgtccaaatttgtgccacaatgttgat

SEQ ID NO: 189858 - DNA, 601 bp, Human
cataagaatgttaaaggaattgccctacttttaaataaaaagtgtagctacatcatgcatgtataggctttcctagcaactcaagaactgtaaattgtttctgtgggtacgtcaatcaaagtttctagttgtaagatacagaaactaacatggctaattaagcagaaaaggaattcattaagggattattagtgaattcccacatttgttacaggtactggagaacaagacttgagactaagattccaggaacggtgtccaaatttgtgccacaatgttgatcagataaagaaactattgytatagccaccaaacacacagaattgtgtatggaggttgtttccatgtcaggatcttgaccttgagacctaatgcaggaagcacagcaagaaggcaatagagagagaaaacaagtgtcctctttgctggagtcagagtctcagtgtcagcacctgcatcacaacctggcatgagtgtaccttcttggcagagccaaagtcacccgttctgcttttgagggaaggaattatgagaaattccaacttctgccttcaagcaggaactttcccagccatttccttgaaaggttgtttacaaggtc

SEQ ID NO: 189859 - DNA, 601 bp, Human
tcatctaggccctgtccaatactgccacaccagttgggatcattaggaaaggattctcagtatcagaagatggtaaggagtttagggactgtttcttaaaaattattccaagaatagcttgtggaatttgcagagccagtactgtcaagcaattacatgtttgcctgatttcacagggagttcatatacttttcaattaaaatttttaatggcaaacgaatgtatacatataatcataaataatattttaggttgttttatttctgaatagtttctagatttaatactcatatgtctggtrttttgaactagcagtcatcaaattaaactacttacagttcagcatttgctttgaatagacttgtgaggagacagtatggcacaggggagcttgagatgctatttgtggcttaaaacctttggaatgtacttgatctttagatattttataacatgacatgttttctacttactaaaatcccatcaagctaacaatgagagaaatacaaataaagttaaaacatcctctcctttcatagaacttgtttgccttcactttgcagcatagattcaagaatataatttctgtagactatcttcc

SEQ ID NO: 189860 - DNA, 601 bp, Human
tagaattctgtctgttgtttctgattgttggtatgaacattaaactattgggctggtaagttgtagtaatatgaatttttcatctctcttaacagttgtgtatattgatatgtttggtaaggcataaagtatataaataaaggtcgtcaaaacttttacaaaacaaatataagattatgtaattattttataaatatccaggaaggtttttatagaaagagaattataagcaaggtataaaataataaattagaaatttctaactcagactttgcaatacccaatgaaataattcgttaagttaaaactgtgaaaacaaaaattagctttaattctctataatattttttagaaattatccgtatctttagcaccaaaaagaacaactcacaaactcaataatatggtattatatatttctaaaaggtatgaaccaactggttttgtttttctaaccagaattatattttaatagaaaagtaattcaacatttaacagaattctgttagtacttcttattctggcaatattactaactaaattaaaatagaaattctcttgataaactcctagtaatacttggtatatcaataataaagac

SEQ ID NO: 189861 - DNA, 601 bp, Human
ctgcataataattaaatagtacttggtattgtttgtcagtgtgtgcatgtggagtaaaattataaaatattttggaatgacaccaatttaagatagtggaacctctagaaaggaagaaaggaggacgatactaggaattaggcttttgcagaatctgtagcattttattcaagagccatctggagcaaatataacaaaatgttaacaactgttaaatgagggagtggttgatatatgcatggctattagattatgttctggacttgtgaattttaaaatgttaaataattttaaggctatrtcgttcattggctggttccatatgtttttttaaaatctctaagtaaagtacatattgtgggtagtagtttctgtcagtgactttttttgtggttcctgtctggttctcagtgcctggcatttgtgcctggcaagtgactgtggcaccaccagtgaatgtcgggtgaatgaatgggtcatgcagaaatgggagtggggttgaccagggaaaggaggaaaatgtgcacaaatgcatatatggccccacaaacagttgtcccgagcagtaagaggctcagtgtctaggatatgtcctaaaagg

SEQ ID NO: 189862 - DNA, 601 bp, Human
tttaagatagtggaacctctagaaaggaagaaaggaggacgatactaggaattaggcttttgcagaatctgtagcattttattcaagagccatctggagcaaatataacaaaatgttaacaactgttaaatgagggagtggttgatatatgcatggctattagattatgttctggacttgtgaattttaaaatgttaaataattttaaggctatgtcgttcattggctggttccatatgtttttttaaaatctctaagtaaagtacatattgtgggtagtagtttctgtcagtgacttttyttgtggttcctgtctggttctcagtgcctggcatttgtgcctggcaagtgactgtggcaccaccagtgaatgtcgggtgaatgaatgggtcatgcagaaatgggagtggggttgaccagggaaaggaggaaaatgtgcacaaatgcatatatggccccacaaacagttgtcccgagcagtaagaggctcagtgtctaggatatgtcctaaaaggacctactggcttatgaaattggaaaggtgaagctggcatttaattgtgaagaactttattagatctttaaaggagaccaactgaaa

SEQ ID NO: 189863 - DNA, 601 bp, Human
ctttgccattaggggagctaaagttttttattgtgtcacttgagagatcccccttgcatctccagtgtgtttcaattgtcagtcttggaaccagaatctaagtgatacagagaagaacagaaattagctcttagacccaggccccctttccggtatgccatttccgatttgctaaaaaataacaattaaaagtggaattgttgctttgggccatcaagcttctgtttgattcagttcgttcttgcatgaaatgagtttaatcagcaaactgggggatttgatcaccagttacctttcatastgtttgatttggatcctgtggcagagttggtaaggtgatctgtaagattttcttacttttcctggtccaaagatgacactaatgactcaaaggaaaacgaaaagcatttgtttttatttaccttttcacccatccaaagtttttgtcattattggcctcaccctgtgaagaaggacgtggcagtggcatgaggttctgtttaatacctgtttaatgacgcttatgctgtgataaacaaactgtggaatcctcttccccgaatgggtggctctaatagtgagtagttcggttccctcacac

SEQ ID NO: 189864 - DNA, 601 bp, Human
aagttttttattgtgtcacttgagagatcccccttgcatctccagtgtgtttcaattgtcagtcttggaaccagaatctaagtgatacagagaagaacagaaattagctcttagacccaggccccctttccggtatgccatttccgatttgctaaaaaataacaattaaaagtggaattgttgctttgggccatcaagcttctgtttgattcagttcgttcttgcatgaaatgagtttaatcagcaaactgggggatttgatcaccagttacctttcatactgtttgatttggatcctgtkgcagagttggtaaggtgatctgtaagattttcttacttttcctggtccaaagatgacactaatgactcaaaggaaaacgaaaagcatttgtttttatttaccttttcacccatccaaagtttttgtcattattggcctcaccctgtgaagaaggacgtggcagtggcatgaggttctgtttaatacctgtttaatgacgcttatgctgtgataaacaaactgtggaatcctcttccccgaatgggtggctctaatagtgagtagttcggttccctcacacttgtaggatcaaagattcat

SEQ ID NO: 189865 - DNA, 601 bp, Human
aatcagcaaactgggggatttgatcaccagttacctttcatactgtttgatttggatcctgtggcagagttggtaaggtgatctgtaagattttcttacttttcctggtccaaagatgacactaatgactcaaaggaaaacgaaaagcatttgtttttatttaccttttcacccatccaaagtttttgtcattattggcctcaccctgtgaagaaggacgtggcagtggcatgaggttctgtttaatacctgtttaatgacgcttatgctgtgataaacaaactgtggaatcctcttcccygaatgggtggctctaatagtgagtagttcggttccctcacacttgtaggatcaaagattcatttttaacccatgccagaagatgtttccattttataggtagaaactagtcctctgcatatatttccacctatcaggaaatgtcccaaaaaggtgaactgcataataatcattggcagtttatttgcagtatgccttcttgagaacattttgaaaatcttaagataaaattccttagtttttctattaatgactctttagaattagtagtcttccaaacaaggtaaaaacctcatttctg

SEQ ID NO: 189866 - DNA, 601 bp, Human
tgtaaacacagtaaagagttccacatctgaaagataccaaatgagtcaaagctgacctgcagctctacagaagttgtttatctagagcagtttgctcaactacagttcttccagaaggcatttttaattatgatatctcattgccattccagtcacaagccagtttcaactgggacatacaaatccaaatgacaagtatctctacacatgtgaattaaactagtataactgagtcttgcctaggacatgtgaccccaaggtatttcaaccagtattgcagtaagctaacgtattttaagcyaaaaatgtcaccatgaagaattttaaacaatatatcttttatgagtaatagaatcttttttgaacctagaatgttttaatcacagcaaataagtattccaaaataaattacctgtctcttagactgagcattttaaatgttaaatggataatgcagttaggaagaaccacaaaaaagatcaggttaatagcataaatgtttcagattattttaagactattttaatatatgtggttaaaatggaggcacctcagctgtattaatttttctaatacttttaaaaattcagaggcccataca

SEQ ID NO: 189867 - DNA, 601 bp, Human
gtacatattgataaagtactttaataggttatacaggatatttcaagatgcttgaacagatttgccttcgctgctttataggagttagtaattacatttaccatctcataaaagcaacaatgctcttaaatcctgtattttcttattactattattattttccccttatctgggttttaaaatcttctttattttgagaaatgttaaaaattgtaaatgcagagaataaaatggaaatgttaagtactcacatcctgtaattaaaaattattaaaaattcattttttataaaaaatattgwacataaaattcaagtcccctttgccacattttctcttccccatagctaaccactagtatgtaatgtttcaattgactttgtatacttttatgtcaatacatatacagtacttatatattatatacatatatattaacacctgtgtaaccaatattttgtgttgctttttttttttacatcaaagattgtaggtgtagtttatgtgccattgtacaccttgattttttccatttgagatccagccacattgaaatgtgtaaatctagttcattcttttaactgctcttgtatatttatatc

SEQ ID NO: 189868 - DNA, 601 bp, Human
agtaatttggcttgttatttttggttctatcattagttttttaaagctaaaataactctgggatatatttcttaaaatagtacagatcctagtacattgtagaacaaagtacaccatattgatctattttaagaatatgaacattagtacagtgacacgtatgtggaagaaataactttctttctacctataatataataataaatctcaaattatccaaacctgccacttagggtaggtgaaggcccaactaatattactctcagtttctatttccacattttctttagtgactctgcacttatttttttctgcaaatatttatgatgtcttttctaaattcattcactaaatacttagcttttcctgttttctagagctacaaagagacaagcttagaaatttgccttctatcagcaagagaccattgtgcgtaactaaaccaggtgatgaagtgtcttcctagcagcataaaatgtatgcctgtattttattatttttagttttgtgaagaatgctgttgatgaggttgcactggttctcctagctctgtcccaggatgccttaccttggtatctttgattatcatatcctttggtaa

SEQ ID NO: 189869 - DNA, 601 bp, Human
taaggtagtttgttttaaatttatcctgtaacattcttaagtagagacaaacttaagaatcattagtagttattttgtcatatttccttggggaggggaaaaaaaaatcccagatgcataatgggaaatacagagtgacagggaactatggagcccagttcacataactaagaggattctggaataattctttaaaaagcaatttgtaatgcctagaggataacaaggtgttaagtaattgcaatgtgaactcattgccaaaaaataaaatcacaaaatgagtttacctttttttttttttaacttagaaatagaccttggaattgactaaaaagtagacttagctagaacttctcacaatagatttggaatccagaaagcctatacatttgctaatggagtaattttgattagtggaaaaataaagcccaccaatggcacaataaaaggtgaaacatatgttacaaaatgagcaaatcacaaattgaaagtaagataataaagaattggtggaaaaagagagaaatgcagtttggaacttatgtcctgaagccactgagatttcatctgtaaacgtgggcgtttttaaactctaattcaa

SEQ ID NO: 189870 - DNA, 601 bp, Human
ttctataagatacaaagagcccaaatcgggaggaatctgtctcttttgcagaatgattgaaacagtttctaaaattatgtagcattaatctttaaaacaacaacccaaagagtgaagatcagctatcatctatttaagcatcctactcaatgccagttcctggttagatgcaggtagaattaatatactatctttactctcaagaaggctgcagtctgctagtagaacaggtaggtaaacaaatactatggttacaatgtgaaaagtgcaaaaatagagataaattattgggtacattcaygataaaaaggaggaggtgaccaactctcctcaaggtaattctggaaggatgattgttggtcaccagagagaaggctatagatggtacatagtctagacagtgggacacacccatgctccattcataaataaaacaatttctaggataatttgagttatcccttctaattaatactgagtaaaatttaatttgttattggctatggtttattttttcagctattaatgagttatattcatatataaatatacatgtgtgtgtaaaatttcttgacacaattatttttgtttatttttttga

SEQ ID NO: 189871 - DNA, 601 bp, Human
tttctttctttttctttagctcaactgagaagtcatttccttggagatcaacaggtatgttttttattatataaaagttatgtttgataaacacaaattacatagcctactctcttaacttactatctcttggtgaaataagccaagcaaagcctttaatagtgacaatattgcgctacattgctttggaatagtacttaatatgcttaagtttttagtataattgagtaaatttgtgtatgtcaactgtaatgaaaaagcattgaacagcagcatttttaatattaaccccatatctgaragtttccatttccatcataagaaaacacagggctgacttcaaaaaaagttattacgtaatcaagaaagctgctaattatacaagttgggtatttcactgtgtttatcatactcagagaaaagtcgcttgaagttttcatttttttaatgtatccacatgtagaatatctagtagcttctaacatagtgtggtagctttccatgtagtctctctatcttttctttttaacctaaattcaccacataggaaggatgaattacattaaggagactgtctgtcacttacacaaatcgttgatgt

SEQ ID NO: 189872 - DNA, 601 bp, Human
cgtaatcaagaaagctgctaattatacaagttgggtatttcactgtgtttatcatactcagagaaaagtcgcttgaagttttcatttttttaatgtatccacatgtagaatatctagtagcttctaacatagtgtggtagctttccatgtagtctctctatcttttctttttaacctaaattcaccacataggaaggatgaattacattaaggagactgtctgtcacttacacaaatcgttgatgtcttcatactcagccttcactcaataaatgtttattgagtattcacataatgtacygggtgctgtgcacattgctgggcagagtgatgggcataacacacacttgtccctgtccccttcccccatggagcttacatcgtaatcagtaatgtgaacaatgttgtaatgctggaataggcattgatgtgtaaatactttggcccttttcaaacaagacttgaattgaggaagacttagataaccaaatgcccagtatctgagtttatctaaacctagtgccaggattctggtgttccttatactgcatacaaggcacttggctgtcatacaaagaagttctttcccccagaaaaatag

SEQ ID NO: 189873 - DNA, 601 bp, Human
ttcctttttatggctgaataatatttattcattcatcagttgatggacatttaggtcttactacttttgtctgttatgaataatgcttttatgaccatttgtataaaagttttgaatatatgttttcagttctcttaagtataaacctattagtggaattgctaggtcacatggtaactctgtgtttaacccgttaagcaactaccagattattttccagagtggctgtaccatttaacatttccactagttaaaaataacggttctacaggagaatggtgtgaacccgagaggcagagcstgcaatgagcggagatagcaccactgcactccagcctgggcaacagagcgagactccttctcaaaaaaaaaaataataataaaataacagttctgatttctccacatcctctcaaacacgttattatcctttttattatagccgtcctagtgggtgtgaagtaatttgttgtattttaaccttaccaactgccttcatctcgactttcttctttactttgtaaatataatttttctcctgattctaaatgtaatatatactcatcaaaagatatttggaaaatatttaaaaagtacaaaa

SEQ ID NO: 189874 - DNA, 601 bp, Human
gtagttcaacatacggaatttgatacagaaaatgtagttacgaaagtgtgggttggaagatatgagtgattaaacaggatgatgaagcacccaagagataatgataccagaaagctgctatcatccctaggactgcagaggcaaaggggtaggtagatggttttgtcagtgtcctagagctggagcagtgggaggggcttcagacggggagatttccagcattaggtgaaaccaggaaggagatgccacccgtgccagaaatgttgtttaaaatagagccagagaaataccctgatttccscatgcaatttttctcctaaccctcaccagtctatacactggctgaactgagctggagagggcagttgtggatttttaattaccaaaagccaagcagacactgcatataatcatgtgttgatttacagtctagagagaatgagtttagattatgaagacacattaattatagtggacctatggccttggcatcctttctaccccttccccgttgcttaagtcatttgactgccatcttcagggtttttatcatggccaagtaacaaatataagagtacaaaaaaatagaaaaaaacaataa

SEQ ID NO: 189875 - DNA, 601 bp, Human
gcctaaaactcatattcaagcctagtagttacatttactaattttttttcctttgaggggaaggaggaagggtattaacttctaaacacagcaatcacaactggtatttactttctaatattttaactgtataatgttgtggtttttcttaagtttacccacttttcagccatatttatgacatttaaattgtaaccatggcaataagctatagttagaagagtagcaaattgaaaatttatgaataaaatagtaaaatcttattttcttttctttctttctttttttttttttttttttttgagacggagtcttgctctgttgccatagccgaagttcggtggcgccattttggctcactgcaacagccacctcctgggttcaagagattctcctgtctctgcctcctgagtagctgggattataagcgtgcaccaccatgcccagctaatttttgttttttttaaattacagacagggttttgacatattggccaggctggtctcgaactcctaacctcaggtgatccgcccaactctgcctcccaaagtgctgggattacaggcatgagccactgcactggcccatatttccttttct

SEQ ID NO: 189876 - DNA, 601 bp, Human
tgcaggggaggagaatcggcctcagaatccagcctccctccgccccagctcttcctagcacattagaccaggagcagtccgtcttacagggctggaatgtgctgctctgtccccaccagccagccagccaagctcattctttttaacactgctgtgttcctagaaaaagaaagtgttcgagaaattgatggatgttacgtaggtgataaagaattggtgctcatgggtaagaaattagaggccaaaaaagattggaatctctaccaaaacaacaagtgagagaaattttctggttgactcrgaaggcactgaggggttaatagatttggatgaacaggagagaaaatagtaacaattctgtgcagttaggagttttgatgtttgacagtaaatatggaagggaagaaaaaagaccatagtaaaataggaagtttaaaactgattctataacttcacagtgctgcattcatttattgtataacaggtattgaagtggtatgattttaacatactattcatttaaatcattactgtgtgaaatactggcattagttaatgtttactactaaatttaagactgtaggagctaggctgtgcattt

SEQ ID NO: 189877 - DNA, 601 bp, Human
atccagcctccctccgccccagctcttcctagcacattagaccaggagcagtccgtcttacagggctggaatgtgctgctctgtccccaccagccagccagccaagctcattctttttaacactgctgtgttcctagaaaaagaaagtgttcgagaaattgatggatgttacgtaggtgataaagaattggtgctcatgggtaagaaattagaggccaaaaaagattggaatctctaccaaaacaacaagtgagagaaattttctggttgactcagaaggcactgaggggttaatagattyggatgaacaggagagaaaatagtaacaattctgtgcagttaggagttttgatgtttgacagtaaatatggaagggaagaaaaaagaccatagtaaaataggaagtttaaaactgattctataacttcacagtgctgcattcatttattgtataacaggtattgaagtggtatgattttaacatactattcatttaaatcattactgtgtgaaatactggcattagttaatgtttactactaaatttaagactgtaggagctaggctgtgcattttgtttatgtatttaaattttgtttct

SEQ ID NO: 189878 - DNA, 601 bp, Human
ggctttcttctgtcttcatagctggctcaaaatgatcagatacatttttctatcatgaaaaatgcaacaaccactaccaaatcaagcaaaaaacaaacttaaaaaatcaccactggatataattgtgggtgccaacatctcactccagaggttcctacacactgctatacttcagagtcacctgcagagctactaaaatcttgacgcccaggcatcacccccacacaatttagttcgaaagtctgagttgggaaccaggcgtcagtggggtttaacgagtccccaggtgactccagtgtgyacagtttgagaaccactgctttattctaaaacctagtcattaaagagaagaattaaaaatttatcctgcctgtcctgttcatatttcaggataagtaaataatcctagctattatgtaaaatattccaaaagaattcctgctgataaatgtagaaagaataacaaaattagaaaaatcactagtttgcaagctctaatgaaataattcaagcaaagattgtcagtggatgctaaaacctcttaagttcccaaccctagctgcacagtagaatcaccctgggagttttttaaagttccatt

SEQ ID NO: 189879 - DNA, 601 bp, Human
taaaatcttgacgcccaggcatcacccccacacaatttagttcgaaagtctgagttgggaaccaggcgtcagtggggtttaacgagtccccaggtgactccagtgtgcacagtttgagaaccactgctttattctaaaacctagtcattaaagagaagaattaaaaatttatcctgcctgtcctgttcatatttcaggataagtaaataatcctagctattatgtaaaatattccaaaagaattcctgctgataaatgtagaaagaataacaaaattagaaaaatcactagtttgcaagcyctaatgaaataattcaagcaaagattgtcagtggatgctaaaacctcttaagttcccaaccctagctgcacagtagaatcaccctgggagttttttaaagttccattattcagaatacagcttagactgattgaattggaatctctgagtgtgggacttggacagcaatagtgttaaaattccacccaattttcaacccaggtgattgcattgtacaaccaaggctgagaaccatcgcattaggagacagattggtggtaaacttgacagaggattaggctgccactacctgcattgcct

SEQ ID NO: 189880 - DNA, 601 bp, Human
cattgtttttaagggcttttattgagttatgactgaggttgaagatttaatctgttcatcaacgactttatttcattttgtgaaactacaagttcttttgtctatttttataattcgtgaaagcttttttttactagagataagctcgcacctcgtaatatgcttctcaagtattttttccattttgtcacttctttttatttcattttggttttaatttacaaaactgtttaacattcttacatagtaaaattagtatcttttttatgtcttctaagaaaatttaagcctttttgagatktttgtgattgaataattttgcctggagaatttatattgaacttgatttttgagctcaaagaaattcttagtggagaaaccacctctttttcattcatctatccaagaagtgtgcttgacttagatattttctgaaatgcctctgaaaagtatgcagcaaaatgatgtaggaatcatttatgaaattctacctcccaaggaaatcttagaaaataaatagttctgaggacttccatattcccccgtgtgtatagaacagctatgtagaaatttctgcttgtaagagagtagagaggagact

SEQ ID NO: 189881 - DNA, 601 bp, Human
ttaacattcttacatagtaaaattagtatcttttttatgtcttctaagaaaatttaagcctttttgagatttttgtgattgaataattttgcctggagaatttatattgaacttgatttttgagctcaaagaaattcttagtggagaaaccacctctttttcattcatctatccaagaagtgtgcttgacttagatattttctgaaatgcctctgaaaagtatgcagcaaaatgatgtaggaatcatttatgaaattctacctcccaaggaaatcttagaaaataaatagttctgaggacktccatattcccccgtgtgtatagaacagctatgtagaaatttctgcttgtaagagagtagagaggagactggaggaaggaagccagcatataaattattgtctccatatttaaccctaagaggactcatttcctctggtttaaacagtctgtttctctgacaatgcaggtaaaattagactttatgtcttggggggaaaatatatataatgtctattttttaggcccagcctctcagtgatttttttctagaaatactgcagtgttctcaagaagcaaagtgttcttgatttcaaaggac

SEQ ID NO: 189882 - DNA, 601 bp, Human
ttttatgtcttctaagaaaatttaagcctttttgagatttttgtgattgaataattttgcctggagaatttatattgaacttgatttttgagctcaaagaaattcttagtggagaaaccacctctttttcattcatctatccaagaagtgtgcttgacttagatattttctgaaatgcctctgaaaagtatgcagcaaaatgatgtaggaatcatttatgaaattctacctcccaaggaaatcttagaaaataaatagttctgaggacttccatattcccccgtgtgtatagaacagctaygtagaaatttctgcttgtaagagagtagagaggagactggaggaaggaagccagcatataaattattgtctccatatttaaccctaagaggactcatttcctctggtttaaacagtctgtttctctgacaatgcaggtaaaattagactttatgtcttggggggaaaatatatataatgtctattttttaggcccagcctctcagtgatttttttctagaaatactgcagtgttctcaagaagcaaagtgttcttgatttcaaaggactaatagcctgctaattgataagcaatgttttg

SEQ ID NO: 189883 - DNA, 601 bp, Human
ttctaagaaaatttaagcctttttgagatttttgtgattgaataattttgcctggagaatttatattgaacttgatttttgagctcaaagaaattcttagtggagaaaccacctctttttcattcatctatccaagaagtgtgcttgacttagatattttctgaaatgcctctgaaaagtatgcagcaaaatgatgtaggaatcatttatgaaattctacctcccaaggaaatcttagaaaataaatagttctgaggacttccatattcccccgtgtgtatagaacagctatgtagaaatytctgcttgtaagagagtagagaggagactggaggaaggaagccagcatataaattattgtctccatatttaaccctaagaggactcatttcctctggtttaaacagtctgtttctctgacaatgcaggtaaaattagactttatgtcttggggggaaaatatatataatgtctattttttaggcccagcctctcagtgatttttttctagaaatactgcagtgttctcaagaagcaaagtgttcttgatttcaaaggactaatagcctgctaattgataagcaatgttttgtactacatt

SEQ ID NO: 189884 - DNA, 601 bp, Human
tcgttatagcaagaggggagccagtagctaaaacccacattgattcgtttagtttctttccatgtcacattgctgtccagggtaggtaataatcattcactttagaagctttatgcatgtgttaactttcttgcctctcctcactaaccaacatgtaattagcactcttattcaggtccatttgcttttagttgtgatttgattaactgaactaacaggatgggagcaatcttttttttttgagacagactctcactctgttgcccaggctggcgtgcagtggcgcgatctcggctcactrcaacctcccgcccccagattgaagcagttctgtgcctcagcctcctaggttcaagcaattctctgcccagcctcagctgggattacaggcgcctgccaccatgcccagctaatttttggatttttagtagagtcggggtttcaccaccttggccaggcttgtcttgaactcctgacctcgtgatctacgtgcctcagcctcccaaagtgctggaattacaggcatgcgccaccgtgcctggccaatcttacctttttataattacttactttgttaatgatttgctatttttttaaaagc

SEQ ID NO: 189885 - DNA, 601 bp, Human
agtacattctaatcaatgaacatagtgattatactgttaattcaggaataagtttgtaaaactgtaaatctgactctcctcgggttagatgcatattcagtatcaaaaggaaagccttgttggaatatttctttgtaattcttttgccaaacaagtttttggagaaaatccatacatgagttacttggccatctttgatttagcaagcatgaagcccaagtgtatttggcattactccttttttaatgttggatgttctctgaatagttaaatgtagaatgtaaaatagataccccttgcmatggactcaaactggtacaggattcaatagcgacatttataaaagcagggagctggagcatcacacccttgtaccgccagtcctcatgtttatgccataccatcaaggctcatacagcagatgctgtagcccatggtggtgtgagctgccaggttgtgctgcacggctagctcatggagtctcaagactacttttttttttttagtaagtatcacaaatttattaacatgcttacaaatgaaccctaggtagcaataataacccctcaaaggtacaactctagaacaccagagtggggaa

SEQ ID NO: 189886 - DNA, 601 bp, Human
ataagactaagaaatagatattgtttaaaatctttttaattgcaggaagatatgtacacagttactggagggatacccactgaaataattagtaaagtcattttaaatacagtgtagagtatctttgtaatagcatcatacagtaatttaggggagtagctgtagaatcatttgatatatcagtcttctttccctcttgtgaagtagattttccagtgttattacaatccacaggtctagaaataaaatgtataatagtctgtctgtatccatggagaatacgttccaaaaccatcagtgratgcctgaaatggcagatggtactgaaccctgtatatactatgtgttttcctatacattcattcatgtgataaagtttaatttataaatcaggcacagtaagagattaacaacaataacaaagaatgaaatagaacaattaagtaaaataagggttgtttaaacacaagcactgcagtactgagacagtaaatctaatagtcaagacagctgctaagtgactaacagactagtagcatctatagcatgggtacactggacaaagggattattcacgtcccagtgggatcacagctgaatg

SEQ ID NO: 189887 - DNA, 601 bp, Human
aaagaatgaaatagaacaattaagtaaaataagggttgtttaaacacaagcactgcagtactgagacagtaaatctaatagtcaagacagctgctaagtgactaacagactagtagcatctatagcatgggtacactggacaaagggattattcacgtcccagtgggatcacagctgaatggcacagatttcatcatgttactcagaatggtgtgcaatttaaaacttatgaattacttgtttctggaattttccatttgatatttttggacaattgaccacgggtaactgaaaccatggmaagcaaaaccaaaagataaggatggactactgtagaataaaataagtaacctgggtacacgaagtgttaaaattttgatggttttaattacttacaaatttgaataaatatcttgtttttaccactagaatgaaattaataaattttgctattttatcatttatctctaagattcttatatttctctcagttttgttactgaacctcaatgaacatactatataagcagatttgtagtttcacttttgctgtttcttgctaaaaaattaacaaaatatttatgtacattaaaaacttaag

SEQ ID NO: 189888 - DNA, 601 bp, Human
aatattttaggccaggcacagtggctcatgcctataatctcagcactttgggagacagaggctggcagatcacctgaggtccggaattcaagaccagcctggccaacatggtgaaatcccttctctactaaaaacacaaaaattagctggacatggtggtgcatggcctgtaatccccgctactcagaaggctgaggcgggagaatcacttgaacctgggagaaggaggttgcagtgagccgagatcaagccactgcactacagcctaggagcgagactctgtctcaaaaaaaaaaaaaaattattaggttaaaaattatagtattcattgaactagtgagccaatgtgttttatgggattctagtcagattggtgccaactataaataagttatagaggattataaccatcactaatgctgaacatacatgaatattttatttcagggtttttttggtatttatagaaacatagcaagttactggttattggctataattctatataacatatagattctttctttaacgtttcaagccttcttctgacccactgtgttatataaaactgaagtgtttttcatcattttaatgtgcataa

SEQ ID NO: 189889 - DNA, 601 bp, Human
cccttctctactaaaaacacaaaaattagctggacatggtggtgcatggcctgtaatccccgctactcagaaggctgaggcgggagaatcacttgaacctgggagaaggaggttgcagtgagccgagatcaagccactgcactacagcctaggagcgagactctgtctcaaaaaaaaaaaaaaattattaggttaaaaattatagtattcattgaactagtgagccaatgtgttttatgggattctagtcagattggtgccaactataaataagttatagaggattataaccatcactaakgctgaacatacatgaatattttatttcagggtttttttggtatttatagaaacatagcaagttactggttattggctataattctatataacatatagattctttctttaacgtttcaagccttcttctgacccactgtgttatataaaactgaagtgtttttcatcattttaatgtgcataacagtataccagttccagacctaaaagtgaatgtagtacataaagcccagaaatactcaaataatgtactaatgaattgacaaatggaagaaaatttaaggagagtagcctagagaac

SEQ ID NO: 189890 - DNA, 601 bp, Human
aggaggttgcagtgagccgagatcaagccactgcactacagcctaggagcgagactctgtctcaaaaaaaaaaaaaaattattaggttaaaaattatagtattcattgaactagtgagccaatgtgttttatgggattctagtcagattggtgccaactataaataagttatagaggattataaccatcactaatgctgaacatacatgaatattttatttcagggtttttttggtatttatagaaacatagcaagttactggttattggctataattctatataacatatagattctttytttaacgtttcaagccttcttctgacccactgtgttatataaaactgaagtgtttttcatcattttaatgtgcataacagtataccagttccagacctaaaagtgaatgtagtacataaagcccagaaatactcaaataatgtactaatgaattgacaaatggaagaaaatttaaggagagtagcctagagaactcattctagaaactaaataacttaagtcaaaaattatttcctatattgcctcaagccctgcagatagctttgctatgtttgtgtatttgcacattgcactgctgga

SEQ ID NO: 189891 - DNA, 601 bp, Human
tgcagtgagccgagatcaagccactgcactacagcctaggagcgagactctgtctcaaaaaaaaaaaaaaattattaggttaaaaattatagtattcattgaactagtgagccaatgtgttttatgggattctagtcagattggtgccaactataaataagttatagaggattataaccatcactaatgctgaacatacatgaatattttatttcagggtttttttggtatttatagaaacatagcaagttactggttattggctataattctatataacatatagattctttctttaacrtttcaagccttcttctgacccactgtgttatataaaactgaagtgtttttcatcattttaatgtgcataacagtataccagttccagacctaaaagtgaatgtagtacataaagcccagaaatactcaaataatgtactaatgaattgacaaatggaagaaaatttaaggagagtagcctagagaactcattctagaaactaaataacttaagtcaaaaattatttcctatattgcctcaagccctgcagatagctttgctatgtttgtgtatttgcacattgcactgctggagtgaaag

SEQ ID NO: 189892 - DNA, 601 bp, Human
gtaggagacattaagaattgctttataactatatactgttaccactaatcctttattttgacatgtggactgattatcaaatgttttcttcaaaacattgaaatgagagtggtcagtgggtaaacacttcatgcaattgccataagtaaagtaggttggaccagaagacttcagaaatgagttcccagttcaaaaagccaaatggcagctgtgtttgatttatacctaaacattgtctaactaacatgaaacaagtcacaatataaatctagcatagttgctttttttgtgtgtgtacatrtatttatagtctaagctttatagagacagcaaaattgctcacatttcccagtcctacaatttagtggtaccaatcttaactgatgttcagtaatattttaagggtgattgatccttgatacatattaaagcatgaaaacatcaaaaaatgcttgaactcttctttcttctttcattaactcttcctcacatcaaatgctcaagccgtctttaattgtagcacagggttgggggagacctcagaactcattttgttcagtcatccatccagtgcatgaatctcctgtacagtttccataca

SEQ ID NO: 189893 - DNA, 601 bp, Human
agttattaatccagtctttttttctagttccctttgtttcagtttggcagtttttactgtacttaagtggagaaattttagctgttttttataaagatgccttgcctttgctttaaacacaataactgcccagggcctatatttttggccacatctttattttcagagggaaaaaaggacttttcttcaaatgtattttcccaagacaatatggctgtcattgttaattaaaatggttctctagtatgtaacatgattcttgtgttttcctcattgtgttgaacattttccagttgaaacytaatgagcttttcttttagtaagtgctgatatatgtgagtgcttagggtaatttttcttttattccaaaagtattttttgctgttgttgtacttaaacttgaaagctggatgaagtatggttgttccccagtttggttataaaatgaatgtctgctaggccacaaagtatggaggacagatgggaacatcttgtcactaaaaaagatatgttgaactcatttgttcaaaataattaaatagtgtttctaagctaggaaacatgagtttcaagttattgagcctcctgaaaacatcatttt

SEQ ID NO: 189894 - DNA, 601 bp, Human
cctgccagccagctccagcatgtgccgtcacctcttctgcttctttcccaggctatatatagttggcctgaagagctctgcactccaaacctgcttctttctggcctctgtccttgacactgcaactcaaatgtggtctcccatcctcctgtcaaacacaagttcacacactttgaaaaacatccaaggagaagcggcatggtctcgagtgagtgtgagctttggagccaggttgacttgtttccttccagctctgtggctccagacacatcaccactgtcaaaccccagtgtccccggcratgacacattacctgctgcttggtgtttttgtgatgatgtgtgttgagctcctggcacacaggatattcaagccatacctgttgctcttcctgccctttgtcacaactgcctggtggtgtaactgtttgtggtaaggcccccctgagaacagatggctcccctgtgtgtctccctcggagtctggcatgaagcaagcaagcatctctgccagcgctgttcaataggagaataatatgagctgcatattttctacattttctagcagccatgggaaatctattttagtaatgtattttatt

SEQ ID NO: 189895 - DNA, 601 bp, Human
aaattattaatattttgtgttcacttcttcgtaccaagtcttcataatctgttttttactcaacagtgcatctcagtttggactagccatatttcaagtagccacatgtggctgatggccaccgtatggggcagcacaggtctatactgcatttgggtagaggtaacgtaaatgtcaaaggtatgaggtgtgtaactttaaggctggcgggaggccatattgtagcaggatgtaggtgccatagcatcttggcattactctcgtcccaagaaaaagccgcagaagtttataaaaacccatkgggctaaggggagaacttcaagggcagctgcatagagaaagaaatgaagatgtgtgtttgctagatcctgagtgtttcagccagagactgtatagggaatgataatggaggcatgtgctaggagaagcaggcaagggccgtgatacaatctgcagccctgatattattatgtttgtgctattaatctaatatttctacccccatttttcaagaatgtttgcagggtggttccagtgagcccatagatgcagaatagccaggagctggggcaggaggtggggaggattacataaggagcag

SEQ ID NO: 189896 - DNA, 601 bp, Human
atggctgttgcttttttgcttttggcaatgtctacaaacacttgggctctttttaatataattaggaaacatggcataaattgaatgctgtctaaaaatgagtggtttaagattgtctttcatatcaaaaagaaaaacagttgtataggctgccatgcatatctgccaccagagaaatcgcattttccaaatgttttgttgttttttaatatcctttaagaagtacatttttcaaatagttgctattattttaattaatcagtaaaatcagcttctaatttgactataaaattatcagttygccattagaatagctataaagttagttttaaatgtgagctctttcaaaattgtgcagcataggatttatgtgaaatggtattttaattactttattcattctttgtgaggaaaatgaactttcatctctcatggcagtatttcattgtgattattggttactcataattatatgtacttgttcctgtgacagggaataagcagcgttttctacaataatatgcatgagactccctaatattttctaaattagtttgtatgtttatattcttagtcctcacaacaaatagctaattgcttt

SEQ ID NO: 189897 - DNA, 601 bp, Human
tccctaatattttctaaattagtttgtatgtttatattcttagtcctcacaacaaatagctaattgctttaaattaaataaaacctcaagcttcctcaaccaaattctagtttatttttaactttccctttgagaaccaggagataatggagtatggtgataaatatttttgaagcaaattttgcattaggatgttggagttagaggttatcatgttgatggagaaggctaatcctacagctcttcattttctcatcagtcttactacatctgggagttggtgtattctctattcattacktactgccctagcaagattcttcctgacccattaaatgaagccctagacaaagtggagagaacattgttttagtgaggtcgagcacacacaggtgttattagccggtcttaagagaggtgctttttactttgagcaaaaaagccaaattaatcatttcatatctaaggcttttaagtttaattaaatctttttcatccattatttattgactagagctggttgttttggctttatataaccttagttttggaatagaaagtgaggaagaaaaaccagtcaaaatggtgagttaaatccata

SEQ ID NO: 189898 - DNA, 601 bp, Human
gggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaaggtaggatgacttccacttatctacacttctttccatctttgcaaactaacttgaaatgttatatatatatgttctgcctcagtcagatcagccctgatggtgaaagggtcacagctacttagcttgtstgtgaaggggttaaagggaaaaaagggagacaagcagttgctctggggatacaaagataaatacaagtccctcactatgagaaacagaaggctagtgagaaaaacagatggtgccagcacagtgtagaagccacaggatgtatgtgctgtggggtcctgaaagaagacatctaacccagccacacagtgtaagggaaggtcaggaaaagagcggagtaaggacgtggaggagatttcctgaaggggatgctgcccggcagaatctctgaagatgagtgaaagtaagcctgtagaggctga

SEQ ID NO: 189899 - DNA, 601 bp, Human
aaggccaaacttcaggagctgaatcctaacctacacacaggagggactaccgaaagagtctgggcagatgagtgacagagacgggctaatatcatcactgctcccccacttccatggcagtgcaaaaggtggattcgaggaagggagagttagaagcagggattggatttgggagccagtgcagcaatacaaaggtgagaaatcttgagtggcaggacagaacacaggttgggcagcactgtggggagggatagaggacctctgttcctctcagaccgttacagacatgcctgtgtctaargtttctgcatctttttgcaaatgtatgagtatgaaaactgaagacagtttccttttgttaccactgtaagcaagttctcagaactttctaaatgtcccccagcaacttcccagacagtccttgtctgagacattttcaacctctagtaatttcttgacaggtgtattttagtagagttactacaatgcttgctgtgggcttcttcccccaccttaaccccccaaaatgagaatcttttggtgatggtgttttcaagatagtgaaaagcattgataagcctaggtatggtttgtttcgtgc

SEQ ID NO: 189900 - DNA, 601 bp, Human
agacatgcctgtgtctaaggtttctgcatctttttgcaaatgtatgagtatgaaaactgaagacagtttccttttgttaccactgtaagcaagttctcagaactttctaaatgtcccccagcaacttcccagacagtccttgtctgagacattttcaacctctagtaatttcttgacaggtgtattttagtagagttactacaatgcttgctgtgggcttcttcccccaccttaaccccccaaaatgagaatcttttggtgatggtgttttcaagatagtgaaaagcattgataagcctargtatggtttgtttcgtgcacgtggccactatgttgaatatagagcgataactatggtctagtgctaagccggtgtggttattttgttgtggctcctagttaaagtgccagtgactgagtgtgtaagtgctggctctgaatccaggccactctgcttaccgtctggcagcctaggggctctgcccacagtttccacctccctaaaataaagtgaatattaatacctgccttataaagtggttatgaggatttagtgagatactcccagcacataagtatttataaacatttatgttgtaga

SEQ ID NO: 189901 - DNA, 601 bp, Human
ttggcaggggaccaactgcaaagaaaacacacgatccttccttaatcatgtttatgtatctgagatagaaagtaatcactgccttctcttttctgcacaaaaatatctggcagatggtggtttgagattttcaggctttgggatttctttttaaatcagtcattccagcctatctttctccccaactttggttttctcttcactgacaccacagatttgatcttcaattggaaagaaaccatttaatctattagttcatcttttggaaacatcttttttaggtgacagtaacatatgagastggaactctgttttatgttacttcctgccttatttttctcactagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggtatgttctggtgacaagatgagctgtaaatgtgagagcagctacaaaattcatgaaactcttcttttgattaataaatatatggcttgtaaaatcattaacag

SEQ ID NO: 189902 - DNA, 601 bp, Human
cagctgagccctagtctccagtttcttggcatatttgagtactcctgttttgtgaccattctttttcagcaggaggcaagctcattaattagtcattgattagggaaggtaaattttcagaaaggccagcaattttagttgtaccttacaacactagtagggttaatgtctctcatttctaagagagttctctatatcctgagcaacaaaaaatcttaatctccctttccaatttttggactgctacctgctaattcaccaacactaccatactctaaataaaaaatcacatgaatgtttygtagctttcccctctcacattggtataaatctttatcccagagaagaaccactgtcccaacatcatttccacccgggcaggggcaggactagggtgagctaagcaaggcgccaaaggcacaacattttaggaggcctttactctcaggtttgtacaaggtagggttggcacatgcacaaaccaaacagtgaggacctctgtacgctccgcaccccaggcagcttgcttgcctctgcggcattgccacatcctaggcaggatgcgggctaaagaagacatcagggacccccataaacctga

SEQ ID NO: 189903 - DNA, 601 bp, Human
ctgatttccccttgctgtggaagttatgtcttcctcttatacctgactcttccattgcagagatttttattttggttcactgctatatccttggcatctagaataagcctggcctgctcataacaggtgtttggtgaatatttattaattggccaaatgacagtgctggaactcacattacatctcatctttatacttttgaaggagtttctaaaatataagaataatctaaaaccatattctcatctcccagaaaccacacctatcagcagtaatgatatttcctttcagtctttttttwaaatgtatttttttctatttaattagtaataaatggttatagggggtggggagggctgggaaggggagtgagtggaaccataatcacttacgctcttaaaatgtcgctggacagcctgcacttgtgagcagcataagaagaggctgagatgctgagccagtgccagaacctttccatattaagaaaattgctacccagtctaatctgtttttcaaaaccagagattcggaaagtcctggaccaaatcaaattgtctcctagctccacacacttaacttctttcacaagtacttactgcct

SEQ ID NO: 189904 - DNA, 601 bp, Human
tggcatctagaataagcctggcctgctcataacaggtgtttggtgaatatttattaattggccaaatgacagtgctggaactcacattacatctcatctttatacttttgaaggagtttctaaaatataagaataatctaaaaccatattctcatctcccagaaaccacacctatcagcagtaatgatatttcctttcagtctttttttaaaatgtatttttttctatttaattagtaataaatggttatagggggtggggagggctgggaaggggagtgagtggaaccataatcacttaygctcttaaaatgtcgctggacagcctgcacttgtgagcagcataagaagaggctgagatgctgagccagtgccagaacctttccatattaagaaaattgctacccagtctaatctgtttttcaaaaccagagattcggaaagtcctggaccaaatcaaattgtctcctagctccacacacttaacttctttcacaagtacttactgcctgcctgctgtgtgccagacgctcttctctatgctgggcttgcagcagcagacaggtcgcatgacagccccacccgaggtagcttacgttcca

SEQ ID NO: 189905 - DNA, 601 bp, Human
tcattattcattttgagaggtttctttttctcttaactctgcaggatgggtggaatcagaaccattttattacacctgtgtcgacattggagcgagaccgattcaaatcacatccttccttgtctaccaccaaccaacagatgtcacccatcattcagtcaggtcagtgggaaaatgccactccttggcgagaacctttgtgtgacagaacattgttccccagccagagaagatcaaacataagctggttaagcctgtcatctccaacactacccatgcagcagagaaccttctgtaggawtcacacaccattataaaccacaagcccactttcttcctttttaaaagtgtatacaattttacatcagcaacagcgccccaggccctgccctcaagtctgcctcactaagtgtgagaaggggccctgaaacctgcagttgacagactggacaggggatcggggtgcctgagagtggagggccacacttcgagacgcactgggttatgcctgaaagtggctgccctgtatgccagctggccataaggttggaatctcctccaaagtgaatttttttaagttttcttagtgaaaccttttaga

SEQ ID NO: 189906 - DNA, 601 bp, Human
actacccatgcagcagagaaccttctgtaggattcacacaccattataaaccacaagcccactttcttcctttttaaaagtgtatacaattttacatcagcaacagcgccccaggccctgccctcaagtctgcctcactaagtgtgagaaggggccctgaaacctgcagttgacagactggacaggggatcggggtgcctgagagtggagggccacacttcgagacgcactgggttatgcctgaaagtggctgccctgtatgccagctggccataaggttggaatctcctccaaagtgaayttttttaagttttcttagtgaaaccttttagaagcagggtcctttaccagaggacctttaaggtcttcagatccgcaacctgggagagctgcctgctttccagttaaacctccttcctctgcagacccccagcatctgctgctaatggaagcaggccttacagtgtgggtctgtaggaattccttttgatttttaagttgggaatcctggcaaccatactacctacttctttgtaatgtttaacttgatggaaagaatgttttgagattcagacttaatttttttacatgtaagggcaga

SEQ ID NO: 189907 - DNA, 601 bp, Human
tgccctcaagtctgcctcactaagtgtgagaaggggccctgaaacctgcagttgacagactggacaggggatcggggtgcctgagagtggagggccacacttcgagacgcactgggttatgcctgaaagtggctgccctgtatgccagctggccataaggttggaatctcctccaaagtgaatttttttaagttttcttagtgaaaccttttagaagcagggtcctttaccagaggacctttaaggtcttcagatccgcaacctgggagagctgcctgctttccagttaaacctccttccyctgcagacccccagcatctgctgctaatggaagcaggccttacagtgtgggtctgtaggaattccttttgatttttaagttgggaatcctggcaaccatactacctacttctttgtaatgtttaacttgatggaaagaatgttttgagattcagacttaatttttttacatgtaagggcagattattactgccaagccaatcagtcctataaatctaattctttccaaaatgagaaaggaaaaataataagtatcttatttttatttggctttaagtcacccatttggacttttaaatat

SEQ ID NO: 189908 - DNA, 601 bp, Human
ccaggatggctttgcggcccaacacaaatttgtaaattttcttaaaacattatgagatttttttggtgattttttttttttagttcctcagttattgttaatgttagtgtattttatgtgtggcccaagataattattactcttcgatgtggcccaaggacgccaaaagattgcacacccctggatcattagcacatagttactgaatagtgaccttgttttcaggaccccttaaatatacctgctggacagtgttggctagccccattcaaattcctaggtgccttttgggattctagtcagtggtagggaatactccacttctgcttctccagttattctaagggctgataatgcatcccttcacactagtgtgggatctgcttccgggcatgtctgatgccttgctgatgtcattggaggcaggcgggtatgctttctgtcctactactttctggaaagtaagcaaggtgagcagcacatagacattgtccatacatgcttacatgtttaacactgaacaatcctatgtcagtgaggtgactttttaggaaaagtatttcattgtcagtcttcctctgaaagcgtcaatttatgcaaa

SEQ ID NO: 189909 - DNA, 601 bp, Human
ggtgcttttattcaaacatgtttagagatgtggatattttggaaataattagaaatcaaaacatgccataaaacttctgttggctgaagagctatacataaaggataataggtgggtattttgcaagcaactgaactgggatcataaaataacaagtataactcttgcatggctagtaagttattatcactcagtttcaaacgcctagtcaagacattgagacagactagtggggaaagctgcatgatctctacactgtgcctctttagccgggcagcttgccctccagcttgagagtgarccccggtgttgactttgctgatttgtgcagtggcaggcctgcatgcaggtagcacttgcagtacttgggtctagctgctcttccactcccagcacctctgagatattttcagcaccagctgtgtgtcatttctagttactgagctttgtgtttctggagaggattttccacagatactgatgctgatttctctttctacccctctttctctcctcctttgcctctcccttcagtcggcagcacctcttcctcaccagcactgttaggaatcagagaccctcgctctgaatacgataggac

SEQ ID NO: 189910 - DNA, 601 bp, Human
actgtgcctccattgttgctccttccttgacctgagattttgaatcccagttgtttgtttggaaggcatggggcttgttcgaatattgtgtttcgcttctcctctctgacccactgctgtagctcagagccctggaaaaggagtgttcctcagctcaggatcccgtgctgctgtccaaagccagctggagaaaccctcccacatgtgagcagagcttgagcaggaacctttgcgcatgggctctgcactggcattgctttttggggaaacacacgcagcctgtttttgccatagttttgcyattagcccccaccagccctgaggtaagcagcagccaggccagatccagggaccctgagctgctacctctcccagcccgcattggcactggggaagacaggccctgtcggggacagtgctagccctagtgcaggggagaccacccagcctaatggaccagagtaataagcactagttttaatttcataaaatattttcttacaggctccagcaaaccttcaccaatttacatcagttcctattcctcaccagcaagagaacaaaatagacggctacaggtgaatttgcaatatcattttta

SEQ ID NO: 189911 - DNA, 601 bp, Human
gagcttgagcaggaacctttgcgcatgggctctgcactggcattgctttttggggaaacacacgcagcctgtttttgccatagttttgctattagcccccaccagccctgaggtaagcagcagccaggccagatccagggaccctgagctgctacctctcccagcccgcattggcactggggaagacaggccctgtcggggacagtgctagccctagtgcaggggagaccacccagcctaatggaccagagtaataagcactagttttaatttcataaaatattttcttacaggctccagyaaaccttcaccaatttacatcagttcctattcctcaccagcaagagaacaaaatagacggctacaggtgaatttgcaatatcatttttacagaaggctgattagcagttaacacagtaaggggtccacgtcgattgacttcccagagctgggccaacatggcagggtcctagatgctttccctggggatcttcactccttggaaactcaacgtgtggtttaagcaaagcatttccacggtagcctcacgttcttgagtatccacatcggtactgctgagaccaccgtgccactgatgggg

SEQ ID NO: 189912 - DNA, 601 bp, Human
cccagcccgcattggcactggggaagacaggccctgtcggggacagtgctagccctagtgcaggggagaccacccagcctaatggaccagagtaataagcactagttttaatttcataaaatattttcttacaggctccagcaaaccttcaccaatttacatcagttcctattcctcaccagcaagagaacaaaatagacggctacaggtgaatttgcaatatcatttttacagaaggctgattagcagttaacacagtaaggggtccacgtcgattgacttcccagagctgggccaacayggcagggtcctagatgctttccctggggatcttcactccttggaaactcaacgtgtggtttaagcaaagcatttccacggtagcctcacgttcttgagtatccacatcggtactgctgagaccaccgtgccactgatggggacagccgagaagtctttagttcatgtcttttgcccagcagtgtcctcttcccactctttttctgttaagctctaaaatctcttccagcctctgagtgagggaaggttggtaagcacacttcatgccctcatcacattgttctcttttgtgtatacctcg

SEQ ID NO: 189913 - DNA, 601 bp, Human
gccctagtgcaggggagaccacccagcctaatggaccagagtaataagcactagttttaatttcataaaatattttcttacaggctccagcaaaccttcaccaatttacatcagttcctattcctcaccagcaagagaacaaaatagacggctacaggtgaatttgcaatatcatttttacagaaggctgattagcagttaacacagtaaggggtccacgtcgattgacttcccagagctgggccaacatggcagggtcctagatgctttccctggggatcttcactccttggaaactcaacgtgtggtttaagcaaagcatttccacggtagcctcacgttcttgagtatccacatcggtactgctgagaccaccgtgccactgatggggacagccgagaagtctttagttcatgtcttttgcccagcagtgtcctcttcccactctttttctgttaagctctaaaatctcttccagcctctgagtgagggaaggttggtaagcacacttcatgccctcatcacattgttctcttttgtgtatacctcgttctccatctcgcccctccctgtccaagctccacaatttaaaaacactgag

SEQ ID NO: 189914 - DNA, 601 bp, Human
aggctgattagcagttaacacagtaaggggtccacgtcgattgacttcccagagctgggccaacatggcagggtcctagatgctttccctggggatcttcactccttggaaactcaacgtgtggtttaagcaaagcatttccacggtagcctcacgttcttgagtatccacatcggtactgctgagaccaccgtgccactgatggggacagccgagaagtctttagttcatgtcttttgcccagcagtgtcctcttcccactctttttctgttaagctctaaaatctcttccagcctctgrgtgagggaaggttggtaagcacacttcatgccctcatcacattgttctcttttgtgtatacctcgttctccatctcgcccctccctgtccaagctccacaatttaaaaacactgagtccatcaccaggtctgtttgtctcagtggtcaaggtggactcagcccctgccgggatggacctcactgtgggagagtgggactggcggttataacacacccaggctttgctttcatgaagggcctgcagtcagtctcaggtccttaccagtgccatggcgaacttggaccatctggtctctcct

SEQ ID NO: 189915 - DNA, 601 bp, Human
ttaagcaaagcatttccacggtagcctcacgttcttgagtatccacatcggtactgctgagaccaccgtgccactgatggggacagccgagaagtctttagttcatgtcttttgcccagcagtgtcctcttcccactctttttctgttaagctctaaaatctcttccagcctctgagtgagggaaggttggtaagcacacttcatgccctcatcacattgttctcttttgtgtatacctcgttctccatctcgcccctccctgtccaagctccacaatttaaaaacactgagtccatcacsaggtctgtttgtctcagtggtcaaggtggactcagcccctgccgggatggacctcactgtgggagagtgggactggcggttataacacacccaggctttgctttcatgaagggcctgcagtcagtctcaggtccttaccagtgccatggcgaacttggaccatctggtctctcctcttccctttcaatgacacagagcagctggagtttcctaaaacaagactgtatcctgtccttcagataaggatgtgttctaagacctctccttctcgtcatcttttctctgtaggtggaagaaaaa

SEQ ID NO: 189916 - DNA, 601 bp, Human
ctttttctgttaagctctaaaatctcttccagcctctgagtgagggaaggttggtaagcacacttcatgccctcatcacattgttctcttttgtgtatacctcgttctccatctcgcccctccctgtccaagctccacaatttaaaaacactgagtccatcaccaggtctgtttgtctcagtggtcaaggtggactcagcccctgccgggatggacctcactgtgggagagtgggactggcggttataacacacccaggctttgctttcatgaagggcctgcagtcagtctcaggtccttmccagtgccatggcgaacttggaccatctggtctctcctcttccctttcaatgacacagagcagctggagtttcctaaaacaagactgtatcctgtccttcagataaggatgtgttctaagacctctccttctcgtcatcttttctctgtaggtggaagaaaaagaactttccaagttattcataatttatgctatggttttttagtcaggaaaaatagaccagaatcataactctggcttgaaaggagaatttagctctgaaatccttataatgttagaatgcattgagttccaggacat

SEQ ID NO: 189917 - DNA, 601 bp, Human
ttaagctctaaaatctcttccagcctctgagtgagggaaggttggtaagcacacttcatgccctcatcacattgttctcttttgtgtatacctcgttctccatctcgcccctccctgtccaagctccacaatttaaaaacactgagtccatcaccaggtctgtttgtctcagtggtcaaggtggactcagcccctgccgggatggacctcactgtgggagagtgggactggcggttataacacacccaggctttgctttcatgaagggcctgcagtcagtctcaggtccttaccagtgccwtggcgaacttggaccatctggtctctcctcttccctttcaatgacacagagcagctggagtttcctaaaacaagactgtatcctgtccttcagataaggatgtgttctaagacctctccttctcgtcatcttttctctgtaggtggaagaaaaagaactttccaagttattcataatttatgctatggttttttagtcaggaaaaatagaccagaatcataactctggcttgaaaggagaatttagctctgaaatccttataatgttagaatgcattgagttccaggacatgacattggt

SEQ ID NO: 189918 - DNA, 601 bp, Human
gctctaaaatctcttccagcctctgagtgagggaaggttggtaagcacacttcatgccctcatcacattgttctcttttgtgtatacctcgttctccatctcgcccctccctgtccaagctccacaatttaaaaacactgagtccatcaccaggtctgtttgtctcagtggtcaaggtggactcagcccctgccgggatggacctcactgtgggagagtgggactggcggttataacacacccaggctttgctttcatgaagggcctgcagtcagtctcaggtccttaccagtgccatggygaacttggaccatctggtctctcctcttccctttcaatgacacagagcagctggagtttcctaaaacaagactgtatcctgtccttcagataaggatgtgttctaagacctctccttctcgtcatcttttctctgtaggtggaagaaaaagaactttccaagttattcataatttatgctatggttttttagtcaggaaaaatagaccagaatcataactctggcttgaaaggagaatttagctctgaaatccttataatgttagaatgcattgagttccaggacatgacattggtttct

SEQ ID NO: 189919 - DNA, 601 bp, Human
agtcaaagccttggtaaaataacccatgtctccaattgcatatagaacatactctatacaatttcagttcttttaaatgtgtcaaggtttgttttgtagctcaggatatggtctattttggtgactgaacaaaagaaaacagattcttaactgaacttatgcaaataactatattgccataaaataagaatactcatgagtagtttccaaattttggagaactcagaaaggtaaattttgctcatgaaagtatactttactcaatcataagctataaataactcaaaagcaaaaggatttycttcaattagaatggcagcctgccaaacagcgtgctgtgcattcaccttggaactgccatccacaaaccaagcagccatgtctcaggagcagagatggtggagtcttaccccctttcgcttttctaatgtacgcatttattcagcgctagaaatttcctttccaccactgcttagctgcatcccacgtgttttggtatgttgtgttttcattttcattgagttctgtctatatatttttaaatttcctttgagacctcctctttgaccctaggttatttagaagtgtgttttatttccaa

SEQ ID NO: 189920 - DNA, 601 bp, Human
ggttttagatgagaaatcccttgtcatctgaattggtgttctcaactaagttatgtgtcattcctatgtggctgctttcaagattgtcttttagtattaagaagtttaattgtgatgtgtcttgtcatgggttctttgggtttatcctttttggggtgcactcagcatcttgaatctggagtttcacgttttatgccaggtttgggaagttttcagccattatgtctttaaatacttttccagtcccttcctctcttttggaactctgatgataagaatgttagtgcttttgttagtcctstaagttcctgagactgttcatttttttccagtagattttctctctcttcagattgagtaaattctattgattttgcctcatattcactgattgtttttaaaattatgtttaattatatttttcaattctaagatttctgcctgtttctactaggtaagttggaagttcagatttctccttggctttgctggtactttccaaacaaaagaggggccccagtgcacactgctttattgtgtccagttgttgggggagatgtgtaagcttggctccctcagccactgctgacaccaggaagca

SEQ ID NO: 189921 - DNA, 601 bp, Human
tttggaactctgatgataagaatgttagtgcttttgttagtcctgtaagttcctgagactgttcatttttttccagtagattttctctctcttcagattgagtaaattctattgattttgcctcatattcactgattgtttttaaaattatgtttaattatatttttcaattctaagatttctgcctgtttctactaggtaagttggaagttcagatttctccttggctttgctggtactttccaaacaaaagaggggccccagtgcacactgctttattgtgtccagttgttgggggagrtgtgtaagcttggctccctcagccactgctgacaccaggaagcagggagaccatagagggctgcctcataccttgtttctgcagagtagaggtcagaactcagcttccctctgagggaagctgaccccaccaggggtgggggggtcaggtacaacatgccaaccaggcccactttctactacctgattctccctctttgatgctagatgggagagttctcttttgttctctttaattagccagatggggcgaagactcagtacccactgggtgcccagacacccaaggctggggctggga

SEQ ID NO: 189922 - DNA, 601 bp, Human
tgattttgcctcatattcactgattgtttttaaaattatgtttaattatatttttcaattctaagatttctgcctgtttctactaggtaagttggaagttcagatttctccttggctttgctggtactttccaaacaaaagaggggccccagtgcacactgctttattgtgtccagttgttgggggagatgtgtaagcttggctccctcagccactgctgacaccaggaagcagggagaccatagagggctgcctcataccttgtttctgcagagtagaggtcagaactcagcttccctckgagggaagctgaccccaccaggggtgggggggtcaggtacaacatgccaaccaggcccactttctactacctgattctccctctttgatgctagatgggagagttctcttttgttctctttaattagccagatggggcgaagactcagtacccactgggtgcccagacacccaaggctggggctgggagagccgatgggcccatgaaccctgttttgcactgtctggttcagtgggtgtgtgtaatgtcatgtcaactaactaaccccaccttgtacccacccgttgctgtttagtagag

SEQ ID NO: 189923 - DNA, 601 bp, Human
ggatccttcttcttggtaaccttttttcacacactatgaggtagcggaagtaaaccgtcagtataaacaacatgtacccggtttaacccgtttgtaagaggccaggccttcgtggttttaagtatttgcttagaatgaatttgtctccccagtgtcctctgggaaaccaaaatgtgctttgtattttctcttctctgccttggaccagatccacatgattcgtgagtagagttgccaagacaggtgtggcaagaaatagccctgagacagggctgctggcacgcagctctcctcctgttcygcctttctgtgtggaccacgaggcagcagtgagggcttcccatggagcatgtctccctttcagtcacacatcttgcgctcacagtcactgccagccagttgactgcaagtgctgtgtctgtaaaccttgcagtggggacttgacattgctttcagagtgaggaaaccgaacttggggatttggacatgagtctgggctgtgcttagtgttggagccccgggttgaacttgggtctttggtactggcagactgccctctgcacagtacataatgcttggtttagtttggacttccctttct

SEQ ID NO: 189924 - DNA, 601 bp, Human
acaatcccaattctatctgtatcacacagtgtgtttctcatctaggatacagactcactgggcagcagccgtgtctgccctggaaagtgggggcatcagggaggaggaggaatgtgtgaacctaaacacatggaagaccttcaaaagcaccagaacacagtctttcagcacagaattctttacatccttaacttgcacttgtgctaatgaagactctacctcctgttcttttccttctgtgacaaaacaagttatctgtctgggaagacatggcacaatttatttatacaacatttttatrgcttgcagatgactccgctggatcctccctcagaattgcccttcatagggaagttcagtggccactcaagtggttagcaaaatcaaggtgaaaagtttttctttttattcaaaatgggataaaaagaagcagctgccttttgtgacttttaagtgagaagctttcattatgtcttagccctacagtgtgttatcaataatcatatctgtgttaaattgtacttcactttgtatatcaccattgtaagttttaaccgtatacattataggctttttccatttttattttaaaaactgttta

SEQ ID NO: 189925 - DNA, 601 bp, Human
gaaagaaaacatggatctgcctaggaagtcacctctgcctgagtctgctacttgcaggattggagcttttgctgcagattacagctttgaagtcactttacctcaagagcagtttatattttattgtgctttaaaaaaaaaatttagtgccaggtttatggagtgaagtgctttcataaatgctgaaactacattttctgtgggtaaaaatgcagctcatcagaatttcccctttgaagaattttttatgttcacataaaattgccaagttaaaaatttgatctccctacagagtaagagytttcatttcaaataaaaccattttatagaccaggtatcaacatttacggcggtcagacacattgcagatagcaaaataaaatatttatgcttggttcttacttttcttataaactagaaatgtcaacctaagttatctttttgatagctcgagtatgttaggataggaggaattgggttgagtatccaggtaagattacaggagtgagggtggagcagcgtgtgtttggagatttctgtatgccaaaccccacgggctccaggcacgcttttggaagaccataccggtggatccctttgt

SEQ ID NO: 189926 - DNA, 601 bp, Human
tagtatctatttccataataactttttaaaactacacctaagtacagttgatagctcttactaatgtagttattgccaattccagtataagcctagtctctaaaccattatctttgcttaatacaactctcctaactctgaaatgctaaagacacatctcagggctccagagcattgccatggtttcttgccttttgcccaccagggtctggttgggaaaccgtctgcaccagagttgcttagggacttgaaagagtacagcctcctgtatctctctctctctctctctcacacacacacwcacacacacacacacacacacacacacccgccatttctccctgccagagcttagggatgtgtttatatccatgaatttatttaggctaattaatgttaactactgaacttttctttttgtacaagaaacaggccattcgtttatttgcttctgccaaagccagcagggcatttatctcttaagatgagtaagttgaaattggctaatttgttaaaagctcctacctgctggctaggttgaatgcattcactaagtgctagttttgataggttggcttctgacagagactgccccttgata

SEQ ID NO: 189927 - DNA, 601 bp, Human
agggctccagagcattgccatggtttcttgccttttgcccaccagggtctggttgggaaaccgtctgcaccagagttgcttagggacttgaaagagtacagcctcctgtatctctctctctctctctctcacacacacacacacacacacacacacacacacacacacccgccatttctccctgccagagcttagggatgtgtttatatccatgaatttatttaggctaattaatgttaactactgaacttttctttttgtacaagaaacaggccattcgtttatttgcttctgccaaagscagcagggcatttatctcttaagatgagtaagttgaaattggctaatttgttaaaagctcctacctgctggctaggttgaatgcattcactaagtgctagttttgataggttggcttctgacagagactgccccttgatagtatttggtggtatttgcaattgccagcccaagcacgagccatgtggaagcttctaaaccacagacacaagtcaaagtgttaaagagaatccagtggacttaatttacgagttaggggaaattgacagggggaattatttttgttttgtcttataaaaag

SEQ ID NO: 189928 - DNA, 601 bp, Human
cctttaggaggactgcatgagacccttgtgcagtgggtgcccaaacaaaacacacttttcttcttcccctaagggcgaactaacttgttaaaagcttctaaatcagggaaagaacacttaaaaagagtagctctttaaggggcagtaagcccaggaaaaggaactatgacatcagcatcacctcatatcacatctacccagaaattttgttttctcccagtttagttcaaaaattaattttaagactttttacagatttgttagaaatatttgtgtgacacaggtacaatcaaagtaaatkttgtatgattggatgtattcagaggccatgcctgacatcctgaaagtttccccttcatcagcctttgtgcttctccaccagggcttcctacagcagttcctccctctggtttattcacagactgcagataactctggaggggatcggtgtgtgtccctcttaccccactgccacccccacaggggtggtgtgatattctgcctctcctaggccctcagtctttgtgggattattgttaaattcacttgggtataagatgaggcaagagattgtagaggaattggcaaaaactcttcaaag

SEQ ID NO: 189929 - DNA, 601 bp, Human
gttttaaaaaaggaaattttattctatatctcttattctttaaccagagttatgtagaagactctgccactctaatctttagtacatggctgtagttgttgaagtcagggagctcccagaaatgtgaaagagtgtgtgagatgggcttgcctctagagacttatctttggaactttcccagtgatctgtggaccacaatgtgatttttgttttgttttgttctgatgcagcttccatgaggcaggctgaacctgcagatatgcgcccagagatatggatcgcccaagagttgcggcgtatyggagacgagtttaacgcttactatgcaaggagggtaatgatgttttctttacccgcttttctgctcacaccctccccttccacactatatttttttaaaaagacagtgacttcttgtaactacatgctaattctggaaatgattactgttgcctagttgtgacctttcattgtttctcctttcccatttttcatttgttttatgactaagtaatggcacttaaataaaataatacagtaggaggcagcaaaggaattttatgagcacagactttaaaacaatgctaaaaaagggattatt

SEQ ID NO: 189930 - DNA, 601 bp, Human
ggaagcagggagccattgcccttgcagagcccattgctgtctttggacatttaattgttgaaatgtattaggaggccgctaatcaatagcctgtaatttgggctgtaaaaactttatattatagataattgccacttattttgagctatgttcttgattttttaaaaattttagcctatgtcatcttctgtagttagtagaagcggtgttttttgtttgttttacctgggggcaatgtaggtgaccatttggacacctttttcacatgggacacttttgtttgtttgtttgtttgtttgtktgtgtgtttgtttttgagacggagtcttgctctgtcaccaggctgaagtgcagtggcgcaatcccagctcactgcaacctccgcctcccaggttcaagtgattctcctgcctcagcctcttgagtagctgggattacaggcgcctgcaaccacacccagctagttttgtatttttagttgagatggggtttcaccatattgtccaggatgatctcgatttcctgactctgtgatctgcctgcctcggcctcccaaagtgctgggattacaggtgtgagcctctgcgcctggccgcatggg

SEQ ID NO: 189931 - DNA, 601 bp, Human
gtctgtgtttccaataagatgcaacctattgttcccatgcttttggtaaattaaatttgtctgattgcagtatttacaaggttttgtcattgtgcatcttttgcatatcttaaaaataattcagtgcaaaaatacagtcacaaatcattaaaggactttagctttgttagtaggctgggatattagggggaaggagtagggatagattctaggttataacccaatttttctaaaacaaaggtaaatatattcagattttataaatagcgcaaaacacaaggctgggtacggtggctcacayctgtaatcccagcactttgggaggctgaggcgggtggatcaccagaggtcacgagtttaagaccagcctggctaagatggtgaagccccgtctctactaaaagtacaaaaaattagctgggtgtggtggtgggtgcctgtaatcccagctactcgggaggctgaggcaggagaattgcttgaacctggaaggcgcaggttgcagtgaactgagattgcaccattgcactctagcctccacaagagcgaaactccatctaaaaaaaaaaatagttcaaaacactggatgatgctgtggata

SEQ ID NO: 189932 - DNA, 601 bp, Human
tataacaacttggattcatagattcctgttttattcaatgggctgcaatgcgttactgtcaatatttattttgatgctcagattcttaatgatttggcgggaggcaccagtagtgcaggcacagggagaaccagttgtgggacaaagcccaggggctgtgaaggtcacggagctcttaaaagtcatttgttgcggaatgaactttggccagagggctactgaccctcacagctcttcctatgcaggtctgctgtgcagggcactcttaaaagactccaagcttgtgagactccttagtggmgagtagggaggctattggtaaaggctaggtagcgtaaggatgttagtaggcatggagggaagagaagttctctgagaaactaaatattttggaatttgtgagaaagtgagcagcttgcctttacctgagtggtgcagtgtttgtatttctgcagcctgcaccttctcttcctggtgagtgtgtcagcccaagacagccagactgttcttcagtagcggttgccagtttctttcatcacccaaactgtgtgagcgcatgtaccggttcatctgctggacgcagtgccagcaagtgtagatt

SEQ ID NO: 189933 - DNA, 601 bp, Human
tcaatgggctgcaatgcgttactgtcaatatttattttgatgctcagattcttaatgatttggcgggaggcaccagtagtgcaggcacagggagaaccagttgtgggacaaagcccaggggctgtgaaggtcacggagctcttaaaagtcatttgttgcggaatgaactttggccagagggctactgaccctcacagctcttcctatgcaggtctgctgtgcagggcactcttaaaagactccaagcttgtgagactccttagtggcgagtagggaggctattggtaaaggctaggtagcrtaaggatgttagtaggcatggagggaagagaagttctctgagaaactaaatattttggaatttgtgagaaagtgagcagcttgcctttacctgagtggtgcagtgtttgtatttctgcagcctgcaccttctcttcctggtgagtgtgtcagcccaagacagccagactgttcttcagtagcggttgccagtttctttcatcacccaaactgtgtgagcgcatgtaccggttcatctgctggacgcagtgccagcaagtgtagattgcgaccctctgtagatgtgggccggaggtactgg

SEQ ID NO: 189934 - DNA, 601 bp, Human
atgggctgcaatgcgttactgtcaatatttattttgatgctcagattcttaatgatttggcgggaggcaccagtagtgcaggcacagggagaaccagttgtgggacaaagcccaggggctgtgaaggtcacggagctcttaaaagtcatttgttgcggaatgaactttggccagagggctactgaccctcacagctcttcctatgcaggtctgctgtgcagggcactcttaaaagactccaagcttgtgagactccttagtggcgagtagggaggctattggtaaaggctaggtagcgtarggatgttagtaggcatggagggaagagaagttctctgagaaactaaatattttggaatttgtgagaaagtgagcagcttgcctttacctgagtggtgcagtgtttgtatttctgcagcctgcaccttctcttcctggtgagtgtgtcagcccaagacagccagactgttcttcagtagcggttgccagtttctttcatcacccaaactgtgtgagcgcatgtaccggttcatctgctggacgcagtgccagcaagtgtagattgcgaccctctgtagatgtgggccggaggtactggaag

SEQ ID NO: 189935 - DNA, 601 bp, Human
gctattggtaaaggctaggtagcgtaaggatgttagtaggcatggagggaagagaagttctctgagaaactaaatattttggaatttgtgagaaagtgagcagcttgcctttacctgagtggtgcagtgtttgtatttctgcagcctgcaccttctcttcctggtgagtgtgtcagcccaagacagccagactgttcttcagtagcggttgccagtttctttcatcacccaaactgtgtgagcgcatgtaccggttcatctgctggacgcagtgccagcaagtgtagattgcgaccctctrtagatgtgggccggaggtactggaaggatagtgtctacttgggtgggagtcttgaccatgggctggggctgcagtcagaagcccttagaatgtaaaaatgcttactcttggaataactggacccattctgcaaccaacatgcctccctctttcccctccataacccctaatactgaagctggagttgtttaccttctgtggcttctaggttcttcacagtcaggttgtccagctcaagtcactccatgtgcaggaacactgctcttggctaactgtgacctgggcatgtcctggtggtgg

SEQ ID NO: 189936 - DNA, 601 bp, Human
ctctccagatgaggccagcagtgaataaaaaccctttcattgtttgatcacaagaaacagtgatcttttgtttacactgcctacttcctactctgtccagggcatgtgcagacaggaattgattgaagtgcatgtagaccaaaatctagccctgaatgagacaaagtagagttgagaaggtgacttgcagactgattttgatggaaagaatttaacgtgtcattacattagcattttcctgtgctctgtatgaatttgaaatacttatatgctctccttcttgagaagtgaaatccccagkgctatctcattcttgtttttataaatggtagtcactcttctgtgaataatgtacaaaggcaaggactaaagtttagcctgcttggtaattgcacaaactgaacacaaacccaaacgtgtgttctcagcgtactttggaggtcttcattaattgaatgttggagtttagtaaaagaagttgctttctgttactggctgtgaaaagagtcgtggaaatctgcacatcagatattaaattcaaattagacctaactcatgcaatgataggttgccccacacttcactcacatgagttgataga

SEQ ID NO: 189937 - DNA, 601 bp, Human
aattgattgaagtgcatgtagaccaaaatctagccctgaatgagacaaagtagagttgagaaggtgacttgcagactgattttgatggaaagaatttaacgtgtcattacattagcattttcctgtgctctgtatgaatttgaaatacttatatgctctccttcttgagaagtgaaatccccagtgctatctcattcttgtttttataaatggtagtcactcttctgtgaataatgtacaaaggcaaggactaaagtttagcctgcttggtaattgcacaaactgaacacaaacccaaacttgtgttctcagcgtactttggaggtcttcattaattgaatgttggagtttagtaaaagaagttgctttctgttactggctgtgaaaagagtcgtggaaatctgcacatcagatattaaattcaaattagacctaactcatgcaatgataggttgccccacacttcactcacatgagttgatagaatgtcagttttcataacaaaagcagtcatgaggagcttagataaattggtacctgccattgatcagtggcacggttttcattcaggttcagcaagagttttccttaaagctggagg

SEQ ID NO: 189938 - DNA, 601 bp, Human
ttaaatggctggatgggcatcgggctaaaggacttgtgcttgtttgcaccacgtgtgagtgctcatctgtttggcaggtgcctacacctgcagggctgccttgcagctctggatcaaggccattaacacataaccatgaggaaggagatgcaggtgcctggaaggggacttcaggaggtctaactggggttttttttaaatctcttgaggaggaaatgaagatgcacacaaactaaggcttggccctgctgcagacgttcaaaaataataagcttctcatatcatccttcactagacttcyaccacctgaaacaaagtggagaggttttagttgtggttaaactatgttacgtctcacttagcttttttctgaggctgaaacattttggaacagtgtgtttcttctctgaatctaatattccaactactggtgcctcacacagatgtcagaacaatctgtctcttctctgtggttggccatagaacagtgacgatttcagaagtggcaggtgggagttgttccccagtttagccagcaccaggtctggagtctgacaggctagagacctaccaagtggagggctgtgctgtgctgcctgaa

SEQ ID NO: 189939 - DNA, 601 bp, Human
cattttggaacagtgtgtttcttctctgaatctaatattccaactactggtgcctcacacagatgtcagaacaatctgtctcttctctgtggttggccatagaacagtgacgatttcagaagtggcaggtgggagttgttccccagtttagccagcaccaggtctggagtctgacaggctagagacctaccaagtggagggctgtgctgtgctgcctgaagagcctcagtgcacagcctcacctggacattcactggagaagagatttgtgtcacaataagccttaactatcataatttcyttgaaatagtgtgtcaaaaataggataaaagtttggtttatgcaaatgtagtttttatctgacttctgaagaccacattgtcaccatagcagatcagctgcagcacccatagctttgcaacgctaggggagagtgctctcctggtttggggtgaaggtaccatgcatctgggagggaacttcctagtgccctttccccagctgtggtgacatcaaagtgcagcaggcacaagctatgcaaatatccatgttgccttggtgatgaatagaaagtggatttggtgttgggcagtattgtagc

SEQ ID NO: 189940 - DNA, 601 bp, Human
agcatgcatatggaaccagtgctgaaataccagctcagctgccgtttgactgtggttgttggtctgaaagtggagagagaccagatcttcctgaagagctccacatcatgctcaactgtgtgctgggcctttttctctctgacttctgtgtcacttagttgccagttaaaatgctgtttagactgctgggttatgaacgagtcgtggagtggtagttctaacagaatcaggggggtgactcctagttccatgtcccaccctgccacctcagtgtccctaaagatgccgtgacagcccctgkgtattctcaggctcctggatgtccatcccaggccctctcttctgcagcctgtggggatcagacaccaaccagagagactgcttcctcagttgcctgagcctggagcagagattccctctgtccttcctggtctcacagtccaaaattcagcctcctattatatataatgtataataatttatagtatatatataaacacttaaatatatataaaaaataagtttcaggacatcctatacatttactgttgaaattctgtaagaaacaagtttttgagtaagttaaattcctctgcatctc

SEQ ID NO: 189941 - DNA, 601 bp, Human
ggcacacaaagtccaaaggcctggagtgccctaggcagcttttcaaaggttcgactcctctcactgttggagagtgaagctgaatccaaagctgcattctatagttgtctgctgttcaacctgaccagttccctggggccagggcctctattgttttccaagcatctgcttccctggactgagcaagagagtggtgttctgtgattattttggcattagaatgtcattaaattccctgacacttaattggtcgtcccaagtgtaaattgaagatgcttctgccctgcacttaatgttcctygctgcagtggcagctccagcccctggcaaggcagcaggaaccccacgctagggcattcctgtggtacagctcctcccaggttgccacccagatgagcttgtgccatctggtgtcatggggacatgtgaagaactatttaggaattccctgttgaatgctcgacaccgtctcaaagggcattgttcatatcttcagagaaagactgcttaagtctatgctgaggaacttgtagacacataatcctatgcctttacacttagagggcacagtctgtgggggagcaatcctgcaacttggcat

SEQ ID NO: 189942 - DNA, 601 bp, Human
ataccaccccaaaaccaaaggccctggtttaggagctgaattgtagcagccgttcctcagtatctagatcgcagggagatttcactggagctggctgaagctgttggcgctttgagcagcgttgagccatcagtcctagttctgcgtctttgccccactgcagcttttggccacttgccccagtttagtgtcaccaggccccgactataagccacagtaatttttatggctgcaggtattagagggcagccagtctacagaggtaggggctgcccatcctccagctgtcttttgcaatacrggcatacacttcgagccaacagcagctccagccggccgtgccagctgtcaaatgctttctgggctggcacggctctttgaatccgtggtaatggcttcctctgttgaatgtcgtccaaaagcaattgcttgtcagcttaaaagcgtgtgccatgttgtcatgcccgccgtctgagagggcaggcatccccgcacacttgcagactgggatgctgtagcatcttctcatgagtcagggattgggtgtaacttttgccaaaatttcctgcattttccccaccctctccaacatgtctttgaa

SEQ ID NO: 189943 - DNA, 601 bp, Human
tattctcacacagaggcagcaaagtaattttgaaagttaaatcaaaacaaagcaatcttgtgtgtaaaacagataaaaatcacagactgtggttacagagtgcctctacaggaatcgcttacataaagctgatttcctccaatcttgttatggaaggaaaaggggaaatgccctggccttatcacaatcccattctgtcaaacaagcgcggcagagcttgtgtaaacagtggagctgcagctgcggctggtgtctgtgggggccattcggggtctgaggggacagttgtctcagcctgatkcatggcaggtggttcccgcgacggtgtgttggaggtatcccccacccaatgagaagggggtttgtggagagacagtcatgtagcccggtctcgtgtggattagtcattaagaaatgtccagggcagatttcagacttgaacagtgaaccaggttgtagctcatggcgtcgaggttgaggtgttgtgttgccgctgcctttggtgactgtgaatttataccttgcacatactcacaaaatggattagaacctgaaagtgggcgctgtggaagacctgaggaccctgaaagcattggataag

SEQ ID NO: 189944 - DNA, 601 bp, Human
acagagggccaagcctggccttgggccatttgcttcacttctctgagcctcagtttcctcatctgagcagtgagctagcaatccctccttacaggatgttttgaggagccagcagggggccaggcaagcaatgagtattccaggggtggcaaaggaccctgcggccttgaaaacacatttaggtttcagcccagacttgctgccagaaacaagggcagctatttcttctagctgggcaggagggcaccaaggatgggccctccaggcatgggcacaggcttgagagccaaagcagtgcccrtcaacatggcctctttcatctgagcatcaaagcaaatcaccaaagtggaaccagtttccctcagcctggcagcgcctgctggcgggttgccaaagacagggaaaaggagcaggaattcctggtggccacctcggcagcctgatcaggtgcacaccaagacacacccccgaggagcaatgtcctccagagacccaagaaggcagcaccctgtgctgggaagtatgcagggtcagagtgagttcaggcctgggttcaaatcctggctcagccactctgtggggccctgggcagatcattgca

SEQ ID NO: 189945 - DNA, 601 bp, Human
cccggccataaaaggactcttaacatcgcctctccccaactcccttaacctggggctggagaccctcctccgttatcaggctccgccccagctacggccccacccctggtgctggcaccacctcagtctaatccaggttccacccccaatccacctaagccgtgtccctagccctggccccgccctgatgttgccgtgtaactcagttcccgccgttttataggctaccgccccagccaggccccgccctctgatgtggccccgccccccgacgctgactttttctgtcttcactttagcsctggctccgcccctagccttggcccgcctcagcgcggactctcagtctctgcgcctgccacggcctcgtcccgctcagccctggccctgcccctggagccgactctctccgcctccgccccggtcccgccctggcactgactgtctccgtcttcgcccctgccctggccccgccccctgcctgctctggccccgccccgccgctctctccgtctccgcccctgccctggccccacccttgccccgccccggcgctgactctctccgtctccggctccgcccccggctcctccccggcccc

SEQ ID NO: 189946 - DNA, 601 bp, Human
tgccctaaccctgatcctgtcctactggacaccctgcccctgcgggtcacatcccaaagacccacacacacacctcccctccgagaagggctctgaaccttctcctgccagtgcccaggcctctcagactctcccgcatcacagaaaactctggcacccaaaactcacgacacagaaacatgtgtaggttttctgggagctctccttcctgagctctgggccctccttggtccctgccaggattctgccacataaaagggctctgttgttttttttgtgtgcggtttttttttttgttttkttttttttttgagacggagtcgtctcgctctgtcgcccaggctggagtgcagtggcacgatctcggctcactgcaagctccgcttcccgggttcacgccgttttcctggcgcagcctcccgagtagctgggactacaggcgcccgcaacaacgcccggctaattttttgtatttttagtagagaccggtttcaccatgttggccaggatggtctcgatctcctgacttcgtgatccgcccgcctcggcctctcaaagtgctgggattacaggcgtgagccaccgcgcccggccataaaag

SEQ ID NO: 189947 - DNA, 601 bp, Human
tataagagagaattggactaaccaatcctcctcattcaaactcacctgggtttagggcactaatcagacgacaccaagataaactacagttgggctatacccgtgtgtacccctggccatcagtggtgtccagggtccaggcaggcaacacctaccgaggtctttggccttcttggcagcatcattaatgtagtcctggctccggccatcagtgaagacaatgcccaccttctgggccccgggcctagccccactggacacagtgaaggaattgtcaatgaggtacttgagagcagccccrgtcattgtgcccttctccatgtaggacatattccgcacagccgccttgatgtccttcttggtgtggaagcgacccagggggaactcctggcgcacagagcttgagtactgcaccagccccacctgggccagcttgtctgacacgtccagcgtatccacgatctgactgatgaacttcttcaccagctcaaagttctctggcctcacactcttggatccgtcaatgaggaagaccaggtcagtggccgagctgccaccaccaccactgcagactgtggaggacaggaaggcaacgggctga

SEQ ID NO: 189948 - DNA, 601 bp, Human
tcttctgcaacttcttgcctatctggttgatggtcttgaagtcagccgtgtagaagtagtgctctgccacaggttctgaggctatttccctcagctcatcctccacggcattgcccacacccacagcaaacatcttaaagcctgccaggaggaacaggagaagtaaggctggacatggggatgggcaaccatatggctgagcctcctggggaaggcttaggcagccaacaccagacacctcctgctggcagctgctggaattgcaagcacaatgcctggaacaaggacaatgagaaaatcmatatttactgaggttctgctctgtgtcagaccctatagtgacttcctgtactggaagctttgtacagcaagcttcatttaaccctaataatcatccatctggtggttattttttcctcatttaataggttacaaaacagactcgggcttgttccaaagtagagttgccttccaatagttgatgtgttcttgggaatatccagctggaaaagttccaagcctcacttacaaaaggaccatcaaaacaagccacttacttttctggggcctcaattttgtcattggtataagagagaattgg

SEQ ID NO: 189949 - DNA, 601 bp, Human
cggagagcactgagaacagtgccagccacgtaacgagcattcaacatgtttgctggtagtaagagctgtaagcgccagcccaccttctggttctgccaactcttggtgccacctcggcccctgcttttccccacccacacccagttccaggatggctccacctccacagtgccccacctgcaaatcccatcaatgccagccctggcctcactcacccacacagatcttcttctgcaacttcttgcctatctggttgatggtcttgaagtcagccgtgtagaagtagtgctctgccacaggytctgaggctatttccctcagctcatcctccacggcattgcccacacccacagcaaacatcttaaagcctgccaggaggaacaggagaagtaaggctggacatggggatgggcaaccatatggctgagcctcctggggaaggcttaggcagccaacaccagacacctcctgctggcagctgctggaattgcaagcacaatgcctggaacaaggacaatgagaaaatccatatttactgaggttctgctctgtgtcagaccctatagtgacttcctgtactggaagctttgtacagcaagct

SEQ ID NO: 189950 - DNA, 601 bp, Human
cccatcttacaggtgaagaatccaagaagtgaaaaaacttgcccatggccaacagcgtcagagcaaagacacaggcccaggcacgtctggctctgaaacccacactccttaccactaagaaccagctggtgaggtcaccagagaggaccagagaggcagtagggttcaaatcttggctctcccagctattaacagttgttccacccctttggccttgtttatcccatctataaaatggggttaatgacattcttaccaaataggatcggatgatgtaatatccggagagcactgagaacastgccagccacgtaacgagcattcaacatgtttgctggtagtaagagctgtaagcgccagcccaccttctggttctgccaactcttggtgccacctcggcccctgcttttccccacccacacccagttccaggatggctccacctccacagtgccccacctgcaaatcccatcaatgccagccctggcctcactcacccacacagatcttcttctgcaacttcttgcctatctggttgatggtcttgaagtcagccgtgtagaagtagtgctctgccacaggttctgaggctatttccctc

SEQ ID NO: 189951 - DNA, 601 bp, Human
cttttccctggtccccaaataaccacactgcctctagccccattcactgcttacgttaaatcacatttaattgtttctcaccggagaatagagaaatcagtaaagaaattcacagcactcagagtcaagaaagggttaactaaaaaagatgggaatatattaagcttttgattataaaaatgcaaacgcagtccctctcacactcacccctgcattatcactctcacactcacattctggcaagactcatgcccaccctcaggcgcacgtgcacacacacacacacacacacacatgcacrcatacacacacgcacacatacacacacgagctcccaaacgccattacacgctctcaataggcacacccagacacaccccctcccacccccgggctggcttccctcactaaaatggtaaagctacggcggacacgtgcaggacgcttggagaggccacagtggtgacaggcagccttagacaactgtgttctccaggatggccagccgcttactcacagcttccagtggactcagagttaaggagaggtgcaggttggccagagcagggcagggatggctgtggccctgcactcaggcccc

SEQ ID NO: 189952 - DNA, 601 bp, Human
gtgatgccgcctgtgcacaggaaacaaacagaactccaacagggcatgttgggggcgggaggggagaggcacctagggcagcccaggcccaggctggagcccttcccatcatctcacacacacactcaccccgtgggctcccaggtatcaagaggaggcacaaacccctggtacgacctaaacccactctcttttcctctggctggtccctctggctggtgggggtgacatgagcaccctgctcaactgtatgtctcttagggcaggaactacgtctgtctcatacagcaccatcccccccaccgccattgccctgtaagtacatgatacctgaacgaatgagtgaacgaatgaatgaatgaacaaatgagtcctatctggtgtcattgccctttttctctgaagcctttttcttttgatgttcttcagtcctagattcaagtcctgtctctcagcgacccactgctgagcaagtcatttcatcatttagactctcagctttcccatttgtaatggggataatttgagtcttttctgggtaaggttactggaagtgaaatgaggtcaactaaatgaatatgtaactgaaaaggcaggacaa

SEQ ID NO: 189953 - DNA, 601 bp, Human
gggacacactgctgagccttctcagtccatatcaacatggctgcctctccccctccccacctgtgtggggaggagaggggagtggataatctcagaagaaaggaagaatgagcagagtcataacttctcaggtggctgtgtcaaggagcctccttggacagcagaaaaactcctgccccagggacggacagagagaaagggtttggtgaactgtgtaggaggtggagtcaggtcatgggggcgagggtggctgtgccccagttaagtcgcgcttgtgtatttgtgctgttgtactgatgtrgctcttgggtaccgttcgtgttgttattctgcctctttgaactgcctccgaggaagatctttcggtgtggtctgagcttcttgtaaaagccttttagacatgctctcaagtgtgaatctagtagtaacactaaaaatgctccattaaacaagaataggttcagaaaatcaccaaagctccccctctgagaggacagagatggagattccggagcagcactggtccaataggggcctgggggaggtgaccgagatctcagggtgtgacctgcagaccccacatagggctggaggaagggaa

SEQ ID NO: 189954 - DNA, 601 bp, Human
atgaccctctcctcctccttggggacacactgctgagccttctcagtccatatcaacatggctgcctctccccctccccacctgtgtggggaggagaggggagtggataatctcagaagaaaggaagaatgagcagagtcataacttctcaggtggctgtgtcaaggagcctccttggacagcagaaaaactcctgccccagggacggacagagagaaagggtttggtgaactgtgtaggaggtggagtcaggtcatgggggcgagggtggctgtgccccagttaagtcgcgcttgtgtakttgtgctgttgtactgatgtagctcttgggtaccgttcgtgttgttattctgcctctttgaactgcctccgaggaagatctttcggtgtggtctgagcttcttgtaaaagccttttagacatgctctcaagtgtgaatctagtagtaacactaaaaatgctccattaaacaagaataggttcagaaaatcaccaaagctccccctctgagaggacagagatggagattccggagcagcactggtccaataggggcctgggggaggtgaccgagatctcagggtgtgacctgcagacccca

SEQ ID NO: 189955 - DNA, 601 bp, Human
ttgtgccttggattttggcaaattgttttcctcaccgccacctcccgcggcttcttaagggcgccagggccgatttcgattcctctgccgctgcggggccgactcccgggctttgcgctccgggctcccgggggagcgggggctcggcgggcaccaagccgctggttcactaagtgcgtctccgagatagcaggggactgtccaaagggggtgaaagggtgctccctttattcccccaccaagaccacccagccgctttaggggatagctctgcaaggggagaggttcgggactgtggcgsgcactgcgcgctgcgccaggtttccgcaccaagacccctttaactcaagactgcctcccgctttgtgtgccccgctccagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggc

SEQ ID NO: 189956 - DNA, 601 bp, Human
ctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctatcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctggtaagcgaagcccgcccaggcctgtcaaaagtgggcggctggatacctttcccattttcattggcagcttatttaacgggccactcttattaggaaggagagatagcagatctggagagatttgggagctcatcacct

SEQ ID NO: 189957 - DNA, 601 bp, Human
acttcttcttacctcccgttaacattttaattgccctggggcggggtggcagggagtgtatgaatgaggataagagaggattgatctctgagagtgaatgaattgcttccctcttaacttccgagaagtggtgggatttaatgaactatctacaaaaatgaggggctgtgtttagaggctaggcagggcctgcctgagtgcgggagccagtgaactgcctcaagagtgggtgggctgaggagctgggatcttctcagcctattttgaacactgaaaagcaaatccttgccaaagttggacttttttttttcttttattccttcccccgccctcttggacttttggcaaaactgcaatttttttttttttatttttcatttccagtaaaatagggagttgctaaagtcataccaagcaatttgcagctatcatttgcaacacctgaagtgttcttggtaaagtccctcaaaaataggaggtgcttgggaatgtgctttgctttgggtgtgtccaaagcctcattaagtcttaggtaagaattggcatcaatgtcctatcctgggaagttgcacttttcttgtccatgccataacccagctgt

SEQ ID NO: 189958 - DNA, 601 bp, Human
tgtatgaatgaggataagagaggattgatctctgagagtgaatgaattgcttccctcttaacttccgagaagtggtgggatttaatgaactatctacaaaaatgaggggctgtgtttagaggctaggcagggcctgcctgagtgcgggagccagtgaactgcctcaagagtgggtgggctgaggagctgggatcttctcagcctattttgaacactgaaaagcaaatccttgccaaagttggacttttttttttcttttattccttcccccgccctcttggacttttggcaaaactgcaatttttttttttttatttttcatttccagtaaaatagggagttgctaaagtcataccaagcaatttgcagctatcatttgcaacacctgaagtgttcttggtaaagtccctcaaaaataggaggtgcttgggaatgtgctttgctttgggtgtgtccaaagcctcattaagtcttaggtaagaattggcatcaatgtcctatcctgggaagttgcacttttcttgtccatgccataacccagctgtctttccctttatgagactcttaccttcatggtgagaggagtaagggtggctggcta

SEQ ID NO: 189959 - DNA, 601 bp, Human; identical to SEQ ID NO: 38894

SEQ ID NO: 189960 - DNA, 601 bp, Human
ccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactraataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtg

SEQ ID NO: 189961 - DNA, 601 bp, Human
tgggatggcagctgcactgggctactgcttttcagctctgcagtaaactagagtggtgggggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataartgtcaccatttaagattcagttatccttcttaatctctggatagtccattctgatgcactgcatactttccttaaatgggttgggggagagggcatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggag

SEQ ID NO: 189962 - DNA, 601 bp, Human
agtctttgatttccattcgacacatttaataaatgtcaccatttaagattcagttatccttcttaatctctggatagtccattctgatgcactgcatactttccttaaatgggttgggggagagggcatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggakttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggag

SEQ ID NO: 189963 - DNA, 601 bp, Human
aagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgygctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatg

SEQ ID NO: 189964 - DNA, 601 bp, Human
aatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatyctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattcttt

SEQ ID NO: 189965 - DNA, 601 bp, Human
tcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaa

SEQ ID NO: 189966 - DNA, 601 bp, Human
tccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttrgggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattat

SEQ ID NO: 189967 - DNA, 601 bp, Human
acccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagatygaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttac

SEQ ID NO: 189968 - DNA, 601 bp, Human
caggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactkggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgctta

SEQ ID NO: 189969 - DNA, 601 bp, Human; identical to SEQ ID NO: 26557

SEQ ID NO: 189970 - DNA, 601 bp, Human; identical to SEQ ID NO: 26556

SEQ ID NO: 189971 - DNA, 601 bp, Human; identical to SEQ ID NO: 26555

SEQ ID NO: 189972 - DNA, 601 bp, Human; identical to SEQ ID NO: 26554

SEQ ID NO: 189973 - DNA, 601 bp, Human; identical to SEQ ID NO: 26553

SEQ ID NO: 189974 - DNA, 601 bp, Human; identical to SEQ ID NO: 26552

SEQ ID NO: 189975 - DNA, 601 bp, Human; identical to SEQ ID NO: 26551

SEQ ID NO: 189976 - DNA, 601 bp, Human
gttattgtgactgatcactacttctaatgtttaacttttgcttgaaaccatccagtgagtgtcctgagggcctgggtcctgacttgaggatgtactcacgtgggggatgaggcggcaggagcggaccgagtcgctgaggcccatccactgctggtggtcggcatagtcgccgcggcgcaggaagtactggaggcccgagtagttgggctgctcatagagcatccagcagccgctgtccacgcgcgccgagttgcagcggctcaagtagggctgcaggttggggtggtcgctgctgcattcrtagtggcggccctggaagccccggtcctcgtagagggtgatctgcaaggcaaggcgggacaaggcgaggtctcacaggcctgctcctgccccagtctctggcccccgcgatggaggaagctccggggtcccggggcgcaggctgggctcaccttccccatggctggctgggcgcacggcggtgctgagctggtggggcggcggcgctgagcgggtggggctgcggcgcggcgggctatatagcaggagggctgctgcgttggcaagaaccgcacaaaaggggcccccggaggggagcaag

SEQ ID NO: 189977 - DNA, 601 bp, Human
tttatttaaagttaatcatattttattttaataattatattcaaattatattttataagtataaattaaaattatatttattttacaaattatattttattttaaaataactttactaaaatataaataaaatatatttaaaatacagaaatataaggggtggggcagtggctcatgcctgtagtcccagcaccctgggaagccgaggcaggtggatcacttgaggtcaggagttcaagaccagcctgacgaatatggcgaaaccttgtctatactaaaaatacaaaaattagccaggtgwggtggcgggtgcctgtaatcccagctacttgggaagaaaattgctagggcccaggaagcagaggttgcagtgtgccgagatcatgccactgcactccagcgtggggaacagagcaagacttcgtcaaaaaaaataataataataaataataaaataaagtaaaataaaaataaaaatacaaaaattagctgggtgtggtggcgtgctcctgtaactccagctactcaggagactgagagacgagaatcatttgaatccaggaggcggaggttgcagtgagccgagattgcaccactgcac

SEQ ID NO: 189978 - DNA, 601 bp, Human
tccagcacgttgagggagtggatttcattgaagcggaagcggtcctgaagacaggagcagtcctcagtgaactctatcatctggcctctgtagtcctccctctcatagagtctgatcctgtgagagccagactggcggacccagaaataaaaagagaagaaaagcaagtgtgaaatgattccaatgcattgttaggcagtccagcttggtgaggacccgctcaagccattttgaaatacatggtaaaatttaattaattctgaatatttataaactcctcattaccgagcacagagattcrgtaccttttcaagattatgaagtgtggtgaagaaattgagaaggaaatctcactctttaatatattcagctatttcttaggatgagctgcctcctaggctcagtatcctgtaccacatgcaaatccaaacctgtaacagcttattactattttataccattttgaagaaatgttttaatattaaaataaacattaaattataaagaaatatatttaaataatgtataattttaatatacatatgatatctaatacatatttaattatatactatatttaaaatatattataaaatgtata

SEQ ID NO: 189979 - DNA, 601 bp, Human
aactacctcctacctgacttcacatctactcccaaatgcctagtgaaggcttaataatttcaaaaagggactctagaatttcatttgataccagtcagacaaatgtgtgaaaattaagcataataggcagaatcccaggggtactgacagctgtattaagaggtgattcaagggctaaaccttagagtccagcattggttatgggtgtgacaagaaaatgaagcctatgttggctgggattagcaaccacagttctagaggaagcaaggtggagaaactatatagggggctccctttgtaygttttatttattttaaacatctctataaactctagaaattaaaacaacaataccaacacaaaagcatcactttttcgaccaaagaccattgctatacttttttgtgtaaagggctagatagtaaatattttcagctttgtgggccacataagtctctgcaatagacaatatgcaaacaaataagcatggctgtgtttcaattaaactttattatgaacattaaaatttgaatttcatataacttttacatgttgcaaaatattctttatttaaattctattgcaatatgctttaaaagat

SEQ ID NO: 189980 - DNA, 601 bp, Human
tagtcttctgagggaaagaaattagcaaacaaattgtaatctcagttatgtgccatgttccatgctgggcacaggggatacagtagtttaaaaaaaacacaagatctataaggtgtttcttcttgtggaccttacagtctagggtgcttggaaacatggggcgttggcagacaagtaaatacacattttgtggtaaaggctcaggtagaagaagtacaggatagaatagagcacaccatggggaattaatctagacttcagagaggctcacacatacataatttatgtgtgactatttcartgcatttgaggtttcttggaaatagaggttaggttttattttaaggaagttaccattttttttttcagtgtgatgtggttgaaccaaagaatgccatgcccagtgatggtaataggataatctttttaaaaattaagagccacctaataaatcaatagtttcattcagcgggagctcctgcagagttcaaaaagaagagaatctggcacagcgtttcctttaaagttcattttcctagagtgtgaatggaagcaagagattataacattttgaggtcaaaaaaattctgaaatgcctata

SEQ ID NO: 189981 - DNA, 601 bp, Human
tgaacaaagagcctcaataagggattttgaggtctagaaaaagagaggaaataccaaataaatggaataattataaaataaataccagcaaagttaaatcaatatatcatgtgggagatatccttatatcactcatgtgatttctattttgttcctatattaggccaaggagaggtggaacttgttttcctttttccctctcagctacgaatggacatacttaaaactgtttctctgcttctgttctctaaaatgtgattgtctaacagtaaccgtgatgacgttttgacagttgcacaastttctttctttaagctttaaaaatgccagccagtaacccagtggcatttctactataaaatcttaaggccaatccatttccccttttccttattttcttggtttcaaatatatttttattgccaatggaaataaaaatcctaaattagagagcaatggcatcccttgtcttgtgaataaagagctcctaaatgtgaacttatacaggatgcagcaatttatagggtagttaatcattcttctttctagccagttgttccagctacagttttgtggctcttgttagtggcttcattcccag

SEQ ID NO: 189982 - DNA, 601 bp, Human
gttagaagtggcctttcaatgccaatggtacacattccttggtttctttacgatactattgctcttacaacttttatctgaagtcataaattcatagttgtcccagaagttaagttccttgcttctagaggacagaaaacaaacaatttacacaactcatggtgcatgtcaccagtccttagatctcatgaaatatgcatgaaatcttaaatcacttgctgtagccacccagccattgacatatttgaaagactttagtgtatcaaagtcactataatgaaaattttgatttcaccagttytaggagtgaaaaatcaaatgtttagtaaaactttctaaaattaacactgacagttgatttctgtatactgttgttcttaataatagctttattgagatataattcatattcaaaacaacttacccatttaaagcatacaatccaatgattttttagtatcttcaaagagttgcctatcaccataaccaattttagaacactttcatcactgtaaaaagaaactccattcctattagcagtcattccttattccaaatccccctgctcgccctagacaactacaaatgtactttccatctc

SEQ ID NO: 189983 - DNA, 601 bp, Human
tgttgtatctaagtgtatgctactttaaaaaattagttgtaatatggcaaattggatacatgtgtaggctttggtgtcacaatcctaattttaaaattctgactctgcccttgacaaattaactaattaagcttccttagcctcagtttctcaactgtaagttggagatattaccaagacctacctcttgaattgttgtggggatcagatgaaataatgtatgtgaaatatttagaattatgcaagtctgtggtaatgaatactaatgttagctatcattattgttataatcccaataatmaattctggtgctttgaaaattaaaccaaagccaagcagttgatatgaagaagcatgtaataatgtacagacataatgctttatagacaacattgaatttggctctcatgaacatcaggaatagtggtcatggtagttattatctccagcaggaactgtagctgagagatcttcagagctttttccaaggcgatatcactgggaaataatagagacaaggttacaagctagggctgtgttttcttcttaaaatctttagttcagtttttttcaataacagatttgtagtaggcatcaggtg

SEQ ID NO: 189984 - DNA, 601 bp, Human
aattggataaaataaatgtgacattcaaaatgttatttatgattttagaaaaatatccttatagacactagatgagttttagtctcaaatcaatcctccctatcatagtcacttatcaaaataactaaagcaaagtggtagagctgtgctctagaagtttgggatttatgatcacaatcttttccaatgagtcccctctttcctctgcctgtcttcaacatttgtttttttttttttttggttaggactatccagattgtgtggcctatttcaaactcatggcaaatacattggatgatcrgaaattttctaatgtatttgaatttgtctacacaaactagagtaattgctattaattcctcaagtgttaattatttcatgcaaaaaggaaaaaggctattagtctttaagtgtattagtatgtcaatatttgggagaagtgtcatgcaattagtggtttgaatttcctattttattttattgcattttattttatttgcctagtcaaataaaaagtaatgttaaatacatggaagcatgattgttttctacactaaaaatcattttgacttgaaaagatctgatatccatgaccttcatc

SEQ ID NO: 189985 - DNA, 601 bp, Human
cttgaaaagatctgatatccatgaccttcatctgaagttttggcagatgaaaatgtcagatgcgtcttttggattaataaaaggcaaaagtcagatcgaaaaatgagtataagctttaattatatgactttaggaggatatgttatgaaaatcaaagctttaatagtgattataattggcaagttctttttttataaggaattacaagtcactctatacaaaaattggaatttttgtcctaagaaatgaaatttactatagtttcatctgtgtgtgtgtgtgtgtgtgtgtgtgtgtgtggttaaaaaatcaagtgatagggcttttcctcaataaaatctgaaatctcttatagttaagtgaacagaacagtgtatctaggatgctagacttttttttcaaagttagtttaaaacttatacatagtaaaatctgtatgccttagggatctctgtttgctatcccatagtgaatgattaattagtttctgttagaaatagtcagaactaggctgggtgtggtggtggctcatgcctgtaattccaggactttgggaggccaaggcaggaggatctcttaagcccaggaatttgcaaccagc

SEQ ID NO: 189986 - DNA, 601 bp, Human
ttgaaaagatctgatatccatgaccttcatctgaagttttggcagatgaaaatgtcagatgcgtcttttggattaataaaaggcaaaagtcagatcgaaaaatgagtataagctttaattatatgactttaggaggatatgttatgaaaatcaaagctttaatagtgattataattggcaagttctttttttataaggaattacaagtcactctatacaaaaattggaatttttgtcctaagaaatgaaatttactatagtttcatctgtgtgtgtgtgtgtgtgtgtgtgtgtgtgtgtgtaaaaaatcaagtgatagggcttttcctcaataaaatctgaaatctcttatagttaagtgaacagaacagtgtatctaggatgctagacttttttttcaaagttagtttaaaacttatacatagtaaaatctgtatgccttagggatctctgtttgctatcccatagtgaatgattaattagtttctgttagaaatagtcagaactaggctgggtgtggtggtggctcatgcctgtaattccaggactttgggaggccaaggcaggaggatctcttaagcccaggaatttgcaaccagct

SEQ ID NO: 189987 - DNA, 601 bp, Human
agcccaggaatttgcaaccagcttgggcaggctggtgagatcctatctctacaaaaacaaacaaacaaacaaaggacaataagaaagaaagaaatagccagagctttgaacaaaatttctaagtagaccaatgtaaaagtctgtcgtcaatatgtagtggctatgaatggaggttatgaatgaaagagaaggataagatgaactagaggtgagaggggaagacagcaggcccaagtgaaaggcagagccgagtttattgctttttggttattccaggtgtgtctgctttgtctcatgaaayacctggatgatcactgatttctagtggaagaaatgctgaaaagtccttactgtgcatttaaacattctaggtttaatatactcagggtttttcaaaagaaagggtggctggagttttgcactaactaatatttcataaagtgtctaagtatagatgtctggtttttttttgtatttctaagactggcttgaggtaggcatggagaattctttgatgggacataattttcttcctttctttttttttttttttttttttttttgagacggagttttgctcttgttgcccaggctggagtgc

SEQ ID NO: 189988 - DNA, 601 bp, Human
gggcaacaagagtgaaactctgtctcaaaaaaaaaaaaaaaaaaaaaaaagaaacaaaaaaaaaaaaaaaacaaaaagcaaacaaacaaaaaaacaaaaattatcacttcctaattattttgcattttactattatctatgctattaacgttatttgccttcattgtatttgaaaggtggactatattctattgcactttcattgtactatattctaatatgcaactgtgtatcccttcccaactctgtgttcaatgactttatatttggttgctttaaaatgatgacgatgagagtattkatatcatagaaattggcaaatgccgtaagtcagtttttgtttttgtttttgttttccggagaggggattgttaaatatttgcctgcatgcaacaccactacatgcagtctgctatcttttgttcttcctgctttcaggctcctctcccagctgtctgtctagcacaacccagcataccaaattttcttaaatagggaaagttgaacatggtaaaagaatgaatgaagtcaaaagaatgtggaaagacctaggctttgccatttagtaaagtttagcatctctaagcctccatctctttat

SEQ ID NO: 189989 - DNA, 601 bp, Human; identical to SEQ ID NO: 19339

SEQ ID NO: 189990 - DNA, 601 bp, Human; identical to SEQ ID NO: 19340

SEQ ID NO: 189991 - DNA, 601 bp, Human
ctttgtggtgtttaagtgccttgtatgttccccagttgctgtccaatgtgactctgatttattattttctacatcatgaaagcattatttgaatccttggttgtaacctataaaaggagacagattcaagacttgtttaatcttcttgttaaagctgtgcacaatatttgctttggggcgtttacttatcatatggattgacttgtgtttatattggtctttatgcctcagggagttaaacagtgtctcccagagaaatgccatttgtgttacattgcttgaaaaatttcagttcatacamccccatgaaaaatacatttaaaacttatcttaacaaagatgagtacacttaggcccagaatgttctctaatgctcttgataatttcctagaagaaatttttctgacttttgaaataatagatccataatatatattcttatggaaatctgaaaccatttgggcatttgggggtaaaaagtattttattagtaaatttaaatgaggtagctggataattaaattacttttaagttacctttgagatgatttttctcaatcagagcaccacccagagctttgagaaacaattttattcacag

SEQ ID NO: 189992 - DNA, 601 bp, Human
caatgtgactctgatttattattttctacatcatgaaagcattatttgaatccttggttgtaacctataaaaggagacagattcaagacttgtttaatcttcttgttaaagctgtgcacaatatttgctttggggcgtttacttatcatatggattgacttgtgtttatattggtctttatgcctcagggagttaaacagtgtctcccagagaaatgccatttgtgttacattgcttgaaaaatttcagttcatacacccccatgaaaaatacatttaaaacttatcttaacaaagatgastacacttaggcccagaatgttctctaatgctcttgataatttcctagaagaaatttttctgacttttgaaataatagatccataatatatattcttatggaaatctgaaaccatttgggcatttgggggtaaaaagtattttattagtaaatttaaatgaggtagctggataattaaattacttttaagttacctttgagatgatttttctcaatcagagcaccacccagagctttgagaaacaattttattcacagcttctgattctatttgatgtaatttttagaaaataagttttgc

SEQ ID NO: 189993 - DNA, 601 bp, Human
ctttaacatttaagactcctagcaagtccgggcacgggggctcacacctgtaatcccagcactttgggaggccgaggtgggcaaatcacaaggtcaggagtttgagaccagcctggccaatatggtgaaaccctgtctctactaaaagtacaaaaatcagccaggtgtggtggcgtggtggcgggcacctgtggtcccagctacttgggaggctgaggcaggagaatagcttgaacctgggaggcagaggttgcagtgagctgagatcgcaccactgcactccagcctgggtgacagagcragactccatctcaaaaaaaaaaaaaaaaaaaaagactcctagcatggaagagaaactggctgttgaaaacctgaatgtgagagtcagtcaaggatagtttgagggaagccaagtagaggaagctctcacaagcagattggtgagagaatatgattatacaatgcatttattatgataagaaattcacaagcattcattcaaaatactcttgattcctaggcagctctgggcatatttccaccaacaaattgaggcatatgtcagtgcagcctaggtcagactaccttttttcattaaacc

SEQ ID NO: 189994 - DNA, 601 bp, Human
acgggggctcacacctgtaatcccagcactttgggaggccgaggtgggcaaatcacaaggtcaggagtttgagaccagcctggccaatatggtgaaaccctgtctctactaaaagtacaaaaatcagccaggtgtggtggcgtggtggcgggcacctgtggtcccagctacttgggaggctgaggcaggagaatagcttgaacctgggaggcagaggttgcagtgagctgagatcgcaccactgcactccagcctgggtgacagagcgagactccatctcaaaaaaaaaaaaaaaaaaaaagactcctagcatggaagagaaactggctgttgaaaacctgaatgtgagagtcagtcaaggatagtttgagggaagccaagtagaggaagctctcacaagcagattggtgagagaatatgattatacaatgcatttattatgataagaaattcacaagcattcattcaaaatactcttgattcctaggcagctctgggcatatttccaccaacaaattgaggcatatgtcagtgcagcctaggtcagactaccttttttcattaaacctcacaaaattaaaggacatacaggagaagtcct

SEQ ID NO: 189995 - DNA, 601 bp, Human
cttctctaaccctagagtgacactgcactccccacaatctcctatgtcctgaatattttaccccatcctaaactccatctctaacacagatgcactttcttgtgctgcctactgcattgtacatcttccccttagttcccatgatgcaactctgccctaccccagaaaatgtaatttaattggtctgggataaaacctgggacactatcattcttgaaatattccccaagcgattctaattatatagccaaagttgagaactatttgtagacaggcatcagcatgatcacttaatgatttracttttgctagatctaaggtgaggaaattggagagtggtatccataggaagaactgtttagtttaattttttttttattttttcttctaaaaaaaaatccaacaacgagatacatgtgcggaacatgcaggtttgttacataggtataatgtgccatggtagtttgttgcacctattgacccatcctctaagttccctcccctactccttacttcccaacaggccctggtgtatgttgttcccctctctgggtccacctgttctcaatgttcaactcccttttacgagtgagaacacatg

SEQ ID NO: 189996 - DNA, 601 bp, Human
atctctaacacagatgcactttcttgtgctgcctactgcattgtacatcttccccttagttcccatgatgcaactctgccctaccccagaaaatgtaatttaattggtctgggataaaacctgggacactatcattcttgaaatattccccaagcgattctaattatatagccaaagttgagaactatttgtagacaggcatcagcatgatcacttaatgatttgacttttgctagatctaaggtgaggaaattggagagtggtatccataggaagaactgtttagtttaattttttttttattttttcttctaaaaaaaaatccaacaacgagatacatgtgcggaacatgcaggtttgttacataggtataatgtgccatggtagtttgttgcacctattgacccatcctctaagttccctcccctactccttacttcccaacaggccctggtgtatgttgttcccctctctgggtccacctgttctcaatgttcaactcccttttacgagtgagaacacatggtgtttgattttctgttcctgtgttaatttgctgaggatgatagtttccagcttcatccacgtccctgcaaaggac

SEQ ID NO: 189997 - DNA, 601 bp, Human
aaaaatgccaagtgaaaaagagcatattattattttcatttgcattacttttggttcctggtgagtttaatctgtttttgtatattaattatgcatttatatttctttttgtgtgtgtgaattgcctttcatgttctttgtgtgtttttattttgttgtatttgtctctttcttgatatatgagagaatattttccctagcctgtcaattgccttgtaattttgtttctagtgagtttttttttttttttttacaattaaaagctttaatttttgaaaattttgctggcaaatctatatawctttttctttgttttctgctttgacattattcttttataaaggcccatgccacccaaatattatgtaagcatgcatctatgtttttattacttcatcttttacatttaaatatctactctatttagaattcattgtgatgcatgtatgaggtagaaatctaatttcaaaaagatgagtatccagtttgtccatcatttattgcatgatctctttctccactgaattaaaatgccgtattttataatatattaaagtattacatgtgcttggacatgttcctggacttttgagataaatca

SEQ ID NO: 189998 - DNA, 601 bp, Human
ctatttctttgtcatgtcacatattattatggctttatgatttaatatccagtaatgtaaaccctctgacacattattcttattcctcaaatgtttttgatgagttttcttccaaatgaaatttataatcattttattcattgattcaacaaatatttgttgaatggatattctgtgcttggtattgtgcatggtattaggattgttgcaaaaattgagactgacagtccctactcttacggtgctaaaaattcacttccaaaaaaatctttaaatgttgatgaagattgcactaatcttrtaaaataacttggaggggaatgtaatctttgcaacattaagttcttcattttagaaagttttaagactctccatttatttgagacttttaaaatatgtcccaataatgttttgtgagatgtatattttaagatatatatcttattgctattacattgtatcttttgttatattgttactatgaatgggatactcatttaattagatgtcatttttggtatatagaaatctattttcttagcatagtcattttttaaacctcgatctattaaattcttgattcatttacatttgttacaca

SEQ ID NO: 189999 - DNA, 601 bp, Human
taagactctccatttatttgagacttttaaaatatgtcccaataatgttttgtgagatgtatattttaagatatatatcttattgctattacattgtatcttttgttatattgttactatgaatgggatactcatttaattagatgtcatttttggtatatagaaatctattttcttagcatagtcattttttaaacctcgatctattaaattcttgattcatttacatttgttacacaatcatattctatgctgataatacttcttgcttctttccaatatttgtacctcgatcatttttcttgttgagttgtattagctagaagttctagaaaaatgttaaatggtagtaatagctagtattctgttttttcctgactctaaatgtaatgcatctagacttttataattatggcattgattgtaacattttgaggaagaaatcctttttcaggttaataatgtatctttatattcaagtttattaagaacatttattggaaacatattgaaattttatcagattccttttcagttgttactgagataatcataggttcttctgtattcttttaattaatttctcaaaattaaactgtcc

SEQ ID NO: 190000 - DNA, 601 bp, Human
tgttgagttgtattagctagaagttctagaaaaatgttaaatggtagtaatagctagtattctgttttttcctgactctaaatgtaatgcatctagacttttataattatggcattgattgtaacattttgaggaagaaatcctttttcaggttaataatgtatctttatattcaagtttattaagaacatttattggaaacatattgaaattttatcagattccttttcagttgttactgagataatcataggttcttctgtattcttttaattaatttctcaaaattaaactgtcctaktattcttggaataacgacatataaagtactgtatatttaaaagaagttaaaatgataatggtgattttattaagtgacctcacacaatagaaaacagtgtagccttagaagttttccaagtgaccattctacttagaaacaaccctgctttgggatcagaactgtaatttttaaagtaaagttttctgggtttaattcatttagtgtaattacaagcatgagttcaggtttctatttttttcacctgaactttccttcatggtttgaatatctagaaaaagcagactttcctatctctag

SEQ ID NO: 190001 - DNA, 601 bp, Human; identical to SEQ ID NO: 19341

SEQ ID NO: 190002 - DNA, 601 bp, Human; identical to SEQ ID NO: 19342

SEQ ID NO: 190003 - DNA, 601 bp, Human; identical to SEQ ID NO: 19343

SEQ ID NO: 190004 - DNA, 601 bp, Human; identical to SEQ ID NO: 19344

SEQ ID NO: 190005 - DNA, 601 bp, Human; identical to SEQ ID NO: 19345

SEQ ID NO: 190006 - DNA, 601 bp, Human; identical to SEQ ID NO: 19346

SEQ ID NO: 190007 - DNA, 601 bp, Human; identical to SEQ ID NO: 19347

SEQ ID NO: 190008 - DNA, 601 bp, Human; identical to SEQ ID NO: 19348

SEQ ID NO: 190009 - DNA, 601 bp, Human; identical to SEQ ID NO: 19349

SEQ ID NO: 190010 - DNA, 601 bp, Human; identical to SEQ ID NO: 19350

SEQ ID NO: 190011 - DNA, 601 bp, Human; identical to SEQ ID NO: 19351

SEQ ID NO: 190012 - DNA, 601 bp, Human; identical to SEQ ID NO: 19352

SEQ ID NO: 190013 - DNA, 601 bp, Human; identical to SEQ ID NO: 19353

SEQ ID NO: 190014 - DNA, 601 bp, Human
aggtgggaggatcacctgagcctgagaagtggaggctgcagtgagccatgattgcaccactgtaccctagcctaggtgataggctcaaaaaaaaaaaaaattggtgtttgcaatgctaataatacaatttggttgtttctctctccagttgttttcctacatacgaaacagcttttaaaacaaaatagctggaattgtgcattttttcttacaaaaacattttctttcttaaaatgttattatttttcttttatatcttgtatattattactagcagtgttcactattaaaaaattatacyataggaggggctgatactaaataagttagcaatggtctaaacaaggatgtttatttatgaaaaggtagtaattgtgtttcatagaatttttaaaattaattctgcgtatgtcttcaagatcaattctatgatagatgtgcaaaaatagctttggaattacaaattccaagacttactggcaattaaatttcaggcagttttattaaaattgatgagcagataattactggctgacagtgcagttatagcttatgaaaagcagctatgaaggcagagttagaggaaggcagtggtcccttg

SEQ ID NO: 190015 - DNA, 601 bp, Human
ttatagttttttttggacaaaagatctagctaaaatataagattgaataattgaaaatattaacattttaagttaaatcttacccactcaatacaatttggtaatttgtatcagaagcttaaaagataacctaatagttcttctacttctataacttacccaaatatgtttgcagagatcttatgtaaagctcttcattataacactgctttcaggagccaaaaattgggtgggggagccccataaatgttgaataataggggtttgattagataaattttggtgtagttctataatggcrtgttattcagccaataaaaggtttgttaaagaatgactgtgacggatgtatatgatatactcttaagtgaataaagagttacaaaatgttatgtacaagttacaaaatgtatgtacattatgatccatttttcataaaatcatatgtatgtatatatgtgtgtctggaaggataaatttatcaagttgttatctctgaaattttgggtatattttatatttctagattttctgttactttgttactttactgataaagtaataacgttgttgacttttgtcactctcccctattaataat

SEQ ID NO: 190016 - DNA, 601 bp, Human
tgaataattgaaaatattaacattttaagttaaatcttacccactcaatacaatttggtaatttgtatcagaagcttaaaagataacctaatagttcttctacttctataacttacccaaatatgtttgcagagatcttatgtaaagctcttcattataacactgctttcaggagccaaaaattgggtgggggagccccataaatgttgaataataggggtttgattagataaattttggtgtagttctataatggcgtgttattcagccaataaaaggtttgttaaagaatgactgtgayggatgtatatgatatactcttaagtgaataaagagttacaaaatgttatgtacaagttacaaaatgtatgtacattatgatccatttttcataaaatcatatgtatgtatatatgtgtgtctggaaggataaatttatcaagttgttatctctgaaattttgggtatattttatatttctagattttctgttactttgttactttactgataaagtaataacgttgttgacttttgtcactctcccctattaataatcatctaggctgcaaaaggatcatgtcttctttatttttatatt

SEQ ID NO: 190017 - DNA, 601 bp, Human
actttgttactttactgataaagtaataacgttgttgacttttgtcactctcccctattaataatcatctaggctgcaaaaggatcatgtcttctttatttttatattccaaggactgtcaacaagtgcctagcacttgacaggtatattatagaaatttaactgaatatctttaggaaatagatttttgtttgtagttgttctagtctacattaaatgtcttgcgcttatgaaacttccttgaattattttagtgaagcaatattagtatagaattttgcatcactggatgcccttgacygaaagctggcttatggcatctcaccagtgtgtggggagtttcagtccttctgttgtctgcatcacagctgaagcagtgctgttgctgacaattcctgacaccaccttgtctctattattgatcattgcctcactatggtactgagttttagcttattcttgtaataactgggactcatatgtatagaataagctattagctcacgtttttgcttgctttttatacagaatacatgtctgcaaatagttttatcaatattttggaattttgggagatatgaagttaaaaacatcattgaat

SEQ ID NO: 190018 - DNA, 601 bp, Human
ttaaaaagtttctcatcttatagggaaaatagtatgtcaatgtattcttaacttgcatttcttttattataagtagtgtaaaatatcatttcaacttatacacaggaggaatttctctctatataaagtgatcctagaatcataatgaaaaatatcaccaactcattaggaaaatgtacaaaggattgaatagatatctcatcaaaaataaaaatataagtggcctttaaacattgaaaggtaacatttgaacaaagacttgcaggaggtgagggattagggaatgcagactctgggaagrgtcttccaagtagcaggtgaagcaagtgcaaagctttcagatgggactgactatacctgtctggtttgaagaacagtaaggaggtcactgaggctggcatagagtaagacagggagggtagaatactgtcagagaagtaatcggcggtggaggtagggggtaaaccataaagtgctcgtaaagactaaggcttatttctctgggtgagattagaggccactggagagttttaaacagaagtaacagggccactttggctaatgtttttaggctattctgtagggagacaagggaggaagc

SEQ ID NO: 190019 - DNA, 601 bp, Human
tcctccaaacctattccaactatctgaatcatgtgccccttctctgtgaacctctatcataatacttgtcacactgtattgtaattgtctcttttactttcccttgtatcttttgtgcatagcagagtacctgaaacaggaagtattttaaatattttgaatcaaatgagttaatagaatctttacaaataagaatatacacttctgcttaggatgataattggaggcaagtgaatcctgagcgtgatttgataatgacctaataatgatgggttttatttccagacttcacttctaatgrtgattatgggagaactggagccttcagagggtaaaattaagcacagtggaagaatttcattctgttctcagttttcctggattatgcctggcaccattaaagaaaatatcatctttggtgtttcctatgatgaatatagatacagaagcgtcatcaaagcatgccaactagaagaggtaagaaactatgtgaaaactttttgattatgcatatgaacccttcacactacccaaattatatatttggctccatattcaatcggttagtctacatatatttatgtttcctctatgggtaagc

SEQ ID NO: 190020 - DNA, 601 bp, Human
aaattgtgaagatattgtatccctggctttgaacaaataccatataacttctagtgactgcaattctttgatgcagaggcaaaatgaagatgatgtcattactcatttcacaacaatattggagaatgagctaattatctgaaaattacatgaagtattccaagagaaaccagtatatggatcttgtgctgttcactatgtaaattgtgtgatggtgggttcagtagttattgctgtaaatgttagggcagggaatatgttactatgaagtttattgacagtatactccaaatagtgtttstgattcaaaagcaatatctttgatagttggcatttgcaattcctttatataatcttttatgaaaaaaattgcagagaaagtaaaatgtagcttaaaatacagtatccaaaaaaatggaaaagggcaaaccgtggattagatagaaatggcaattcttataaaaagggttgcatgcttacatgaatggctttccatgtatatactcagtcattcaacagttttttttttagagccccattcttattttttatacactttgagagcataatgaaaagaaaagctacctgcaaaagttttgga

SEQ ID NO: 190021 - DNA, 601 bp, Human
tgaacaaataccatataacttctagtgactgcaattctttgatgcagaggcaaaatgaagatgatgtcattactcatttcacaacaatattggagaatgagctaattatctgaaaattacatgaagtattccaagagaaaccagtatatggatcttgtgctgttcactatgtaaattgtgtgatggtgggttcagtagttattgctgtaaatgttagggcagggaatatgttactatgaagtttattgacagtatactccaaatagtgtttgtgattcaaaagcaatatctttgatagttkgcatttgcaattcctttatataatcttttatgaaaaaaattgcagagaaagtaaaatgtagcttaaaatacagtatccaaaaaaatggaaaagggcaaaccgtggattagatagaaatggcaattcttataaaaagggttgcatgcttacatgaatggctttccatgtatatactcagtcattcaacagttttttttttagagccccattcttattttttatacactttgagagcataatgaaaagaaaagctacctgcaaaagttttggacttacctcaaagaggatatacttcattcc

SEQ ID NO: 190022 - DNA, 601 bp, Human
ttgatttcctcaagtcaacctttaaaagtatatttagccaaaatatagcttaaatatattactagtaataaatttagtactgtgggtctctcattctcaaaatgagcatttactaatttctgaacactgtgctaggtcctgggaataccaaattgaataagacatagtctatttttctgaagggtttatagcagagtcccctgtgttaataatgaaggagtgtgtggtatgtgaatcatatatcaatagggttgttaaaaataatgaaaaaaggagaagaggaagaacatcttttttttttctgattgcacgggcagccttaaaattatttttgaagtgtacaattcagtgtttttttagcatattcacagggttgtattatcatcaccatatttttggcctcttgaaaagaaatcctgtgcctattagcatccaattaccgttcctttgtagctaagtctcccccattccagctttaaacaatcacccatctactttctgtctctataaatttgtctcttttggacatttcacataaatgaaataatataatagggttttttgtgcctaaataagcttctaaagaagaataaggtaagga

SEQ ID NO: 190023 - DNA, 601 bp, Human
tctccctttgaggtaaagaaaactgttagaaatagtatttctactactgatagtatttcttctacttatgcctccctttgaggtgaagaatactgttagaaaacatgacataggagaaatacccctgagagacagttcttattagtgactactgtgcagaaaagatggaggttggtgtaattaaggagaaggaaagccatgaagccaaagtattatgaaaaagcatcaatatgaattttcatgttgacaaagtggtataaaagataattataaagatggtcacttataaatacggtagttstgtgtgacacaatttacagaagttggtatatcgtgtggaagaaaacagcataagatcctgaaggtttgaactgtgggcacattggctccatgctcaggaaatggcaatggggttgggaagtgattccactttatgtccctttcagacacataaaaattacttgtgtgagtatcttatgccagacactattcactgtgtagtgagcatggtgggtatgaaatgacaactttattgtctttcctgtcaaagaacttgtaggctggttgggggaaagagaccatttcaatatgaagtgctgag

SEQ ID NO: 190024 - DNA, 601 bp, Human
aactaacctgtaagaacttgaaacttagcctttgaatggtcaatccaccactgtaggagaatttatgaatgttcagttgagagaactgaaaataaagaagtaccataggaattaacatttgcattcagtagccaagatataatggacatctgaaacaggtatttgaggccaggcgtggtgtctcatgcctgtaataatagcactttgggaggccgaggtgggtggatcacaggaggccaggagttcaagaccagcctactaaaacacacacacacacacacacacacacacacacacacactagccaggcgtggtggtgcacgtttgtagtccaagctacttgggaggctgaggcatgagaatagcttgaacccagaaggcggaggttgctgtgagctgagattgcgccactgcactctagcctgggtgacagagtgagactctgtctcaaaaataaaataaaacatatatttgaaacacattgaattatgtcccttaaacaagaataaacatcactaaatgactgtaccttgaactacctgtaattttctcctgataggtaattaagcttcaaagtactgacacttatttactgtaatat

SEQ ID NO: 190025 - DNA, 601 bp, Human
cctactttttatttaccaggtttagttatccttgaattagattttataaattaaagaaatagatttcaataaatatttgttgagttcctagtatggaaacatcgtgtttggcaccagggatgttgcctgcaagtataacaggagttcgtatttgtaatgagtttatgatttacagatatttggggggcaaagatatcattcggtaaatacttatgagtgcaaactttgaactagggactgggccaaactctaggaacatatttgatgacagagacacaatccctgtcctcaaggagctttmattctagtagagaagatgaaaaccagtacagtttggtaagttagatgatattggttaatgtagggttcttatgtaagtctagagaagtagcatttaatctgttcttagaaggtcaggaaagatttccctggaggaagtgacatttaagctgagagaggatggataaacaggagtcatctgagtgaacaacagggagaacattccagaaagagaacaaaatgtacgaggcctgatgccaagagagaacattcattgcattggggaactatagtcacttctgtgtggctgggatgtagaatg

SEQ ID NO: 190026 - DNA, 601 bp, Human
atagagtgccagggaaagtgctttcatggacctcttcattctctcctctcctggtgtcataagctactccttcatccatgctgccatttctcttggtttacggttccagtatagtactcatcacattattactatagagccatccaccttatgaaggtgaaggtgtccatctccttacttaaaaaaaaaaaaaacaaacaaaaaaacaaaaaacccgaaaaacaaaaaaagaggcagaaagacagaaggtcctccactaactttcacgtgccatgtaaccagcgaaatccaattattttayagcattctagctatagaagagtttgggaagcgtagtgcttagtgttctagcctttgtagcacaggaaagggcctggaaggaaaggaattgtgtcttccgcagttgcttttctttatggggaagtgctatagcccaaacaatattttaggaattttcatctattgtcaatatgcaaactggaaggggataatgaaaatgttgtggttagaagtttatgaaatattgttattcacattttaaagtaaaaagagggaatgtttaagagacttgtttaagatcacatgtctcataattggtggg

SEQ ID NO: 190027 - DNA, 601 bp, Human
agaagcgtgacatgatcagcttgaatgatgaacaacttgaattgtttaaagtggatcacacagtctactgttttacagttattctttgaccaagatattctttattaactgaggaaaaaaagggctttcctgaattttgcagtcatgggatatatgataagcattcttgatttatcatcttcaatcctgttacataacataataaccattgttattacctttagcaatgctttcctcagtattatctaatggcctataaaatgtgactttcatttgcaaatacagtacatctaacaagaayttaccacagctgctatgcaaaataccaatacaattgacccttggacaatgtgggggttaggggtgctgattccccatgcagttgaacatgttacataacataatacataaccattgttattatgtaacaggattgaaaatgataaatctttggaaagtggggcaaatgaattcttatgaattccatatcttccacatgtgttttacttttttgataagaagtagtaacctagttcagaaagaaaataatcatccccttttacttatgcaggataccaagtctatcttagcaccataatag

SEQ ID NO: 190028 - DNA, 601 bp, Human
aatgataaatctttggaaagtggggcaaatgaattcttatgaattccatatcttccacatgtgttttacttttttgataagaagtagtaacctagttcagaaagaaaataatcatccccttttacttatgcaggataccaagtctatcttagcaccataatagtgaatgataggaatcaagctctatgaatacattcacatgtacatatatatggctatataggacacatgcatgcacatatacatatatacacttgcatatatgtgtatatacatgtacatatatgcatgtatattcaawtgtatatgtgtatatagccaagttattgtacagttgacctttgaacaacacgggtttgaactatgcaggtccacttacacgtattttttttttccgtttctgacacccctaaggcaacaaggccaactcctccccttgctcttcctcctcagctgactcaacatgaaaactatgaggacgaagacctttatgaagattcacctccacttaatgaatagtacatacatttctttttccccatggttttcttaataacattttcttttctctagcttgctttattgtaataatatagtatat

SEQ ID NO: 190029 - DNA, 601 bp, Human
tagccatcccattcatgagggtatgtcttagaaaaataagatcacaaaatcatagagatttatgtgcaatgatattattggtaggtcatttttatgaggaggggtgtggatagtaaatgccagggtaaatcacatagcatctaataaacgtatttatgaactacaaaagcttacactttcagtctagtctagtccagactgcaaataaatgtgagcaagtgaattcaagcacagaagtgcttgaaggcaggtttcataaatctactttcttacagtatcctgatattgacttatcgagacrgttactgtggggttgattattaaaatatttatgtatctaggtatttttcattcagtagtatgttattcaattagcaacaagtgtggggatttaaagatattcttgtttgtttttactgctgaaacatattctagtggaaatttcgaataaacgattagtcatcctaaaagcaagatacattttctcagaaaagacaaggtaaagaacttgtatatcctccctcaattcgtttataaggtaataagatgaataaaaatatcatagtacaatttagcattgtaaaataaaattaattggtca

SEQ ID NO: 190030 - DNA, 601 bp, Human
agtttcattcttctacatgtggcttgccagttttcccagcaccatttattagatagggtatcctgtccccactttatgtttttgtatgctttgtcaaagatcagttgactttaagtatttggctttatttctgggttctctattctgttccattgtctacttgcctatttgtgtaccagtaccaggctgttttagtaactatagccttgtagtataatttgaagtcgggtaatatgatgcctccagatttgttctttttgcttagtattcctttagctatgtgggctcttttttagttccmtatgaattttaggatttttttctagttctgtgaagaattatgatgatattttgatgggaattgtattgaatttgtagattgcttttggcagtatggtcattttcatagtattgattctacccatccatgagcatgggatgtgtttccatttgtttgtgtcacctgtgatttctttgagcagcattttgtagttttccttgtagagatctttaacctccttggttaagtatattttcatgtattttagttttttttttttgtttgtttgttttgttttgttttgtttttgcagctgttgta

SEQ ID NO: 190031 - DNA, 601 bp, Human; identical to SEQ ID NO: 19354

SEQ ID NO: 190032 - DNA, 601 bp, Human; identical to SEQ ID NO: 19355

SEQ ID NO: 190033 - DNA, 601 bp, Human; identical to SEQ ID NO: 19356

SEQ ID NO: 190034 - DNA, 601 bp, Human; identical to SEQ ID NO: 19357

SEQ ID NO: 190035 - DNA, 601 bp, Human; identical to SEQ ID NO: 19358

SEQ ID NO: 190036 - DNA, 601 bp, Human; identical to SEQ ID NO: 19359

SEQ ID NO: 190037 - DNA, 601 bp, Human; identical to SEQ ID NO: 19360

SEQ ID NO: 190038 - DNA, 601 bp, Human; identical to SEQ ID NO: 19361

SEQ ID NO: 190039 - DNA, 601 bp, Human; identical to SEQ ID NO: 19362

SEQ ID NO: 190040 - DNA, 601 bp, Human; identical to SEQ ID NO: 19363

SEQ ID NO: 190041 - DNA, 601 bp, Human; identical to SEQ ID NO: 19364

SEQ ID NO: 190042 - DNA, 601 bp, Human; identical to SEQ ID NO: 19365

SEQ ID NO: 190043 - DNA, 601 bp, Human; identical to SEQ ID NO: 19366

SEQ ID NO: 190044 - DNA, 601 bp, Human; identical to SEQ ID NO: 19367

SEQ ID NO: 190045 - DNA, 601 bp, Human; identical to SEQ ID NO: 19368

SEQ ID NO: 190046 - DNA, 601 bp, Human; identical to SEQ ID NO: 19369

SEQ ID NO: 190047 - DNA, 601 bp, Human; identical to SEQ ID NO: 19370

SEQ ID NO: 190048 - DNA, 601 bp, Human; identical to SEQ ID NO: 19371

SEQ ID NO: 190049 - DNA, 601 bp, Human; identical to SEQ ID NO: 19372

SEQ ID NO: 190050 - DNA, 601 bp, Human
ggcttggcttatagagtcttttgatgaaaagaagcttttaagtttaataaagttcaatttattgtcttttcctttatgttttgtgcttttggtatcttgattaagaactccttccttatattgggttctcaaatttagcagcataacattttcatactattatttaaatttttttcacattatttagtgatagcacctttcttattcctaaagtgtttatcattgccttctgtctttctgcttgataaatattgccacacatttgtatactttattagtgtgtacaaagaccacattttarttgtgttatttctcttgttttggttttctagaatgcagagccattaatattatagtaatgcttatgtgctaataccatatcaggggcacaaatcccattgcagcgggactgagaaattaaaggaaatgatgcacatttactcatttttgtttaaaaaatcaaatgcatatttttcaatcagactatatggttggtctggatagcttcatcattgaatttttaaagtatttttgtactactgtatttaaaattattcattcaccactgcttttgtagatggtttagaaacccaagttagga

SEQ ID NO: 190051 - DNA, 601 bp, Human
aaccacacacatttattcagctataaaatttgtatgatcaactcctgtcagaacaaacatcattataaaaaatatctccaggaaaaagaaaacccttttaatgctctcttctggttcatgtgtcttcttattttctttaagcattttcataacccattgagctgtaatttaattggaacatgatttatactaaagttggtttctttacctttaactttttttttttagtttgatcagctctctttagcttctgtagttcggtctttaattccattccagtatgcttttggagttgggtctyataaatgtatagaaatgtttctgttgggaaacagcaggagaatattaaataaatattgtgcttacatctatttaattctttgcccaactttctacaactttgactttacatttaagctcctcatgcacttacatgtttctttacctaaaaatatcttttcaccatgggtgtgtacaattcctttgtccttgctgtattaattttcttggtttacatagtagcctctacacattgatgtcaaaacctctgtttggtgcatttctactctgcgtgttcaatctccatgaaagtttctgtaag

SEQ ID NO: 190052 - DNA, 601 bp, Human
ttctttccacaacctacttcattttatttccatcagccccataactcaggatcaacatcttgccagagccaatttccttgtctcccttaacagctccagcagtatttatgccatggacaaattattcttcttgtgatactttctctcttgcttccatgacactactcccacttcattttctttctacctctctggctcttccttggtcccttttcctggccccttctctctttcagatctctaaacatcagctatatctcagccctgttctactgacactctctagctgttattttctaarcccatgtttcagaaaccatatcttgatgaatcttggaaggccgaggcaggcgaattacttgaggtcgggagtttgagaccagcctggccaacgtggtgaaaccccatctctcctaaaaatacaaaaattacctggccgtggtggcatgcacccagctacttgagaggctgaggcacaagaatcgcttgaacctgggaggtggaggtttcagtgagccgagatcctgccactgcactccagcctgagcaatagaggagactccgtctcacacacacacacacacacacacacacaaagaaa

SEQ ID NO: 190053 - DNA, 601 bp, Human
tatgccatggacaaattattcttcttgtgatactttctctcttgcttccatgacactactcccacttcattttctttctacctctctggctcttccttggtcccttttcctggccccttctctctttcagatctctaaacatcagctatatctcagccctgttctactgacactctctagctgttattttctaaacccatgtttcagaaaccatatcttgatgaatcttggaaggccgaggcaggcgaattacttgaggtcgggagtttgagaccagcctggccaacgtggtgaaaccccrtctctcctaaaaatacaaaaattacctggccgtggtggcatgcacccagctacttgagaggctgaggcacaagaatcgcttgaacctgggaggtggaggtttcagtgagccgagatcctgccactgcactccagcctgagcaatagaggagactccgtctcacacacacacacacacacacacacacaaagaaaataaaccatctcttgatgaatcataaatttgtgtctctagtttagacctctatcctgctctctaaatgatgtatccaactatcatcttgacaccatcatatgttca

SEQ ID NO: 190054 - DNA, 601 bp, Human
cctgttctactgacactctctagctgttattttctaaacccatgtttcagaaaccatatcttgatgaatcttggaaggccgaggcaggcgaattacttgaggtcgggagtttgagaccagcctggccaacgtggtgaaaccccatctctcctaaaaatacaaaaattacctggccgtggtggcatgcacccagctacttgagaggctgaggcacaagaatcgcttgaacctgggaggtggaggtttcagtgagccgagatcctgccactgcactccagcctgagcaatagaggagactccrtctcacacacacacacacacacacacacacaaagaaaataaaccatctcttgatgaatcataaatttgtgtctctagtttagacctctatcctgctctctaaatgatgtatccaactatcatcttgacaccatcatatgttcataaaacataattatagaatatctttcagtaggcttgacattttaaggcatgagtttccgttcagtatctccttaaaatatacccagggtctcaggagactattcaaacaggacaaagcttctattctacttactaatgtgtctggccctatttggca

SEQ ID NO: 190055 - DNA, 601 bp, Human
tttctaaacccatgtttcagaaaccatatcttgatgaatcttggaaggccgaggcaggcgaattacttgaggtcgggagtttgagaccagcctggccaacgtggtgaaaccccatctctcctaaaaatacaaaaattacctggccgtggtggcatgcacccagctacttgagaggctgaggcacaagaatcgcttgaacctgggaggtggaggtttcagtgagccgagatcctgccactgcactccagcctgagcaatagaggagactccgtctcacacacacacacacacacacacacaaaaagaaaataaaccatctcttgatgaatcataaatttgtgtctctagtttagacctctatcctgctctctaaatgatgtatccaactatcatcttgacaccatcatatgttcataaaacataattatagaatatctttcagtaggcttgacattttaaggcatgagtttccgttcagtatctccttaaaatatacccagggtctcaggagactattcaaacaggacaaagcttctattctacttactaatgtgtctggccctatttggcaggttggataaaaagtcatctgaacattgtc

SEQ ID NO: 190056 - DNA, 601 bp, Human
attttaaggcatgagtttccgttcagtatctccttaaaatatacccagggtctcaggagactattcaaacaggacaaagcttctattctacttactaatgtgtctggccctatttggcaggttggataaaaagtcatctgaacattgtcactttatgaataatatagtttaatagtttgtgaatcacccctgcaatttaaaaaatagtaaaattatcagaatctaatttaataattcctattggaacaccccatgttaggggatttccagttatttcaattgatatctcaatgttttaaarattgtttatttctattactaattcactctttattttaacataaattgtggctatctatctctattcatttcaattatatttctcataccattctatagatggggtgaaaagaaaagtgttaattttttaaaactccatacctcaaatactatatgaatttatagttgttattgctaaagcaattatcttacatcttttcctccaaaacaaagttatgtgctggtttattttctttgtactcataagatgccttccatttttagtaacataagtcttgtctttctcctattcttagctact

SEQ ID NO: 190057 - DNA, 601 bp, Human
cccctgcaatttaaaaaatagtaaaattatcagaatctaatttaataattcctattggaacaccccatgttaggggatttccagttatttcaattgatatctcaatgttttaaaaattgtttatttctattactaattcactctttattttaacataaattgtggctatctatctctattcatttcaattatatttctcataccattctatagatggggtgaaaagaaaagtgttaattttttaaaactccatacctcaaatactatatgaatttatagttgttattgctaaagcaattaycttacatcttttcctccaaaacaaagttatgtgctggtttattttctttgtactcataagatgccttccatttttagtaacataagtcttgtctttctcctattcttagctacttaagcattatgtagcttaaataagcactaaagattcctatctgtatgaaaaaataaagattaaataaataagatctagaaagggtgacaaggtgatgcttcaaaatgaaccataccaagccatctagcgattgataaattactcacactcataatcacattgttggaaagaagccattgacaattc

SEQ ID NO: 190058 - DNA, 601 bp, Human
ggcatttggctgtctcagtgggtgggaaagggtgctccaggcaaagggcataacatgaggcaaagggcatgcacagaaaacagtgactggttcagtcaggttgggggatgccaaaggaagtaatgggagacaagattggagcaagatagataagagattgtggattttttttcttttttatctatataaatacagagacagggtctcactatgttgcccaggctggtctcaaactcctggcctcaagtgatcctcccacctcatcctcccaaagtgctaggattacaggcatgaggcactrtgcccaacctccaattttggattttgagagctaaagcaatatagtcgaaaactcagataatccaggtagattttgctattaggtgctatttggttcctggtacagagctaaaacccttggaatttcctaagtgataagagctacaggagcatcttttgttatatgtttccccccctagttcctgaaatagctctagagaaatacaggtgaataacatcctttgttattcatatcaagcccctatcaaccataccccagtttctatttatgaagtggcttttgggaagtccctaaagacag

SEQ ID NO: 190059 - DNA, 601 bp, Human
tttgatttaatttgatcttcttttgctagttatccaaggtggaagcttatattgttaagatccttttgcattcttatgcattcaatgatgtaaatttccctctaagcactgctttttctgcatctcacaaatattcatgagttgtattttcatgttcatttagtttgaaatatttttaaatttctcttgatatttctcttttgacccatgtgttacttagaagtgtgttgtttaatcaccatttttaaaaattttctagctatctttctgttattgatttctagtttaattccattgtggactgagagcatatattgtataattttaatttttataaaatttgttaaggtgtgatttatggcccagaatgtggtctatcttggtgaatgttccatgtaagctttggaagactgtgtattctgctatatttgaatgaggtagtctatagacatcaattatgtccagttgattgatggtgctgttgaattcaactatgtccttactgattttccacctgctagatctgtccattctttgcagagggacactgaagtctccaactctagtagtgaatattctatttcttgttacagttttatca

SEQ ID NO: 190060 - DNA, 601 bp, Human
gcctcccaagtagctgggattacaggtgcctgccaccatgcctgagtaatttttgtatttttagtagagatggggttttatcatgttggccaggcgggtcttgaactcctaacctcaagtgatctgcccaccttagcctcccaaattgctgggattataggtgtgagccaccatgccctgcctttagcatgttaatcatagttgttttaaattcctgatctgttaattccaacatccctgtcatatctgactgtggttctgatgcttgctctgtgttttcaaatggtgtttttttttttttgccttttagtaagccttgtaattttttattgaaaggtggacatgatgtgctgggtaaaaggaactgtagtaaataggcctttagtaatgtactggtaggtgtagcagagggtgagggaagtattctgtagtcctatgattaggttttagtcttttagtgagcctgtgcgcctgcagcttggaagcacttgtgaagtgttttttcaccccttttggtgggacatagtgactagtgtgagcgggagttgagtatttcccttcccctaggtcagttaggctctgaaaaaaccctgataggtta

SEQ ID NO: 190061 - DNA, 601 bp, Human
gaacctggtaagcatcctataggcaaaattcataaaagtatagaagtcggccagtgacttggacccacttggaattttcttgctctcacatcatgcacactgaatctccagcaatttttcacttacagtttaggttttcctaccctactactggttctctcagaggtttctgcttattggtttctgttttgtaagttgtgattctctgtacctaactgcctgtctcccattttggggggcagtggtttgccctgtgacctcacttctctgacagatctaagaaaagttgtttatttttcastgtgctctgctttttacttgttacgatgaagccaaccactttcagaatttctacaaaccagatcagaatctggaagtcctgtttttttattttttttatccctttgtttagcatgttacctatcttaacacattttaaataagtgaatgcatagcttatatctacttctaggttatatgcttccttagaataggaattgattcttaaaatgtcgttctgctcacgcctgtaattccagcactttgggaggccaaggcaggcggatcacttggggtcaggagttcaagaccagcctggtca

SEQ ID NO: 190062 - DNA, 601 bp, Human
ctctattctgttccaaggttgtttgtctccatatatcaacattggtcaggattgaaagtgtgcaacaaggtttgaatgaataagtgaaaatcttccactggtgacaggataaaatattccaatggtttttattgaagtacaatactgaattatgtttatggcatggtacctatatgtcacagaagtgatcccatcacttttaccttataggtgggcctcttgggaagaactggatcagggaagagtactttgttatcagcttttttgagactactgaacactgaaggagaaatccagatcratggtgtgtcttgggattcaataactttgcaacagtggaggaaagcctttggagtgataccacaggtgagcaaaaggacttagccagaaaaaaggcaactaaattatattttttactgctatttgatacttgtactcaagaaattcatattactctgcaaaatatatttgttatgcattgctgtcttttttctccagtgcagttttctcataggcagaaaagatgtctctaaaagtttggaattctcaaattctggttattgaaatgttcatagctttgatagtgtttttcagaagacca

SEQ ID NO: 190063 - DNA, 601 bp, Human
tgaatggtatcaaattcaccacacttaaaactttgggatgtctaatttcaaccaacagctttctttcttcataatgttgaatatatgtgtatctattttagctaaatttaatatatatcaatatactttgatagatattttatataaactattagactatagtattatgagtaaaagacccaccatttcccaagcaattataaagaacgatcaaaattttaatgggttgttagtattatttctttaaagattgtgatactgataaatatttggccacattttaatagaattatacatgggrtgtgtgtgtgtgtgtgtgtgtgtgtatatgtgtgtgtgtatatatatatggcagtagagatatatatatctacacacatctagatatatatatacatgtatatctatatatacacacatatatctgtgtgtatatatacatatgtatatatacctacatacatatgtacatatacatacatgcatatatctgtacatatatatatagtgtgtgtgtgtgtatatatatatatatatatttattttttttttcctgagccaaaacaaaatactaggttgtaatagctgttctttcagaagg

SEQ ID NO: 190064 - DNA, 601 bp, Human
cgatcaaaattttaatgggttgttagtattatttctttaaagattgtgatactgataaatatttggccacattttaatagaattatacatggggtgtgtgtgtgtgtgtgtgtgtgtgtatatgtgtgtgtgtatatatatatggcagtagagatatatatatctacacacatctagatatatatatacatgtatatctatatatacacacatatatctgtgtgtatatatacatatgtatatatacctacatacatatgtacatatacatacatgcatatatctgtacatatatatataktgtgtgtgtgtgtatatatatatatatatatttattttttttttcctgagccaaaacaaaatactaggttgtaatagctgttctttcagaaggaagaaaaacaacatgtgctgaactctgagtttgatgtttttgtattttacttcctattttcatatcagtccatttatttattcaggaagaatttattgagcatatattatgaacacagcttttgctaaggacagggtatgcagcagttatggcctagtaggagatatggatgttaaaaacaaaatgctcacaaatgcacatataatc

SEQ ID NO: 190065 - DNA, 601 bp, Human
gatcaaaattttaatgggttgttagtattatttctttaaagattgtgatactgataaatatttggccacattttaatagaattatacatggggtgtgtgtgtgtgtgtgtgtgtgtgtatatgtgtgtgtgtatatatatatggcagtagagatatatatatctacacacatctagatatatatatacatgtatatctatatatacacacatatatctgtgtgtatatatacatatgtatatatacctacatacatatgtacatatacatacatgcatatatctgtacatatatatatagwgtgtgtgtgtgtatatatatatatatatatttattttttttttcctgagccaaaacaaaatactaggttgtaatagctgttctttcagaaggaagaaaaacaacatgtgctgaactctgagtttgatgtttttgtattttacttcctattttcatatcagtccatttatttattcaggaagaatttattgagcatatattatgaacacagcttttgctaaggacagggtatgcagcagttatggcctagtaggagatatggatgttaaaaacaaaatgctcacaaatgcacatataatct

SEQ ID NO: 190066 - DNA, 601 bp, Human
atattctaaatgttaatatcaaaaatattattttcaattcaccccaggcacagagaactaagtattattattgctattgcaccggcattccccaatgagacagtgattttcttttaagacatttttaaataatataggcagaattaagtagacggtgatctggtaagtagatgtttcagggtaacagctgtgcaatgctccatgcagggaattagattgtcattttattccttaccaggaacatacattcagttaaacaattatttgacttctgctcttccactgatttctaagttgaggytctctcttgtgcctgtctgatcagataagtagagttgtgccttggtttatagatgagataaatgtgtatttgaataagcataagttaaagaaattttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatt

SEQ ID NO: 190067 - DNA, 601 bp, Human
aaatgtgtatttgaataagcataagttaaagaaattttaaaatcccttaggaagctaggcttatcagagaaatccaaggaaatacattaacaaactaggaatttgttctaacaggttaattataactcataaacttattgggtttttttaccttttaattttatattacatttgcttataataaggaatattgctaggaataaaattttttaatattctacaattaacaattatctcaatttctttattctaaagacattgggattagaaaaatgttcacaagggactccaaatattgctrtagtatttgtttcttaaaagaatgatacaaagcagacatgataaaatattaaaatttgagagaacttgatggtaagtacatgggtgtttcttattttaaaataatttttctacttgaaatattttacaatacaataagggaaaaataaaaagttatttaagttattcatactttcttcttcttttcttttttgctatagaaagtatttattttttctggaacatttagaaaaaacttggatccctatgaacagtggagtgatcaagaaatatggaaagttgcagatgaggtaaggctgct

SEQ ID NO: 190068 - DNA, 601 bp, Human
ctgggaaacaggtttagcataaaacagtgatgctcattctagaacacctgcaaatgacaatagttttctttcgaagtcgccaggaatcgtctgcctttgggtatgtggctgtgagcactgccgggcaaaatgccatatgacctagatgaggcatatgccatcctttgaagccattaggacattatataggaaatatattaactaaaatggaataaaattttctaaataacaccttatgtttatccaacaggtggttcattatacttgagagcattatacagaggaatttgatggggaggakagctggagaaattctcgaaattctgggtttctttaacagaatactctagctataaacttataattttaaaaaataagcattatattaaagaaaagggaacataaattattttgttttattaaacttaagtccaaaggtctggattgtggcagaataggatcaggggacctaaaatgttgagcctcaaaggtcttcttagagaacaactgtattccactattagcgcttttggtccttttagcccaatttctgtttatcccaaatgttcttcccttttctgccttccttcacagtggaccc

SEQ ID NO: 190069 - DNA, 601 bp, Human
caaaatttttacctgtttaggtttttatttcatcagttcatatttaggtatatacttttactgttctccttttttataatttaccattcacaaagatgatgatgttagtctaactttaatgtcatgagtgctttgagtagtagtgctaagtttttgttgagtagtagtgtgcttttttgattagtagtgataggtttttgatgagtaagcctgctagcagcatacaaacaaacaagcaagtatcagcctagagaagcagaaaaggcatttgggtttcaaagtcacaaggcctaggctttaktctaatacagctgataatacaatttgtccaaacaggacatttttgggtgtgtcaaacactaaactggacaggacattatgacaaaagtgcaaagcaggactttccggggcaaaccaggatgtatgtcatctcactgagtcctctctttgtccttgccatgactagtatctctagaggtaaatgaacagagtaatgacaaatagccagacacctgaatcttatcccaacagcacctcctacataattccccattatcccaaatggaaattaaaaatatatacagtgataattccaggccaa

SEQ ID NO: 190070 - DNA, 601 bp, Human; identical to SEQ ID NO: 19373

SEQ ID NO: 190071 - DNA, 601 bp, Human
aggggccgggcacggtggctcacacctgtaatcccaacactttgggaggtcgaggcgggtggatctcttgaggtcaggagttcgagatcagcctggccaacatggtgaaaccccgtctctaccaaaaatagaaaaattagccgggtccagtggacagcgcctgtaatctcagctactcaggaggctgaggcagagaattgcttcaacctgggaggcagaggttgcagtgagctaaaatcacaccactgcactccagcctgggtgatagagtgagactccatctgaaaaaaacaaaaaaaaacaaaaaaccagactatattgtttagggataaatagttgacaaaataatagagacaagcaagacataattaccataaaaatcaggacctggggttgggggtggagagggaaggtttaagtggaaagaatggagtggtgacaatgtgtgtcaacctgggccatggtgaccctggggttcgctttgtaattcctcaaaatgagcatttatgtgctattcacttttcagagggtagaatctctgaaccaaaatgtttaagcaaccatatattaaaaaaagaaaaaatatggacagatttgtatt

SEQ ID NO: 190072 - DNA, 601 bp, Human
tattgcccaggctggagtgcaggggtgtgatcatggcccactgcagccttgacttcctgggctcaagtgatcctcctgccttagtctcctgagtgcctgggactacaagtgtgtgccaccaagcctggctaatttttaaatttttttgtagagacaaagaactgcgctatgttgctcaggctggtctcaaactcctgtcctcaagccatcctcccacctcaggtcccaaagtgctgggaagacagccgtgagccaccacacgtggccaggccaccatttttcacctagcctattccacctygcacccattctagtccacccctgcaaaccatcctttaagatggcagctggaaagacttaaaaagaaactcaaggctgggcgcgctgactgatgcctataatcctagcactttgggaggccgagaggggcagatcacctgaggtcaggagttcgagaccagcctggccaacatggtgaaaccccgtctctactaaaagtacaaaaattagccaggtgtggtgtgggtgcctgtaataccagctattcaggaggctgaggcaggagaatcgcttgaacccgggaggcggaggttgcagtgag

SEQ ID NO: 190073 - DNA, 601 bp, Human
aaaaaagcttcaacaaataaaagttgtggctaaaagccactctgaaattgtatggttcctatttcaggtaatttagtcttaacaacagggaaggatagaaaatgaacacaatttgtagttctttgttcttaacaaactaagaatactttgcttaaataagtagcaatgagaatgtaactgagtaatttatacaaatagggaaaagggaacacaggttgaaacactttattttagcttggaagcacgtccatggggccaagtaatcaattccacaaatcattttcttgtcttttttttttttgtcctggagacagggtctcactctattgcccaggctggagtgcaggggtgtgatcatggcccactgcagccttgacttcctgggctcaagtgatcctcctgccttagtctcctgagtgcctgggactacaagtgtgtgccaccaagcctggctaatttttaaatttttttgtagagacaaagaactgcgctatgttgctcaggctggtctcaaactcctgtcctcaagccatcctcccacctcaggtcccaaagtgctgggaagacagccgtgagccaccacacgtggccaggccaccat

SEQ ID NO: 190074 - DNA, 601 bp, Human
aggaggtggaggttgcagtgagccgagatggcaccactgcactccagcctgggtgacagagtgagactccatctcaaaaaataaaaataaaaaaaaataaaagaagacattatgggatgcaagtctgcaaagccttaattacaaagtaaagaaacaaaaaggaaaaagacattaaaatacaggagcagaaacatctcattttccccatagtccaataggtccctgcaaattgatccccaaatgcttaaaacaaggccaggtgcggtggctcatacctgtaatcccagcactttgggaggctgagggcaggtggatcacctgatttcaagagtttgagaccagcctggccaacatggtgaaaccctgtttctactaaaaatacaaaaataagccaggtgtggtagtgcatgcctgtagtcccagctactcaggaggctgaggcaggagaatcgcttgaacccgggaggcgggggttgcagtgagccaagatcgcaccactgaactccagcctgggcgacagagcaagacaccgtctcaaaaaaaaaaaaaaaaaaaaaaaaagcttcaacaaataaaagttgtggctaaaagccactctgaa

SEQ ID NO: 190075 - DNA, 601 bp, Human
actcaccaaacctcccaccctttaaaagaagacattatgggctgggtgtggtggctcacgcctgtaatcccagcacttcgggaggtccaggtaggcagatcatctgatgtcaggagttcaagaccagcctggccaacatggtgaaaccccgtctctactagaaatacaaaaattagcctggcatggtggcacgcaactgtaatcccagctactcgggagggtgaggcaggagaaccacttgaacccaggaggtggaggttgcagtgagccgagatggcaccactgcactccagcctgggtkacagagtgagactccatctcaaaaaataaaaataaaaaaaaataaaagaagacattatgggatgcaagtctgcaaagccttaattacaaagtaaagaaacaaaaaggaaaaagacattaaaatacaggagcagaaacatctcattttccccatagtccaataggtccctgcaaattgatccccaaatgcttaaaacaaggccaggtgcggtggctcatacctgtaatcccagcactttgggaggctgagggcaggtggatcacctgatttcaagagtttgagaccagcctggccaacatg

SEQ ID NO: 190076 - DNA, 601 bp, Human
aatttgatcacttgtcttactttgccatgcactcaccaaacctcccaccctttaaaagaagacattatgggctgggtgtggtggctcacgcctgtaatcccagcacttcgggaggtccaggtaggcagatcatctgatgtcaggagttcaagaccagcctggccaacatggtgaaaccccgtctctactagaaatacaaaaattagcctggcatggtggcacgcaactgtaatcccagctactcgggagggtgaggcaggagaaccacttgaacccaggaggtggaggttgcagtgagccragatggcaccactgcactccagcctgggtgacagagtgagactccatctcaaaaaataaaaataaaaaaaaataaaagaagacattatgggatgcaagtctgcaaagccttaattacaaagtaaagaaacaaaaaggaaaaagacattaaaatacaggagcagaaacatctcattttccccatagtccaataggtccctgcaaattgatccccaaatgcttaaaacaaggccaggtgcggtggctcatacctgtaatcccagcactttgggaggctgagggcaggtggatcacctgattt

SEQ ID NO: 190077 - DNA, 601 bp, Human
gaatcatcttggagaggccatcaactgcagctttcaactcatacagacgttttaaaatatcatcttggcgggactcaagagcttgcagagacaggttagactcttcctaaacaaaccaacagccaaatgttcatttcctctcccatcagaccagtgttgtttaaatttgatcacttgtcttactttgccatgcactcaccaaacctcccaccctttaaaagaagacattatgggctgggtgtggtggctcacgcctgtaatcccagcacttcgggaggtccaggtaggcagatcatctgaygtcaggagttcaagaccagcctggccaacatggtgaaaccccgtctctactagaaatacaaaaattagcctggcatggtggcacgcaactgtaatcccagctactcgggagggtgaggcaggagaaccacttgaacccaggaggtggaggttgcagtgagccgagatggcaccactgcactccagcctgggtgacagagtgagactccatctcaaaaaataaaaataaaaaaaaataaaagaagacattatgggatgcaagtctgcaaagccttaattacaaagtaaagaaacaaaaagg

SEQ ID NO: 190078 - DNA, 601 bp, Human
tccggctccctgagggcctggttgcgcctcatctgagtcctcagtgcatgccaacaagtactgaatgaatgagggagcagaggaaggaatacatgaatgcagaggtactgaggttaccaaatatcccagccctgggtgagacaccacaatgcttgcattttttagggctttaagtagtgctattctatcacccattctagaggaggctattgatagggattcttgggacaaacccttttgcatcctcaaataagtatcacattgtggttaacaaacgaggtggtctttctttgcatatcasattctcccctaaattagctgaagcctgtaaacttcaatcatgagagctggctgatgcaacttacttgtaatacagcaaactgagttcaagcaaaacgcatttgaaatatgagactgactggcctaagcagtacatttcaaaaggatgggtaggatttttgtacttgggcagtcacggttctgaaagttggcctgtgatcagagagagtccgggctgcctctgctgaacctctggggaacactgagcaagcaagctgagatctgttcttccagggctcagaagctgctggacccatgcccg

SEQ ID NO: 190079 - DNA, 601 bp, Human
ttctcagtcatttcagccgcgcatgctcgaaaactcatctgctaggctccggctccctgagggcctggttgcgcctcatctgagtcctcagtgcatgccaacaagtactgaatgaatgagggagcagaggaaggaatacatgaatgcagaggtactgaggttaccaaatatcccagccctgggtgagacaccacaatgcttgcattttttagggctttaagtagtgctattctatcacccattctagaggaggctattgatagggattcttgggacaaacccttttgcatcctcaaataartatcacattgtggttaacaaacgaggtggtctttctttgcatatcagattctcccctaaattagctgaagcctgtaaacttcaatcatgagagctggctgatgcaacttacttgtaatacagcaaactgagttcaagcaaaacgcatttgaaatatgagactgactggcctaagcagtacatttcaaaaggatgggtaggatttttgtacttgggcagtcacggttctgaaagttggcctgtgatcagagagagtccgggctgcctctgctgaacctctggggaacactgagcaagcaag

SEQ ID NO: 190080 - DNA, 601 bp, Human
ataatgaatgcactgatgtgaacactcacggccaaactccttggctttctgtaccccgcctgccactcctgaccaatatcccacacgtcggcctaggcagaatgccttgcagttccctgaacatattgtattacttgacgctgggtcttctgaggtatcaaaattcatcttgagcaccacatgctctgagatacctccccagcaccctgagaaatgactcagggtcttttctcagtcatttcagccgcgcatgctcgaaaactcatctgctaggctccggctccctgagggcctggttgcrcctcatctgagtcctcagtgcatgccaacaagtactgaatgaatgagggagcagaggaaggaatacatgaatgcagaggtactgaggttaccaaatatcccagccctgggtgagacaccacaatgcttgcattttttagggctttaagtagtgctattctatcacccattctagaggaggctattgatagggattcttgggacaaacccttttgcatcctcaaataagtatcacattgtggttaacaaacgaggtggtctttctttgcatatcagattctcccctaaattagctgaagcc

SEQ ID NO: 190081 - DNA, 601 bp, Human
atttgtgttcattaagatgtttccatgaagaaccccttaagaaggggtgttggcccaagatatcattgatgatgagggatggggagatgctaaaatactaggcgttaactgaagtgctcagactgacagccttgtttattcccactgtgtaaccctcttcagtgccagtggcccacgggtacagaagccaggcaatggttcggggccacagtttgctctggcatggggcactatgagaggtccagggggatgggcctgtcataatccaaacccatgcatgacagcctttttagataaagastttcttattctacgctttcactcgtaataatgaatgcactgatgtgaacactcacggccaaactccttggctttctgtaccccgcctgccactcctgaccaatatcccacacgtcggcctaggcagaatgccttgcagttccctgaacatattgtattacttgacgctgggtcttctgaggtatcaaaattcatcttgagcaccacatgctctgagatacctccccagcaccctgagaaatgactcagggtcttttctcagtcatttcagccgcgcatgctcgaaaactcatctgctagg

SEQ ID NO: 190082 - DNA, 601 bp, Human
gcagttattccagctactcaatctttccaacagctgaccacggccaatttgtgttcattaagatgtttccatgaagaaccccttaagaaggggtgttggcccaagatatcattgatgatgagggatggggagatgctaaaatactaggcgttaactgaagtgctcagactgacagccttgtttattcccactgtgtaaccctcttcagtgccagtggcccacgggtacagaagccaggcaatggttcggggccacagtttgctctggcatggggcactatgagaggtccagggggatgggyctgtcataatccaaacccatgcatgacagcctttttagataaagagtttcttattctacgctttcactcgtaataatgaatgcactgatgtgaacactcacggccaaactccttggctttctgtaccccgcctgccactcctgaccaatatcccacacgtcggcctaggcagaatgccttgcagttccctgaacatattgtattacttgacgctgggtcttctgaggtatcaaaattcatcttgagcaccacatgctctgagatacctccccagcaccctgagaaatgactcagggtctt

SEQ ID NO: 190083 - DNA, 601 bp, Human
agtctcctgagtagctgggattacaggtgaaggtcaccatgctgagctcatttttgtgcctttaatagagatggggtttcgccatattggtcaggctggtcttgaactcctgatctcaggtgatccacccacctcagcctcccaaagtgctgggattacaggcatgaaccaccacaaccggccaaaatctacattttcaatgtgagatgaataggtattctgcaaaaagtgcaaggtttttgcacctcctggtgcagctatagtgacgccttcatgaatttccctttttttttttttttttgagatggagtctcgctctgtcgccaggctggaatgcagtggtgcgacttcagctgactgcaacctccacctcccaggttgaagcgattttcctgcctcaggcttccaagtagctgggactacaggcacgcaccaccacgcccagctaatttttgtatttttagtagagatggggtttcaccatgttggccaggataatcttgatctcttgacctcgtgatctgccctcctcgttctcccaaagttctgggattacaggcgtgagccactgtgcccgaccaaatttccctttttttaaaca

SEQ ID NO: 190084 - DNA, 601 bp, Human
gtatcccatctcctccatgattttctttatggcatctgggaacttgtctgctgcctcttggttggcggaagctgcttctcctgttatcttgacatttttaaaagccaaacctcttcctaaaattatcaaaccatcatttgctggcattaaactctccagctttagatctttcaccatcctttggcttcaagttgtcatataatgactttgctttttctaaaatcttatgagagtctataggtatgcctaacagtaatcctgcaccccacataaaagctgcattttcttttctttttttttkagacggagtctggctctgtagcccaggctggagtatagtggtgtgatctcggctcacggcaacctccacttcctgggttcaagcgattctcctgtctcagtctcctgagtagctgggattacaggtgaaggtcaccatgctgagctcatttttgtgcctttaatagagatggggtttcgccatattggtcaggctggtcttgaactcctgatctcaggtgatccacccacctcagcctcccaaagtgctgggattacaggcatgaaccaccacaaccggccaaaatctacattttcaatg

SEQ ID NO: 190085 - DNA, 601 bp, Human
aaacctgttgacacaggtatcccatctcctccatgattttctttatggcatctgggaacttgtctgctgcctcttggttggcggaagctgcttctcctgttatcttgacatttttaaaagccaaacctcttcctaaaattatcaaaccatcatttgctggcattaaactctccagctttagatctttcaccatcctttggcttcaagttgtcatataatgactttgctttttctaaaatcttatgagagtctataggtatgcctaacagtaatcctgcaccccacataaaagctgcattttcttttctttttttttgagacggagtctggctctgtagcccaggctggagtatagtggtgtgatctcggctcacggcaacctccacttcctgggttcaagcgattctcctgtctcagtctcctgagtagctgggattacaggtgaaggtcaccatgctgagctcatttttgtgcctttaatagagatggggtttcgccatattggtcaggctggtcttgaactcctgatctcaggtgatccacccacctcagcctcccaaagtgctgggattacaggcatgaaccaccacaaccggccaaa

SEQ ID NO: 190086 - DNA, 601 bp, Human
ggcatggtggctcacacctgtagtccctgctgcttgggaggctgaggtgggaggatcacttgagcccagaaggttgaggctgtggtgagctatgatcgcaccactgcactccagcctgggagacaaagcaagaccctgcctctttaaaagaaaatgataatgaatttactattcattaagttgaagtggatcatcataaaggtcttcatcccactgtcctcatgtcgctgaggaagaggggttggtcttgctgtcttgggtggaagaggtggaggaggtagaaagggaggcaggaaaggasgagaggcaagcacggtgtaactttagggaaatacatcataatttgtctgactttttgccttttgatttctctaaaaatagttgtgtgcagcatcaacccttccactgcttgctttagtttcagtgcttatatcatagaagactccaggtcgtaaaagaagtcaaaagcagccttgaataatcagaagccttctcccagactgtctaatggaaatctgttttccagcccggcttctcctaggtcttcttcctcaacgtctggcactggtttggaagcacttctctccattaagctgtctta

SEQ ID NO: 190087 - DNA, 601 bp, Human
tttctagacttagaatatctgacctgatgcaaatcgctatgtggccagtatgccacagaatgtcctaaacccttgctgcctcttatcaaaaccatgttgcacatctcatcatatagtacagctaacccttgaacagtgggggggttagggacactgacccccgactgctgtgcagtcgaaaatccacataaaacttctgactccttcaaaacttaagcactaatagcctactattcatgggaagccttacccatcacagttgattaacacgttttgtatggtctgtatattatatgctatrttcttacaataaacttgagaaaatgttaagaaaataataaggatgctgggcatggtggctcacacctgtagtccctgctgcttgggaggctgaggtgggaggatcacttgagcccagaaggttgaggctgtggtgagctatgatcgcaccactgcactccagcctgggagacaaagcaagaccctgcctctttaaaagaaaatgataatgaatttactattcattaagttgaagtggatcatcataaaggtcttcatcccactgtcctcatgtcgctgaggaagaggggttggtcttgct

SEQ ID NO: 190088 - DNA, 601 bp, Human
gaaagggtgttttcaagaagaacatcacattttcagtctgtctctaagatgcttactactgaaaagggtttaagtgcaaactatgttaaaaaagtaaccaaagagtcattcctggtatttgattatgacacttctgaagctagaagggacctcagaccacctgctccaatccctgctgcctaaggttttgggggctgagggctggaaacccaggagctgcatctcccaggctcttggcctcataatcgccttctgtgagactgagggcaattaagatatgaatgacatgaactcgcttctytccatatcaacataaaccagaagaggcatacatctgtgggatagtcaatacataacatcctatctttatatggccatatgagaagataacttcagtgtccctatgatggtaagttcttgaatgtgagggcaagatggctgtgatagccatgactccccgctttgcctggttggacagaacccccttccccaaatgctcacagtcccccccttgagctgtgtctcactcagagaccctaaattttgcagacgaacaagggcatctttgcgttgcttcatctctgctcctcctctagaacta

SEQ ID NO: 190089 - DNA, 601 bp, Human
ggaaaacagcggctttttctttactgcttccctcttttaactgaaaaatcgcaatatctacccagctatctataagggttgcgttgacagcattatgcttctggccaaacagagagaacaagaaacgtgcaatgttcccttcgccttcgatggggcacatcgtctggatgctgaatttcatctgcgtcttcggcactgaaaagaaaaaacacgccaggtagcatcaccagagcagccctgagggaagtactcgcacagtggggaaggggacagtcaccaaacaccacagactgatgacatkggaaagggtgttttcaagaagaacatcacattttcagtctgtctctaagatgcttactactgaaaagggtttaagtgcaaactatgttaaaaaagtaaccaaagagtcattcctggtatttgattatgacacttctgaagctagaagggacctcagaccacctgctccaatccctgctgcctaaggttttgggggctgagggctggaaacccaggagctgcatctcccaggctcttggcctcataatcgccttctgtgagactgagggcaattaagatatgaatgacatgaactcgcttc

SEQ ID NO: 190090 - DNA, 601 bp, Human
cagaggcagcgatctgatgaattggtttttgaatcccagaaagggtctgccatggagttggcagtcatcacggtagatggcgtatgattttgctgaattttaaataaaatgaaaaccataaattacatgatgcttttattgacacttgacaactggcctaaataaaaagactctgactctaatacaagtccccttactgataataggcatgaaagagcaccattcttaaaatctaaaccctttaaaatcagttacggcaattcacttaaggagcttgagggccgtgttaaaaggagccagrttttcacaagacctcatccacctctgcacattggctggcactgtcacactgcagcctccgatctgctggagtacagaccacagcaccacgtctgctacggtgagttcattcccagcgagccaagggctcttcccaagagcagagttcatggagcggaaaacagcggctttttctttactgcttccctcttttaactgaaaaatcgcaatatctacccagctatctataagggttgcgttgacagcattatgcttctggccaaacagagagaacaagaaacgtgcaatgttcccttcgcct

SEQ ID NO: 190091 - DNA, 601 bp, Human
cagcttctccttaatgtcacgcacgatttcccgctcggccgtggtggtgaagctgtagccgcgctcggtgaggatcttcatgaggtagtcagtcaggtcccggccagccaggtccagacgcaggatggcatgggggagggcatacccctcgtagatgggcacagtgtgggtgaccccgtcaccggagtccatcacgatgccagtggtacggccagaggcgtacagggatagcacagcctggatagcaacgtacatggctggggtgttgaaggtctcaaacatgatctgtaaggcagagatrcaccatgtcacactggggaagccactggggacagccaggccagacgggggacatgcagaaagtgcaaagaacacggctaagtgtgctggggtcttgggatggggagtctgttcagacctactgtgcgcctacttaatacacactccaaggccgctttacaccagcctcatggccttgtcacacgagccagtgttagtacctacacccacaacactgtcttagacacctagtcagagagacaaacaccagaaaaagagctcatctgggaaaaagcaaatagaacctgcagagttccaaagg

SEQ ID NO: 190092 - DNA, 601 bp, Human
tccagaaattagccctatatgcaagtccagctcttttctcattgttctgagtttattcttccaagtttcaaagcaatgcattaatgacttcaaaaatgacttcaaataaatttgcccataggcatttttctgtttttaaacaagtacttcttcagattacatgagtcaataggaatctgaaatttccctaagaattaatggtaccaaaactaatctgtatcaccaccgggaaaagtgctggcttgggattcaggagacctgcattctagccctatctctgccactgaccatccccagaatstgaggttatgtgactagacaagctaagatcccaaccagttctagaattctacaatttgcaagatttggaaactgacatctagatatatagatatatctacatacacagacaccaaagtaatcgccctggtggtaggagaatcaagtgaaaaatcacaaagtgatgggaagaaagaaaggaaagaaaaacaacatttgtctctcctattgcatgacttagcattgacagttatcagtcctacctttttcactgtgtccttcagcttttgcacattcctctggatatgcaggtcatcacctt

SEQ ID NO: 190093 - DNA, 601 bp, Human
acttgctttagttaatagaaaaccagatataggtcctaacattcattctttctctctccaagtcaaatgcagatgaggatcccaaacttaatcgaagaggaaacccaaattcaagtgaaaagcattccctactgaaattcctctaatctatcatatttgcattatttcaagaaaaaccttgtcaccattgtcctctatataatacatggttcttccttttcctgctttcttccgccctttcacctttccatacttcttttgacataaggccaaaaagatattcttttctatctcaaagacyccaagactataaagaattttaaagtttatcgtcccctactgtctgtcatgcattttactaccaacctgcgttctgcttttacccccaacgagagggaattaatgcctcccaaaaccaccctatttcagacagctctgacagtttctcctcctgttgatctttctctgaacaacattgctctccctcctgtgctttctgaagctaccagcaaaaaagcataatcactcttccacatggcaacccattgcaaatatgaaattgattctttcaaaatggattaaaggtcttgaaaatcacaca

SEQ ID NO: 190094 - DNA, 601 bp, Human
tgttcttttagcttttttatttcccaatataaccattaaattgcaatgtcacaaatgagctcaacaaagctgatactccaaaggtcccaaaaactatagtaagctaaagaaagtattttcaagctaggctaaaaaatacaaaaacaaaaaacagcaaagccaccccactataaaatactgccccccaatggtacaggtttctattacatctactgtgccttcctgtagggtattattatacgagctttaaaagatagttccaaacatgtgcgagtgtgtgtgtgtgtgtgtgtgtgtgtgwgatttgattttgtgttgtaagaataaaatcaattgtgaatgtctgaatattattatgacagctataattataacagctaagttttaaacaaataatgaaatatttaaaatgtaaaaacttttcattaaccatcaataaaattttaaaagaaactcaaaaaattcacttaaaatttttaaacattccttagccagaatcataattcttccaaaatcccagtgagcaacgaagttccggaatacttcacaagtaatatagatagagaagcagaatgttgaaatcactttttggagaaaatca

SEQ ID NO: 190095 - DNA, 601 bp, Human
gacattcatgtcttccttgatggtctccacactcttttggatgctctggtcatctttaaagtttttaaaaagtttgaagtaaaaggagacaatttggctctgcattatttttctgtcactctccttggaaggaaagagcacaaacagaggatgatgtgaatttatccatcagaaagcaagcaacaggaaaattagccaaatgggaatattcagcttacctctttccaattcttcaaaatgcctaagaaaagagttccattatccgctacatctgaatgacctgcattctaaaaaaaaaaaagaaaaaattggtttacaattagcccataaattgccttaaaaatatatttcaagtttcattgaactcagatgtgacaatattcactgatttccttttcaactcttctgcttagttctaacaataagtattcccaaaaggcttatgtgagatatagacaaagactattatgttcttttagcttttttatttcccaatataaccattaaattgcaatgtcacaaatgagctcaacaaagctgatactccaaaggtcccaaaaactatagtaagctaaagaaagtattttcaagctaggctaaa

SEQ ID NO: 190096 - DNA, 601 bp, Human
tgtagctttcttctatctcattctcattttctattctttgcattgtagagttttggagcaaagaaggtcatcaaacttatacagtgaacctaacagtttccttttaagatgaggaaactgagccccagccagccatgtgattcatcacagttccttggtggctgagttgggaggagaacacacatcttctcagctcctcccactgctctttccattaagacagacagcctctcattcaaagtaagagaatttccatcatatgagcaagggacaatgagagaactgcttctcagtactcccygcttcttcctcacctacttcctcttcactggatttgtcaactcacctgtctttacgcaatagttacaatgccagcatttctctacattacatacttcagcgattctcttactggctttgcaaagtcacccaaacacgaatggaaatagtaaggtagagtttcagccatgagttgagttcatagctttagcaactgttaaatagctaatgtctactttctggagaataaatgctttgcaagaccctcggcaatgaaaccaaagaaagaatttaaatagcctcaccgaataattagtcagct

SEQ ID NO: 190097 - DNA, 601 bp, Human
ggtaagacttaggagtctaaggagttctccagctgagatattctgaaagttgatagagagttgatagaacaatcttttcataaggtataaattctatctatttttccctaaaaacaaacaaacagcaaccattcttgcttctaattgggcagtacaatctgataggttggctagagacttgcagtggggtgtccctggtacctattcaaagactgtagctttcttctatctcattctcattttctattctttgcattgtagagttttggagcaaagaaggtcatcaaacttatacagtgarcctaacagtttccttttaagatgaggaaactgagccccagccagccatgtgattcatcacagttccttggtggctgagttgggaggagaacacacatcttctcagctcctcccactgctctttccattaagacagacagcctctcattcaaagtaagagaatttccatcatatgagcaagggacaatgagagaactgcttctcagtactccctgcttcttcctcacctacttcctcttcactggatttgtcaactcacctgtctttacgcaatagttacaatgccagcatttctctacat

SEQ ID NO: 190098 - DNA, 601 bp, Human; identical to SEQ ID NO: 30051

SEQ ID NO: 190099 - DNA, 601 bp, Human; identical to SEQ ID NO: 30052

SEQ ID NO: 190100 - DNA, 601 bp, Human; identical to SEQ ID NO: 30053

SEQ ID NO: 190101 - DNA, 601 bp, Human
atgtttgtcctcttcaaatctcatgttgaaatgtgctttccaatttggagatgagggggccctggtgggaggtgactggattatggaggtgggtccttcatgaatggtttggcaccatccccttggtgatacgtgaattcttgctctgagatctggttgtttgagggtgtggcagctccccacttgctctcttgctcccgttcttgccatgtgacatgctggctccctgttgccctctgccatgattgtaagctccttgaggcctctccagaagcggatgccagcaccacacttcctgggragcctgcaaaaccatgagccaatcaaagctcttttctttataaattacccagtctcagatattcctttataacaatgtaagaaatgaccagtgcagactggaaggagctccagttaaatggccttggccctatatcaaaagatagatgataaatgtacacttacagattttattttaaatagaagcaattaagatatgggcatagctcccctctccccatatgctttgatcaagtgtttaaagtatgtttccaaccactggtcttggcctggtcagagggtgttttgtttaagtggccaa

SEQ ID NO: 190102 - DNA, 601 bp, Human
aaatctgagtgtgccatgtaatcccctacagggcttgctaagacccagcatgctggatctacaccgacttttgattcaggaggtctggggtggggcctgggaacttgcattttaacaagttccacatgatgctgatcctgttggtccagggaccacacttggagaactctctagctactgagtggaaccactgaaggtctaagggttgcaggtaggaagtgacatgtagatcagatgacaatcactaggatacagctgaccactaaataggagattgacgccgagactattctcttcaaaygcctgagagtatcatcaggaccaaatgaaatggaggagtgttctttcaaagtgtggtgacttcaggaccctggagtttctggtgaatcaggttatgataccttagaaagtgcatgtggcaggtctaccctctgcttctgcaggtgcaactgataaactccatggtgacacagtatgtgctattctttgagaaggaacacttgggctgggcatggtggctcatgcctgtaatcccagcactttgggaggccgaggtggggcagatcacctgaggtcgagtgttcgagaccagcctgaccaa

SEQ ID NO: 190103 - DNA, 601 bp, Human
tcagggtagacttggggttgaggttacaatggtgggtgggggatctgattagagatggtctcttacagggacttcattctagagcagtgagtctcaaatctgagtgtgccatgtaatcccctacagggcttgctaagacccagcatgctggatctacaccgacttttgattcaggaggtctggggtggggcctgggaacttgcattttaacaagttccacatgatgctgatcctgttggtccagggaccacacttggagaactctctagctactgagtggaaccactgaaggtctaagggktgcaggtaggaagtgacatgtagatcagatgacaatcactaggatacagctgaccactaaataggagattgacgccgagactattctcttcaaatgcctgagagtatcatcaggaccaaatgaaatggaggagtgttctttcaaagtgtggtgacttcaggaccctggagtttctggtgaatcaggttatgataccttagaaagtgcatgtggcaggtctaccctctgcttctgcaggtgcaactgataaactccatggtgacacagtatgtgctattctttgagaaggaacacttgggc

SEQ ID NO: 190104 - DNA, 601 bp, Human
taattacagaaatacaaaaatgcaaattaaataagcaatgagttaatacagtaccactagtagactggcaatcaagaaagtggacagggcccattgctgggtggggtttggggctttacgactgcagtctggcatatgcaatctggcgtatgtggtcaaatcaagcttatgtgtgaatgccctatgacctagaaataccactctgggcatgcatcccagagaaatagtgatggaggtctgtgaagaaactgactcatataaggatgttccctgaggcaccctgtggggaggtggggctttrgaggcactcaccttataaagacctctggtcttgcccagggatgctccctctgggacttacacagcaggttgctacagccacatggtgtaaagctaatccattaaattcaaagccgtgaaaaaagtaagtagacttttttgaaacagccaaatctgacacgaggaaaggtgaccaacaattctagctttcctgaggaaagaaggattcctgtaatatagattacagtgatttcattcctttccccaacacactgccagaactgcccatctgtgaaacagatcaggaaacttgacatccctt

SEQ ID NO: 190105 - DNA, 601 bp, Human
acagcaccactgcccattaaccactgacttgaaatgagataaacatgactcccctgcagcatcccagagagggctcatctggccttggagtgtaaggctgtgatgagcagagtagtggctctggaggctgtcgcctaaagtttccaaagccactgccaaaaatagagatgtcacctcagctcctggactcaaccctgaaaacagcacccctatatgcatatcctatttcaaaatcctgtacctcttacctgggggttcagttcttactgtgcccctcattctgggatggaaaatgaggagtttttttttttttttttggagatggagtttcattcttgttgtccaggctggagtgcagtggcacagtctcagctcactgcaacctccgcctcccaggttcatgccattctccttccccagcctcctgagtagctgggactacaggcgcccaccaccacgcctggctaattttttctattttttagtagagacggggtttcaccgtgttagccaggatggtcttgatctcctgacctcgtgatctgcccacctcggcctcccaaagtgctgggattacaggcatgagccaccgcgcccagct

SEQ ID NO: 190106 - DNA, 601 bp, Human
cttcccttcagctgagtcacttcagagggcagggctcctttgttggagacagcaccactgcccattaaccactgacttgaaatgagataaacatgactcccctgcagcatcccagagagggctcatctggccttggagtgtaaggctgtgatgagcagagtagtggctctggaggctgtcgcctaaagtttccaaagccactgccaaaaatagagatgtcacctcagctcctggactcaaccctgaaaacagcacccctatatgcatatcctatttcaaaatcctgtacctcttacctggkggttcagttcttactgtgcccctcattctgggatggaaaatgaggagtttttttttttttttttggagatggagtttcattcttgttgtccaggctggagtgcagtggcacagtctcagctcactgcaacctccgcctcccaggttcatgccattctccttccccagcctcctgagtagctgggactacaggcgcccaccaccacgcctggctaattttttctattttttagtagagacggggtttcaccgtgttagccaggatggtcttgatctcctgacctcgtgatctgcccacctc

SEQ ID NO: 190107 - DNA, 601 bp, Human
agttgtcagagaactatcatgtgagaatcattcagggttcagaattttagaaatggaagaagcagtattccacttcgaggtttttaaggacatttagtctcagtaaatcgatggggagcagagacattcaggaatggagactacagagcctccagtgttgacatgggtttgccacagaatctgggcaaatgagtgaactgtgggagagggtgggaccatgaatgctgtagcggtcagacatcaagcttaatacccaagagatgactttcgtggttttgaaaattggatttgccagtaaatktgctgagtctcaactgctctccacacattctggtgagtgcaggaacgcatgagctctgcttcccttcagctgagtcacttcagagggcagggctcctttgttggagacagcaccactgcccattaaccactgacttgaaatgagataaacatgactcccctgcagcatcccagagagggctcatctggccttggagtgtaaggctgtgatgagcagagtagtggctctggaggctgtcgcctaaagtttccaaagccactgccaaaaatagagatgtcacctcagctcctggactcaacc

SEQ ID NO: 190108 - DNA, 601 bp, Human
aactgggtaaaatttaccttatctaaaaccaaacctttttggttttaagtagataattttacatacacagacaagctatagatagcaccattaaatgtctctgctgaatttactatgacagcaaaacttacaagtttttcgatgaaaagttgccctctattaaagaagttttttgaagtttcacagtagctacattaagttagattattatagaatggtccctatggatatacaggacttattaactaaacatacagttagcctgcactattaaagagtgtctaaagtctcgtgaccctgyggcaaatattcaaagaaaagatccaatacaatttctaaaatttgtgttttaaggagtacagataagccctattttcccaactaaaggaaaacaattcctaaataagtgtagatttataagtatcagtcatcaggtcatttatttcaagcaatactcaatataaacaaattctgctacaacatgagattttaattgctccccttgattgcttggcacaggatttgatctgagttgtcagagaactatcatgtgagaatcattcagggttcagaattttagaaatggaagaagcagtattcc

SEQ ID NO: 190109 - DNA, 601 bp, Human
atgtaaagtgctgcagataggccgggcatggtggctcacgcctgtaatcccagcactttgggaggccaaggggggtggatcaccggaggtcaggagttgaagaccagcctggacaacatggtgaaaccccatctctattaaaaatataaaaattagctgggtgtggtggcacacgcctgtaatctcagatactctggaggctgaagcaggagaatcgcttgaacccaggagacagacgttgcagtgaaccaagattgcaccaccacacactggacagagggagactctgtctcaaaaaaacaaacaaacaaacaaaaaaactacagataaatcaagaaggataagaagcaagatctggttagggtttttggtgatctgggtggtccctttatgtacatagagtagaagccaaataggaagagttggaggttgaggcaatgtgtatagaatctacttttgaaaagtagacagaataaggaaaaagagggggtgatgggtctatgaagaaactggtcaacagaactctgatcttgacgatctttataggacaagagaaggaactggttgacggagattctcaaggtgggaaggatactgatgg

SEQ ID NO: 190110 - DNA, 601 bp, Human
aaacttctatgtctgatagcatttgaccctattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgacccttacatccagcggtgagtttgaatgtgacataacttctctcaaaacttaattgaagtgccttgtgtattatgaatgtgtcagctgtgtacaaagaacaattcctccttgtttagtcarcacagtgatattattttggactttctgtggacttaaagtggtctgtggacatattttctgaatgtcttttttggttgatatttggatctacaaagtgaaaaaatttgaagcgaatcttcccatttaaaaaaaattatcacgccatttaagaatgtttaaaatatattatttgccttgttcagcacctactcactcaataagaaatttcactgggcagggatataataatgtatggataatcttcaagtcaaaataaacaccaaataattctgatttatacattaagaaatagataactag

SEQ ID NO: 190111 - DNA, 601 bp, Human
tattgcttttagcctcccggctttatatctatatatacacaggtatatgtgtatattttatataattgttctccgttcgttgatatcaaagacagttgaaggaaatgaattttgaaacttcacggtgtgccaccctacagtactgccctgacccttacatccagcggtgagtttgaatgtgacataacttctctcaaaacttaattgaagtgccttgtgtattatgaatgtgtcagctgtgtacaaagaacaattcctccttgtttagtcagcacagtgatattattttggactttctgtrgacttaaagtggtctgtggacatattttctgaatgtcttttttggttgatatttggatctacaaagtgaaaaaatttgaagcgaatcttcccatttaaaaaaaattatcacgccatttaagaatgtttaaaatatattatttgccttgttcagcacctactcactcaataagaaatttcactgggcagggatataataatgtatggataatcttcaagtcaaaataaacaccaaataattctgatttatacattaagaaatagataactagccattgttgtaccaaacagattgtggctt

SEQ ID NO: 190112 - DNA, 601 bp, Human
tacaaagaacaattcctccttgtttagtcagcacagtgatattattttggactttctgtggacttaaagtggtctgtggacatattttctgaatgtcttttttggttgatatttggatctacaaagtgaaaaaatttgaagcgaatcttcccatttaaaaaaaattatcacgccatttaagaatgtttaaaatatattatttgccttgttcagcacctactcactcaataagaaatttcactgggcagggatataataatgtatggataatcttcaagtcaaaataaacaccaaataattytgatttatacattaagaaatagataactagccattgttgtaccaaacagattgtggcttgtcattgcattttataaggaatattttttggtatgtttgataatgaaatcttttgacaaatctgacttttaaagcttgtgattgtagtaaattttatttagaaacatttgcctagtactaagagagaatattagtgagggtgcacaattgtgtatgtgcttcaaattagactttgctatttttaaactggtaaatgaaatctgaacagtgtttttccagtcataaagttatgggagatatt

SEQ ID NO: 190113 - DNA, 601 bp, Human
ttgatatttggatctacaaagtgaaaaaatttgaagcgaatcttcccatttaaaaaaaattatcacgccatttaagaatgtttaaaatatattatttgccttgttcagcacctactcactcaataagaaatttcactgggcagggatataataatgtatggataatcttcaagtcaaaataaacaccaaataattctgatttatacattaagaaatagataactagccattgttgtaccaaacagattgtggcttgtcattgcattttataaggaatattttttggtatgtttgataatgaaatcttttgacaaatctgacttttaaagcttgtgattgtagtaaattttatttagaaacatttgcctagtactaagagagaatattagtgagggtgcacaattgtgtatgtgcttcaaattagactttgctatttttaaactggtaaatgaaatctgaacagtgtttttccagtcataaagttatgggagatattcaagtcatatgtagcaatgtgatgttagtttaacagcatgagatttcgtactttattttataagactaatgagagaggtcctttgcgtgttgaaaatggtgaggt

SEQ ID NO: 190114 - DNA, 601 bp, Human
aaattagactttgctatttttaaactggtaaatgaaatctgaacagtgtttttccagtcataaagttatgggagatattcaagtcatatgtagcaatgtgatgttagtttaacagcatgagatttcgtactttattttataagactaatgagagaggtcctttgcgtgttgaaaatggtgaggttacaaagggttaacttgccatttaccacctgtgtctgttggagcttgatactagaagcagattctgctctctctgggcaggactcacttactgtagactagtagagtgtgaaagatktgtgatcttcctttaacgtgatttgctacaacgtagaacactaatgtgagctatgtagattgtttctcttcctgtgaggtttctggtgggttgtgcgaaaaggcagaagagaaagagcaaggcagaaagataaatagaataaaggagataaaaagaaaagggtgaaaaaagagagaggggaagcaagtttggggtctccaaggtttcagtggaatttgttggtggtggcttgattcgtgtcttgctgtttaccacaaacaacaatattagcacaaataaatggctctaggatttatgttc

SEQ ID NO: 190115 - DNA, 601 bp, Human
ctgttggagcttgatactagaagcagattctgctctctctgggcaggactcacttactgtagactagtagagtgtgaaagatttgtgatcttcctttaacgtgatttgctacaacgtagaacactaatgtgagctatgtagattgtttctcttcctgtgaggtttctggtgggttgtgcgaaaaggcagaagagaaagagcaaggcagaaagataaatagaataaaggagataaaaagaaaagggtgaaaaaagagagaggggaagcaagtttggggtctccaaggtttcagtggaatttrttggtggtggcttgattcgtgtcttgctgtttaccacaaacaacaatattagcacaaataaatggctctaggatttatgttcttgtataatgtgaaaattagatctagctgcagttgaggattgggttgattaaaaagaaaaacaccaaagattttctggttctcaaaattgtttctaatctcaaaattatctattccattaaacatctttggaaataatagttctaagaagataattgtgatgaaatagtaactgtgtaatgctactcttgagggcatctctcctaaactaggtacttg

SEQ ID NO: 190116 - DNA, 601 bp, Human
gaggtttctggtgggttgtgcgaaaaggcagaagagaaagagcaaggcagaaagataaatagaataaaggagataaaaagaaaagggtgaaaaaagagagaggggaagcaagtttggggtctccaaggtttcagtggaatttgttggtggtggcttgattcgtgtcttgctgtttaccacaaacaacaatattagcacaaataaatggctctaggatttatgttcttgtataatgtgaaaattagatctagctgcagttgaggattgggttgattaaaaagaaaaacaccaaagattttckggttctcaaaattgtttctaatctcaaaattatctattccattaaacatctttggaaataatagttctaagaagataattgtgatgaaatagtaactgtgtaatgctactcttgagggcatctctcctaaactaggtacttggaaccagggaagctttagaagaaacttccttctattgactaataacccacacttcaatcctgcatacatacctctctagaagcatttctaatgataagagaggcctataaatataaagaaatagagaaactactttttatattaccttgacgatctat

SEQ ID NO: 190117 - DNA, 601 bp, Human
gcagaaagataaatagaataaaggagataaaaagaaaagggtgaaaaaagagagaggggaagcaagtttggggtctccaaggtttcagtggaatttgttggtggtggcttgattcgtgtcttgctgtttaccacaaacaacaatattagcacaaataaatggctctaggatttatgttcttgtataatgtgaaaattagatctagctgcagttgaggattgggttgattaaaaagaaaaacaccaaagattttctggttctcaaaattgtttctaatctcaaaattatctattccattaarcatctttggaaataatagttctaagaagataattgtgatgaaatagtaactgtgtaatgctactcttgagggcatctctcctaaactaggtacttggaaccagggaagctttagaagaaacttccttctattgactaataacccacacttcaatcctgcatacatacctctctagaagcatttctaatgataagagaggcctataaatataaagaaatagagaaactactttttatattaccttgacgatctattagttcatgaagcaaatgtcatctcagtttttgacatactgtaata

SEQ ID NO: 190118 - DNA, 601 bp, Human
aaaataaaccagttaaaatgataaacatgaatcaaaattaaattttgaaattatgtgatcactgagggctaagaattagagaaaagtaaacatcatttcaatttgaaccaccagtaaaatattttgtattgtttcttcttagtcatcctgtattccaaagaagcatcgaactattaaaatactatatggataatatgaagtgtgttttttgtgtgtgaattacatatttgttatgatttttattctttactggcgtaaaggtcaactttattagctgtactttctaaatatatcccaaaargaagagtgatgacaatgaagttacagtggaagatcatttcatttgtaagttaaaatcacctaaaggcagatgcagctctgtgttgggcgtccttcacttgctcctccacatctgctctttttctttctcattctttgcctcaagaagctgcctcctgataattgctttaacaggtcttttcttctctggtttcctgttgaattcaaccagcagcaatctcctgcaggagagtgaagttggaatattggtttccctggctgactccctgttggtttttggctaaaggctgcagatcctctc

SEQ ID NO: 190119 - DNA, 601 bp, Human
aacatcatttcaatttgaaccaccagtaaaatattttgtattgtttcttcttagtcatcctgtattccaaagaagcatcgaactattaaaatactatatggataatatgaagtgtgttttttgtgtgtgaattacatatttgttatgatttttattctttactggcgtaaaggtcaactttattagctgtactttctaaatatatcccaaaaggaagagtgatgacaatgaagttacagtggaagatcatttcatttgtaagttaaaatcacctaaaggcagatgcagctctgtgttgggygtccttcacttgctcctccacatctgctctttttctttctcattctttgcctcaagaagctgcctcctgataattgctttaacaggtcttttcttctctggtttcctgttgaattcaaccagcagcaatctcctgcaggagagtgaagttggaatattggtttccctggctgactccctgttggtttttggctaaaggctgcagatcctctcagaggcccttgctgcaggtccgagtcccctgactttgagtagttactccctccccttccttttcttcaagcttaggaggagtaaccat

SEQ ID NO: 190120 - DNA, 601 bp, Human
accagtaaaatattttgtattgtttcttcttagtcatcctgtattccaaagaagcatcgaactattaaaatactatatggataatatgaagtgtgttttttgtgtgtgaattacatatttgttatgatttttattctttactggcgtaaaggtcaactttattagctgtactttctaaatatatcccaaaaggaagagtgatgacaatgaagttacagtggaagatcatttcatttgtaagttaaaatcacctaaaggcagatgcagctctgtgttgggcgtccttcacttgctcctccayatctgctctttttctttctcattctttgcctcaagaagctgcctcctgataattgctttaacaggtcttttcttctctggtttcctgttgaattcaaccagcagcaatctcctgcaggagagtgaagttggaatattggtttccctggctgactccctgttggtttttggctaaaggctgcagatcctctcagaggcccttgctgcaggtccgagtcccctgactttgagtagttactccctccccttccttttcttcaagcttaggaggagtaaccatttcccgccattgctaattcta

SEQ ID NO: 190121 - DNA, 601 bp, Human
ccaaccgtggttagccaaaagcacaatgccgctctattaccatgcgctgcatctaagcggtgagtgcatttaaatagcagagagtcatcttagcagagtgcacaaaggatttgcaaaagatctcaattgtagtaagtaaactccaccactaagtgattatgtgaccttcatgaaatcacttaagctatctaaatcaaagttcctcatgagttaagtagggataaaaacctctcatttactgttcacaactagaactttgagaaataaactcaactcaactctgaaatacacccctttagtgtacggtaagttctcacttaacattactgataggttcttggagattgtgattttaagcaaaaccgtatgtaactaacgaaaccaattttaccataggctaattgatataaacaacagttaagtttctatggcatatttcgggtcacaaaaccgccaccaatcttctaaatatagacccacaagatttctaatattaaacattgagataaatgtgagctacacatgtatttaagaaagattaatacaaggaagtaagataattatttgcccaatttttggtgaatcagtgagtgatggtcat

SEQ ID NO: 190122 - DNA, 601 bp, Human
ctaattgatataaacaacagttaagtttctatggcatatttcgggtcacaaaaccgccaccaatcttctaaatatagacccacaagatttctaatattaaacattgagataaatgtgagctacacatgtatttaagaaagattaatacaaggaagtaagataattatttgcccaatttttggtgaatcagtgagtgatggtcatagtggtagtacgttaaatcaaggaataaatctttgcaaagcaaaaattgtaaggagcacctcttaccaccacacagttcaaaatcaaatgaaaatayagcaggcttactgagcactttttgactgcatcgtttatcatcatgtattttatgattatcatagactttgtgaatttttattttacaataatgtatattcattcctttaattattttccaacctgcttattccagttcagggtctcagggccagagcctatctcagcagctcagggtggaaggtagaaaccaaccctggactggatgctattgcactgcaggacacacacacacacactcacaatggggcaatttagacacaccaatgaacctaatgtgcatatctttgaaatgtgggag

SEQ ID NO: 190123 - DNA, 601 bp, Human
atttctaatattaaacattgagataaatgtgagctacacatgtatttaagaaagattaatacaaggaagtaagataattatttgcccaatttttggtgaatcagtgagtgatggtcatagtggtagtacgttaaatcaaggaataaatctttgcaaagcaaaaattgtaaggagcacctcttaccaccacacagttcaaaatcaaatgaaaatatagcaggcttactgagcactttttgactgcatcgtttatcatcatgtattttatgattatcatagactttgtgaatttttattttayaataatgtatattcattcctttaattattttccaacctgcttattccagttcagggtctcagggccagagcctatctcagcagctcagggtggaaggtagaaaccaaccctggactggatgctattgcactgcaggacacacacacacacactcacaatggggcaatttagacacaccaatgaacctaatgtgcatatctttgaaatgtgggaggaaataggaatacctggaacatccatgtagacctggagagaacacaaaaactccacatagacagtgacctcagctgggaactgaat

SEQ ID NO: 190124 - DNA, 601 bp, Human
aaggaataaatctttgcaaagcaaaaattgtaaggagcacctcttaccaccacacagttcaaaatcaaatgaaaatatagcaggcttactgagcactttttgactgcatcgtttatcatcatgtattttatgattatcatagactttgtgaatttttattttacaataatgtatattcattcctttaattattttccaacctgcttattccagttcagggtctcagggccagagcctatctcagcagctcagggtggaaggtagaaaccaaccctggactggatgctattgcactgcaggccacacacacacacactcacaatggggcaatttagacacaccaatgaacctaatgtgcatatctttgaaatgtgggaggaaataggaatacctggaacatccatgtagacctggagagaacacaaaaactccacatagacagtgacctcagctgggaactgaattttttttttctcatcagcgttatatggaaaagacgttaaacaaaacatttttcatgacctgctgtattgttcagttctactattatattacgtgtatagtgtgccagtggactggagctgccttccaacaattgtgt

SEQ ID NO: 190125 - DNA, 601 bp, Human
agcaataggaaactaatccaccaaggtaagaattgttatccccaaattgtagatatggacactagaaaactgcgttttgttttgatgcgtttaactaaaccttcccatgaatttattatttttttatggtgccaagtggggaaggtagaatatatgagtgaaatacaatcctagacctcagggaatccaaggtaaaagtacttgtatagaaataatacaaggtacaaggtggggctgaaaaacactggacaagctagcccggggactgcagatgcaagcatctgctcttgaggcagtaaaytgaaacagtgattcttattactagtttctgttaaagttcctcaaactcttttacacagagatatatctgactcttagatggcagctctaaaattttgaaggccaaatttagatccaggaaacacaggaatgcacatactcacttctgatgttgtcagatattgagagggcttgggtggagccttggaaatgcactgtaaactgtaagacaattttgattcgggtggttatcagaccacacttggagaaataattctagactttttggtgttggaaggttctcagttaatttgggtttgag

SEQ ID NO: 190126 - DNA, 601 bp, Human
gaagaataaatgtaagggctcaaaatctcttgccactttcaaatttccagttcttttttctttcgtttcaaatgagtaaacctaatctgttaggttgaacagcaaacacccattctcaaattccattaactcaggcagatttttcataattgagggcaaaaccagcatcatcataatgttaagactgagaaagcattttgagtcaagaaatacaaaaccgaagctagcgtgattatttagtcagccatatggccggctagaaaaggtgtttaatctttttaaacagatgttgatttatcaygggaataaataatagaacatatacaggtttataatagtggactatgggaactctttcttttaaagtcaagtatattatgccttaagactgttgattgcatttaatttaaccctccatcaaatgctgacattttatcaatgtgttcaatttttacagcttccttaaaaacatcaaactttaaatattttatttgaaattcatcattagcttttctttcttctttattattttctggctcaaagaaacttctgtctttgcacttgaatttagtagtgtcatttacttcttaactacataaat

SEQ ID NO: 190127 - DNA, 601 bp, Human
agggctcaaaatctcttgccactttcaaatttccagttcttttttctttcgtttcaaatgagtaaacctaatctgttaggttgaacagcaaacacccattctcaaattccattaactcaggcagatttttcataattgagggcaaaaccagcatcatcataatgttaagactgagaaagcattttgagtcaagaaatacaaaaccgaagctagcgtgattatttagtcagccatatggccggctagaaaaggtgtttaatctttttaaacagatgttgatttatcatgggaataaataatrgaacatatacaggtttataatagtggactatgggaactctttcttttaaagtcaagtatattatgccttaagactgttgattgcatttaatttaaccctccatcaaatgctgacattttatcaatgtgttcaatttttacagcttccttaaaaacatcaaactttaaatattttatttgaaattcatcattagcttttctttcttctttattattttctggctcaaagaaacttctgtctttgcacttgaatttagtagtgtcatttacttcttaactacataaataatgaatatattat

SEQ ID NO: 190128 - DNA, 601 bp, Human
tccttaaaaacatcaaactttaaatattttatttgaaattcatcattagcttttctttcttctttattattttctggctcaaagaaacttctgtctttgcacttgaatttagtagtgtcatttacttcttaactacataaataatgaatatattattcattaaagctttcaatgaggaaatatgctttcttacaacttttccatgacactgcaactgcctctataaaaaaaattttcataagatgtatttttctattttacttttttccttttaacccttttgttatctcaggcaataaaygagacaaaatttttcaaactaaatgatgaacaatcaaaactgacgggttttctttcagcatcttaattgatactgtctaatatgataaatctttgtaccttcataagctcattttttagtaccctatagaggctgatgtggctgtaattgagaattctgcaacaaaatgtgaaatattaatgcacgatttatcttcaagttagtactgctgcaaatgtggtccattgtaaatgttgcagtcacactgacacactttttacagtcagatgttcaatcatttttttcttgctgaacaaaagg

SEQ ID NO: 190129 - DNA, 601 bp, Human
gtttgtagtttgaaagctacaaaactacttaatattgttctgcacatatttattaaatacttgatactggatatatgataagaaatttacaacttcaacatttttatgtatttgtttttactgtagcaaatttggttctgaaataatcttaattaagtgtgaggtaaaggaagatcttcgaagctcaggtagaaatataaatgtcagagcattttagatattctcaggtaaaacatactcagataaaagtaattgtgacttgctactacttatatttcaataagtatttattacacaaatraagtgtttctaataatcatgatgccaacaaagaaaaatttagtaaaacaattgttttccatgccatcttctaggttcataatttttttacaaacaagttataatcataaatagtttcaatgtcttattcattaataaataatctaatgagcactttccagttattatgtaagtgactgcatcagtatctcatcatatctatgtaatttactacatttattatttcccttatttttgaacatttggtttggttataatttttgttattaattaagaatgttatacaaccacctttcttttg

SEQ ID NO: 190130 - DNA, 601 bp, Human
gtattatttttaaatttcattaagttaatagatgtaagatgatatgtggttttgattagcactttttattaactaggacttccgtattaactacggaaaccacaattactaattttaaaagacctcaacgtttgattttgtatttttacaaaatgaaaatgagatatgaacagcgaaatatgtagtatttattgaattttaactatgttccaggaactgttccaagcactttacacatttaactctcaaaccacctttaaaggtagttactagtattatttctttctaaccaacagacaayagtataacgtttaagagactggattcgggggccaatgcgcataggttcaaaaatctcactctggcaaatgttatacctcctaacttaatctatatgtctattttttttttcatgtataaagaagagtgataatagtagtacctacctgattggattgccttaaaaattaaatgagttaattgtacaaatgacttaagacagagtctggcacacagtaagtactacaggatgataggtcttattatttatattttatatgaagaaatcgaagcagagagaggctgtgtaacctgtcctggg

SEQ ID NO: 190131 - DNA, 601 bp, Human
agcgaaatatgtagtatttattgaattttaactatgttccaggaactgttccaagcactttacacatttaactctcaaaccacctttaaaggtagttactagtattatttctttctaaccaacagacaatagtataacgtttaagagactggattcgggggccaatgcgcataggttcaaaaatctcactctggcaaatgttatacctcctaacttaatctatatgtctattttttttttcatgtataaagaagagtgataatagtagtacctacctgattggattgccttaaaaattaartgagttaattgtacaaatgacttaagacagagtctggcacacagtaagtactacaggatgataggtcttattatttatattttatatgaagaaatcgaagcagagagaggctgtgtaacctgtcctgggtaaaagagctggtagttatgggtaggattctgatttctatcacatgttctttaatagtaagtgccttaactttcagtaaattctatatagaaatgattttaaagcataaataaaacatgacagaaaactgcaaaaactaataatttaacattctagaaaaatggtctgagt

SEQ ID NO: 190132 - DNA, 601 bp, Human
tgggatcatagttgacccatggttactcaataatttcacgttttctgaaatctcaaccatcaaagtgatttactgacctttatgacaatacactgatcttcagaaagctctcctctgttacatggctccattttcctctttactgtggcatctcatctgccagttctttgggaactctattcccttttgattgccttcccacaatgttgtcttacagtccctctgccttttcagctcaagaagctcccatttccacttcaggtaccaatccacacaaatgccctgggttgttcatcattasctgaaattatcaggcccaaatcacacaatcttacactttcctttctggccactatctcctctctcatacccccagcttgcaccaagtcccttcccctctctcatacccccagcttgcaccaagtcccttcccctctctcatacccccagcttgcaccaagcctgttccttctgcacaccctcacaatcttccctgtgaaaatttattcccttcttcaaagtttgtcttaatttctatttatttcataatgtattttgtgcatattcacttatgagtttctgttcacctactagaccctac

SEQ ID NO: 190133 - DNA, 601 bp, Human
tccatatatcattcttatgcctttgagtccacatagcttagctcccacttacaagtaagaatataccatatttgattttccattcctgagttatttctcttaaaataatggtctccaattctacccaggttgctgcaaatgccattatttctttcctttttatggctgagtagtatcccattgtgtatatacaccacattttcttttttttttttttatggtgaaatggtacttttatattggaccctaccttttcccacccaattcagtttgagacagagcaacagaggcactgtaaggsactatggctgtcttcctcgatattcagacatcctagtttccaataatttgttatgtacctgttacccatgaatcgatataaacctattcatatttagggattagtttccacaagtactaagttgaatttccttttatttgtcctaaaatgcttactttcaaacttgaagggacttcaattattccatgtagttttcaataatattcttttatcttttcagaccagagtcaaaatattcgtacagtattcatactgcagcaccttccacacaccctttggtctcttgaactgcccttcttt

SEQ ID NO: 190134 - DNA, 601 bp, Human
gtagtatcccattgtgtatatacaccacattttcttttttttttttttatggtgaaatggtacttttatattggaccctaccttttcccacccaattcagtttgagacagagcaacagaggcactgtaagggactatggctgtcttcctcgatattcagacatcctagtttccaataatttgttatgtacctgttacccatgaatcgatataaacctattcatatttagggattagtttccacaagtactaagttgaatttccttttatttgtcctaaaatgcttactttcaaacttgaarggacttcaattattccatgtagttttcaataatattcttttatcttttcagaccagagtcaaaatattcgtacagtattcatactgcagcaccttccacacaccctttggtctcttgaactgcccttctttggttccttttccactttcagatctttcttgaagtctagtaagcagaactgtactgggtattccagctgcagtttggtctgtcattgttggaatgacttctgctactccatggtcttccagctggtctatttctaggattatatgatcttcttttttaaattttttttta

SEQ ID NO: 190135 - DNA, 601 bp, Human
aaacttgaagggacttcaattattccatgtagttttcaataatattcttttatcttttcagaccagagtcaaaatattcgtacagtattcatactgcagcaccttccacacaccctttggtctcttgaactgcccttctttggttccttttccactttcagatctttcttgaagtctagtaagcagaactgtactgggtattccagctgcagtttggtctgtcattgttggaatgacttctgctactccatggtcttccagctggtctatttctaggattatatgatcttcttttttaaatttttttttattttttattgtgttttttaatttttttattatttattttattatactttaagttctagggtacatgtgcacaacgtgcaggtttgttacatatgtatacatgtgacatgttggtgtgctgcacccattaacttgtcatttagcgttaggtatataggaaatactatccctccccactcccccaccccacgacaggctccagtgtgtgatgttccctgccctgtgtccatgtgttctcattgttcaattcccacctatgagtgagaacatgcagtgtttggttttctgtcct

SEQ ID NO: 190136 - DNA, 601 bp, Human
gactgccctgttggatttcaaccttgcatggggcctatagctccattgttttggccaatttctcccatttgaaatgggtgtatttacccaatgcctgtacccttattgtatctaggaagtaactagcttgcttttaattttacaggctcataggcagaagggacttgccttgtctcagatgagactttgggcttggacttttgggttaatgctagaatgagttaagactttggaggactgttgaaaagtcatgattgtgttttgaattgtaagaacatgagattttggaggggcacagtgsagaatgatatggtttggctgtgtccctactcaaatgtcatcttgaattttagttcccataatccccacgtgtcatgggagggatcaggtggagataattgaatcatgggagcagtttcccccatcctgttctcatgatagtgagtttgttttcatgagatctgatggttttataaagggtttgccactttgctgggcgctcattcttctccttcctgtcaccatgtgaagaaagatatgtttgcttctcctactgccatgactgtaagtttcctgaggactcccagccatgtggaactga

SEQ ID NO: 190137 - DNA, 601 bp, Human
taggtttcattctatttttaacctgaaattaatccatctgtttgatgactttgtcaatcagatccagtgtttatatatttttcactcatgaggacaatcaatcttatttctcagtttctatgttgtaaccattatatgtcacaattataaactatgttatgtaattttcctagatttctactaagtagacttatctgctaatttcagctggttgtaccaaaacaagtgcagtctcttttcaaattttagtacctgcttttgctttttgttttaaattactctacttaaactaattttcctyatgtgtcagttgagtcaacctaaaactagacctttgtgaatatatggcactcaatctttcataaactgcaattgttaaccaaagattcagtcagtatttaattttcttaaagcttttctcacaaaccatatttaacttataataaaggtgcttgtctagttttccataatctttatatgtttaagggattaaatctaaacagatttcttactgtttgttatcttagcaccaaaccagtgttagagagaagcatcttgagtgtttcatggggtcctaagtgcttaggggagaaataattga

SEQ ID NO: 190138 - DNA, 601 bp, Human
attgcaatcattacaaataatcaaaatggcaggactcatggcagaatgaaaaaaatatatagattattaaactgaaatgtatgtgaaaaaatccattttcttccacaggctataggacaagaaaaccagtctggctttagattaactaattattttgtttactggctttgatattagaactaaagaagctcatgttactatttaggaattttactaaggagtaaaaaataaacacatttttgatgttatacttttattattgcattaattaattttaagaagtacttttcaatggaatctktgtggtagagatgtattaccaatgtttaccttgggatagcctggggttttcagatatgctaatgttataatggctttttacaaaaatatatttaaaaaccctaaaaaatgattaatggaatatgcaagctgaaaaaaatctattaattacaaagcccttttacatatgtatgaatgacccagttatgtagaaatttttgtgtgtgctgagtttcactcagatttcaacataaaatctcctggctcaactattttgccatgtcattttattttccattgtaacatgccctcaatgtaatgt

SEQ ID NO: 190139 - DNA, 601 bp, Human
acaaataatcaaaatggcaggactcatggcagaatgaaaaaaatatatagattattaaactgaaatgtatgtgaaaaaatccattttcttccacaggctataggacaagaaaaccagtctggctttagattaactaattattttgtttactggctttgatattagaactaaagaagctcatgttactatttaggaattttactaaggagtaaaaaataaacacatttttgatgttatacttttattattgcattaattaattttaagaagtacttttcaatggaatctttgtggtagagaygtattaccaatgtttaccttgggatagcctggggttttcagatatgctaatgttataatggctttttacaaaaatatatttaaaaaccctaaaaaatgattaatggaatatgcaagctgaaaaaaatctattaattacaaagcccttttacatatgtatgaatgacccagttatgtagaaatttttgtgtgtgctgagtttcactcagatttcaacataaaatctcctggctcaactattttgccatgtcattttattttccattgtaacatgccctcaatgtaatgtcttgttcaatgt

SEQ ID NO: 190140 - DNA, 601 bp, Human
ggctttgatattagaactaaagaagctcatgttactatttaggaattttactaaggagtaaaaaataaacacatttttgatgttatacttttattattgcattaattaattttaagaagtacttttcaatggaatctttgtggtagagatgtattaccaatgtttaccttgggatagcctggggttttcagatatgctaatgttataatggctttttacaaaaatatatttaaaaaccctaaaaaatgattaatggaatatgcaagctgaaaaaaatctattaattacaaagcccttttayatatgtatgaatgacccagttatgtagaaatttttgtgtgtgctgagtttcactcagatttcaacataaaatctcctggctcaactattttgccatgtcattttattttccattgtaacatgccctcaatgtaatgtcttgttcaatgtgttgagctggaagggattttaattaggttagaggagagaagccaaattttaggttttgcattccactgagaacacctggatggaaatatcacggaacagttcttgaactatataggactctgcagtgactactgcagtgctgttaagtctt

SEQ ID NO: 190141 - DNA, 601 bp, Human
tggactcacagaatttgggagaataaaaggaagactggagatcatttttgtttatttttagtctattggaacacaatgtaaatgaaaattgagatctctgcttctataaaagttttaaaaaattattttaggagacttcttggttagccctaaaatgcaaggagcttggaggttgtcactcctcttacgacaagaaaaagctggacaaatcaataactttttttgaacccaccagaaaacagagactgtaggatgaatggccacaaacaaatctggagagtgggcgtggtggctcacatcmctaatctcagcactttgggaggccgaggcgggtgcatcacctgaggtcaagagttcgaggccaggctggccaacatggcaaaaccccatctctactaaaaatacaaaaattagctgggcatggcacatgcctgtagtcccagctacttgggaggctgaggaaagagaattgcttgaacccaggaggtggaggttgcagtgaggcgagctcatgtcactggactccagcctgggcgacagagtgagactctgtctcaaaaaaaaagaaaaaataaaataaatctggagagacagatgcaca

SEQ ID NO: 190142 - DNA, 601 bp, Human
ggactcacagaatttgggagaataaaaggaagactggagatcatttttgtttatttttagtctattggaacacaatgtaaatgaaaattgagatctctgcttctataaaagttttaaaaaattattttaggagacttcttggttagccctaaaatgcaaggagcttggaggttgtcactcctcttacgacaagaaaaagctggacaaatcaataactttttttgaacccaccagaaaacagagactgtaggatgaatggccacaaacaaatctggagagtgggcgtggtggctcacatccstaatctcagcactttgggaggccgaggcgggtgcatcacctgaggtcaagagttcgaggccaggctggccaacatggcaaaaccccatctctactaaaaatacaaaaattagctgggcatggcacatgcctgtagtcccagctacttgggaggctgaggaaagagaattgcttgaacccaggaggtggaggttgcagtgaggcgagctcatgtcactggactccagcctgggcgacagagtgagactctgtctcaaaaaaaaagaaaaaataaaataaatctggagagacagatgcacat

SEQ ID NO: 190143 - DNA, 601 bp, Human
aagactggagatcatttttgtttatttttagtctattggaacacaatgtaaatgaaaattgagatctctgcttctataaaagttttaaaaaattattttaggagacttcttggttagccctaaaatgcaaggagcttggaggttgtcactcctcttacgacaagaaaaagctggacaaatcaataactttttttgaacccaccagaaaacagagactgtaggatgaatggccacaaacaaatctggagagtgggcgtggtggctcacatccctaatctcagcactttgggaggccgaggcrggtgcatcacctgaggtcaagagttcgaggccaggctggccaacatggcaaaaccccatctctactaaaaatacaaaaattagctgggcatggcacatgcctgtagtcccagctacttgggaggctgaggaaagagaattgcttgaacccaggaggtggaggttgcagtgaggcgagctcatgtcactggactccagcctgggcgacagagtgagactctgtctcaaaaaaaaagaaaaaataaaataaatctggagagacagatgcacatagagaaactgcttagctagaacagaagcc

SEQ ID NO: 190144 - DNA, 601 bp, Human
cctaaaatgcaaggagcttggaggttgtcactcctcttacgacaagaaaaagctggacaaatcaataactttttttgaacccaccagaaaacagagactgtaggatgaatggccacaaacaaatctggagagtgggcgtggtggctcacatccctaatctcagcactttgggaggccgaggcgggtgcatcacctgaggtcaagagttcgaggccaggctggccaacatggcaaaaccccatctctactaaaaatacaaaaattagctgggcatggcacatgcctgtagtcccagctactygggaggctgaggaaagagaattgcttgaacccaggaggtggaggttgcagtgaggcgagctcatgtcactggactccagcctgggcgacagagtgagactctgtctcaaaaaaaaagaaaaaataaaataaatctggagagacagatgcacatagagaaactgcttagctagaacagaagccataaagtggtaagaacacttagttggtaaatttgataaattgtttgaggctgtgtagactatctatcttaacagtgagaaaccccttgacacttcagtcttagaaaaaacccacacat

SEQ ID NO: 190145 - DNA, 601 bp, Human
caaatcaataactttttttgaacccaccagaaaacagagactgtaggatgaatggccacaaacaaatctggagagtgggcgtggtggctcacatccctaatctcagcactttgggaggccgaggcgggtgcatcacctgaggtcaagagttcgaggccaggctggccaacatggcaaaaccccatctctactaaaaatacaaaaattagctgggcatggcacatgcctgtagtcccagctacttgggaggctgaggaaagagaattgcttgaacccaggaggtggaggttgcagtgaggcsagctcatgtcactggactccagcctgggcgacagagtgagactctgtctcaaaaaaaaagaaaaaataaaataaatctggagagacagatgcacatagagaaactgcttagctagaacagaagccataaagtggtaagaacacttagttggtaaatttgataaattgtttgaggctgtgtagactatctatcttaacagtgagaaaccccttgacacttcagtcttagaaaaaacccacacattgttgggcttttctgtcattaacccatcaggttctcactgtagggatctgagtacaa

SEQ ID NO: 190146 - DNA, 601 bp, Human
atagtaaataacaatgtattaaatgattaaagtgtatagcagggtgaaatgaattacatcaatatcacatgggatgagagaagaattgggagttctctattataagagaacatgtactacccataagatagtgtagtgttatttggagacagacttagattagttaaaagtgcatatttcaactctaaatcactaaaagaatgtttaattgcaatttttacataaatagaggaggcaaaatggtcttatataatatgcttagttaaaaccaaagaaggcataagggtatgtatgggagatkgggaacaaagaacataagcaatgaataaaaagagtttcaaacaaggtaagtacaaatgtacctcaaccaatcatcacattaaatgtgaatggtttaaacataccaagtaaaagacagagattgtcaggatagaataataaaaaacaaaagctcaaatataagttgtctgtaaaaaactcactttaaatacaaggacagagatattttaagggtaaagagatataaaatatatgccatgctaacactaatatagaacagctatattcataagggacaaaaaacagatttccaaagcctgag

SEQ ID NO: 190147 - DNA, 601 bp, Human
aagatagtgtagtgttatttggagacagacttagattagttaaaagtgcatatttcaactctaaatcactaaaagaatgtttaattgcaatttttacataaatagaggaggcaaaatggtcttatataatatgcttagttaaaaccaaagaaggcataagggtatgtatgggagatggggaacaaagaacataagcaatgaataaaaagagtttcaaacaaggtaagtacaaatgtacctcaaccaatcatcacattaaatgtgaatggtttaaacataccaagtaaaagacagagattgwcaggatagaataataaaaaacaaaagctcaaatataagttgtctgtaaaaaactcactttaaatacaaggacagagatattttaagggtaaagagatataaaatatatgccatgctaacactaatatagaacagctatattcataagggacaaaaaacagatttccaaagcctgaggaccacatggtaacaacaaggttaattctctaagaatacatagcaacactaaatgtgtatgcacctaacaacatatcaccaaaatgtatgtctccaaaacagaaagaagtgaaggggaaaatag

SEQ ID NO: 190148 - DNA, 601 bp, Human
aaaagacagagattgtcaggatagaataataaaaaacaaaagctcaaatataagttgtctgtaaaaaactcactttaaatacaaggacagagatattttaagggtaaagagatataaaatatatgccatgctaacactaatatagaacagctatattcataagggacaaaaaacagatttccaaagcctgaggaccacatggtaacaacaaggttaattctctaagaatacatagcaacactaaatgtgtatgcacctaacaacatatcaccaaaatgtatgtctccaaaacagaaagaastgaaggggaaaatagacaactttattattagggtttgaaattttaacaccaaaaattggaagcaaccaagatgttcttcaacaagtgagtgaataaataaactgcagcgcattccattcatacaatgaaatattactcagcaaaaaaaagaaaaaatattatgaagcatccaaaaaaaaaaagacaacaagaatctcaaatgcatattgctaaggggaagaagccaatctgaaaagtcttcatactgtatgattgtgattttgtgacatgctgtaaaaggtaaaactatagagctaagaa

SEQ ID NO: 190149 - DNA, 601 bp, Human
ataaaatatatgccatgctaacactaatatagaacagctatattcataagggacaaaaaacagatttccaaagcctgaggaccacatggtaacaacaaggttaattctctaagaatacatagcaacactaaatgtgtatgcacctaacaacatatcaccaaaatgtatgtctccaaaacagaaagaagtgaaggggaaaatagacaactttattattagggtttgaaattttaacaccaaaaattggaagcaaccaagatgttcttcaacaagtgagtgaataaataaactgcagcgcatyccattcatacaatgaaatattactcagcaaaaaaaagaaaaaatattatgaagcatccaaaaaaaaaaagacaacaagaatctcaaatgcatattgctaaggggaagaagccaatctgaaaagtcttcatactgtatgattgtgattttgtgacatgctgtaaaaggtaaaactatagagctaagaaaaagattacatgttgccaggggtttggggtaaagggaaaaatatttaatagaaggtacataggagatttatttttgggcagtgaaactattctgtataatactgcagtgatgc

SEQ ID NO: 190150 - DNA, 601 bp, Human
aaacagatttccaaagcctgaggaccacatggtaacaacaaggttaattctctaagaatacatagcaacactaaatgtgtatgcacctaacaacatatcaccaaaatgtatgtctccaaaacagaaagaagtgaaggggaaaatagacaactttattattagggtttgaaattttaacaccaaaaattggaagcaaccaagatgttcttcaacaagtgagtgaataaataaactgcagcgcattccattcatacaatgaaatattactcagcaaaaaaaagaaaaaatattatgaagcatscaaaaaaaaaaagacaacaagaatctcaaatgcatattgctaaggggaagaagccaatctgaaaagtcttcatactgtatgattgtgattttgtgacatgctgtaaaaggtaaaactatagagctaagaaaaagattacatgttgccaggggtttggggtaaagggaaaaatatttaatagaaggtacataggagatttatttttgggcagtgaaactattctgtataatactgcagtgatgcatacatgatattatgaatttgtcaaaaccaagagaccattacggcataaaaaatgaa

SEQ ID NO: 190151 - DNA, 601 bp, Human
acaagtgagtgaataaataaactgcagcgcattccattcatacaatgaaatattactcagcaaaaaaaagaaaaaatattatgaagcatccaaaaaaaaaaagacaacaagaatctcaaatgcatattgctaaggggaagaagccaatctgaaaagtcttcatactgtatgattgtgattttgtgacatgctgtaaaaggtaaaactatagagctaagaaaaagattacatgttgccaggggtttggggtaaagggaaaaatatttaatagaaggtacataggagatttatttttgggcartgaaactattctgtataatactgcagtgatgcatacatgatattatgaatttgtcaaaaccaagagaccattacggcataaaaaatgaacctcaatgtatataaattttgtgaaaatttggagatcaagcattctccagtggaaggcagaatggggtaaaacagttttacaatattacagattagtgaaacaacctcactgaaggagatgaaaaaggtgctgacctaagtaactttagaaataaatagagactataaaatgaagacaaaagaactagacataaaaattgcactctctttg

SEQ ID NO: 190152 - DNA, 601 bp, Human
tactgtatgattgtgattttgtgacatgctgtaaaaggtaaaactatagagctaagaaaaagattacatgttgccaggggtttggggtaaagggaaaaatatttaatagaaggtacataggagatttatttttgggcagtgaaactattctgtataatactgcagtgatgcatacatgatattatgaatttgtcaaaaccaagagaccattacggcataaaaaatgaacctcaatgtatataaattttgtgaaaatttggagatcaagcattctccagtggaaggcagaatggggtaaaasagttttacaatattacagattagtgaaacaacctcactgaaggagatgaaaaaggtgctgacctaagtaactttagaaataaatagagactataaaatgaagacaaaagaactagacataaaaattgcactctctttgatgaagcttttacctgtggagatacaatttaacaatattgcaacaacaaatgtatactggaattgaacaattaaacaaatggatggtacatggtaagaaccatatttatctattggagtaggagattacaacagataagcaatgaaagaaaatgagagtgat

SEQ ID NO: 190153 - DNA, 601 bp, Human
gttacaagcacactttcatccagaatttgatttctaatactagcttcttatatctgttcctactaccagagcttcttggaaaagtggcaattctcaaactagggtaagacatatacaagataaaactgatgcatcctgtgttttcaaaaagtaaagcgtttctaacaacagaaacaatccacaaaacataataacggggatatgtcagtggtacaaaggcaccaactgaagagctcccaacccacaaaaagggaatgatttcagtaacaaaattaataaagtagtattgggttgtaatacraaatattaaatgaatattcatgatttcacactaatatgaataaattattggataagcaaattaatataggagaatagaaatacttgaagaaagggatttcaaataatttttgtagatattctgccctcaagcaggtgaagccctcactccttaagtacaggctgcatgtagtacttccaaccaaaaatacagcatagaaaggggaaaaaaaagaagaacttaaaagtgagaaactttgcaaacactcctcagacaggtgatcaagaaaaatatcaacagtgacaattcaagtagatagta

SEQ ID NO: 190154 - DNA, 601 bp, Human
tttctaatactagcttcttatatctgttcctactaccagagcttcttggaaaagtggcaattctcaaactagggtaagacatatacaagataaaactgatgcatcctgtgttttcaaaaagtaaagcgtttctaacaacagaaacaatccacaaaacataataacggggatatgtcagtggtacaaaggcaccaactgaagagctcccaacccacaaaaagggaatgatttcagtaacaaaattaataaagtagtattgggttgtaatacaaaatattaaatgaatattcatgatttcacrctaatatgaataaattattggataagcaaattaatataggagaatagaaatacttgaagaaagggatttcaaataatttttgtagatattctgccctcaagcaggtgaagccctcactccttaagtacaggctgcatgtagtacttccaaccaaaaatacagcatagaaaggggaaaaaaaagaagaacttaaaagtgagaaactttgcaaacactcctcagacaggtgatcaagaaaaatatcaacagtgacaattcaagtagatagtatgtagccttaacaagatgtagtaaaaatgg

SEQ ID NO: 190155 - DNA, 531 bp, Human
aaaatttgaaaaactgttgtaactaaagagccaaatgagatatgatgaataaacataatgtggtatccctgtatggaatttaggagaagaaaaaggagataagcaaaactaaggaaatatgaataaattatgggactttagcctatctaactcagttggtagagaatgagactcttcagttatggactttgataataatgtatcggtattggttcattaattgtgacaaaygtacatactaatatatgatgttaataatagggaaactgagtcagggtaaagggaaactgtcctatctttcaattgttctgaaatataacgctattctaaaataaaagtttattaacttatttattcatttatttttaattatttcaacttttattttagattcatggggtacatgtgcagttgtgttgtatgaatatattgcatgatgctgaagtctggattatgattgattccatcacccagtacccaatagttcatttttcaacccttgccccatctctcattccccactctagtagt

SEQ ID NO: 190156 - DNA, 601 bp, Human
atgtaggttttctgattactctgttgataattccttttgcttcacagaatctctttagtgtaattaggttccacttgtcaatttttgtttttgttgcaattgcttttgaggacttcatcataaatactttcctaaggctgatgtccagaaagatgtatctaagttttcttccaggattcttatagtttgcaatcttaaatttaaatctttaatccgttttaatatttgtttatgatgaaaggtagggggtccagtttcatcttctgcatattggttagccagctatcccagcaccattgaktgactatggagtcctttccgcatgcttatttttgttgattttgtcaaagatcatatggctataggtgtatggctgtctgtctgggttctctattctgttccatgaatgtatgtgtctgttttggtaccagtaccatgctgtttttgttactgtagcatgctgttttggtcactctagcctatagtttaaagttgggtaatgtgatgtctccagctttgttcttttgcttaggattgctttgaattttcaggctctttttttgctccatatgaattttagaatagttttttctagttctgt

SEQ ID NO: 190157 - DNA, 601 bp, Human
agttctccttgtagagatctttcaccttcgatgttagatgtagtcctaggtatttttgtgtgtgttcctattgtaaatgggattgcattcttgatttggctctcagcttcaacattattggtgtatagaaatgctactgatagcatttctatcagtgtaactatacatttattttgtatcctgaaactttactgatgtcatttatcagttctcaaagccttttggtggagtctttcgggttttctaggtgtaaaatcatatcagcaaagagagactttgacttcttccttttctatttggrtgtctttcatttctctcttgcctgattgctcttgctgggactgccagtattaggttgaatagaagtagtgagagtaagcatccttgtcttcttctagttctccaggaaaatgtttccaatttgtgcacactcagtatgatgttggctgtaggtttgccgtagatcactcttattattttgaggtatattcctttgatgcctagtttcttgagggattttatcatgatggggtgttggattttatctaaatctttctccacatcttttgagatgatcatggggtttttgttttgaattctg

SEQ ID NO: 190158 - DNA, 601 bp, Human
tagtgttaggtgccttggacacagaaacaaatatatatctattatttcttgagtgtctactaagtgctttagcgtaattaacttccaaaacattttaaatatctaaaaacatggagactgggaaaaagtacattacttatccaaacctctacagagagtaagctgcagattagaacttaaaacttaggtctgacttccccctaaactatatttttgtcatctttcctatccccccaagccctgcctttaaagggtttaagagctttttggtaaaaataggcacttggacatgtgaacagcracaggaatatcacaatacccagcaaagaaatttaacataaatctgacataatttattgcatgcctatctcgttactaaaatcttttgtaaattttaaatatgaagggcagtactatgctcaaaattacatagaaatattttttcaaaaacattcaaaatgacaaactttaaagctagagatggtcggtctttggtactgccatcctatttcctaactgaggaagataatgctctgtgatgcaacatgcattgcagcatgccacattgcatagacatctgaatcccacaggaaccagagcc

SEQ ID NO: 190159 - DNA, 601 bp, Human
gcgtaattaacttccaaaacattttaaatatctaaaaacatggagactgggaaaaagtacattacttatccaaacctctacagagagtaagctgcagattagaacttaaaacttaggtctgacttccccctaaactatatttttgtcatctttcctatccccccaagccctgcctttaaagggtttaagagctttttggtaaaaataggcacttggacatgtgaacagcaacaggaatatcacaatacccagcaaagaaatttaacataaatctgacataatttattgcatgcctatctcrttactaaaatcttttgtaaattttaaatatgaagggcagtactatgctcaaaattacatagaaatattttttcaaaaacattcaaaatgacaaactttaaagctagagatggtcggtctttggtactgccatcctatttcctaactgaggaagataatgctctgtgatgcaacatgcattgcagcatgccacattgcatagacatctgaatcccacaggaaccagagcctgagttaaaaaagaaaacagtgactcagaattcaagacttctggccttagttgattcaagatgtcattttt

SEQ ID NO: 190160 - DNA, 601 bp, Human
agagtaagctgcagattagaacttaaaacttaggtctgacttccccctaaactatatttttgtcatctttcctatccccccaagccctgcctttaaagggtttaagagctttttggtaaaaataggcacttggacatgtgaacagcaacaggaatatcacaatacccagcaaagaaatttaacataaatctgacataatttattgcatgcctatctcgttactaaaatcttttgtaaattttaaatatgaagggcagtactatgctcaaaattacatagaaatattttttcaaaaacattsaaaatgacaaactttaaagctagagatggtcggtctttggtactgccatcctatttcctaactgaggaagataatgctctgtgatgcaacatgcattgcagcatgccacattgcatagacatctgaatcccacaggaaccagagcctgagttaaaaaagaaaacagtgactcagaattcaagacttctggccttagttgattcaagatgtcattttttcagtttttattttttttcctccagatcaaatttcagtaaaatgtgacagtaagactttattgtatgtgcctcttatttctcc

SEQ ID NO: 190161 - DNA, 601 bp, Human
tttaaagggtttaagagctttttggtaaaaataggcacttggacatgtgaacagcaacaggaatatcacaatacccagcaaagaaatttaacataaatctgacataatttattgcatgcctatctcgttactaaaatcttttgtaaattttaaatatgaagggcagtactatgctcaaaattacatagaaatattttttcaaaaacattcaaaatgacaaactttaaagctagagatggtcggtctttggtactgccatcctatttcctaactgaggaagataatgctctgtgatgcaacrtgcattgcagcatgccacattgcatagacatctgaatcccacaggaaccagagcctgagttaaaaaagaaaacagtgactcagaattcaagacttctggccttagttgattcaagatgtcattttttcagtttttattttttttcctccagatcaaatttcagtaaaatgtgacagtaagactttattgtatgtgcctcttatttctcctttagtttataaaatattttggtgttctctgactattgctgaattgtatgcttggatattaaacataataaagttccatctactttcataa

SEQ ID NO: 190162 - DNA, 601 bp, Human
catagccttttatgtgtgtagatggtagaaagctataatttcactaaaagcagaagagatctagctggtggggagacagtgttgtatcggagctagcttgtacctgctcataccatctggttattaaatattcaggaattttacaaaccaattgtgaaatatagccattattaaaaaataaactgtatagacttataactaagtaaaaatattagaatgaaagcataaataaccaaactcatcacttcttaattcttttactacatcttactattacctgtgttctcattattttacactyactgcctttgcatggtaaaacgactccttatgagagtgtactaccacccgtggttttcttcactctgtgttcagtgacataatttttgtagcttaaaattggccatgttgggagtatttatgctgtagaaattgacttatgctacggttcagggatttttatctcagatatccagttgttaaacatgtgtcagcatgccactgagaatagaggaatatcacaaatattgatcagcttctgctattcacaaattcaaccctacttcaacattataatctcgtgttcaaacctgataagcta

SEQ ID NO: 190163 - DNA, 601 bp, Human
attgatcagcttctgctattcacaaattcaaccctacttcaacattataatctcgtgttcaaacctgataagctactttttgtcaggatcaggtcctagtttggtatgttttgagtaaaattcccaaatagattagagtatatgtagtttgaggatgaagtgaatgtaatatttgatgttattgatatttgcaactatgaggggatatatctgaaggcaaaacctaacatgcagaggatggctgagcaggaagaagagtgaatccttgatgatgatattgaatcacaacactaattaattytggagtcacacttcagccaccttgtcatgtgaaaaatatattctttaaagccacttttaattgtggtgtgtattatatgcagcagaaagtaacctaactaatacaccaattacccattttatagataaaagtcagctaattcctacagccacgacatttaggaaagttcatgtaaggtcttattagcacttctattttaaaggcttgtcttttttgttttttaattttaagcataactttaattatagcttccagtatataaaagcattatttgaacctgggtcaacatgaaatgcaacc

SEQ ID NO: 190164 - DNA, 601 bp, Human
tgagcaggaagaagagtgaatccttgatgatgatattgaatcacaacactaattaattctggagtcacacttcagccaccttgtcatgtgaaaaatatattctttaaagccacttttaattgtggtgtgtattatatgcagcagaaagtaacctaactaatacaccaattacccattttatagataaaagtcagctaattcctacagccacgacatttaggaaagttcatgtaaggtcttattagcacttctattttaaaggcttgtcttttttgttttttaattttaagcataactttarttatagcttccagtatataaaagcattatttgaacctgggtcaacatgaaatgcaaccagaaactttaaaaaagtgtaagcactgcaaatatatatttgtataataatgggtactgatgactacgatggatatctaatatctaactgaaaataaatatagttttccttaggaaaggaaaagacatcagaacccagttattcaaatacttacttaggcctttcttaagtaggggaggttgtttatagccataagatacttatcaaacgtaataaataagcacatttccaattataaactaa

SEQ ID NO: 190165 - DNA, 601 bp, Human
gccacttttaattgtggtgtgtattatatgcagcagaaagtaacctaactaatacaccaattacccattttatagataaaagtcagctaattcctacagccacgacatttaggaaagttcatgtaaggtcttattagcacttctattttaaaggcttgtcttttttgttttttaattttaagcataactttaattatagcttccagtatataaaagcattatttgaacctgggtcaacatgaaatgcaaccagaaactttaaaaaagtgtaagcactgcaaatatatatttgtataataaygggtactgatgactacgatggatatctaatatctaactgaaaataaatatagttttccttaggaaaggaaaagacatcagaacccagttattcaaatacttacttaggcctttcttaagtaggggaggttgtttatagccataagatacttatcaaacgtaataaataagcacatttccaattataaactaatgagtagattttattaaacattattcttacaattccttgaaaactctagtagttatagaaagagcacaaagtattctgattttatgcttttaaaaatgtgacccttta

SEQ ID NO: 190166 - DNA, 601 bp, Human
cacatttccaattataaactaatgagtagattttattaaacattattcttacaattccttgaaaactctagtagttatagaaagagcacaaagtattctgattttatgcttttaaaaatgtgaccctttaacagagaaactccacttaggtttaataagacatatttgacattctactatcattcaaaacccctgagattggttacacaaaagttatatcaactaatacaaaaataatgattatatgaagttatttattctgtgtaatgaacaaatactaattaatgaaatagacttataytgtaattatgactttttatattctagcaaaaacaatgaaattgggaggttttaaattcaacctatagtctgaaatccaatattattctagcaaaaggagagaaagagaatgaaatagagaagagacagatgaatattaagaaatgatttagaataggtaaacagtaaaatagtaataaataatacaacattggttaatatggcagttgatttaccttgtgaggtgtcaaaaatctgaaaggtagctgaagaaacttttggcagtttcttggaagaagtgagtaattcattctcctaaatt

SEQ ID NO: 190167 - DNA, 601 bp, Human
aagagttgctgaaggaggtagaatctgtggactagggcaccagagagcagggagctaatttgagtaggaaccccagagtttgtgtgggagctcttgtagggtgtctggctatgggataatctttacaagctcaggaagagactatgggaggctgcaaagcaaataagtactaaagacttgagagtagaacagaagctgaagattgcatggttatggaagaacccaatgccccaactcagctagagtgcaaaaatcttattaatatcctgagtattcaactgagacatcaagaagttcattycttaagtatagaccatgttctacagcaagagacagcaaatgttttctgaccctggtccctataatctctgttccaacttcttaaccttgcttttgagatgtgaaagcatctatagaaaatacataaataaataggtgtggccgtattccactacagctttaatcataaaattaacaggtatcagtcgagatttgacccacagaccatagtttgctgaccctacccaagagtaaggcctatacaacacctccttattaaagcgtaaaactcagctttgacaatatccacaggaagacagag

SEQ ID NO: 190168 - DNA, 601 bp, Human
atgggaggctgcaaagcaaataagtactaaagacttgagagtagaacagaagctgaagattgcatggttatggaagaacccaatgccccaactcagctagagtgcaaaaatcttattaatatcctgagtattcaactgagacatcaagaagttcattccttaagtatagaccatgttctacagcaagagacagcaaatgttttctgaccctggtccctataatctctgttccaacttcttaaccttgcttttgagatgtgaaagcatctatagaaaatacataaataaataggtgtggccrtattccactacagctttaatcataaaattaacaggtatcagtcgagatttgacccacagaccatagtttgctgaccctacccaagagtaaggcctatacaacacctccttattaaagcgtaaaactcagctttgacaatatccacaggaagacagagtttagaaattaagccgtagcaagttacaggggcttgagaaaaaaaattaggcattgcacagatatgttcaacaaagcataaaactaagcgaatacaagtttaaggtaaataggctatgatagagctacttatttgaacaaaaa

SEQ ID NO: 190169 - DNA, 601 bp, Human
gggaggctgcaaagcaaataagtactaaagacttgagagtagaacagaagctgaagattgcatggttatggaagaacccaatgccccaactcagctagagtgcaaaaatcttattaatatcctgagtattcaactgagacatcaagaagttcattccttaagtatagaccatgttctacagcaagagacagcaaatgttttctgaccctggtccctataatctctgttccaacttcttaaccttgcttttgagatgtgaaagcatctatagaaaatacataaataaataggtgtggccgtrttccactacagctttaatcataaaattaacaggtatcagtcgagatttgacccacagaccatagtttgctgaccctacccaagagtaaggcctatacaacacctccttattaaagcgtaaaactcagctttgacaatatccacaggaagacagagtttagaaattaagccgtagcaagttacaggggcttgagaaaaaaaattaggcattgcacagatatgttcaacaaagcataaaactaagcgaatacaagtttaaggtaaataggctatgatagagctacttatttgaacaaaaatc

SEQ ID NO: 190170 - DNA, 601 bp, Human
aaaaggaaattataccagacaaaaactcaaacctacaggaaataataggggacataagaaatgataaataattgggcaaatagaaaatgttttttgtttctcgaattttcctgaggaaacaactgtttgtatgaagtaaaaataatcacactgtaaagtgggtttataaaatctgtaagtaaaacctgtgacaatagtgaaagggaagacaaggaaaatagaactataccccataagcttattacatttctgaatgttttggaaaatgggctctgaggcttaaatctgaagtgataatatmtgggctctaggtagacattaataagttagagatacagaatattagtcctagagctattatcataaagtaaataaaaagagatatagtaaagcaagccaatagagaaataaaataaaacaaaagtatatgactcacccaaaagtggcaagaaaggaataagaaagcagcaaaaacagaagggaccagtggaaaacaaatagcaaaatggtaggtttaaacatggctatatcaatgtttgcattaagtgttaaacattcctattaaacagtagagtttgtcctattgaattaacaaaaaagg

SEQ ID NO: 190171 - DNA, 601 bp, Human
gtatttattcaaaggaaagaaaatacatatattgaagagatacctgcacctttatatttattgcagatctatttaaaatagccaaaatatggaatcaacctaaatgtccatcaatggatgaatgaataaagaacttatgatacatatacacaatggaatactattcagcaataaaaaagaatgaaatatggtcattcacagcaacatggatgagcctgggaggacattattttaagtgaaataagtcagagacagaaagacaaatactacatgttctcactcatatgtgggggctaaaaayattgagttaatagaagtagtgagtagaactgtggttatcagaggctgggaagggtagcaaggagggaaagataggaaaaagctggttaaggtatacaaagttacagctgagtaggaagaataagttctatgttctgcagcactatagggtgaatatagctaatgataatgtagtgtatattttcaaaaagctagaagagaagatttttgaatgttcacaacacaaagaaatgataaatgtttcaagtgataaatatattagttattcttatttgatcattacacattgtagataagaatg

SEQ ID NO: 190172 - DNA, 601 bp, Human
atcccagcagtttgggaggtcgaggtaggaagatcacttgagttccggagttggagaccagcctggacaacatagagagactttgtctctacaaaagatgaacaaaattagctgatcatagtggcacatgactgtagtcccagctactaggggagctgagatgggaggattacttgaacctggcaggggaaggctacagtgagccgagatcatgccactgtactacagcctgggtgacagagcaagaacctgtcacaaataaagatagaaagaaaaaaggaaggaaggaagggagggaggsagggaggaaggaaggaaagaaggaaggaaggaaggaaggaaggaaggaaggaaggaaggaaggaaagaaggaaggcaggcaggcaggtaaaaagaagaagagattaagacctaagataaacataaaaataaagtatgagcagaattcaaccatagagaattaaacaaagccaacaattggtttttttaacataattaatacaaacagttaaacctctagcaagattaatcaaaaaaagaggaaaaagcaaaagaataccaagtaaggcatatgcaactctgccttccacgttcaagcaat

SEQ ID NO: 190173 - DNA, 601 bp, Human
aacttagcaaagtcacatcatataaatacaaacaaatgaattttatttttgtgtataggtcgttaacaactgaaaaacaataatctttaccatagcattaaaataacaccacaaaacaggaagaaatttaacaaaaagataggcaggacatttatactgaaacattgatgagataaatttaagcacatattttcgtttctgttataccttgtgtagaggggtgggaatcacaactcaattcaattatttgcagctgtttcacttctgcaatttacttagcttaaactcagtttctaattckttgtcatcattcataaaattcattttctggataggtcattaatagaattggaaatatgtgaagtaattggcataaaccctgaacttaatagaagtacagcaaattgaaatagttttattattgttattgtgaataatgcattataaagtgagatacttatatttattactttagcaataaagaaaccataggcaagactttgaataaagaaaacaacatatgattgatagcgtaagtgaagattaattttcataatggtgagaaatccaggcttatttagccttttatttactaataaat

SEQ ID NO: 190174 - DNA, 601 bp, Human
aacaaaaagataggcaggacatttatactgaaacattgatgagataaatttaagcacatattttcgtttctgttataccttgtgtagaggggtgggaatcacaactcaattcaattatttgcagctgtttcacttctgcaatttacttagcttaaactcagtttctaattctttgtcatcattcataaaattcattttctggataggtcattaatagaattggaaatatgtgaagtaattggcataaaccctgaacttaatagaagtacagcaaattgaaatagttttattattgttattrtgaataatgcattataaagtgagatacttatatttattactttagcaataaagaaaccataggcaagactttgaataaagaaaacaacatatgattgatagcgtaagtgaagattaattttcataatggtgagaaatccaggcttatttagccttttatttactaataaattctgaagataagtcataaaacaatgtacggatagtagatacaccagtgtacataatgtcaggtctttgcagaagtggcaagtagctcaaaagtaggttaatatgagaaatttctttttcaaacaaaatg

SEQ ID NO: 190175 - DNA, 601 bp, Human
aactcaattcaattatttgcagctgtttcacttctgcaatttacttagcttaaactcagtttctaattctttgtcatcattcataaaattcattttctggataggtcattaatagaattggaaatatgtgaagtaattggcataaaccctgaacttaatagaagtacagcaaattgaaatagttttattattgttattgtgaataatgcattataaagtgagatacttatatttattactttagcaataaagaaaccataggcaagactttgaataaagaaaacaacatatgattgatagmgtaagtgaagattaattttcataatggtgagaaatccaggcttatttagccttttatttactaataaattctgaagataagtcataaaacaatgtacggatagtagatacaccagtgtacataatgtcaggtctttgcagaagtggcaagtagctcaaaagtaggttaatatgagaaatttctttttcaaacaaaatgagatagcattgttccaggacttcttattgggacctattcaatcctgaaccactccatctaagtctgcatatctccaaaaccacagtcgtcattcttgtttgg

SEQ ID NO: 190176 - DNA, 601 bp, Human
tgcattataaagtgagatacttatatttattactttagcaataaagaaaccataggcaagactttgaataaagaaaacaacatatgattgatagcgtaagtgaagattaattttcataatggtgagaaatccaggcttatttagccttttatttactaataaattctgaagataagtcataaaacaatgtacggatagtagatacaccagtgtacataatgtcaggtctttgcagaagtggcaagtagctcaaaagtaggttaatatgagaaatttctttttcaaacaaaatgagatagcrttgttccaggacttcttattgggacctattcaatcctgaaccactccatctaagtctgcatatctccaaaaccacagtcgtcattcttgtttgggatgatgttcttaaatgtcttatttctggttccctcaaaaacagaaacccagacaggaactttggtcctggtaatttattcaggcgatgatccaggaagcaagaaaggggagcaaacaaagtaagacagggacacagaagcgtcaatatagaatgatttatcgaggttacactgtgggcaatgagggatttttttccaaaacctga

SEQ ID NO: 190177 - DNA, 601 bp, Human
attactttagcaataaagaaaccataggcaagactttgaataaagaaaacaacatatgattgatagcgtaagtgaagattaattttcataatggtgagaaatccaggcttatttagccttttatttactaataaattctgaagataagtcataaaacaatgtacggatagtagatacaccagtgtacataatgtcaggtctttgcagaagtggcaagtagctcaaaagtaggttaatatgagaaatttctttttcaaacaaaatgagatagcattgttccaggacttcttattgggacctrttcaatcctgaaccactccatctaagtctgcatatctccaaaaccacagtcgtcattcttgtttgggatgatgttcttaaatgtcttatttctggttccctcaaaaacagaaacccagacaggaactttggtcctggtaatttattcaggcgatgatccaggaagcaagaaaggggagcaaacaaagtaagacagggacacagaagcgtcaatatagaatgatttatcgaggttacactgtgggcaatgagggatttttttccaaaacctgagaaacatacagaaagtttcccaaaattt

SEQ ID NO: 190178 - DNA, 601 bp, Human
cagaaacccagacaggaactttggtcctggtaatttattcaggcgatgatccaggaagcaagaaaggggagcaaacaaagtaagacagggacacagaagcgtcaatatagaatgatttatcgaggttacactgtgggcaatgagggatttttttccaaaacctgagaaacatacagaaagtttcccaaaattttcccttagccagacagaaatctgcaatatttatccacaagctccatgaattgaaaattacatgaaggcattaactcccctaactctctgcctatccaggctgcgtgtrtaccaggctgagtagattcccaaagtgtcagagaaggcactgaagcagagtacagatatacacataaaatgagctttagatgggactctatcaatgtgtggcagatctgaactagcacagaactgccctctgcagctaaggctgaaatcagaaatgagctaaggtgataatgatattaactagaagaccctatgtagcacatcaagtgtaaaaacgggttaggttttcttcactctactaatgctgaggcactcctcagcattgacaaaatcatgtattttgtcaagtgtcttagtcttt

SEQ ID NO: 190179 - DNA, 601 bp, Human
gtttggtgtccagtggggaatcatttccttattcatagatgataccttcatactattccttcacatgatagaagggactaactggctctctggagtcttttaatgagggcacaagtcccagtcatgagagctctgccttcattcataactcagtcatctcccaaagacctcacctcctccattgccttaggggttaggatttcaacatggaatttgaggagatacaaacattaagatcatagcaagaagactgtcatcagaagataattattgaattttaatatttaatcatgatacaaamtagaaaaaaattactgtctataggtcattttaaaagattataaaaatataaggaggtcaaaaaatttagattgcatttagaatataacctaaacatcataatttgataaagtctagattggcagtgctatttgtaccaggtcacatattagacatatataagtcacatataaatttagaggtcataaatattccccatattcccaacccatagattttttcgctagtctactcagtctttatccacatcacctgctttgatgcctgaatcaatgttgactcataaatagattgacatgaa

SEQ ID NO: 190180 - DNA, 601 bp, Human
ataaggaggtcaaaaaatttagattgcatttagaatataacctaaacatcataatttgataaagtctagattggcagtgctatttgtaccaggtcacatattagacatatataagtcacatataaatttagaggtcataaatattccccatattcccaacccatagattttttcgctagtctactcagtctttatccacatcacctgctttgatgcctgaatcaatgttgactcataaatagattgacatgaacgagtactgtggcacggttacgtctcctgctccccctcacccaccacygtgctgggtgagctgcatcaaataaatgaaaccagctacagcctggaagtatggtgtcacttatgtctgctgttctcctaaatgttatcccatttaagaggctacagacagaggcttaattcttatggaaaatgttcttctggtgtgttaattagctcttctgaggaacagaataagcatgtgctcccacaagtccttttttttccagtagagccagaaacacacacattcattaaaaagaaccgtgaaccctttgaaaaaccattagtaaagattttattttgttcagctttattgtga

SEQ ID NO: 190181 - DNA, 601 bp, Human
tcaatgttgactcataaatagattgacatgaacgagtactgtggcacggttacgtctcctgctccccctcacccaccactgtgctgggtgagctgcatcaaataaatgaaaccagctacagcctggaagtatggtgtcacttatgtctgctgttctcctaaatgttatcccatttaagaggctacagacagaggcttaattcttatggaaaatgttcttctggtgtgttaattagctcttctgaggaacagaataagcatgtgctcccacaagtccttttttttccagtagagccagaaatacacacattcattaaaaagaaccgtgaaccctttgaaaaaccattagtaaagattttattttgttcagctttattgtgatataattgaaatataaaaattatatagatttatattgtataacattatgttttgatgtatgcgtacattgttaactgagtaccaaaagcaagctaattaaaatgtccatctcctcatatacttaccatttttgtgtgtgtgatgaggacacttaagttctactctcttagcaagtttcaagtatacaatataaaattattaactatactcattatgctgta

SEQ ID NO: 190182 - DNA, 601 bp, Human
caatgttgactcataaatagattgacatgaacgagtactgtggcacggttacgtctcctgctccccctcacccaccactgtgctgggtgagctgcatcaaataaatgaaaccagctacagcctggaagtatggtgtcacttatgtctgctgttctcctaaatgttatcccatttaagaggctacagacagaggcttaattcttatggaaaatgttcttctggtgtgttaattagctcttctgaggaacagaataagcatgtgctcccacaagtccttttttttccagtagagccagaaacrcacacattcattaaaaagaaccgtgaaccctttgaaaaaccattagtaaagattttattttgttcagctttattgtgatataattgaaatataaaaattatatagatttatattgtataacattatgttttgatgtatgcgtacattgttaactgagtaccaaaagcaagctaattaaaatgtccatctcctcatatacttaccatttttgtgtgtgtgatgaggacacttaagttctactctcttagcaagtttcaagtatacaatataaaattattaactatactcattatgctgtac

SEQ ID NO: 190183 - DNA, 601 bp, Human
aatgttgactcataaatagattgacatgaacgagtactgtggcacggttacgtctcctgctccccctcacccaccactgtgctgggtgagctgcatcaaataaatgaaaccagctacagcctggaagtatggtgtcacttatgtctgctgttctcctaaatgttatcccatttaagaggctacagacagaggcttaattcttatggaaaatgttcttctggtgtgttaattagctcttctgaggaacagaataagcatgtgctcccacaagtccttttttttccagtagagccagaaacatacacattcattaaaaagaaccgtgaaccctttgaaaaaccattagtaaagattttattttgttcagctttattgtgatataattgaaatataaaaattatatagatttatattgtataacattatgttttgatgtatgcgtacattgttaactgagtaccaaaagcaagctaattaaaatgtccatctcctcatatacttaccatttttgtgtgtgtgatgaggacacttaagttctactctcttagcaagtttcaagtatacaatataaaattattaactatactcattatgctgtaca

SEQ ID NO: 190184 - DNA, 601 bp, Human
tcataaatagattgacatgaacgagtactgtggcacggttacgtctcctgctccccctcacccaccactgtgctgggtgagctgcatcaaataaatgaaaccagctacagcctggaagtatggtgtcacttatgtctgctgttctcctaaatgttatcccatttaagaggctacagacagaggcttaattcttatggaaaatgttcttctggtgtgttaattagctcttctgaggaacagaataagcatgtgctcccacaagtccttttttttccagtagagccagaaacacacacattcrttaaaaagaaccgtgaaccctttgaaaaaccattagtaaagattttattttgttcagctttattgtgatataattgaaatataaaaattatatagatttatattgtataacattatgttttgatgtatgcgtacattgttaactgagtaccaaaagcaagctaattaaaatgtccatctcctcatatacttaccatttttgtgtgtgtgatgaggacacttaagttctactctcttagcaagtttcaagtatacaatataaaattattaactatactcattatgctgtacattaagtctc

SEQ ID NO: 190185 - DNA, 601 bp, Human
gcaacaccaagctactctctgttcctattatttgacattttttagattccatatgtaagtgggatcatgcagtatttgtctgtctgtgcctggtttacttcacttagctttatgtccttcagttatatcatgttgcaaataacaggatcttcctttttaaggctgaataatatttcaatatgtatttgtattatatagaatatatcgtgtgtgtgtgcatgtgtgtatgtgtgtgtgtgtatcccatatgttcctttaaaaaaaaatagacttagggagtacacgtggtacagttgtgttrcatggatacattggatagtagtgaagtgtgggcttttagtctagccatcacccgaatagtgtacgtcaggaatccccagccccctgcccacagactggtacccatctgtggcctgttaggaactggaccacatagcagagagatctagttttaatgcttttcatgagaatctgactaattcctgacgatctgaggtggaacagtttcatcctgaaaccacccaccccccaacatcagtggaaaaattgtcttccacgaaactggtccctggtgccaaaaaggtttggactcctggtatac

SEQ ID NO: 190186 - DNA, 601 bp, Human
tctaggttcatccatgttactggaaaaaacataatttcattctttttatggttgaatagtattccatggtgtgtgtttgtgtgtgtgtgtgtgtatacatattgcatgtttatatatgtacatataatgtgtacatatagatatacacacacacacagtggaatactactatataaatgttttatatatattctatatacacacacatatttatatatataaatatatataaataattatatatttatatgtaaataattatatataaatatgtgtgtatatatatacatatatacacgtrtacatatatacatatatatatacacacatatatatacacatatatatatggcattttctttatctaaccatgagttgatgcacacttaggttgattccagatctctgctattgtgaatagtgccacagtcaatgtacaaatgcaggcatctttttggtataatgatttcttttcctttgggtcagtatccagtagtggggttactggatttaatggtagttctatgttttcttctttgagaaatatccatattgtttgccataaaggttgcactaatttatattcccaccaacagtgtat

SEQ ID NO: 190187 - DNA, 601 bp, Human
aatgatattgattcttctaatccatgagcatgtgacatttttccatgtgtttgtgtcatccaaaacacaaacatttcattaaacacatttcatttgtcagtgttttgtagttttccttgtagagacctttcacctccttggttaaatgtattcctcaatattatttttttagctattgtaaatgaggtttacttcttgatttgtttcttagtttggttgttattgatgtatataaacgctactgattattgtaagttggttttgtaccctgattttaaaatgagcaaagaccccaaatttrctgaagttacttatcaaatctagcagtcttttcttaattcattcatgtttagatgaacagaggttgattccgtatctgagctattgtgattatgcttcagtgaacatgggggtgcagatagctcttcaagttactgatttcatttattctgtatgtgcattgaaaagtaggattactggaccatgaggtagttttatttttaattttccgagaaacttttatactggttttcataatggttgtaccaatttacattcccaccaacaataggtttgcttttctccacatcctcaccagcac

SEQ ID NO: 190188 - DNA, 601 bp, Human
tgatagttaatcatcatacacattataaatgctgtggtggacatctgaacagagagttttgagggttaaagaattcaaatagtgatcaactccactttacaaagtcaaaaaagataacagagggaatttcagaacaggagaattgcatgtaagtatgcgtaaaagtatgaataagactgtgttctgagaattttgagtagtttagtgtacctgaaggttaagggcaggaagtgagagtagattagagcaaaagagaaatatgatgcctattagtgatgtcaagggatatagaattgatctrtgcatttcttatgttttctttctttcttttttttttttttttgagatgaatttcactcttgttgctcagcctggagggcagtggtgcaatctcggctcactgcaacctccgcctcccgagttcaagcgattctcatgcctcagcctcccgagtagctgagattacaggcatacgttaccacgcccagctaattttttatatttttagtagaaatggggtttctccatgttggtcaggctggtcttggactcctgacctcagatgatccacccgccttagcctcccagagtgttgggatta

SEQ ID NO: 190189 - DNA, 601 bp, Human
atctgaacagagagttttgagggttaaagaattcaaatagtgatcaactccactttacaaagtcaaaaaagataacagagggaatttcagaacaggagaattgcatgtaagtatgcgtaaaagtatgaataagactgtgttctgagaattttgagtagtttagtgtacctgaaggttaagggcaggaagtgagagtagattagagcaaaagagaaatatgatgcctattagtgatgtcaagggatatagaattgatctatgcatttcttatgttttctttctttcttttttttttttttttgagatgaatttcactcttgttgctcagcctggagggcagtggtgcaatctcggctcactgcaacctccgcctcccgagttcaagcgattctcatgcctcagcctcccgagtagctgagattacaggcatacgttaccacgcccagctaattttttatatttttagtagaaatggggtttctccatgttggtcaggctggtcttggactcctgacctcagatgatccacccgccttagcctcccagagtgttgggattacaggtgtgaactaccgtgcctggccaaggatatacttatata

SEQ ID NO: 190190 - DNA, 601 bp, Human
aatttttgtatttttagtagagatggggttgcatcatgttggtcaggctagtctcaaactcctgacctctggtgatctgcctaccttggcctcccaaagtgctagaattacagatgtgagccaccatgcccagcccaaatctaccttcttataggtggagaaactgagaccctgaggttcatttcacatgtataaggcaatacacatacttagttgtagaatttgttctacaacaaaaattcttcacctaaagaatttggggtccattgttgagctactggggatttcttgaatcgtgtaytgggagtgtgccaaaattgtgtgcaaatatgttcatttttctgagtatataaattgtattaggtattcaaaagggtcatgcctcaaaaaaaggataggtaacattggtctatgtcctagattactgctcattgtggcagttatgatgtatatttttaattgtcttaaggccatacataagaggagtttctgtcttgacttgttgggaaactagcagttcatctctttgctaaagtagtgtttatactgaatggtccacttgaaatatcattagtcactttataggacaggtaatggcagg

SEQ ID NO: 190191 - DNA, 601 bp, Human
gaaactgagaccctgaggttcatttcacatgtataaggcaatacacatacttagttgtagaatttgttctacaacaaaaattcttcacctaaagaatttggggtccattgttgagctactggggatttcttgaatcgtgtattgggagtgtgccaaaattgtgtgcaaatatgttcatttttctgagtatataaattgtattaggtattcaaaagggtcatgcctcaaaaaaaggataggtaacattggtctatgtcctagattactgctcattgtggcagttatgatgtatatttttaawtgtcttaaggccatacataagaggagtttctgtcttgacttgttgggaaactagcagttcatctctttgctaaagtagtgtttatactgaatggtccacttgaaatatcattagtcactttataggacaggtaatggcaggagaggagggtgaatattgagaacaatgaggcagatttttgaacttttatatattgtgtcttaacagggaaagtccttggggttttaacctccaaggtaatggatatctttgcctccttccctctacctctctgctcctcctgccacactgaaggtccca

SEQ ID NO: 190192 - DNA, 601 bp, Human
ttcacatgtataaggcaatacacatacttagttgtagaatttgttctacaacaaaaattcttcacctaaagaatttggggtccattgttgagctactggggatttcttgaatcgtgtattgggagtgtgccaaaattgtgtgcaaatatgttcatttttctgagtatataaattgtattaggtattcaaaagggtcatgcctcaaaaaaaggataggtaacattggtctatgtcctagattactgctcattgtggcagttatgatgtatatttttaattgtcttaaggccatacataagargagtttctgtcttgacttgttgggaaactagcagttcatctctttgctaaagtagtgtttatactgaatggtccacttgaaatatcattagtcactttataggacaggtaatggcaggagaggagggtgaatattgagaacaatgaggcagatttttgaacttttatatattgtgtcttaacagggaaagtccttggggttttaacctccaaggtaatggatatctttgcctccttccctctacctctctgctcctcctgccacactgaaggtcccaaacaattaaatttttggactttg

SEQ ID NO: 190193 - DNA, 601 bp, Human
gctggttgatcacctgagatcagggagtttgagaccatcctggccaacatggtgaaaccctgtctctattaaaaatacaaaaattagccgggcgtggtggtgcacgcctgtaatcccagctactcgggaggctgacacaggagaatctcttcaacccgggaggtggaggttacagtgagctgagatcatgccactgcactccagcctgggtgatagaatgagactccatctcaaaaaaaaaaaaaaaaaaaaaagaaaaagaaaaagaaaagaagaaaggtaattgactgtgtatggcaaytcaggatttctcaacctgggcaattgacattttgaactgaacaatattttgttgtgggaagttgtcatatgcatttgtaaggtgtttaggaacatctctggcctctttccattagatgccaatatgacacttctgcttcccaagctgtgtcaaccacatatgtctcaagatatttccaaatgtttcttgggggccaaaattgcctctggttaagaaacgctgctttaaataatcagttttcctgtttaagcttcagggttcctatctgtaaaaggaaagcatgtttctcacactagctgt

SEQ ID NO: 190194 - DNA, 601 bp, Human
tctcttcaacccgggaggtggaggttacagtgagctgagatcatgccactgcactccagcctgggtgatagaatgagactccatctcaaaaaaaaaaaaaaaaaaaaaagaaaaagaaaaagaaaagaagaaaggtaattgactgtgtatggcaactcaggatttctcaacctgggcaattgacattttgaactgaacaatattttgttgtgggaagttgtcatatgcatttgtaaggtgtttaggaacatctctggcctctttccattagatgccaatatgacacttctgcttcccaagytgtgtcaaccacatatgtctcaagatatttccaaatgtttcttgggggccaaaattgcctctggttaagaaacgctgctttaaataatcagttttcctgtttaagcttcagggttcctatctgtaaaaggaaagcatgtttctcacactagctgtgtaagagtctatactacagtcctctggtatctacagcactagatgtttccttctaaagaccattctcttttgtttttctgttgttgtcctttgggtttctgttgttatttactatagaaataggccagttaaaaaaactaagtga

SEQ ID NO: 190195 - DNA, 601 bp, Human
caagctgtgtcaaccacatatgtctcaagatatttccaaatgtttcttgggggccaaaattgcctctggttaagaaacgctgctttaaataatcagttttcctgtttaagcttcagggttcctatctgtaaaaggaaagcatgtttctcacactagctgtgtaagagtctatactacagtcctctggtatctacagcactagatgtttccttctaaagaccattctcttttgtttttctgttgttgtcctttgggtttctgttgttatttactatagaaataggccagttaaaaaaactargtgactaatagaaacatagaatatcgtacctagaaccattcaaatagatcatcttgcccaagtcaattatgttcaaggcaagtgtgcttttcaagatcaagcttgttaatgtcaggactgaaatacagatttcttcatcatttctttctgacacaattcaatgcttttcttttattgctacgggttgtcatcttcggaagcacctataatcttaccttaataacattatttctagcactctctattattttattgataaacagcaactgtgaggtaacactgatgtgactgaatatgtaa

SEQ ID NO: 190196 - DNA, 601 bp, Human
tacccgtacaagagagtcatgtcctgtaaatggacgagtattatgaaaatctttagaaaagggtacatctgaacctttcctgccagcaccccctcaaacaaaaatcagtgttttcaggagaataactatgttacaggtgcttgttacctacaacctttggcttatatcttatctcaagcatctactccgttatgtggcttcatcaataaaataattgaaatagataggatgactgtttctttgactccagaatttcatatcttatactatttaaggaaaggtgattaatgaaaacaaagtratttataaagtatatacattttagaatttaaactaattcttccaattgcttgcactaatccattgaaggttagctactcttccctacgttcgtattctgcagaatgatttcagattgaggaacagacacccaagaaaatgttttcccccaaatacacattaattaaaaccaagggagaagagaacaaggtgtgacagcttttctgtgtgaattaagctgggtaaaatacctgaaccatgaatctttatttgtggaatgataatagctaaatccaaatagggttttgcaccaacaaattat

SEQ ID NO: 190197 - DNA, 601 bp, Human
gagtcatgtcctgtaaatggacgagtattatgaaaatctttagaaaagggtacatctgaacctttcctgccagcaccccctcaaacaaaaatcagtgttttcaggagaataactatgttacaggtgcttgttacctacaacctttggcttatatcttatctcaagcatctactccgttatgtggcttcatcaataaaataattgaaatagataggatgactgtttctttgactccagaatttcatatcttatactatttaaggaaaggtgattaatgaaaacaaagtaatttataaagtayatacattttagaatttaaactaattcttccaattgcttgcactaatccattgaaggttagctactcttccctacgttcgtattctgcagaatgatttcagattgaggaacagacacccaagaaaatgttttcccccaaatacacattaattaaaaccaagggagaagagaacaaggtgtgacagcttttctgtgtgaattaagctgggtaaaatacctgaaccatgaatctttatttgtggaatgataatagctaaatccaaatagggttttgcaccaacaaattattctacaaatcatg

SEQ ID NO: 190198 - DNA, 601 bp, Human
cccatattttggtcacagcattgtcaatattctataggaaaatttagagcaatttcatttgtatctttttctctaaagacaaggaaatagaaactaagaaagtgatcatgacttattcagagttatacagtgagttgttgggaaaacagaggccaaaacacagttctctaccacaccagaccaccacactctacacaacctcaacctggcctctgatggagagtctacagtcagtgagatagcctcaagttctctaataaacattcacttactagaaaggactctatagttatcacttacrcttcagtgtgaattaaggacactttgttgttccctgtcccagagaacatttctttggattcacatttggacaactaggccatacatatcctgtttccacttactaaccagatactacctacacttcaggctagccctgcgcaataggctagatgataagagctacaatggtgggagaaaagtatgattgcctgtaggcaatagtgtgtgtgtatatgtgtgtggctgtcctgctccaacctaaaaggttaagtagtaaggtgatgttggtttgtgctatttttctttccagaatgttctt

SEQ ID NO: 190199 - DNA, 601 bp, Human
ttgtatctttttctctaaagacaaggaaatagaaactaagaaagtgatcatgacttattcagagttatacagtgagttgttgggaaaacagaggccaaaacacagttctctaccacaccagaccaccacactctacacaacctcaacctggcctctgatggagagtctacagtcagtgagatagcctcaagttctctaataaacattcacttactagaaaggactctatagttatcacttacgcttcagtgtgaattaaggacactttgttgttccctgtcccagagaacatttctttggrttcacatttggacaactaggccatacatatcctgtttccacttactaaccagatactacctacacttcaggctagccctgcgcaataggctagatgataagagctacaatggtgggagaaaagtatgattgcctgtaggcaatagtgtgtgtgtatatgtgtgtggctgtcctgctccaacctaaaaggttaagtagtaaggtgatgttggtttgtgctatttttctttccagaatgttctttttctggttctctacgtggtaatactgaattaacatttcaagtctcagttttcattac

SEQ ID NO: 190200 - DNA, 601 bp, Human
taaagaacatatttattataatatatacttttatatttaggaaatttaaaaggaatctgttgttttcaagaaccttgataaagaaaaatattctcaaggggggtacactgaattctccaggtgtgtttaagattttttgtatgtcaaaaggtagaaaggaacactggcctagacctgaaaggagatcatttgccaccttaaattgcttattatatgagggagaaagtatcagtctactgtgaattcacaatgccagcagccatttaacagtaactgtgatacttcagggactgggatatcmacaaagaagcctaatgttgacctgatttacaaattaaggaaaaatttattaattctgtagtgcccatgcatatactatgtctaataaagtgtggaattctcccactctgctttgaattgtgcattttaaatatggagaaaatctttatatcacatcgtattaatctataatcgccccctggtttcagctccaccagcccaccctcccctacaaatacaaacagttgttacacagtataacaattatgacaaacattattttagaaaaaaagagaaatcagcttgccattgtgaacttact

SEQ ID NO: 190201 - DNA, 601 bp, Human
aagaacatatttattataatatatacttttatatttaggaaatttaaaaggaatctgttgttttcaagaaccttgataaagaaaaatattctcaaggggggtacactgaattctccaggtgtgtttaagattttttgtatgtcaaaaggtagaaaggaacactggcctagacctgaaaggagatcatttgccaccttaaattgcttattatatgagggagaaagtatcagtctactgtgaattcacaatgccagcagccatttaacagtaactgtgatacttcagggactgggatatccayaaagaagcctaatgttgacctgatttacaaattaaggaaaaatttattaattctgtagtgcccatgcatatactatgtctaataaagtgtggaattctcccactctgctttgaattgtgcattttaaatatggagaaaatctttatatcacatcgtattaatctataatcgccccctggtttcagctccaccagcccaccctcccctacaaatacaaacagttgttacacagtataacaattatgacaaacattattttagaaaaaaagagaaatcagcttgccattgtgaacttacttc

SEQ ID NO: 190202 - DNA, 601 bp, Human
atggaactttaacaaacatcaaggttatatttctgtctaatcccttcatcattctgttgtcctatttatgatttttttcttttatttttccactatggagcccacagtctgaaaccgaagcatactattacaactttgtcttcatttttattttaaatttgtcttatttaagacagctttatgttatttattcttaatggaaaatgcactgaggagaactttttttatttgcttttttaaagaattacaattgtgccactgtactccagcctgggcaacagagcaagactccgtctcaaawaataataataataaaaaagaattacaggtgctttttacatttatgctgtcctcaataaatgttcttcagatcatttgtcctgttctctgatttataattcctaagaggacactttaggaggcatacatgggaggcaatgtaatatggataagctacagttagggatgatataactcaggattgtagttttcctttgaaggtgggtcatacaacttaacctttgctcactttttctccatccataagatggacatgcattaccttgtttatactttttaggaatattttataaatgaataa

SEQ ID NO: 190203 - DNA, 601 bp, Human
ggcaatatggtaggggtcatctgttgtcagagataagacttttgaccttgatgttgccactgttcttccagttgagccaggaaccattacttaatcatttacagcatagattttcccatctacaatttgcttttcagaaaccagccttgtggaatttaggccaagaacctggttgctactgctcagagtaggtataggagaggtatgcatttaattcaacaattcctcttgagggtttctgtgtacaaggtcctgtgctgggtgaggttctacctcatctttagcaagtatatttttgtgyttacaatgacaacattagtaagacaaggctgctaatacattcatagtacccgtgtgaggtgagtgctgatgagtggtccactagagttgttaaaaagtgccacaggaacgtggggaaaaaaatataaattttacctggaggattggagacatttcaaggaggaagtaacattggctccaggctttaaagaagagaggggtttaatagataaatctggaagtactccagatagagggaagaatgcaaacaaacgggtagagaacggagaaattcagtgaattgtcagaatagtgtcttgcc

SEQ ID NO: 190204 - DNA, 601 bp, Human
tttgcttttcagaaaccagccttgtggaatttaggccaagaacctggttgctactgctcagagtaggtataggagaggtatgcatttaattcaacaattcctcttgagggtttctgtgtacaaggtcctgtgctgggtgaggttctacctcatctttagcaagtatatttttgtgtttacaatgacaacattagtaagacaaggctgctaatacattcatagtacccgtgtgaggtgagtgctgatgagtggtccactagagttgttaaaaagtgccacaggaacgtggggaaaaaaatakaaattttacctggaggattggagacatttcaaggaggaagtaacattggctccaggctttaaagaagagaggggtttaatagataaatctggaagtactccagatagagggaagaatgcaaacaaacgggtagagaacggagaaattcagtgaattgtcagaatagtgtcttgccttgtgttgtagcagtaccataatgactgacagcctacagtactctgacaatttaaaaaatataacctgttttctttcatgtgggtataatgtctccagttaggcctatccactttttatgatctt

SEQ ID NO: 190205 - DNA, 601 bp, Human
tagcaatcgctccagaaattatcccatcacatagtgtaggctcattgcctaagaacagaatataaccgagaataatacagaaatatcaatatccaaggacaagtaccgaaaaacaaatcttgttttgacagaggtctgttaaagtgtatgttcgtacaccaattatgcggaaattttgagaagtttcttttctgtccatcctagtaatgtttgagtgacttggttgtgacttagaggcctccttttcaagactgtatctctcactgatgtacaccacagtttctgataggttttccttggytggagattatccttacatctttccaaaattctctcaaatatgagaggcctggtttctcaggagggagtattgaagaagggcatacataaatgacaaagagttaattcagcttgcttctcagagttagagtcattgaacgtaaacacacacagacatacatgtacacattcatataaaaagcatctcttttttttaaagtgctgtctaaaaagcaaaatagaacaaaaatccaagaactcaaaaattctacacaaccagagaagcactgggagagaaacagtactgtacgttcagcaaact

SEQ ID NO: 190206 - DNA, 601 bp, Human
cacattcatataaaaagcatctcttttttttaaagtgctgtctaaaaagcaaaatagaacaaaaatccaagaactcaaaaattctacacaaccagagaagcactgggagagaaacagtactgtacgttcagcaaactgttttattttcctcttgcacgtagttagctatatttttccaacctcccttaaagttaggcatgggcatgtgacttggttctaactagtgcaatacaggcagggtgcttcatgctgcttccagatgtggccctaaaattaccatctgacccttcacttgccctcrtttcctccctttctcctcccttctcctctcctctctttatcataggctgaatagagaggacccagaagaaatctttgaggccctagaggactgctaagccactagatggaaggattctagacctcttagtcaccctgagtaggaaagtcacacaagagagctgccagaagggaaatatctgtgtaagattttgtgtgagaaggctgattatagcatttgttttgaaattacggcatttgttttttcctgtggttatcttttaatctaaaacaggaagcattgagggtatgttctgatcac

SEQ ID NO: 190207 - DNA, 601 bp, Human
cacaaccagagaagcactgggagagaaacagtactgtacgttcagcaaactgttttattttcctcttgcacgtagttagctatatttttccaacctcccttaaagttaggcatgggcatgtgacttggttctaactagtgcaatacaggcagggtgcttcatgctgcttccagatgtggccctaaaattaccatctgacccttcacttgccctcgtttcctccctttctcctcccttctcctctcctctctttatcataggctgaatagagaggacccagaagaaatctttgaggccctasaggactgctaagccactagatggaaggattctagacctcttagtcaccctgagtaggaaagtcacacaagagagctgccagaagggaaatatctgtgtaagattttgtgtgagaaggctgattatagcatttgttttgaaattacggcatttgttttttcctgtggttatcttttaatctaaaacaggaagcattgagggtatgttctgatcacttagaagaagataaggtataacatccagatttgatctctctaagaatgtgctacctttgctattctagggaatattccttgatata

SEQ ID NO: 190208 - DNA, 601 bp, Human
ttctaactagtgcaatacaggcagggtgcttcatgctgcttccagatgtggccctaaaattaccatctgacccttcacttgccctcgtttcctccctttctcctcccttctcctctcctctctttatcataggctgaatagagaggacccagaagaaatctttgaggccctagaggactgctaagccactagatggaaggattctagacctcttagtcaccctgagtaggaaagtcacacaagagagctgccagaagggaaatatctgtgtaagattttgtgtgagaaggctgattatagyatttgttttgaaattacggcatttgttttttcctgtggttatcttttaatctaaaacaggaagcattgagggtatgttctgatcacttagaagaagataaggtataacatccagatttgatctctctaagaatgtgctacctttgctattctagggaatattccttgatataaacattaagacctattaggtatatacatttcagcaaaagatgattgtaattacaaactgacattgatggtaaattactctatacccttaataaggtcacgggttgtgagtctgaaaccgtctctctgg

SEQ ID NO: 190209 - DNA, 601 bp, Human
caggcagggtgcttcatgctgcttccagatgtggccctaaaattaccatctgacccttcacttgccctcgtttcctccctttctcctcccttctcctctcctctctttatcataggctgaatagagaggacccagaagaaatctttgaggccctagaggactgctaagccactagatggaaggattctagacctcttagtcaccctgagtaggaaagtcacacaagagagctgccagaagggaaatatctgtgtaagattttgtgtgagaaggctgattatagcatttgttttgaaattayggcatttgttttttcctgtggttatcttttaatctaaaacaggaagcattgagggtatgttctgatcacttagaagaagataaggtataacatccagatttgatctctctaagaatgtgctacctttgctattctagggaatattccttgatataaacattaagacctattaggtatatacatttcagcaaaagatgattgtaattacaaactgacattgatggtaaattactctatacccttaataaggtcacgggttgtgagtctgaaaccgtctctctggtggtttgggacatagcc

SEQ ID NO: 190210 - DNA, 601 bp, Human
ggccctagaggactgctaagccactagatggaaggattctagacctcttagtcaccctgagtaggaaagtcacacaagagagctgccagaagggaaatatctgtgtaagattttgtgtgagaaggctgattatagcatttgttttgaaattacggcatttgttttttcctgtggttatcttttaatctaaaacaggaagcattgagggtatgttctgatcacttagaagaagataaggtataacatccagatttgatctctctaagaatgtgctacctttgctattctagggaatattccwtgatataaacattaagacctattaggtatatacatttcagcaaaagatgattgtaattacaaactgacattgatggtaaattactctatacccttaataaggtcacgggttgtgagtctgaaaccgtctctctggtggtttgggacatagccaccatggtatgtaaatctgatgctaaaaattggagcagctagccatgtgaagaatttggatactgtacataaaccacaatgaatcttattgtggaatagtaaagatttatcactgtataaatttctgtgcactgatttggtctgtttg

SEQ ID NO: 190211 - DNA, 601 bp, Human
tgtggatttcactttcaaccactttagcttagatagtgataacaattacctaccatttattcagtactcactacgtactatactaaaaactatatacatctcatttactcatacagcgatatagcacattaaatatttttattcctgttccacatatgaggaaactgaggcttagaaagtttaagcaacttggttcaagtcaaacatctgtaatgtggcaaaaccacatttctaaaagtcatgttcctaatcagtgctcaatgcatccgttactgacctttgtattctttatctgtaattrtattagatacctcccttttatgtataatgtccaattttataaaatatatttttatttactcttgagtgagatcaaaccccaggggatagcatatttgttcagggccattttgttttaatgattttacaccataaaatttgtttagattcttagtcactggactttgtggaaagaatgtcataatttctgtgctgaatttcatttttaaaaagccctggaaatgctacttccatgatcccttcccttttaaagagagagaatttgccaatcatctttctcactcagtcccaacattggaat

SEQ ID NO: 190212 - DNA, 601 bp, Human
tctatctaattcacactatcaattgcaacaactgaaatatcaacatacacgtatacgaactaaacaaatatgtacacacacacacacacagtgtttgctgtcctaaagctgctcccatgtttcaacatctctgaaattaaagagttattatcactatttaataacctttccaacatgcaaacacatgcttcatctggatcaatcacagataatttcataataaataatgtactaaatatcatcttccacactgatcaagagaccagcttgagagagtgtgtcatgtaacttttgacaaacmcaataactttgaataataatttgcttattagctaagatttgggaagctgactgcttccagaagcatctggatgggataagaaatgagaacagctatactgttttcatatagctatactgaatttgaatttctttaaactcaatacactaaaaatatgacctcacaagcctgtaggtcacagataaaatctgaaattaggattgtagacatcctgattaaatgaagttggtctcattaaccaaaagtaatcatgcttgttcagtccctaagctgcttaatgcttctgcaaaatctgggaat

SEQ ID NO: 190213 - DNA, 601 bp, Human
tcttctgtgctgcataagccctttcctttaaagcagttttctttgtgttctttttttcttttagcttgaaattggacccagcctccaaaagtcagtctttaccctgagcttagaaagggaagacatagagttagtagtaacaggaaacatattaaatgcaagggatagaattaaagaatgtgttaatgtggaaaaatgagaaaccttgctatataatccactatttctgtcagactccaagaatctaaaatggaaaattattcaagaaagataacaacataagagaatgcgctgatggagraaggtctatattggaaaaacaaaaacaaatgccaatctttacagagggtaacctacaaggatatatcacaagcatctacaagtgatggattttgattcccaagtgtgtggagaaaactcctagggacaactttgcagtgaccagaaagccatgattgaataaggggacacatgttcctgggataggagtgatcttgtgtttattttggaaagaattatttaaagggaaaaataaacctgatgtattagtttgttttcacagtgctataaaggactacctgagactgggtaatttacaaac

SEQ ID NO: 190214 - DNA, 601 bp, Human
ttgtgttctttttttcttttagcttgaaattggacccagcctccaaaagtcagtctttaccctgagcttagaaagggaagacatagagttagtagtaacaggaaacatattaaatgcaagggatagaattaaagaatgtgttaatgtggaaaaatgagaaaccttgctatataatccactatttctgtcagactccaagaatctaaaatggaaaattattcaagaaagataacaacataagagaatgcgctgatggaggaaggtctatattggaaaaacaaaaacaaatgccaatctttamagagggtaacctacaaggatatatcacaagcatctacaagtgatggattttgattcccaagtgtgtggagaaaactcctagggacaactttgcagtgaccagaaagccatgattgaataaggggacacatgttcctgggataggagtgatcttgtgtttattttggaaagaattatttaaagggaaaaataaacctgatgtattagtttgttttcacagtgctataaaggactacctgagactgggtaatttacaaacaaaagaggtttgattgactcagacagagtttcacaagactgg

SEQ ID NO: 190215 - DNA, 601 bp, Human
tgtgttctttttttcttttagcttgaaattggacccagcctccaaaagtcagtctttaccctgagcttagaaagggaagacatagagttagtagtaacaggaaacatattaaatgcaagggatagaattaaagaatgtgttaatgtggaaaaatgagaaaccttgctatataatccactatttctgtcagactccaagaatctaaaatggaaaattattcaagaaagataacaacataagagaatgcgctgatggaggaaggtctatattggaaaaacaaaaacaaatgccaatctttacmgagggtaacctacaaggatatatcacaagcatctacaagtgatggattttgattcccaagtgtgtggagaaaactcctagggacaactttgcagtgaccagaaagccatgattgaataaggggacacatgttcctgggataggagtgatcttgtgtttattttggaaagaattatttaaagggaaaaataaacctgatgtattagtttgttttcacagtgctataaaggactacctgagactgggtaatttacaaacaaaagaggtttgattgactcagacagagtttcacaagactggg

SEQ ID NO: 190216 - DNA, 601 bp, Human
tataatccactatttctgtcagactccaagaatctaaaatggaaaattattcaagaaagataacaacataagagaatgcgctgatggaggaaggtctatattggaaaaacaaaaacaaatgccaatctttacagagggtaacctacaaggatatatcacaagcatctacaagtgatggattttgattcccaagtgtgtggagaaaactcctagggacaactttgcagtgaccagaaagccatgattgaataaggggacacatgttcctgggataggagtgatcttgtgtttattttggaawgaattatttaaagggaaaaataaacctgatgtattagtttgttttcacagtgctataaaggactacctgagactgggtaatttacaaacaaaagaggtttgattgactcagacagagtttcacaagactgggaagacctcaggaaactgacaaccatgacagaaggcaaaggggaaggaaggcgtgttttgcagggtggcacgatgggggaactaccaaacacttttaaaccatcagatcttgtgagcggtcactcactgtcatgagaatggcatgggggaaactgtcaccgtgatccaa

SEQ ID NO: 190217 - DNA, 601 bp, Human
gagagtatgtgggtagcagtttgtagatccctatttcagagagtcttctgtttttcttgagccagatctccttcgtgagcgcttttctttggaattatgctcctctttttctctatgaactttaaaaagcaaatttctttcttgaaatgtagataaagcctgggtttgtcctctaagtactgcatttgagaagcattgaacaatcacataaaccttaaaaggatttttattcatttaatctcatttattctgtttctaaaaggatattaaagaagatccagttagtaatcttcagtagcarttttcactgtttactcttctctcctgccttcacaagctacaatctattcatttttcctctgccaaaccctgtctcaaattcttgcccccagcaagctcggcccacaaggttttcattttttccacgccacctctatctcagagctctttgttttgtaggtagactaaagcatcattgctaaatttgttcatctgtcttctccctccatcattctcagatacagaaatcaaagaaccaggccaaggaggaagaatcattgaagggaagatcaaagcttgtgaacactcctgattttaaatg

SEQ ID NO: 190218 - DNA, 601 bp, Human
gtggtggcacatgcctgtaatcccagctactcaggaggctgaggcaggataatcacttgaacccaggaggtgaaggttgcagtgagctgaaactatgccattgcactccagcctgggcaacaagagtgaaactccgtctcagaaaaaaaaaaaaaaaagaagaagactggaggctggcagggagcagatagggagatagggagagactctgctacacattcattatccagcatctcctaacagactcagccatctcacactaagagacagcaaacaaagagaaggctcccagcagccacayggcaatcacactggaattaccttctgtgcaccactggacagctggaggggtgaggccagagggcctattcgtaaacaagtctctcccagtcatgtccataaaggcatttgcctgtaggaggtgattggcttccgatgaagttgctataagaggacactgacagggaagatctttgcagagatttagaggcctgatctgcaatttaggcagagagtttttggtgcagtaggaagtttgaagaagtctttgcagcagtagttattggtttacagtggaccgtctttaccagaagtcgtgaat

SEQ ID NO: 190219 - DNA, 601 bp, Human
aggatgcttagtgattttctagtattttctagtaatacaataaccttctattacacatgggggaaatgaaaactagagagagaaagggattcccccgtagttacctggctagttagggcagacagtgaaaaatatatggatctatcaggtgcttttttttttttctctgcattgcccgttgtgattggaaatattaactgggtggcaagacacaacaagaatccttgggttgctctgctgaagtgggcggcaggaaagtataatgatccatcttgctttggaggttcagctagaactttgwttcataaagggacttcttcaaaccacctgggaggctctcgcttgtttcacatgcccagacttacctccctgggcgtaaggagtatccagctgcccaggtgatttcgatttgcttatcctcgccacttgagactccttaagtctagacagcaatggttctgaacctcaccaagcattacaatctcttgtggaatttctagacttttaagtaatattccagctcagatttaagtctgggaaattctgatttaattgaactggggtagtgcccaggcatctgtattttaagcatcccagatat

SEQ ID NO: 190220 - DNA, 601 bp, Human
cagggcttggaaagaattccgtgaagacgctgatctaccctctctagactgaagtatatgtggtttcctcagcataaaggaatgacagaggacaaataactcagcaggaagtgtttggaattggcaggtaaggaaaaataataagggagcagccttagaaggataagcgcgtctttagtgtcagcaatccttgggctgtagttcatctgataacaaggtcaaaagtctcctgtaaaatgcacgatagaatctttggaccagagggccttagagctcaggggaatcaaccccttcacttcayagaggaggaacttgaatcccaaacaggggcagggacttgcccaagatcccagctagtgaacgcattgggcctgtaaggcagggctctgaactctgttcactcctaggagagtccgcacagtgcacagtgtgatagttaagaactactccaggcgcagaaagctcatgtaccttccccaaagttatacacctagtaaacgtgggtgtgtataaaacaccaactttctcatgttttgttgggaggattaaatattcgtaaggcacttagatcaatgcccagcatgcagtatgtgttatatta

SEQ ID NO: 190221 - DNA, 601 bp, Human
atttctgttgaactgtaaagtgtgacacctaccgctccttactggggaagtggagtaacctaaggtaaagagtcaagacctttttttccttcagtgatatagttactactggattctccttctcaccattacagatatggaaattgaaggttagagaggttgcatagctcgcccaaagttattaaccttgtgaatgacagactagggactctgaagccatatccttaggaacccagagttaccattctcccggttaccatgtgagtttgagcatttttcttatctattaaatgggttcatrttggtatctaattcaagggatgttgtgaaaattaaacaatgcctgtcaggcatattgcagatactttgctcatggaaacaatcaaatgatagctatcgattctcttattgatgttagcattgttacttgtccttttcaaatattttattcaacaaacatttgtttgacaccccctctgtgccatatactgtgctaatctgtgaacccacaaaggccagaaactaaaatttggtttttctctccatgaaccaaccagtcaggtaggaactgtaaataaagatctgtaccatagacaaaatg

SEQ ID NO: 190222 - DNA, 601 bp, Human
gagtcaagacctttttttccttcagtgatatagttactactggattctccttctcaccattacagatatggaaattgaaggttagagaggttgcatagctcgcccaaagttattaaccttgtgaatgacagactagggactctgaagccatatccttaggaacccagagttaccattctcccggttaccatgtgagtttgagcatttttcttatctattaaatgggttcatgttggtatctaattcaagggatgttgtgaaaattaaacaatgcctgtcaggcatattgcagatactttgytcatggaaacaatcaaatgatagctatcgattctcttattgatgttagcattgttacttgtccttttcaaatattttattcaacaaacatttgtttgacaccccctctgtgccatatactgtgctaatctgtgaacccacaaaggccagaaactaaaatttggtttttctctccatgaaccaaccagtcaggtaggaactgtaaataaagatctgtaccatagacaaaatgtaattctgatcagagaggaacaaaatgtgccctgatgatttagtaaaaacaaaacttatctaccaggta

SEQ ID NO: 190223 - DNA, 601 bp, Human
gaatgacagactagggactctgaagccatatccttaggaacccagagttaccattctcccggttaccatgtgagtttgagcatttttcttatctattaaatgggttcatgttggtatctaattcaagggatgttgtgaaaattaaacaatgcctgtcaggcatattgcagatactttgctcatggaaacaatcaaatgatagctatcgattctcttattgatgttagcattgttacttgtccttttcaaatattttattcaacaaacatttgtttgacaccccctctgtgccatatactgkgctaatctgtgaacccacaaaggccagaaactaaaatttggtttttctctccatgaaccaaccagtcaggtaggaactgtaaataaagatctgtaccatagacaaaatgtaattctgatcagagaggaacaaaatgtgccctgatgatttagtaaaaacaaaacttatctaccaggtatccttaagaaatacattattctgggtagctgagttttctataatagttgaacatatacttgttagatagcattttatgtttctttttgtattggaagatagacatttctgaatataatacat

SEQ ID NO: 190224 - DNA, 601 bp, Human
ttgcaagagtggaagacaaatacaattaaatgcacctgggattcaaatcccctccatctcctctgttcacattctgtattcacaagcattatggttatggaacaccttcgtgctgagcactgttccaggccttgggggatgcatccgggaacggggcaatcagctcatgttaagcttacattcttcaggcagtggggtggatgggggtacgggagagactaacaatcaacatgtaaatatataacacagtctcggataattgatatttaaaaaatatggggcaaggataaaccagcaatcratttctttttctcccttacttctcaccatgatttgcacaaatgtgttgcttaataaataaatccttatgatttgtatcagactttactgctagatactattttttcaaggtgttatacctcattgtgaaaaaaagtctaaaggttgtgatttatataaaccacatttcctgtctttagtcaattttgtgtatttaatttactaaaaatgaaatttaccaggacaaataattaaaacagacatagtatatataattattactttgaatgttaaggaattaggtaaacatggtaatgtgaag

SEQ ID NO: 190225 - DNA, 601 bp, Human
attcacaagcattatggttatggaacaccttcgtgctgagcactgttccaggccttgggggatgcatccgggaacggggcaatcagctcatgttaagcttacattcttcaggcagtggggtggatgggggtacgggagagactaacaatcaacatgtaaatatataacacagtctcggataattgatatttaaaaaatatggggcaaggataaaccagcaatcgatttctttttctcccttacttctcaccatgatttgcacaaatgtgttgcttaataaataaatccttatgatttgtaycagactttactgctagatactattttttcaaggtgttatacctcattgtgaaaaaaagtctaaaggttgtgatttatataaaccacatttcctgtctttagtcaattttgtgtatttaatttactaaaaatgaaatttaccaggacaaataattaaaacagacatagtatatataattattactttgaatgttaaggaattaggtaaacatggtaatgtgaagtttatacacaagacagaccctgtaaagtccactttcaaatagggttaaagcataatcgacagaaaatttaaaaaata

SEQ ID NO: 190226 - DNA, 601 bp, Human
cagtggggtggatgggggtacgggagagactaacaatcaacatgtaaatatataacacagtctcggataattgatatttaaaaaatatggggcaaggataaaccagcaatcgatttctttttctcccttacttctcaccatgatttgcacaaatgtgttgcttaataaataaatccttatgatttgtatcagactttactgctagatactattttttcaaggtgttatacctcattgtgaaaaaaagtctaaaggttgtgatttatataaaccacatttcctgtctttagtcaattttgtrtatttaatttactaaaaatgaaatttaccaggacaaataattaaaacagacatagtatatataattattactttgaatgttaaggaattaggtaaacatggtaatgtgaagtttatacacaagacagaccctgtaaagtccactttcaaatagggttaaagcataatcgacagaaaatttaaaaaataaaacataggacttatcgggactaggaatataaatatgtaaaaattaatatataaaaggaaattgttcctgaatggcaagatgactaattttaaagtttaaaacttctatttt

SEQ ID NO: 190227 - DNA, 601 bp, Human
tactaccaagagttggaacaaataaagtcaggacaggtgaaaatatatatttccttcactttgaagggaaccacacgagggaatttagcaatatgggggcagatggtgggggaggaaatcctgcttcggaatgtgagtgtgtgaattctcagctttctgccatggttctttgttactactgattcttcagtgcaacacatacatagccaatacaaatgtaaaattattttgcaggccgggtgtggtggctcacacctgtaatcccagcacttggagaggctgaggtgggcagatcatgagrtcaggagctggagatcaacctgaccaacatggtgaaaccccatctctactaaaaaatacaaaaatcagctgggcgtgctggcacgcacctgtaatcccagctacttgagaggctggggcaggagaattgcttgaacccaagagccggaggttgcagtgagccgagatcatgccattgcactccagcctaggcaacagagcgagagtttattttgggtggggcgggggggaatattttgtcatcattgctagtgaatgtttggaataaaacatgtacagattaggcaaatttatatttaag

SEQ ID NO: 190228 - DNA, 601 bp, Human
tggttctttgttactactgattcttcagtgcaacacatacatagccaatacaaatgtaaaattattttgcaggccgggtgtggtggctcacacctgtaatcccagcacttggagaggctgaggtgggcagatcatgagatcaggagctggagatcaacctgaccaacatggtgaaaccccatctctactaaaaaatacaaaaatcagctgggcgtgctggcacgcacctgtaatcccagctacttgagaggctggggcaggagaattgcttgaacccaagagccggaggttgcagtgagcygagatcatgccattgcactccagcctaggcaacagagcgagagtttattttgggtggggcgggggggaatattttgtcatcattgctagtgaatgtttggaataaaacatgtacagattaggcaaatttatatttaagaaaaatccataaacacgtatcttgttcctccatatgaacgtcactcggtcttactctctgggtgggccgatcgtcttatcactgagtagcggcagtccaaagaatgaggctcaacaccttggtctgctgctattgatggaatatgtgatcttgacaagtatt

SEQ ID NO: 190229 - DNA, 601 bp, Human
ggatggataggtggaagaagtcatgtttagagttttgaatcacttttatctaagggttgaggatacttccagagtctttgagggctcaagtttccttgagcaatagtaatcctaactgtcttttcttatattacctttgagagtcagttccttctggcaacattgagaatctgcagaagggcaagcattctgtaaatatcattcacctatcattacccattttcttatgccaattttctggtcatatcgtggaaaaaggctgactattttgatgagacagaattagtaaaatatttagttrtttcatagaaaaaagaaatattcctcttaactgtgaaaacttcatattgcccaagttttgtggtgaatgaaaataaggagccatatatgtaatttagcaaagcacgaatttgaaacaatataaatttaaatctcagatttattaccaacacctgagtaacaacttccctatccttgctgaacgtaaagatcatcatgtataaatgctgacattttgtgaggtcctcaaaggtttatacctatttgtgatcccatcctcccaatgaggatatcccagtttgatcacagttggtgaggagga

SEQ ID NO: 190230 - DNA, 601 bp, Human
tttgaatcacttttatctaagggttgaggatacttccagagtctttgagggctcaagtttccttgagcaatagtaatcctaactgtcttttcttatattacctttgagagtcagttccttctggcaacattgagaatctgcagaagggcaagcattctgtaaatatcattcacctatcattacccattttcttatgccaattttctggtcatatcgtggaaaaaggctgactattttgatgagacagaattagtaaaatatttagttgtttcatagaaaaaagaaatattcctcttaactrtgaaaacttcatattgcccaagttttgtggtgaatgaaaataaggagccatatatgtaatttagcaaagcacgaatttgaaacaatataaatttaaatctcagatttattaccaacacctgagtaacaacttccctatccttgctgaacgtaaagatcatcatgtataaatgctgacattttgtgaggtcctcaaaggtttatacctatttgtgatcccatcctcccaatgaggatatcccagtttgatcacagttggtgaggaggaggtccctccaggcctgctctattggagatttct

SEQ ID NO: 190231 - DNA, 601 bp, Human
aaagacttagcaccaggcgctctggctcacgcctgtaatcccagcgctctgggaagctgaggcaggtggaccacctgaggtcaggagttttgagaccagcctggccaacatggtgaaaccccatctctacgaaaaatacaaaaattagccgagcacagtggtgcatgcctgtaatcccagctgctcaggaggctgaggcaggagaatcgcttgaacccaggaggcagaggttgcagtgaaccaagatggtgccacaagactccaggctgagcaagagagaaagccttcatctcaaaaaaaagaaaaaaaaagaacacttaggttttcatgaaatatatctggtgtgaaccagtgaaccagttcttcttagatttcagcttttctgtctgttaaattagaaaaactaagctagacgacctctcaggtctattatttctaaaacccatctatgcagctaaggttgtttggaatctgaaattttagagatgtggagattttcaagcacactgacagaaaataaaggtgcaacagactaaaatgacaacatttagggaagaacaggcaaagcaagagggagtgcagaccattggcagaaacctct

SEQ ID NO: 190232 - DNA, 601 bp, Human
aggtcaggagttttgagaccagcctggccaacatggtgaaaccccatctctacgaaaaatacaaaaattagccgagcacagtggtgcatgcctgtaatcccagctgctcaggaggctgaggcaggagaatcgcttgaacccaggaggcagaggttgcagtgaaccaagatggtgccacaagactccaggctgagcaagagagaaagccttcatctcaaaaaaaagaaaaaaaaagaacacttaggttttcatgaaatatatctggtgtgaaccagtgaaccagttcttcttagatttcagyttttctgtctgttaaattagaaaaactaagctagacgacctctcaggtctattatttctaaaacccatctatgcagctaaggttgtttggaatctgaaattttagagatgtggagattttcaagcacactgacagaaaataaaggtgcaacagactaaaatgacaacatttagggaagaacaggcaaagcaagagggagtgcagaccattggcagaaacctcttgatgttttcagttcacttctgtaaagttctttcttcctgaattaatgcagagtgtaagacagttaatccaagaaaa

SEQ ID NO: 190233 - DNA, 601 bp, Human
gaaaccccatctctacgaaaaatacaaaaattagccgagcacagtggtgcatgcctgtaatcccagctgctcaggaggctgaggcaggagaatcgcttgaacccaggaggcagaggttgcagtgaaccaagatggtgccacaagactccaggctgagcaagagagaaagccttcatctcaaaaaaaagaaaaaaaaagaacacttaggttttcatgaaatatatctggtgtgaaccagtgaaccagttcttcttagatttcagcttttctgtctgttaaattagaaaaactaagctagackacctctcaggtctattatttctaaaacccatctatgcagctaaggttgtttggaatctgaaattttagagatgtggagattttcaagcacactgacagaaaataaaggtgcaacagactaaaatgacaacatttagggaagaacaggcaaagcaagagggagtgcagaccattggcagaaacctcttgatgttttcagttcacttctgtaaagttctttcttcctgaattaatgcagagtgtaagacagttaatccaagaaaaacaacttgaaaagaaaaaaaaaattgacttcgggctt

SEQ ID NO: 190234 - DNA, 601 bp, Human
ctagacgacctctcaggtctattatttctaaaacccatctatgcagctaaggttgtttggaatctgaaattttagagatgtggagattttcaagcacactgacagaaaataaaggtgcaacagactaaaatgacaacatttagggaagaacaggcaaagcaagagggagtgcagaccattggcagaaacctcttgatgttttcagttcacttctgtaaagttctttcttcctgaattaatgcagagtgtaagacagttaatccaagaaaaacaacttgaaaagaaaaaaaaaattgacttygggctttctatctttaggtgtgactgacttgacaaaaacctttgaacagaatgattgttctatgagtaaattgatactgagagtcacccaaaggtaaagacttggaagataggtaggatttgcttcactcttcttgccctatggcaccagctaatctttttcctctttttctctcaataatgtttcaacatatttatctataaaatggaaattaatactgagcatgaaaagaaaaggccatgaaaatcccctaacatagaccgttaatttttctttcctttttatttttaagaaacagac

SEQ ID NO: 190235 - DNA, 601 bp, Human
gactgatctattccaactcccctccaccacccctgtcttttgtaataaagcccccttgaagccctgagaggagtaaagttgcctcatttaatgtagccagtctaagacaaaaatgatctagaagaaaatgagtggtgatgagggtattgttttgacccaaggttacagatggaagggagggataggtttcatataattactttatttttatgtgacactttaaaaactcaaacagaccattcaaacacactatctaatcagtttaattcagcaagtatgtcctggatgcaaacgatgtagygcgttttgtggtagaaccaatgcattgactaccaggcgctgtatgacaattatgttgcacatttaaagaaagcctctcaaccaccttctgagggaagcatagttgaagaaactaaggttcaaaggcattgagtaacttggccatggcctcaaagcatgtcattagcagaactgagattgaacctaggtcagccccattccaaaacttgcaattcttcaactctatcctcaaggagctgtaaaaccacaagaaatacagagctgagagagagatgtttcacccacaaattacctaaaatcc

SEQ ID NO: 190236 - DNA, 601 bp, Human
attcaaacacactatctaatcagtttaattcagcaagtatgtcctggatgcaaacgatgtagcgcgttttgtggtagaaccaatgcattgactaccaggcgctgtatgacaattatgttgcacatttaaagaaagcctctcaaccaccttctgagggaagcatagttgaagaaactaaggttcaaaggcattgagtaacttggccatggcctcaaagcatgtcattagcagaactgagattgaacctaggtcagccccattccaaaacttgcaattcttcaactctatcctcaaggagctrtaaaaccacaagaaatacagagctgagagagagatgtttcacccacaaattacctaaaatcctctgcagcaggttaattgttgaacaagcaaagtaggacagagtagcattgatgagatgaaataaaagaacaaaattcaaaggagaaaaattatacttaaattaggaactaggaagtactaagtaaggaagagagcactgagggttgggtaggcatgggaaaggcagtggggtggagatcctggtctccatgctgtcacgtgcaaggaagctgaagtttgaggagtctggaggcttgtt

SEQ ID NO: 190237 - DNA, 601 bp, Human
cttactatgtggaaataagggaaattatagaaatagatgatgagtatggaaccagtgctgtttttctctcttctgccttagagatgatgtcttccttctatgtaacactcttttctgaatctgccttggtctttattattgaagatgttggtcacattatctatcagtctctttagaaactaaatctacatttctgccaacttaaaaactcatactttttcgaatctcacacactaatatcattattgttgagagcctatttgtgtggtgatgtttaccttctagtgctcacctggctttygagctatcaggcatcccgtttggatctttggatgttggggatgtccttatgggtccgtgtatatgaccactcatatgggagtttatctgcattttggttttggaataattcatgcctttgttcatttctgtttttgacatttgctatgattgcatttacttttattttttcctatatttcagttttatctgaagacaaattttagtgtaaatcaaacatattcaaaagtgtcatcttgagagtatttataagtttcacttcaacgttaaatctatcaacttttacttcttctctacttac

SEQ ID NO: 190238 - DNA, 601 bp, Human
ctctctttccctccctccctccctccgtccctccctccctccctcccttctttttttttttttttttgagacagaatttcactcttgtcgcccaggctggcatgcagtggctcaatcttggcacactgccacctctgcctcttgggttcaagcgattctcctgcctcagcctctcgaatagctgggattacaggcaccggccgccaagcccagctaatttttgtatttttggaagagacagggtttccttgccctggaccctcttcctgccctctccagtctgaatccaaagctagtcttyacaattcccttaattctctgatgtaacctattcagtgaaacaacagtagtattgtttttatctattttgtttgttcccttccccagtggtataagctggagataatcacttaactgtgtaggttgggagatgacaaattcatgttttctaaactgattcacatttctaaaccctcacccttttttcccagatagtcacttaatgtctgacccactcaattttcagcagatggccttgtcttcctcctgcttcatcaagaaaatcgaagtcatcagccttgacttctatttatcttctatg

SEQ ID NO: 190239 - DNA, 601 bp, Human
atgcagtggctcaatcttggcacactgccacctctgcctcttgggttcaagcgattctcctgcctcagcctctcgaatagctgggattacaggcaccggccgccaagcccagctaatttttgtatttttggaagagacagggtttccttgccctggaccctcttcctgccctctccagtctgaatccaaagctagtctttacaattcccttaattctctgatgtaacctattcagtgaaacaacagtagtattgtttttatctattttgtttgttcccttccccagtggtataagctggarataatcacttaactgtgtaggttgggagatgacaaattcatgttttctaaactgattcacatttctaaaccctcacccttttttcccagatagtcacttaatgtctgacccactcaattttcagcagatggccttgtcttcctcctgcttcatcaagaaaatcgaagtcatcagccttgacttctatttatcttctatgaaaacctttatatctgtacttaattttgccatctacttcatcctagagtgagggattaaggggttttagttcaagacagtcctctctacctatgccttgac

SEQ ID NO: 190240 - DNA, 601 bp, Human
caggcaccggccgccaagcccagctaatttttgtatttttggaagagacagggtttccttgccctggaccctcttcctgccctctccagtctgaatccaaagctagtctttacaattcccttaattctctgatgtaacctattcagtgaaacaacagtagtattgtttttatctattttgtttgttcccttccccagtggtataagctggagataatcacttaactgtgtaggttgggagatgacaaattcatgttttctaaactgattcacatttctaaaccctcacccttttttcccaratagtcacttaatgtctgacccactcaattttcagcagatggccttgtcttcctcctgcttcatcaagaaaatcgaagtcatcagccttgacttctatttatcttctatgaaaacctttatatctgtacttaattttgccatctacttcatcctagagtgagggattaaggggttttagttcaagacagtcctctctacctatgccttgaccttttccaacctgcctattccaggatttcttaccatgccattccctttctttccaggatcttgaaattttctctctccacactagctcc

SEQ ID NO: 190241 - DNA, 601 bp, Human
cctcctgcttcatcaagaaaatcgaagtcatcagccttgacttctatttatcttctatgaaaacctttatatctgtacttaattttgccatctacttcatcctagagtgagggattaaggggttttagttcaagacagtcctctctacctatgccttgaccttttccaacctgcctattccaggatttcttaccatgccattccctttctttccaggatcttgaaattttctctctccacactagctccttcctctttaggcataattcaggttcttctaatccaattgtatccaaaaaaacatttcttttgcacacccccatttactcctcaaaacactaaaatattttgagggtgtcattaatctacagaaggttctaatgtcaaggttgccaatgacctccttatgtcaaatctagtaggtatttttgaggtcttatcttcctagatcccattgccattgagtactgttgattacttttcattttgtttttaccttggcttctaaaataccataaacttctcagggtctgttagttctcaggttttctaagtggagccccacgtgccttttctcattgcacctattctgcacaggtcg

SEQ ID NO: 190242 - DNA, 601 bp, Human
atattatttaatatattttgatatatgtaaatatacacacacactctttctctgtctctctcaccataagtacagtacataggctttttaaaaacatagcatataagtttcttcttacctctctggcttaatctcccagcattctctgccccaaatttttcaaaatattaacacagagatgcttgtgattttctcacacataccaggctattttccattatagtgttttgtttatgctgttgtcatagagtgcccactgtgtaccattagctcttacctgaccttcctaattttcatcagyaaaggctctttccttgattcttcaaataaaattacattgttcatctttgtgttttcgtagtgctgtctatactgctaacacatttactataggtttgttttcctgtctttccttctataccatcaattcctagaagatgagacagtattatacactttttatttccagtttccattatgcttcctggcaaataagtcctctatgcatgtttaacttgagcaaatgaatgtgctattgcaggtagcttggaaatcagcattcataaatctaatagtattatcttctactgtattactagac

SEQ ID NO: 190243 - DNA, 601 bp, Human
aaaaacatagcatataagtttcttcttacctctctggcttaatctcccagcattctctgccccaaatttttcaaaatattaacacagagatgcttgtgattttctcacacataccaggctattttccattatagtgttttgtttatgctgttgtcatagagtgcccactgtgtaccattagctcttacctgaccttcctaattttcatcagcaaaggctctttccttgattcttcaaataaaattacattgttcatctttgtgttttcgtagtgctgtctatactgctaacacatttactrtaggtttgttttcctgtctttccttctataccatcaattcctagaagatgagacagtattatacactttttatttccagtttccattatgcttcctggcaaataagtcctctatgcatgtttaacttgagcaaatgaatgtgctattgcaggtagcttggaaatcagcattcataaatctaatagtattatcttctactgtattactagaccagaacacatatttgaaattttaagaagatgattgactatcctcatacagtatttttctaattctttataacaggaacagtaacactta

SEQ ID NO: 190244 - DNA, 601 bp, Human
aggcctatatgttcagttcagcccattgacttgaactttgtggatgaaccatcagaagatggtgcgacaaacaagattgagattagcatggactgtatccgcatgcaggactcggacctgagtgaccccatgtgggtgagtggcacaggctttctcttcagtctttgggccatgctatctatagctctgttaaacctgtcttttcagtcatgtgtgaaaaggcaggtggctctgaatggccaaggcctttgggaagagagtctatgttgttagctgagagaagatttggtgtggattatgsattctgggtctgccgcaaatatctataatatatgtgtttccatccgtgtggggagggagattctttacatcttttatcttgattgttcctcatgtcaaccccaatttagaaaagatggtaccagctcaaggctttctagctggtagggacagcaaaagaatcagaaatttattttatttatatatttatttatttgacagaatcttactctgtcacccaggctggagtgcagtggcaggatctcagctcattgcaacctctgcttccctgattcaagtgattttgctgactcagtctccc

SEQ ID NO: 190245 - DNA, 601 bp, Human
ctatctatagctctgttaaacctgtcttttcagtcatgtgtgaaaaggcaggtggctctgaatggccaaggcctttgggaagagagtctatgttgttagctgagagaagatttggtgtggattatggattctgggtctgccgcaaatatctataatatatgtgtttccatccgtgtggggagggagattctttacatcttttatcttgattgttcctcatgtcaaccccaatttagaaaagatggtaccagctcaaggctttctagctggtagggacagcaaaagaatcagaaatttattktatttatatatttatttatttgacagaatcttactctgtcacccaggctggagtgcagtggcaggatctcagctcattgcaacctctgcttccctgattcaagtgattttgctgactcagtctcccaattagctgggattacagacatgcaccaccacacctggctaatttttgtatttttaggagaggcagggtttcgccatgttggccaagctggtctcgaactcttgccttcctgtgatctgcccacctcagcctcccaaagtgctgggattacaggtgtgagccactgtggctggc

SEQ ID NO: 190246 - DNA, 601 bp, Human
ttcagtcatgtgtgaaaaggcaggtggctctgaatggccaaggcctttgggaagagagtctatgttgttagctgagagaagatttggtgtggattatggattctgggtctgccgcaaatatctataatatatgtgtttccatccgtgtggggagggagattctttacatcttttatcttgattgttcctcatgtcaaccccaatttagaaaagatggtaccagctcaaggctttctagctggtagggacagcaaaagaatcagaaatttattttatttatatatttatttatttgacagartcttactctgtcacccaggctggagtgcagtggcaggatctcagctcattgcaacctctgcttccctgattcaagtgattttgctgactcagtctcccaattagctgggattacagacatgcaccaccacacctggctaatttttgtatttttaggagaggcagggtttcgccatgttggccaagctggtctcgaactcttgccttcctgtgatctgcccacctcagcctcccaaagtgctgggattacaggtgtgagccactgtggctggcaaagaatcagatttttagatctgaatcc

SEQ ID NO: 190247 - DNA, 601 bp, Human
ataaacttgcctatctgtggctgctctgtctgtggaaaaaaaaaaaaaacccctgagatattcctaacaacgtagaaatcctggggcttctcttgccttatgactattccaacatttttatattctcatatatgtccatgtggaaggccacaaaaatggagttggataacaagaatggaaaaatggtaaacttacccaggatgttaatagctagtgttctggtttagaaagtagggagtaggatccttttagattcttagtctttctgaactgctacaacaacgggtgtgagagtctttttcccattacttggtagcatattttcttttctcttttccacgtataggttaatagctaaataattcctaaagtctgcaaataaactactttcctcttaaatataatattcattaagtaaggattgtagccaagcattctctcaccatacaagaaatatgaacttatagacatgaaaaaacatgtcatattcttagggatagaaatctcgaaattgagaaatttaacccagttttactgattttttgatacaacctaaacatttataactagccattaaatggaatcaccatgttttgctctg

SEQ ID NO: 190248 - DNA, 601 bp, Human
ggtggaggttgcagtgagctaagattgtgccattgtactccagcctgggcaacaagagcaaaactccatcccaaaaaaaaaaaaaaaaaaaaaaaaaaagttactttatatcccatctttgtattattcatagactgtgtaagcatgcctgtcatgtcttcatgaggtagataataatattaacacttaaaagttctcccagattgattgatgctaactacataactcttactttcgcaatttttttttttttattccttgtaaactttgaacccttttaacctgtattggatttttcccwggggagttggtggtaattatttaaaactattcctttttgtaaatacttgttgaatcatcccagatatatgtgaagaggcttcagctctaagtatcaaaagaccaatatctatgtagcttatttgtgtctggaaaggcttaggcaacagcccttagcgtagtgccctacatcttatataatccaagattcatatatatttcaagcacatacagtaggtctagccataacaattttgcacctatgatctttgtgacacagaccatgatatccttgagaagacgataacacagcagaaaaggc

SEQ ID NO: 190249 - DNA, 601 bp, Human
cacctatgatctttgtgacacagaccatgatatccttgagaagacgataacacagcagaaaaggcaaatgtgtgtaaaattatctatgaaaagtagttagatatatgtgtttatgtgtttttataaagcacagaaaaaggaatgatttagtgtgcctgagattggcaacacattgcagagaaggtaatttttttatttaggccttaaaatatgagtcaaattgatcaaaacagggaaaggaaaaataatcaggtttgggtaactgttataaaaataattgattataaaaacataatgtgaygctcataagtattaaaagactaaaaaaattgactaaagtttatattaaaaagacataaactttaaaaattataattcataacaaaagcttaataaccccaataaactaaatattcaaaatttaataagagagataaatttccccaattggaaaaagatataggtaattcacaaatgattaatgtacaaatgtttaacagattcaaagtgttcaaattctccactaataaaaaattagggaattgaaataatgagattaattatatctttctgatcagcaaaaaatttaatgataataacc

SEQ ID NO: 190250 - DNA, 601 bp, Human
atttcagtgtgccaccattggcagctgagcattccttctggtcacgcccacccaaccactgctgctaccaccataactgccaccaacttacacacatcacctgcaggcctggggtctggcccacccaggctgtcacagctactgtcaataccagtgtggaacatttgggtcccagagggttgtcttgccactgctaatgccatcacccatgacatgccagctgcccaggggctcaagaacctgcctacccacctacctttccactgccattccaaccacctgagcaagccacctgggactyccaaaattggcttgcctggactcactaacaatggtaccagtgtacactgccctagggtccaaggacaggcacactcagcccactactgctactgcaggagtccaaaggctggcctaccgggtgtctaaaacccagcaaaattcactacagcctccactaacaaccacaccctaagccacaagggaaatcatagacaccgctgatgctgtttacaactgaagatattatacagaggctacaggacagtatatactgagaataaaagccaaaattgcctacccatctaatttcatagataat

SEQ ID NO: 190251 - DNA, 601 bp, Human
aaaatgaaaacagaagaattaaaaaaaatcaaagcatacataacatataagatacctcaaagggacaaaacattagaatttttggtgtttccaaatcaaataaaaggattagaaaatctatttaacaaaataattcataaaaatatcccaagtctagcaagatatttatatatccagatatgagtttcggaactctccaaatagacacagttcagaaaggttttctctacagcacattacagtcaaactttcaaaaggcaaagaattctaaaagcagcaaaaataaataaataaataaaarttttgtcacttataaagagacccccatcagacaaagagtgggttactcagcagaaacccacaggccaggagtaaatagaatgatatattctaagtgctgaaagaaaaaaaaaatgtcagtcaaggatattatactcagcaaagttatccttcattaatgaagaagatataatatttccctataagccaaaggtgagagaatttattgctactagatgggcctacaagaaatgcttaagagaatcctataccccagaagcaaaggaaggatatttaccgtcaagaaaacacataaaaatat

SEQ ID NO: 190252 - DNA, 601 bp, Human
gcaaataacatgtttctgaccattgggtcaagaaagaggaaattaaaaaatttcttgaaacaaatgaaaattgaaacacaatgtatcaaaaatctatgggatacaacaaaagcagtgttaacagggaagtttatagtaataaatgcctacaccaataaggtaaaaagatttcacataaacaatccaacaatgcaccttaaggaaatggaaacacaagaacaaaccagatagaaaattagcagaaggaaagaatagtaaaaatcagagcagaactaaacaaaatatagactaaaaaaattgsaaaggaccagtaaaaccaaaagttggctttttgaaaagatacaccaaattgataaaccacttactagactaacccagataaaaatagagaagactcaaacaaaatcagaaatgaaaaatatatcaccgacaaaagatcatcagagattattatgaacaactgtatactaacaagctggaaaactgacaagaaattgacacgttcctggacatattgcaacctactaaggttgaataaggaataaatagaagacctgaacagaccaatatagaaacatgcctctacataatgatggctata

SEQ ID NO: 190253 - DNA, 601 bp, Human
gaactaaacaaaatatagactaaaaaaattgcaaaggaccagtaaaaccaaaagttggctttttgaaaagatacaccaaattgataaaccacttactagactaacccagataaaaatagagaagactcaaacaaaatcagaaatgaaaaatatatcaccgacaaaagatcatcagagattattatgaacaactgtatactaacaagctggaaaactgacaagaaattgacacgttcctggacatattgcaacctactaaggttgaataaggaataaatagaagacctgaacagaccaatayagaaacatgcctctacataatgatggctatatatgactaatccacagctaacatcacactgaatggggagaagctaaaagcctttcctctaagaactggaacaagaaaaggccacttctagttctcctatttaacatcgtactgaaaagtcctagtcagagtaatcaagcaagagaaagaaataaaaggcatgcagactggaaaagaggaagtcaaattgtttgtctttgctgatgatgtatctaagaaaacctacgctcttcctgaaaactcttagatctgataaatgaattcaatata

SEQ ID NO: 190254 - DNA, 601 bp, Human
tcacactgaatggggagaagctaaaagcctttcctctaagaactggaacaagaaaaggccacttctagttctcctatttaacatcgtactgaaaagtcctagtcagagtaatcaagcaagagaaagaaataaaaggcatgcagactggaaaagaggaagtcaaattgtttgtctttgctgatgatgtatctaagaaaacctacgctcttcctgaaaactcttagatctgataaatgaattcaatatagttgcaggatacaaaaatcaaaatacaaaaatcagtagcatttctatacatcartaacaaactagctgagaaagaaatcaagaaggcaatttcatttacaatggccacaaaagtaaaacacctgggagtaaatttaaccaagaaggcaaaatatctctacaaggaaaactacaaaaaaaaaaaaaaaaaaaaaaaaaggcgggggacagaaaaaaaatgaaagacattctatgctcatggattggaagaatgaaaattgttaaaatgaccatgctgcccaaagcaatctatagattcaaagcaattcctatcaaagtgccaatattatttttcacagaaaaaaaaaatcctaaa

SEQ ID NO: 190255 - DNA, 601 bp, Human
ttttctgtctactagttctattaattgctgagaaaagagggttgaattcttcaactgtcattatgaatgtgtctttctctcctatcaaatatgtcaggttttactacatgtatactaaagctcccttgttgggtatgtcatatttaagattgttaagatgttgataaattgactcttctattaatatataatatttctttatttctgatatctgataattgcttttttccgaagtctactttagtctgtattaatattaatacagcaaatctagctttcttttgatttatgtttgcaaggyaaattttttctccttttacttttaacctacttttatcatttttaacctacttttatcattacatttgaaatgagtttcttctagacaatacagagttggctcattcttatgcattatgatagctcctgtcttttaattggtgtatttacatcatttacatataatgtaattatcaatatggtacttttaggactaccatttattagttttctattggttccctcctgtgctcctccctttctttttatactgacttcttttaaaattatttaacctatttttagtattcaattttaattt

SEQ ID NO: 190256 - DNA, 601 bp, Human
cacattatgaaagcaatacaaccaacataactttagaagtatcaaaaagacataaatcccaaaccagtgataataactatgaacatttttggggttttaaatttttttctagaaaagatttaataaaacatttgtgatcatgtcatactaaatgttataatatacttctttcattctatagcaaacattttatttactaatcttcaaaacttaaatttcctcattatgtattatattttattgtgtacatataccatggtttatttagctagtctactcacatgtttttaagaaaaaaatrtttaaatattttcttgtgctatatgcttagaagtgtaattattgggtaaaattatataaacatgagtctaaccaaacttcttttcatgaatcttgtttttttaatgtttgttatcagtttacattcccaccaactgtgcaaaagtgtggcctgaaatcaatttgattatagacttgaaatcaattggatgatacagtctcctctttgaaacatgcaagtacttttaggtgactgaaggcctgtctagatgtctgccaccaaattgcaatagtgactctcgatatacctttgattgtggtc

SEQ ID NO: 190257 - DNA, 601 bp, Human
aatcccaaaccagtgataataactatgaacatttttggggttttaaatttttttctagaaaagatttaataaaacatttgtgatcatgtcatactaaatgttataatatacttctttcattctatagcaaacattttatttactaatcttcaaaacttaaatttcctcattatgtattatattttattgtgtacatataccatggtttatttagctagtctactcacatgtttttaagaaaaaaatgtttaaatattttcttgtgctatatgcttagaagtgtaattattgggtaaaattrtataaacatgagtctaaccaaacttcttttcatgaatcttgtttttttaatgtttgttatcagtttacattcccaccaactgtgcaaaagtgtggcctgaaatcaatttgattatagacttgaaatcaattggatgatacagtctcctctttgaaacatgcaagtacttttaggtgactgaaggcctgtctagatgtctgccaccaaattgcaatagtgactctcgatatacctttgattgtggtctatggaagggatagtagttttggctggaggtgagtaagacatcttgaagaatgg

SEQ ID NO: 190258 - DNA, 601 bp, Human
tactcacatgtttttaagaaaaaaatgtttaaatattttcttgtgctatatgcttagaagtgtaattattgggtaaaattatataaacatgagtctaaccaaacttcttttcatgaatcttgtttttttaatgtttgttatcagtttacattcccaccaactgtgcaaaagtgtggcctgaaatcaatttgattatagacttgaaatcaattggatgatacagtctcctctttgaaacatgcaagtacttttaggtgactgaaggcctgtctagatgtctgccaccaaattgcaatagtgwctctcgatatacctttgattgtggtctatggaagggatagtagttttggctggaggtgagtaagacatcttgaagaatggagtatccaggagtggggtgagcagacctagctgggatggaaataatatgagtgaagaggtggtaaaagagggctagacaaagtctatttcgagactttcacctaaggttaatcttgaacatgggaatggacataatattttccccttttccttcttaacccttgcttttagtatcccaaatgcttttatccctttggcttctactattaaaataatcatt

SEQ ID NO: 190259 - DNA, 601 bp, Human
tagtatcccaaatgcttttatccctttggcttctactattaaaataatcatttaaacataatttgtgtcaaataggctctgggtatgagttctgtaaatattaattaaacaagtaagaaaatatatttcacatagcaaaaatcctctaatttttggaaagtggatttgtagctacctatgtggcttatagggtagctcaatattcactccgtttagactgaattccggtgtccccataagagcagactgtttctctgttctgttctttgtacagtatagccaatgggaaggcagcactttrttaaagagtgccaagtcggggactttaccttaaacacaagtatgcatttcaaaccctgaacaaacagccttcttaataaaataagggaaagagttttctttcttctattctctagaaattcacaaatatcacttgacaggtgacagttcttcccttacaaaaggggctgtttgccttttgctttggtgtttgggtaaactgcagtatgcactggcagagaatttattgcctaggggaaggtgtttgcagttgctgtgtttaatctgaaaagaaacccttttccttctgtctcctccctct

SEQ ID NO: 190260 - DNA, 601 bp, Human
taactgagataaggcatgttagcataacacactgcctgtggccagtcctcagtggaaatggttgttgctgttagtctttagactgtgttaaatttggaaacagtgaattattaatcctaaatagagcaattactgatgcaggacaagaaaaaaatctacacagatttgtatttttgtttttccaaaaaatatgatattatttgaagatacactagtgttattgtaggtagctagtcagacatgagcaggacaggagagggctccaccccctacccccaaccctcaccagcaatctcagacraccataaggtgatggtcaggcagttgttacactatttcactcaaataatattaataattgttcgtggttgcagccagcaccagggaaaggcagtctcccgatagatagaaaaaaaaccttaaactagtgatcagcagcttcccaaaaacctcggagttgggtgaatgggctcaagcatgtgtactaaggggcaaaatggcagagtttaactagtatatgaccttctaggaacattcagactagtaaagtgagaacacctcaagcaggggtcctcaatctttttggcaccaggaaccagtt

SEQ ID NO: 190261 - DNA, 601 bp, Human
agacaaggttgagttttcttcaaactaagatcaggattttgaaccagacagacttcttatgaaagccaacactcttttgtctgttcaggtttcagagaactcacaagaaaactttattttacttgctaattttgtttatttgggtgtcattcagtaatgataacataatgaaatattccctttgccagtctaatgattaagagcgtgggctttgcagttgagcacaccaatatacttgagtttaaatcttagcatgataatgaagtcagagctgaatgaactcctatatagtttaattccrtggttctcaccgtgtgttctcagggccagcagcatcagcatcatctaagaacttgttaagaaatgcaaattattggatatcactccagatctactgaatcagaaactggagggaaagtgagagtggtgatctttctataagccctccaggtgattcagatgtttgagaaccagtggtacaatcaagtgatttagtatatatttttatgggaggggacagaactcgggctttgggaagtgactaacctgtcaaggaagaggaaaactctgtaaaatatttgaagaggtttattgtgagcca

SEQ ID NO: 190262 - DNA, 601 bp, Human
aattttgtttatttgggtgtcattcagtaatgataacataatgaaatattccctttgccagtctaatgattaagagcgtgggctttgcagttgagcacaccaatatacttgagtttaaatcttagcatgataatgaagtcagagctgaatgaactcctatatagtttaattccgtggttctcaccgtgtgttctcagggccagcagcatcagcatcatctaagaacttgttaagaaatgcaaattattggatatcactccagatctactgaatcagaaactggagggaaagtgagagtggygatctttctataagccctccaggtgattcagatgtttgagaaccagtggtacaatcaagtgatttagtatatatttttatgggaggggacagaactcgggctttgggaagtgactaacctgtcaaggaagaggaaaactctgtaaaatatttgaagaggtttattgtgagccaaatatgagtgaccatggccctcaaatttcaagaggttttgagaacatgtgcccaaggttgttggttttcagcttgattttatacattttagggagatgtaagatatcagtcaatacatatgaggtat

SEQ ID NO: 190263 - DNA, 601 bp, Human
gggagaggttgccacataggtctctgacattccctggaaacattttccccattgtcttggtgattaacattaggctgcttgttacttatgcaaattgctgcagccaacttaaatttctcctcagaaaattggattttgttttctgttgcattgtcaggctgcaaattttccaaacttttgtgctgtttcccttttgaaactgaatgcatttaatagcacccaagtcacttcttaaatgctttactgattagaaatttcttccaccagataccctaaattatctcactcaagttcaaagttstgcaaatctgtagggcaggggcaaaatgccaccagtaactttgctaaatcataacaagagtcatctttgctccaattcccaacaagttcctcatctccacctgtgaccacctcagcctggaccttattgttcatatcactatcagcatttttgtcaaagccattcaacaagtctctaggaagttccaaacttccctgcattatcttgtcttctgagccctccaaactgttcaacctctgcccgttacccagttccaaagttgcttccacgtttttgggtatcttttcagcaacaccacac

SEQ ID NO: 190264 - DNA, 601 bp, Human
ttctagacccatctctaagataattatttctgactgtgactcattttaaaacatgtggaagggtctgctgggttttatcatttaaaaagttaaaaggtaaaatgtaatactttaaaatagtaattaaatatgattattcagtggttggctacatgtatctttataagtaagatgttaaatgcattctcatgaaaatctcttccttggcaaaagaactaaaatgtcaagcttgtgtacttattagttcaagaagcacttactgagtatctgctaagttcaacacactctgctaggagtgcarcgtttaaaagagctgagtctatcactgcctacaacttagagtgggtgaggagacagatatgaagtcaataaactagattattaatgatctaaattattgtacctgggaaaatatttgctgctgaaatattgagggatcgatagaaaagacaataaatgggcatccatcattgaacaacagaccagagttctgttattaacaaggactgcttgccaggtgtggtggctcattcccataatcccagcactttgggaggccgaggcaggaggatagcttgagcttgggagttcaagatcagcc
